United States Patent 10,407,724 (METHODS AND COMPOSITIONS FOR SCREENING AND TREATING DEVELOPMENTAL DISORDERS) - sequence listing, part 84

SEQ ID NO: 2415 - DNA, 915937 bp, Homo sapiens
gctcggctgcgggagtaggaagcagctttgcgcgcccgggcggccgatgcgggcactttgaagaatcacgtgtgttgaggccctcttaaagagataggcacctacttttccctccaccctaaacaccgccctgagggcggcggcgaccgtggtaattgcaactgctcaggggcagggcttgccccagcgccgagtagtggcaacggcgtggttgcgtcgggggtgcctgggagcctggagtcccgggggcctgaaatcggcagcttcccgggcagacactctctccctcaggaagaggtgccgccgagtcagcgcggggcagtgtgagcgccccgaggtgctttctcagttgaggagaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattggtgagtgctcccgcagcccccgccggccttagggacagggagagccccgggatcctcctgccattgaacacgggggcacccggggccccctcccaaggatgaccgcgacctcgctgtgcaactcggggagccgctaaaggagtggccacgccgaggcgcggagacggcgtgggggcggaagagcacccccttctctacttaacccctttctcactcttgtcagcccgggaggcggtgcgggaaggagaaaggcccagccccaacttggggacaccccgagtactgggtagggctgttgtttgtctaacttgtgggcgcaaacctttgcgcgattccattctcctcccacttcttgttagttgctgttttgcctcctaacgcgtagggtccggggcaggggaacctccctcctttttattccaagtccttgggagcccacctacagcttcgcaaatcaagaagaacactatttatgctcccagtctttctactttaccagaaatctcaggaagaggcgcctacgtgcctttttcctcctccttgcctctctccatgtgctctcccaagaaatgtttctttggaagggtgggggcgcgtgggagtttgaggctgggtgaggtaccaccaactgtcgagtgtgtgtaataggcatagtcatacagtacttccacttagttgattaagaacgctcaaaagcagtaggcacaaactgtgcaaatctcaccgtgctgatagtgtgaaccgatggtagcagtccatttcctgccactgaatgtgcagaggaatgaaatcgatgaggcctggtattgcattgggaaatactggagtttcctcagctcatcagaagggttccgctttttgtaaactttctaatttgggtggtgtgaggggaaagggttttcctgtacaaattcagcagatactccttagagctgtattcttagtccagatccgaagcacaagccacatgttgaatgtatagatttcagctttaactaccaacttgattataatagacaaggagagggtgacatataaataaagccgtttcttatggcatctggccatttggtttggatccagtacaaaactgtggtttaatcagtgattaaaaatttaagtaaaaagttaactgatagtttccacaaatggtttggtacgtctagcaagaatctgccacttttaagaagtatgctttcgagaaaaaaaaaaacacttatctctgttagtagtaacaccttgattatattcttctcttccctttagccatttgtcctgattcatcttttatgttttacttgctttgacaaggtaactagatagttatgagatcgtatcattttcagttcctagctaacttcactgttccggttcctagctaacttcactgttccgtgttgaacatagcttgatacggtagaacaagatttgaatccaagagtttgttaatattaacatgaattttctttttttgctcaaacataacttttgagccttacgtgattttacaagcagatgtgtcagagttaacaaaaacaaatttaggaagacattgtggcacattttaaggcaagcaagttgaccaaacagtaagatttagtaagcttttcaggaaagaattcatctgggattcttagaagtttgctagtaagatacaactttacttagatgaaatttttttattttgagtattatgttaataatctctgaactagtccttaatttgtgtgtgtatatgagtgtaaaggagttgtggtatgggattataaaagagagccatatggtgatagaaattatttgtgtaggtgatcttggggcataggggttcttaaactcctgaaattgtatgaaaatatttgagtgtatatgggtacatttatttttctgggccccatggctttcatcagtttttcaaaggcatccattacctatagaagagtaagaactatggcattacaaaagatagaaagtaaaggaaagaatagttgattccactctaagttactgagtagggaagaaggggaaatggcattgaccacacaggtgattgatattgaaacgaattcttctagtggtaaaaaagaagttaactactcaatgtctacatagattaaaatttccgctacagaggaaaattaattcagtcgctccagtataatggattcataaggtataaggcttgtgtagtttggttgttttcatttagttcctcagaattctggaaaaatggaaatggaacacatattttcttttctttttttttttttgggacgaagtctcgctctgttgccatggctggagtccagtggcgcgatcttggctcactgcaacctctgcctcccgggttcaagtgattctcctgcctcagcctcctgagtagctgggattacaggcacgtgccaccacacccagctaatttttgtatttttagtagagacgggatttcaccatgttggtcagcctggaaagcagattttctatagagaggaactgctttcatttatatcctcaactttttaatgagtattagtgagaaatttttcagagtggcatttcaacactataatgatttctatttaagattacttaaataaaaatttaatggaattcacttcagtttttttcatataagcatcctcataatgacccttttgttttgattcttttaaaataaggcattcctgtcttggactcatcacattttgaataatgcattagtagtagagttttggattttatgtaactattttggttaggcccagattgcaacatgtcatcaaacagcatgaatcttagattaatttgtaatttgatgtcaaccatggaatgcattttgttaaattgagtagaagagaaagctctataaatgttgtgaaggaactacatcttgaatcctacttatttaaggcagtgacttaaccattaagagaggccaatgttgatgcagaacaccgcaccccacaccacacggtagtgtagagtgacctaacagtatttgatgtttttgcatttttgactttgtgttcctgcataatttctgaagcctttggttcttcaaacagtaaagtcaaattagttaatttttctggttattatgtaacttcctatttggttatttgtttacaactggataaattatgtttttatttatttatttattttgagacggagtctcgctctgttgcccaggctggagtgcagtggtgtgatctcggcccactgcaacctctgcctcctgggtgcaagcgattctcctgcctcagcctccctagcagctgggattacaggtgtgcaccaccaggcccagctaatcttttttgtatttttgtagagacggggtttcaccatattggccaggctggtcttgaattcttgacctcaagtgatccacccacctccacctcccaaagtgctaggattacaggcttgagccactgcacccagtcttgatttttaatgataaggtatgagcaacaatgatttcatttatgcaatacaggtttactgagtacctactgtgtgctaggcataattctaagggttggtgatacaaagatacttgtagtctactgagacagacagggaagttaattaatgcttaaaatgcaatgtgagccagacgtggtagcttgtgcctataatcccagctacacaggctgctaaggcaggaggatttcttgagctcaggagtttgaagctgcagtgagctgtgactataccactgtattacagccttggcgacagagaacccatctctttaaggaaaaaaaaaaaagcagtgtgataagttgctataggaatatgcatggttgggggtggtcatggagaggcatctacgtagaattgcatgcttgagtaagaaaaggcttatcgcagtaggtgacatttgcagctgaaggctgaagaaaataggtgagggaaaggcattctaggttgaaaaaacaacatatacaaaggtaaacagataagggagcatatccaataaagaaagttcacttagatgaatatggctgaaacaaagggtacacatggtagacttgctagaaaagagacggggtccggatcatgatggatcttgtatgccatgttagagtttcaacttctttctgaaagtaggggtaacccattaaagagattaaggcggagaatgacctgatcagatttgggtttcagaaaaaaaagtactttggagaatttcttggaaaagcatgctagaatggaggcaggaagaccatttagaaggagcagagtagcataaaagagtttttgatatttggagacctggattccagttgcagcttatccattcattcatttaccagctcatccatttactaggtgtttttctctgcacctcagtttccttctgccacctcccttgcctctccttagtaccacacaccctgaacatccccaccaaatctgaaatggccacccctttctcttttataactttcaccccctttcacagcccagctcatgtctcaatattctctcactcttccattaaacaccgattacttcagtttagtgagggctttccttcttctggactcaataactgtcatgagtctgaatgttacatgctgatcttgtctctgcaaatattttaaactgcctctgggaatgggtcccattttatgtctattcttgaaaacctggcaggccggtgcttgggtgcaaaactattcagtaaataattattagctggggatttttttcccctatataccaggtattttgagagtgtaaattggtgaaaagaggctttttaaaaaaatgtttatttgtatgtgccttttttttttttaaagtatatgtactccatcaattgaacctatccatacattcctctttgtcttttctccaattttgaaactcagtaaacttcttcagggctgtgagaactcttctacccccagcttgtttgaattcttgtgatgtcagagcctaaacttccaagcatggaaacagtaccaacaacgatgagccaagtaacattttactcttattagcaggagacttcatattattggcaaaagaatatggaacggagagccaaaagacctgggttccagtgtcccatctgtcttttatttgcttgtgatttctgatgagccatttagcaccagaagtttgagctctttgattaatgtttgccagttggggataatgctgcctgcctgatttgcttcacaaggtgttttagataaaatacagtaaggaatgagaaagcattaggaaattctatattgttatacaaatatagagcatttttattaaccccttatattacttgaatcaaatatgattatggttggatggtttaatgtctttcttgcattttgacagcactaatgttattattgtataaagtaccataatatggttatatgttgaaagattccttattctctccccaataccatttgtccctttggaggaatatgcattctatccttttactaagatttcattctgttgaatgaatataagatgtgagtctaatttttttccatgataattttttggaggactagtctacccttttctttcattgtgtcaatttgaggcattaaaatttttttaaacaaaacttccatttgatatctgtgacattatgccttgtcaggcagcttactgcctttgtacaaataaagaaactgagtcactgaaatgttaagaggactgctttagagataagtttaaaagctacctcctctattgtagaaattatccgtagcactgagtcattgtgcttcagggactctgaaggtgaaaaagttattcaatttttcttcttttgttcctttttggaacaattctaattgtaatccacctagatattattaagctctggcagtagcaacatgttactgaagtgaaatcatgttcttttccaacctgctttcaaagaacactgtaaataacagcatacataatatatgctaatttatataaatcagcacatctggttaaatgttactgggtaccactagcactacaggggttattgttgaagacccaactccagtctaccatgcagaagaaaccggttccttctgctggatttggggtgtttgatacatttttttcccctcaagacaggagaaactatgatgatgtccaggtaacttaaaatatagttattagcttgatatccaagtgggcatgttgtggaagacacccattgtgggatacagctcaaaactgatgcatttaaagaaagattaagatatattttcacatagctatttattgtgaatgtcagtaatggagagaaattaactcatactgatttaaaacttattttcctcatcaggttgagtctgtttccaaataatatactctggctgtagcttaaacagacaactgaattctggtatttaactgactttgtgtgaggttacctggcagggaaaggtattggtccctttctcatgaaagaatgtagaaaacaaaattcttacttatcaccatttgcacagtctttggtttactgaagattttactgtattgctttaaggagagtaagctacattgctacaaatacataccagcatattggccaccagctgtatacagtgtggcctatgaatgagtgagaagcttctaggtagctattaaggcaggcctaggtaggaatccaacactttattaggaaggaattattccgaaatggctgttgactcaatcacctggcagttctggcactcacccaagggagaagagattttgggtacaatcctttttaaaaaatctatttgttgttctgtgatatcatagacatccaggctttaaaaagaaagatctgctcaaaattaagaggaattttaacctacccttaattcgttggtctgttattaagctaaaagtaaaagaaataaacttttaaacttcataatatgagccagttaatgagacttttttacaaaacttaaacaaattttcaaacgtgctaaaaagtagaatagtacaatgaaccaccaccatctatccattgcccagatataagttatctacattttgcaacatttgcttgatccatcctttatttttcccttgctaaagtattttagtgcaaatctcagatatcttgtcattttactcctacatactgtcacgtctttaaaaattaaaattaacatattccttggtatcatccagcattcattccataatcaaatattaccaattgcctaaaaaaattagatttttgatctaaggtgtacctaattgatatacatgtcactgaactccttaaacaaatacagctttaaattactggtaaaatcttattcagagttactccacataaagtgctatcataaagcctcagcccaaattaagttcacttctgtctttaattctgtagaagtatctggaaaggttgactatacaagggtggatagactccttggaacagctgttatgtaccatcaaaaatagaacaaattagttttggctttactcactggttgggcaatcactaattcttcattttgcaatttgtgaagtggggtggggcttatgtgtaagaattttcctttcagggaaatgctgtagatagttaggcaaaggaaaattattcttcatttctctagataaagcgttcatatgactctttgacattcacaccccaccacaacaactaagtttatgttactggctctagttttatttcaaaacaaatgccggtttggtctatctttgtttttcagcccctttgatatagtctaggttgctgaatctggataattgggtgagtaaacctttacatagaagttattcttattgagatgtttgtgggcttacaattgaaaatcagactacactaatgaggtgatggagctggggatgggtggagtaggtaaatatgagaaatcaacttgggcaaatggcctagactccacacagatttgctaaagaaattgtgtaactattactttccagacagcagtttagtgctgttattgtgctgagaggcaataggcaaataatttcactagctgtagactcaagtagatttaggctagtaatctgtctccactctgcaacttctagactgaccatttactaacccagtcagttgggtagttttcctcaaaacagatagatgagtgataattgttggagccagagagctggcattttcttcttttgtttggcccgggagggaaaactatggaggtggtgttttatgtgctctgaaatcaatcactgataaagtcttaaatgcttagtagtctattgtgctggctgaaactgtttacaaagattctatatgtagataggaagaccttgtataggctgtacacttgcattgtgagctttaataatgtatacgtataacagagaccaggtcggtatgtatgggtgggccctgaccaagggtgtgagaccacagaggtcacaccacttaccaaatcatgtgccagttacaagactatgtcttcctggggctgcgttttctgattcacacagaggcaccatatgggctagctaatacatttaaagccagatggattttagtctcatacctgataagaaattcagcaaggattccgggcatggtggctcacgcctgtagtcccaggactttgggaggctgaggcgggtggatcacctgaggtcagaagtttgagaccagcctggccaacatggtgaaaccccatctctactaaaaatacaaaaattagctgtgcatgatgggagacgcctgtaatcccagctactcgggaggctgaggcagaagaattgcttgaacccagaaggcagaggttgcagtgagccaagattgcaccattgtactctagcatgggcaacaagagtgaaacttcattttgagtagggatttcttatttgtcattggttctgagaaaagaatgtaagatgtatatttatgtaatatcctacacctgattacttttgcttttgaattattgaaatcttcaaatgtagatggctgtgcccttgagggcctaggttatagttcagtatgttcattatcttccccaacttaagggttgagttctgttatagctaattgtagatcaattagcttaaggctcctccctttctgcactcctttcagcaattttcttgacataattgtttcacagagttttatatggttacgcattatctaggctgcattttttttttttttagatggagtctcactctgtcacccaggctggagtgcagtggcctgatctctgcttactgcaacctccgcctcccgggttcaagcgattcttctgcctcagcctcccgagtacctgggattacaagcatgcaccaccacgcccagctaatttttgtatttttagtagagatggggtttcccaatgtttcccaggctagtctcaaactcctgacctcaagtgatccgccctcctgggcctcccaaagtgctgggattacaggcatgagctaccgcgcctggctgcattgttttttgaagtttgtaccatgcttatttccactttcattgctcacgatacagggcagaacatatagaaagttaagatgggttaaaacaaatttggcagaagcatttcctctgataatatgctctgcaatctagtacctcacattacaaaatcaacgtttttcagaagagtcagtgtgtacataaaatatttgtgagtgaaaataaacttcttagggtgccctcagcttgtttttcattgacattgcattagtttacattatctacctccccacccccactttggttgactagctaatggtcttttttttttttttttttgagacagagtctcgctctgtcgcccgggctgaagcacagtggcatgatttcggctcactgcaacctccacttcttgggttcaaaagattctcctgcctcagcctcctgagtagctggtatcacaggtgtacatcaccccacccggctaattttttgtgtgtttttagtagagacagggttttgccattttggccaggctggtcctgaactcctggcctcaagtgatatgcctgcctcggcctcccaaagtgctggagttacaggtatgagccacaacgcctggcgctaatggtctttaaacaagctgttacagggaagaataagtttatgattcaaaaatggcctggattttatccatgctggcagtttagattttcacgtgtttgttttacgaaagtagggcttccctgtattctcttatctcaaattcttaggcttcttcattacagcctatacttgcttcatcaaactgcattcagatggtcttgtaagttcccatgagagcaaaatcctacattttaatataagctgagttggtctgggacaaaatactagattttaaatggccattatctctgtataaaatggagctgaggtattagttgcactttacagtaggaactgtgtagggctctgggcccaatttttcacattcttcctatgggttctgttatagctaattgtagatcaagatatgttacaaatccctactttcaacctcctctctcctccttaaataatgttactacttgcatgtttataactctgaagggcatcttatttcttgttgtttttactgatttctgtgactattatcaatggtgtatcctattgtctgaccacggagataacaggcagaaggatggccattggatgttaaatcgattactgaacatgacagagatttattttaaagcatttcctatcctcactcatcaccacgtagttatgaactagtcaaaacttcattttgatcttagcaccaccacttcatgtttttcaagatgcctacattgtattttatggaatctaaatgtatttaatatgctatacagagttgaaataagctaaataggatatttgatcctattaagtgttttttaggagtttgtttctggttatttaaaaaggttgggctgggtgcagtggctgatgcctataatcctagcactttgggaggccaaggcaggaggattgcttgagcccaggaggttgaggctgcagtgagctgtgatcgtaccactgcattccagcctgggtgacagagtgagaccctgactctaaaagaaaagaaaaattttaaaaaaagatcctgtagagataagccgactactttttaaaaatgtgactctggacaagtcttttatttttcttctctctgggtgtcagtgtattctgtaaaataagggaatcgaaatagatgatctacaaagttccatttagctctggcatactgggagtcaaagtttattgaaagctgtaatacatctaccctaacataaatacaagacctctggattccagttagacaaaaagttggaattaggctgaatgctaaagagtgaatatcccagttaactttattgtcctgtttctggagtctaggttagcctagtctagtgaaggccacatcaacgtttctttttaactatgaattgtacggaaggtaatggtctgagccctagggaatgctggcttcctctgcgtcatcctgattcttgggaggatgctttggttcagtgaccaagtacagtatgcaagccttcccagagatgattctcaatagtacacaatatcataggtaccagtttttgttctaagtgctttgcgtgtatttgttaagaactgtgcaaggtctgggattttcccttacttacctacctgttaactgtttaatggatgattgcagaagacccaaaggacaaaagacagtttattattcattgcaaaagcagtagccagaatgtcagcatgacatgctggttcactatgaccataagtcccatcgtgggtagaccagcatgatggccacaaacggagtcagtgacattgcaggagaggaactctgagcttgggggtttgctacttttatagcattaagaagtcagcttgatctttggggtggggagatatcacctcatcctcaaggttgtttgctacaaacacagccatgggaaatggccccagtaaaatgctgtcagtgccttttagtcttggcatagccagcaagaatgggcaggggatgctcagggattcatggcagattgcctccttcatcagttttaactaatttcatcctcacagcaatcattttgtaggtgaagaaaacgtctccaagcagatgagtaactggcccgaggacatgcaaaggtgaatttagaattgaagaccaatgtggggccagatgtggtggctcacacctgtaatcccagcactttgggcggccgaggcaggtggatcaccagaggtcaggagttcaagaccagcctggccaacatggtggaaccctgtctctactgaaaatacaaaaattagccaggcatggtggcatgtacctgtaatcccagctacctgggaggccgaggcaggagaattgcttgatcccgggaggcagaggttgcagtgagccgagatccgccactgcacttcagcctgggcaacagagcgagactctgtctcaaaaaaataaaatatttttaaaaataaaatagaattcaagaccaatgtgactgtaaaatgtatgttttacaccacgattttctatactgcctgagaacctcaaggtagctctaaattgaagacctagtggttctctagactggtgatggtgggacctagcctagatttgcactctgcttatgtataatttagaagacagagttcaggggccattcgttttagtgccattgtcaaaaaaaaaaaaattctttgaatcactgccatgaagtaatgggtcagaaatgtgaccactaagaaaaagccaagaggacaaaagtgatatggctgtggattttaaggctacttgaacacagttcttaaaaataccagcctgtgatagcccaccactggggaaaaaaaaaatacctgtctagcagtctggcctttattaactaattgcatggccagcagaaggcctgtgtactttactactgttgcatattgcatatgattttcttgttgtttgtacgtcagccttgcagagactagcttctgaagaggttacattgcaagttatactgcctacttcatgttttagcttctctctctcctctattgcccacttcctttctgtttgtgatcttttgcatgaagtaaaagtgctttggaaaaattaatgctatctcctgttaaacaagtacacgatatgcattgtttcttgtttaggggagtgccaagaaccacctaccctctcctgctgcttcctgcgtgtgctttgcctaaagattggctgctataaaagtgtggtatattcagccaagtgctatctttttaattagtttgcagaaagtgttgtgacaaactatttttgtgttgacttgtgacgagtaatagacccctaaactacgggcgttaagtgccagacaatatggaagtgcataatgtagtttgagttctagtccccttagtttgatccatcatccttccccaaagaaaaagcccctaatttttaaaaatgtgacaggtaaaatagattacgaatataccagtatgtgtctggagcctgaaattggcctatttcttataattactaatcttaaacttttttttttttttttttaagagatgaggtcttgctctgttgcccagactggaatgcagtggcatgatcatagctcactgcaaactcaaactcctgggttcaggttatcctcctcccttagcatcccaagtagctggtactacaggcatgtgccaccatgccccactaaattttttttttttttcagtagagacagcattttgctgtgttgcccaggctggtctggaactcctggcctcaagtgatcctcctgcctcaactcagcctctcacttggattataggaatgagccaccacacctggcttgattaccaatgttaatgagctaatatttccatattggttctgttcatacaactgtgtacaacacagcatgaaactagaaagtgaaggatatcttaagctctcataatgatagagacataactgggaaagctgataattaagcagactaagaatcttagtaaatttttgtttttcaaatacttcttatcaatttttacaaattcatattttctctaaatatagtcctggttgttgatgttcttttgtttttcactccatctaacccaaagggcttcgtgttacggataaatatgtaaggaaggatatagcattcccatgtcccaaaaactgtgttgttctttttatttagaccagtgattttcagtgggggctaattttacctcccagggaacatttggtaatgtctggagacatttttggttctcacaactgggggagggtgctacactggcatctagtgaatagaggcctgggttgctgttctctatcctacaatcataggacattctctccagcacaaagaattattcagtctaaaatgtcaaggttaagaaactctgctttagaccctataacattttgtatatttagtgtgaaaaactttttgtatatttagtgtgaaaaatttctgtggctcctcagctgttctttactttccattctctcctttcctctctattcagacagggtcagctaatccctgtcttcatggaagcatggtttgtttcattgattcccgccaattttatttgcattttcttcttttctgctactggaaatctggtggactgcactgttgtgaactttttagttgtcaactataccttttatcacttacctcatttctgacatctaaggaaaatattcattttcatcgtagtgagtttaaaaggctctttttccatctgtggattctttgatacttcaacaacttttgatgctggtgacttttaactcatcatctatatgaattttatttatttatatatcattttgagacagggtctccctctactgcccaggctagagtgcagtggcgcaatcatggctcactgcagcctcgacctccctggctcaagccatcctcccacctcagcctcctgagtagctgggactacaggcacatgccatcatgctcagctaatttttgtatttttcatagagatgtggtttcgccatgttgcccaggctggtcttgaacccctgggttcaagcgatccacccgtctcagcctcccaaagtgattacaggcctgagccatgcatctggcctgaattttagattctatggtacagtcttctctgacaacttctgcctcttgatttgctgactgctaaagtgccagctttgtttgccttccatctcaaaacttctcactgttatctgttcttctccacatacaattgcaggcaatcatatgcctcttcaaataccacctggatgcagatgcagatgcagatgatgccaaacttttctatctactttgacatctaagtttgatactttgtcatcatttgctgagaggcatctcctgactgtgttgcagttctactaaaaactgcataacacctcaaatacttcatagtggtgtttttaatatttttcctttttacaggaaaaataaaaattaacttgatgctctcaacacacatacatacacatacacagacacacatggacacacacacactgtttatcaggtttaccttttcaagctaaggtttacttgcttcacttatcaccagactgtattattctgttgttagtcactgactgacctttatgatttctggtccagttgaatgaaggttaacttccctatttgaccagtgaaagtcagtgactccttctcattcaactcatcaggtcccactgtatttttacatttagggctactattaggcacctaattgtatcttcttccttttttaatttgctccccttttaaaagttgaagccgttaggtgtattgtctcatatgcctgaaataacctcttcttttttctgttctcagtgaatcctaagtactttctttctagttctttatataactcttaaaccctttattgcctacttgaaggtgacatgatcatttcattccccttcaatttcccatagagagccagttcatttctgcagcatgcatggccatattaacaattgtccttattataaatgtatgttatagtgttcattccagacacatcaaatctttgttatgtatggggcatcatgctgagggtataaacataagtatatacaggtcttactcttgaggagctcatggcctaatgagaaaaggacagatacatataaagtagtaaattctataataaataggtatgaggagaacgctcttgggaatgccgcatactgtgcttggtagggagaggaaagacttcacagaggtaacatttgatttgggtcttagggatgaagaacagctttgtaagattaaaaggcaagtttttttttttaagactagtcgagtgcagtagtgagaagtggggaaagagtagaacaaggagttagatctgtaactgactgtgaacaatcattcgagataacttactaccttcagaccagccaaggcaagccattcttaatagtgggattatcatgtatgcaagtttagagttatgtaaaggcacatatttgttttaagtgtcattgattttaaaatattaagatcttagagagaaggttgtgactgaacttgttttatgactgaacgtaggtgatcataggaaatatttttcaccaactcagaagtgggatagagagagggaactaacgtttagtgagcacctacagtatttcaggtgttgttctaggagctttacatcaccatcttaattttttattataaacacgtaggcatagttatttcccacatttaacaaatatgggaaacgagtctcagagaggttaattgattctgattccaaaatacatgatattttatgatagcattctgtcttcttcttacaagtaacaggctatatttaaaatctagaaatgagctgtaattttctattttttacataaatatgttttatttttctcctatcgcagatcctattaggagtctaataaatgtattttaacacatttcctttttgttggattacattagttgagaaataatagagcttgagaaattggctgggaattgtccacaaacatctaatttgtagctgtatctggttagttttattactgatgatttgggcaagctcctcagttggtaatattctacctctgaaattcttcatgttcaatagttaatctaatttaataaatgttttggagaagctcacctcagtgctgcggtaagcattatcagggttaaagtaaagaactcctacccactagaaacatagagttggagaatctgatgtatacaaacctgtggtgctgggtggaatgtgataagtgctactgtagaaggaaaaagtgctatgggagcacaaatcgtgttaattccaaatgaagtattagggatgacttcatggaaagataggcaatagaagagagtcttaaagtgcagagattttttttaaaacagttattgtgatagaatggagaaagggcattgtctgtagtgagaaaaatatgcatatctcagtcagcacaggctgctatagcaaattcccatagactaggtggcatatgaacaacagaaatttattacacacagttgtggagactggaagtccaagatcagggtaccagcttgatagagttctggtaagggccctcttccgagttgcaaactgctgacttcttgtggtatcctcacatggtggagaatggagagcgaaagcaaactctcttgtgagttttacagagtcactaatcccattcatgaaggttctaccttcatgacctcatctaatccttattacctcccagagacctcacctcctactaccatcacatggggtgggggttcagtttcacggtatacattttagggggaaacagacattcagtccatgacaacgcataactgcaagagagctaggaagttagggcatgtttgaggaaaaatatgagttagtctagtaaagcccagatgtatgtatgagagtggtggaggtcagtctggatggagagactgcagcttgattacataagcattcagtgctcaccataaacaatttggaattcattctataacccatgtagagtatttgagcaggagattgatgtgatcagagcttacaatcatatcttactttagacattttacagttggaaatatgaagtctaaaatcttatgtccaaactttctggtaattggcctgtttgtagtataaatataaagatatttattaattctgataccttttggcatgctttaatttgacagctttgaacttgcaaaattaaacatgtactgtaaatagtgtgtactttgataacttactgttttacagcaacttaattggcccttgctcccagcctactattctgtagatctgtgcctctaagtctaaagatcttgttgttgtttttttcctccacaaatagatcctactctaaaggtcaggtagcttagattacaaggctgctgctgtcaaactgaatgtgttgggtctaggctgaattacagtcttatagtccctggaatattccaagagaagctgcaagatttatgacatacaaaactaggtaaagttatcctcactagataaagttgtcctcaatcaagtgttatcatgaattttttttccgtttgcatatatcaatcccctatgacaaaatgagaagagatacattgcttacaactgtggcaaagtagtcttagggctatgatttgaactcaagtcccctacttaagataattcacttaaataagtggaatttttattaagagactccctccctccttttcttttcttttctgttttgagacagggtcttgctctgtcatcaggctggaatgcaatgttgtgatcatggcttactgctgcctcggactgttgggctcaagggatccccccaccttagcctcctgagcagctaggactacaggcatgtgtcaccatgcctggctttttttatgcagtgggttgtagctatagaaagaggacattatttcacaaggtataggctgggaaaatgttcaggttccttgtggggttacaaaattattttaaaaagatataggtctttaggacatgaatcatcttttggtagactactttctcatgagggatttgtgatcctggcaaaatcccttttgagcctttgaaacatgaagagcattaactacaaatgaagaagacaggaacttcctgagttataaatacctggccatatgaaaggcccttgggcaggggctcccctggtatgttgagtcaaaatattgcctggcctttttctcccccttgctactgatgttgccttgggaatttgagacccagtcacatcagagtactctttgtttatttctttctcagtgaccttcataaatgtgatagtgctgggaacaatcttctgaagcatctctcttacttgccctaccatatgatttttttgccaaaaaggttggggctgataggagcttttactctgctactggtctctcctccatttttgcttagtagtgtggagcacattttcccatgaacattattcctgtatttgatatgtattgtagtatagttcagtttcctaatatgtttagtgcttaaagatataggtcatgagatacaggtacttgttatcaaggaatttacaatattataaggaaaacagctgtatataacctcagtattcggtaagttccatatgaatgattcagatttaggaacaggaaagattaataatttggattaaaatagactaggaactgagtcactgggaacttctcttcctccctccacgtacttactccaagggaagaatgcattcagagttcaaaacagagggttttttttttttttttttttgaggtggagtcttgctctgttgcccaggctggagtgcagtggtgcgatcttggttcactacaacctccacctcccaggtacaagcaattctcctgcctcagcctcttgagtagctgggattacaggcacatgccactacgcccggctaatttttgtatttttagtcgagacagggtttcaccatgttggtcaggctggtcttgaactgacctcatgatccgcccgcctcggccttccaaagtgctgggattacaggcgtgagccactgtgcctggccaaaaccgagttttgaggctgcagtgagctatgatcgtgccactgcattccagcctgggctacatagtgagacctcaactctaaaaaataaaaattaaaagaaaaaagaagtttgtggcataggtatttcttgttttaagaaaatatatcagcaggaaatttgaattaaggaagcagacaattaatgggcaatgattgcttttacaagagttaatacagggttaccgcagccaactcctttcttcttttaaaatgttttatatgccaaaaataaatactacttttaaaataattttttaaataaacaaaatgtttatgatttttttagaagaccaccttatattttaatgctaattataaccatctccacactattgatctgaaatgtgcagtacattgaaaaacgtaaaagtattttcaatgcattagaaacatagtttccattttcccaagcttctcattccccttaatcctgtagattccctttctcacagattaaagtagcattagaatcacttgcctcaaggccactgggaaagcttgcaaaaaatatagatacaggagtcccaatggacctattgaaacagaatcctttgagtgcaggccctgggaatctgcattaataagctgcctgcatgattttgtactctaaagttggagaaccactaaacttgtgcacagtttgcaaaatggcagccctgcaagtcatacctggcccatagatttgtttggtttggctttcagtattagcaatgtggtttttaaaatttgatttgtttgctaactcttaagaattgggagtttgtacacataaatctaaattcctggcttctcttgaaacatcagagtaatttttacagtactaggctcatgttctcacatggctggcagcaatccactgtgtctgaataagatctgtcttatttgaataggccatgtgctcttgaattggccacagaccaccctcctgcatttcacctggggtccagtgttaattgacatttatttttctatagctggcctgcatcactcaattatatcccctgcttagaatccatatacatttgagtttttgactctggatctagaggttaagaactacacagaaactatgggaaagaagtgagactggaagctgggagaccagagagattataatagtggagataagaaatgaaccatggaactacggcagtggtactagggatggagaagaggaggaagattaggatttagaagctactaattgagttgggttggggatctggatgggagaaggaagaatgagtgtggtggagttgggagagatgaaagtaggtgggaagatgaatttgtttctggatacagtcacttgaggtgatcgtgggacatcattgcgaggtactgaagtatagcttgctatggagcagagactctacagtgttggagaggatgactcctggatggagcatatgacagactcctgggtgtatgtgtagactgagaaagcatattcagaagcctaccatcttttcctaatgcaagctgaaaaaaagtagagatctatatgtaccctataaacatgtatgaatattacatatcagtgaatgtagagatctacaaaattgtggctagcataaatagcatatcctcaactttaactaaagtagaaacacacacagaatctttgggtggaggtatatccaaatctctggaggataggagattcttatccaaattgtcaaagattattaaaggttgacacattgcaggtgggcacggtgactcaagcctgtaatcccagcactttgggaggctgaggcaggcagatcacttgaggtcaggggtttgagaccagcctggccaacatgatgaaaccctgtctctactttttgattgattgattgatggattgattgactgatggattgattgatttagagacagagtctcgctcagttgcccaggctggagtgcagtggcgtgatctcggctcactgcaacctctgcctccggggctcaagcgattctcatgcctcagtctcccaagtagctgggattacaggtgtccgccaccatgcccagctaacgtttttgtatttttagtagagacggggtttcaccatgttggccaggccggtcttgaactcctggtctcaggtgatctacctgcctcggcctcccaaagtgctgggattataggtgtgagccaccatgcctggccttagtaattttaatttttagtacaaaaattaacctgatatggtggcatatgcctgtaatcccagctactctggaggttgaggcaggagaatcacttgaacctgggaggtggaggttgcagtgagccaagatcacgccattgcactccagcctgggagacagagtgagactctgtctcaaaaaaataaataagtaaaagaatacatatgtactcgtctcaaaagaaaaaaaaatgcttggcacattgctgtagggtatcaccaagacacaatgatttaatgacaaccacttctttcttgcaagtggtaattttggtttctttctccctttatctcttctgcattttaaattttgctctgtgagtattctttagttctgcggatgctaggagcatgctgtattctaaaaagtgtttgcaaggcatttttctttttttatatctccaagaaaatgtttctttgggaacatgttatgaatggaggttaggttcccagggtagctcatctttttcaaatcccacttaatctacattgcagatgagctgttctattaatagcatgtgtctgagctctgggagcagacatgtgccatgtggtatagaaacattgaagaaagtctcttcctcttttctgaccataggctaaatttggaaactggtaaattttatctttgggatgctccaaatccctttctgtacctcttttccatataattgtacccctcccctcaggtgacacccatcctcctgtgactcttccccaccccccacccagatcattttttttttttttttgaggtggagtctgctctgttgccaggctggagtgcagtggcgtgatcttggctcactgcaacctccgcctcccgggttcaagcaattctctgcctcagcctcccaaatagctgggattacaggcgcctgccaccgcgcctggctaatttttgtatttttagtagagatagggtttcaccatcttggccaggctggtcttgaactcctgaccttgtgatccacctgcctcagtctcccaaagtgctgggattagaggcgtgagccaccgtgcccgtcccccaccccctgcgacatctttcccattcctcagtgtacctacctcttcccaaacttgatttctgtcacatctctgctgagtgttagaatgaactaagttatgcaattatttttgaatgtactttattgtgatttaaaaaatgattattaacatccattaattgcttggtgaaatatctgtcaagtagcacaataaagtgaataaagcctggcagtgcagtagaatgttctggggaggtaggtaatcatataagcagtcttgctttgaggttctcccctagggataattgtttctacttttcaagtcttgccttcattcacatataagcctatttttcagaagttctcttttttcatgactgcctctatgagagcagcagagaggcttccggggttgagggtaggcaaatagggcaagaagagtggctgtatgggatgggacttccgtaagtctaggactgcccatatggccttttgaatgaagggaatattccataatggcttattttaagcagtaattaacaaatgaaaaaaatttcatatttcttcccataaatggtaacatgtaatttgtaagcttagacaatttgatcactgaggtaaatgatgaatatcattaaaagcattggttcctaataatttgtaaagtacttcgtttctgtttgttaatttgcttaccaaatctgtctatcagtcacttgcatttgttcccaaacctatatatgccagtggtaattgctattgtaactatattatttaattaaacatgcaatttgatgaaatgtgtgaggcaaaagaaatctttctatgaaaattgagaagtcttttgcataaattgataaaggcgctaaaaggattgctactgaattaagcataggtgaggtaactgaaagcctaggaaaaaaataacaagtccaaaaggattcatatggctttgcaggtgtctccagtttctatcttctaaagaaaatgaaactacatatagtagagaatgcattaagggatggtttatgaaaggaagatgctctgatgtagctctacatcaaaatattgataaatgtgtattttgatgtcataaattaaaatgttgaaggtaatgtttgcttttaatgattcctccattaccaactttaaaaaaattaaccacacactggaccttatcatgtctgtataatactttacagtaaaagctcgttttccatgctatgaaatgacgttctagttaacatttcccttctttgccatttctaggtgtagtgaaggaccagcataccttcgaatcaaagtttgttgaatgatcatcgtagtcaaacagattttattctaattatttagaatttactaatcacaaattgttgctttgttataacattctttccatgacagataaaggcatttattgaatatggtaattttattttgtgaacatgataaagtagggaatgatttcagtatatagtgactgagtccttgccattaaagattttttcaagtacggtacttatccagggacatactttctggaacatttgtggttcctcttaggtaatcttgaggaattctatatatttgtaccttgacattatcttagtactcctgctgtttttagtaggatttttgtttgggaggttgctaagtattatttagaagtgaaatctgataaggggattctaaaacctttctcctaccacaatagttcttttcaaatgcagataaactgtcattcagtgagactacctaggctcagccttcagggtaggatgaataaagcaatatatttgctggattgactttttgtccaggctgtatcgaaaaaataatgtacttagccactgaccatttatgtctttttaatgattgtatgtatagtagtcaaatggttagaatttatatgcagaaggatataccatatcacattttcattgtaaattgctgctttactctcctgtctgccacattctttctggtgattctatatttgtgttgattgcttttcatggataataaagaaatttacatttttctctttttactttgtgtggattaatgctctagatttgaatgcctaatgctagtcaatctttggatcacatatgtaatactcctccataatagcacccccctccactcccaccatatgatgaggagggaaaattttttctaaatattttatttttatttcagtagttttgggggaacggggggtttttggttacatggataagttctttagtggtgatttctgagattttggtgcacttgtcacctgagcagtttacactgtacccaatgtgtagtcttttatccctcaccctccctcctgaaaattcattgcatcattctcatacctttgcatcctcatagcttagcacccacttatgagtgagaataaatgatgtttggttttacattgctgagttacttcacttagaataattgtctccaacactccactcaggttgctgcaaatgccattatttcattcctttttatggctgagtagtattccatgttgtatacataacacatttgctttatccacttgctggctgatgggcatttaggctggtttcatatttttgcagttgctaattgttctgctataaacatgcatgtgcaagtgtccttttcatataatgacttcttttcctttgggtagtgggattgctggattaaatggtagatctacttttagttctttaaggaatctccatactgttttccatagtggttgtactagtttacattcccaccagcagtatgtgaaagtgttcccttttcaccacatccatgccaacatctattattttttgatttttagattatggccattcttgcaggagtaaggtggtatcgcattgtgggtttaatttgcacttccttgataattagtgatgttgagcattttttcatgtttgttggccatttgcatatcttcttttgagaattgtctatttatgtcctttgcccactttttgatgggattatttgtttttttcttgctgatttgagttccttgtagatgctggatgtcctttgtcagatgcatgggaggaaaattaacaactggttagagtaatagttttagaatttgtgtatatagattgctggtacaaaatgattgaatgcctatgtgttatcctggctgtatagtgaatcaaatgggtaaactattagagatagtatatgaggtaaagacaacttttttttttactttttttcattttcagaaataacttgctttttcttttagctctgctgttgctgtgtttatctatattagtttttagatgtaacagtctattcaaatgtcataatatttgttagaattttctgttcttgcacagggtggactttctgtagacagtaggtctgtggtaaaaaataaatttaaaaacccctgaacttctaaatgggtgatatccttggcaaactaaagtaatcacatggctagatattgaatttttagaatattgaactgtactaaataagcagatttattacaaagaggttgtaaaggtagagttaggttctaatcttaactcctctgtggctttagctacatcactatgctggctcttcttcatgtttgtatctgtcatcttctctgtcatcatcatatattgttctccccagttgtgtttcatttgacttcatcacgcctgccaaccaggtccctaatgttatttttcagatgttttattctctgaaaaacgttgttgctccttcttttgtggattttttatataattttttcatccttttttttctagagctctaccagcttggcttttacttccccttttataatttttcttaaaaagatctttatttttatcaaagtaccatatgtacataattaaagttaggcatacagagggcttgccataaaaagtaacaactgatgccccaccctttcctattcctaatgttgctcaccctgtggcaaccctgttaactcttttgttttgtctggtagttttctccttatttctaaataatatgcttataatgttatgtattaccttatctattttagatattatctattgcctgcctgctatgatagaagaagattaatctcacatcaatcttcatcaccctgtccttatcatcaacaatacagttatgatttttagtttctctcgtctaaagtaaaccttctttgatcttttttacataatctatgaagaataatacctgtagtccatctagatttgtttgttgcaaattttatgcatagatcctctggtcactttctgatcattgatttgaaaaattaagttctatttatttttttccacactggcgaaagttctcagggaactcaaagatagttaaacattttaactatccctcttgatactctctgcttttgaatttaccaagcagaggagagagcaggagtctcaatttttagtggttccctattttcttatgctattcgatcccactcatgatttgtcttggaattggtctggctatctactatgaagagtggtatggtgtatgtgcacagatgtgcacatacacacttatgtgcacaaggcacgtactagtacatatttccaaactcatgcatgtaaaagagatgataaaggggacctggattaactcacagcctgaacttgagcttgttttcttgtgtacctttgttcctaatttttaaaaaatttcctttatcttgagaatgtcttcccgaggttttgcaatcagtgatctttgtagcagtgtcaacctaacctcctgcctcaaggattgtgtgtgtgtgttagtgtgttttattttttttaagatgaactctattttttacagcagttttaggtgcacagcaaaatcaagcagaaagcagagttctcatattccctctattcccacacacccacaggttacctgctattgacatcctacaccacagtgatacatttgttgcagtcaaggaacttatgttgacacatcattcacccagagtccatagttcaggttcactcttggtgtgccttgtgtgattttaggcaaatacataatggcatggatttaccattatagtagaacatacagagtaattccactgccataaaaatcctctattcaccacctgtttattcttccctccctttaactcctggcaaccactgatcttttcctgtctctatagttttgccttttccagaatgacatatagttggaatgatagagtatgtagccttttcagactggcttctttcacttagtaatatgcatctaaggttccaccatgtttttttcatggctggatagctcatttctttgtagcactgtatgatattccattgtctgaatgtaccactgtttatccgttcacctactgaaggacattttggttgtttctaaattacagcaattatgaataaagctgctataaacatccaagtgcaggtttttatgtggacataagttttaactcatttgggtaaatgagtgctattgctggatcctttggtaagagtatgtttagttttctaagacactgccaaactgtgttccaaagtagatatatcaaggatttttgcataggttgttcctacagcctccacttttttttctaattagactatactcttccttaggacttctcagctcagcaatctctcattacctcattgatttagtaactacctgccattatatgcattcatggcacatgtattgcttctttatagcacgtatcataagtttgtgtgtgtgttttttttttttttttttgagatggagttttgctcgttgcccaggctggagtgcagtggtgtgacctcggctcaccgcaacctacacctcccaggttcaagccattcttctgcctcagcctcccgagtagctgggattacaggcatgcgccaccacacccggctaattttgtatttttagtagagactgggtttctccatgttggtcaggttggtctcgaactcctgacctcgggtcatccatctgcctcagcctcccaaagtgctgggattacaggcatgagccatcgcgcctggcctgtgtgtaatatgttaatgtctagcttcctcattagtttgtaagctctatgaaagcatggatcatgtttcatttgttgctcagcattttacctctagcacttagcctggtgtctggcattttagcaagtatttattaaatatatgttaaatgagtgaatgaatgagtaaataaataaatcaataaattgtatcaatgttctttttttccatagtgattgataactatgttttgatttggcaagtttattttgcttggagaattttacctataagatagcagaaaagctgggcaaaatcacttgaaacttcatatcagaagagactagacacaaaagtttttcaaaccccattttttgtatatatgtgtctgtgtgtgtacatatgattgtgtatgtttaagtattaaaaatggtgtgttttcaagtgaattaatttgtgatagctattgacctggcaaggaaaacattaggtaactttttaaaaattgttattattaagcaagggacatttcttgacttctcttaaatgccatgaatgattaaatagtgaattagagagttctgtatcttttaaaaaattactacactaaaactttgcttgcattcttataggataaatgtatattgcacacaaaatcacatgtatgatttaaatcttagtgaagacttgcatgcagcttatttctgataatcatttgattactcctcagtccaaataaaaaaaaatctaggtagcaaggcatttattcacatcattcatttttgtgcaacaaaatagtcttgcagttgacagtgaacttcagaatgcaggttttcaactcagggcaataattattaacatgaatattcaccttatgaatattgactatatgaatatgcaagctattaatggagtcaaatgtctttgaaagtcacactctagggacacttgttgcaattcttcactctttatggctggattatatatgctttcccgtggcagtattgattacacagtgaagatttattctctttcaccattggagttacatagtcctagtgaagaggaagtggggcacatgcaagatgtaatgtgctgctttgcctcatctttatttctattttaagcttcaatgacctagactagagtattttacaagaaattttatgtgtgattaagagtgagtcttttcatgtttgtttaatgatgagaaacgattagggtttgagggagtgactgctacccagtatgtatttaaacatagccaaaagtagcagtcttatcatagaaatattttcatagacgtaatagcatgagaataagatgcatttgttgtcttctttgcttttggtttaatctttttttttttttttcttcttgtcttgcagtatccttccaaaacaaaaggcataacctaacacttttattgtgctttgagtacctctcctctggaccaggtcaaccatacaactctttcagtcatctggttaggatagaaaacttattttgccttagtgttaacacatctcagatgacaacggataaactgagcctttaatataataagtgcacaacattttgcagatatgtttaatcattgtcccttcaataggggtttggttttgattttgttctgatgctgctaccattttaaaaaatgcctttaggattgtttgggaactgtattcagaattaattttgtaagaaacatgagaaagctattcttatggtcacattagttttgagtctaggatatacttgagagcctgcaatagtaatcagagtttattgtttttgaaaaggagcaagtgatttgagtatgtacattctagtgtattaaagaatgaattcaatccttatattattttcataccttataatggagataagttagttactgatgtatagtctcttatgtattgtttatttcagcagctttattatttaaatataattgacatacagtaagctgcacatacttaatgtgtacagtttactaaactttgcgtatgtgaaaaccaccctcacaatcaagacagtgaacatattcatcaccctcaaaggggttatacctcttggttacctcccgtccctctcttccatccccaaactgagaattagtttgcatttttgtcagttttctggaagagttgccgtagaattgatgtttactagaacaccccagtaaagccatagtgttgggtcttctctcattgtttatcagttttatggatcttcaaagaagcaacttttggttttatttttctatattttgatatttcatgatttaaattttgacccattatttcttttagcttgcttactttgagtttcatttgcttttctttttctatttgcctaaggtgacagcgaaggtcattgatttgagtacttaagagcttattttataatataggcattcattgttagaaatttctccccaattactgctttttggtgtcccacaaatccttatattttgtgattttaattttacttagtttaaatattttctaatttctcttctgatttcttcttctaccgatcgtttacttagaagtgcattgtttattttccaattatttggggattttgtagaaatcttttggttttgatttctaaagactgctgtggtcagaaaatatactttgtatgacttgaatacttttacatttattgagactttgttttatggtaaatgttccatgtgcacttgacaaaaaatatgtagtcttctgttgttgggtcgagtcttgttcggggcctccatatccctgctgattttctgtctgcttgttctatcaattattgagagaagagcactgaagtctgactgttactgtggatttgtctgtttctccttgtagttttctgtttctgcttcgtgtattttgaagctctgttattacaggcataactgtttaggactgtatatcctcccgataattgacccctttgtcattatgaaatgaccctttttataccaggtgatttttttttttttttgctgtgaaatccactttgcctgatattaatacagccactctaaccttcttttgactagtgttagcatggtttatcttttatccttttatataacatgtctttcccccacccgctctggctgcttttaatatttgctctttatcacactggctttcagtaacttaagatgtgccttggtgtacttttcttcatatttcttgtgctggggttctttgggcttttgggaatcactggtttatatgttttttaatttttgtgggtatatagtatatatatatatatatatatatatatatatatatatatatattcacatgagatattttgatacaggcatacaatgtataataatcacattgggggaaatgggctaaccatcacctcaaacatcctttggtacaaacaatccaattatactcttttggtttttaaaaaatatacaataaacttgttgactgtagtcacttgattgtgctatcaaatactagatcttaattattcaatctaactttatttttgtaccaattaaccatccccacacctcactctccaacttcccagcctctggtaaacatcattctactgtctatctccatgagttcaattgttataatttttttagatcccacaaataagtgaaaacatgcaacgtttgcctttctgtgcctggcttttttttcacttaacatgtcctttagttccatctgtgctgttataaatgacaagatcttgttcttttttatggctggatagtactccattgtatatatgtaccacattttctttgttttttttttttttttttttttttttttttttttttttatggtgtctcattctgttgcctaagctggagtgcagtggcatgatctcagctaactgcaacctctgcctcccacgttcaagcgattctcctgcctcagcctcccaagtagctgggactataggcgcgtgccatcatacccagctaatttttgtatttttagtaaagatggggtttcaccatgttggccaggctggtcttgaactcctgacctcaggtaatccacccgcctcagcctcccaaaatgctgggattacaggcgtgagccactgtgcccagccaccacgttttctttatccattcatctgtttatggatacttaggttgcttccaaatcttggctgttatgaatagtgccacaataaacatgagagagcagatatctcttttaatatacttattttctttcttttgggtatatactcagctgtggcattgctggatcatatggtacttctatttttagtttcttgagaaactgctaaattattctccgtagcggttgtactgatttacattcccaccgacagtgtacgaggaatccctcttttccacatccttgccagcatttgttattgcctgtcttttggataaaagcaattttaactgggggtaacatgatacctctgtaattttgatttgcatttccgtgatcaatgatgttaagcaccttttcatatacctgtttgccatttgtatgtcttcttttgagaaaagtctattcagatcttttgtccattttaaaattggattattagatttttttctctatatagagttgtttgagctacttatatattctggttattaatcccttgtcagatgggtagtttgcaaatattttctcctatactgtgggttatctcttcactttgttgattgtttcctttgctgtgcagaagattttttaatttgatgtgatcttatgtgtccatttttggtttggttgcctgtgcttgtggaatattatgcaagtaatctttgcccggtccaatgtcctagaggaccttccccaatgttttcttgtaacagtttcataatttgaggtcttagatttaagtcttgaatccactttgatttcatttttgtatatggagagacacaggggtctagtttctttcttctgcatatggagatctagttttctcattacatttattgaagaaactgtcctttacccgatgtatgttcttggcacctttgttgaaaatgagttcactgtagatttatggacttatttctgtgttctctattccgttccattggtctctgtgtctgtttttatgccagtaccatgctgttttggttactatagctctatagtataattcgaagtcaggtaatctgatgctttcggttttgttctttttttctcagcatagctttggctattctgtatcttttgtggttctgtataacagttaccatttaaaaaaaatttctgtgaagaatgtcattggtattttgatagggatgcatcaaaaacaaaaacaaaagtaaaaaatgaaaacacaaaaaccagtttgtgacatggttaattaaagtgatcgggatttttacaattctctttcacttttctacccttctacctgagcatctggttaatcatggctgaacgttaaccaaccccttccaactttcttgcttagactccaggtataacctcttggattcgggtcaaaattgcttactcaataattatcttaacctcaatctgacagtctccttttattttgcttaatagttatttggcaattcctttactgaacttcattagtccttaaaaactgtgtacatatagcttctttcagtttccaaacatttttccttctaattattgtttctctggtcatgtgatgtatcttttccttgcctgttgtttattacaaaaatctctccagccttggtcaaaattctatccttctgggctcacataccacaggctccagctcaggcacatattgtatttttattaaaaatatagcatagatacagaattttggtactaacaagaacaatacagtttattacttacactcgaagagattgagagcatacttctcagtctctcttctaggttttgccttgtcacatgatgcttaaggtattttcacccttgattattggaaaaattcagcaaaaccttattagaatactttaaatatatataatacagtttggggattattttattagcataactttgtatgttctttaagctagaacattctcattggtcatgctggcagggaaaagagaagccagaagaaaattcaagtcactgttccgtaagaacaaatgttaacatttgggctggatggtcacatcaacatggattttgacagaaaatgtcctgtcaatttgatggattttacttgtgataaatatacttccagagagcttgcaacaaaccactcggttataaatgggtatttctgaagtaatcctttctgatttgttttcagttctagtccctccccaataaaactgtaccctagaatgatgtaattaaaacatatgagatgtagagactaggaaactttttagtaacatgttatacatgtgacctcattgtatactggttttccttgtcctgattccattcagtaggactcttaggcctgtggttctaccttcttactggaactggagggaagcttctgtttgaccaagctaggtcaaagaaaatgaatttttttgctgttggctgtctccagagtttatcttgaaatcatcaagtacctgagggattaagttaatatactcattttgcatgttgctggaactaaaattaggtagaagaaagcagaaactgggaagtttttatgtttgtttaaagatttattatgtattatgggtgtatctaatcttcttgtcatgtaatttaaataaataggataaatatttttaatgcaaatccaaactgaaaattcactttgcagagatcattaacatttatttcatgtcattgtccttctatagttttaaaatgcaaataccatgggaaaatcttctggtatatgctcatgagagtgcatttgttgcttactgactgttttatattttacagttggctagtcaagtgctgactaatgaacacaaagcctgtgtttgaaaataaatttaacagctttatacacaagctaagtttatgtaaagtgatctaggagacacatgacctttgtgctccatagcccttgctcaaattctgaaagtaaactatgtaaatgatctaacatgtcaggtcaaacagtttcagtggttttcagccaagggaactattgaatatgttgaggtgcttccctctactatgatgggtcatgcatcataccatagtactctgtttgctgtttaccttgtgaaggtgtatttgctgctggaaccatgatgctgcatacaggacagagaacattatatggttctgtttttacctcagtatgccttggtttcctaatcagaaaaacgggaataataataatagctacattacaggtttgttttaggaattaattaaatcagagaactaaaaacaatgcctggcacatagaaggtgctcagtgaatcataaatagtagtactaatagtagtgatgctctctctttaggtctagcttttcttttttctttttaatatacaaattataaattaacaatttccttttaggtattcatgtctacaatttggcatttaaagagactcttggccgggcacagtggctcatgcctgtaatcccagcactttgggaggccaaggagggcggatcacctggggtcaggagtttgagaccagtctggccaacatggtgaaagcctgtctctactaaaagtacaaaaaattagccgggcgtggtggtgggcgcctgtgatctcagctacttgggaggctgaggcaggagaattgcttgaacctgggaggtggaggttgcagtgagttgagattgcaccactgcactccaacctgggcagcagagcgagactccgtcttagaaaaaaaaaaagagagactctcattcattcattcgttccctccttctctcctctttctctcttcccttgtccctgtttccttcccttcctctactgtatttccttgacttgttgctgtctagctgcagcagtgtaggcaaaccaggcaggctctaatggctaaaaattggtttgtttgggctacatttaaaataattggatatgtagcaatttgaggtgggctttgagctaatgggtcttatgctgctgtgaagaagtaaacaacataaggccaatatacagaggccatctttaacccatttatgtaatatatacaaaactatataagacccacctcctgccttaggaaattcatacattctagtgagaaattatcgcactatgataaatgctaaaatcaaagtttgaactaagaccttgggagtaataaaaaattccacttttgtggtgtttccaggttttttcaagcatattgtagctcaggaagcactctacattgttggctactggcgactgacattgcatcataacttttaagttttaaaactgtgtcaccctttcaatatctgtgggttacgtgttcatattcagttatgtttgtagctttgagtctacatacagtctcatttctgcatttcatgtgaaagaaaatgccagtcttagcacattctcttatgctattaatggagaggggaagaagccattctagttccttcctaaaaaaagtgatcactgtttaaagctcaagtaggtgggtgcttgtgtatagttcatgaaatttgggatactcagagctcagtgaatacctgaaaatgaagagaccttttaacctggtgggtcaagtttgacttaagttcttgaacaaattcactgtaagtactctagaggcagtgtttatgagggaatttagatgccaggataatttttttaaatagaaggaataaattgccccttgtttcccaattaagacacctaagaagcttgatctgtaatcatgtcttctgtggttactctctgaagtcttatgttgaaataagtggctgtctctcttctgtccctttatgtaccatcactggtatagccagtcctgcctatagaaaggaaaaatcaagttttttacacctcgtgttagaatgggtattttctacagaaactgtttcaaaggagaatggagttggaatactacttactaccagtgtgactctgaaggtgtattatagatttttataggattttaataaggttttttaaagctgatttgcgaattcaaccatcattgagaactttgtttctgtaagaaaatgtagtcgcagaactaactccatatgtttcatcagggctacgaagggcccatgtatgtagaaaacttcagtagtattgattatggctactaaataggtaattttgttgaaaataagtttaacattattagcaaatagaatggtaattgaagagaagttaatttaggaattttgtaaaaaacttggctatgattatggtactgacacagtaatgtggggccagaacttatggtaaccccataagagtgattctataatttttttttttttttttttttttttgagactgagtctcattctgttgcccgggctggagtgcagtggtgcgatctcggctcactgcaaccactgcctcctgggtttaagtgattctcctgcctcggcctcccaagtagcttggattacaggcgcccaccaccacgcatggctaatttttttgtatttttagcagagacggggtttcactatgttggtcaggctggtcttgaactcctgacctcaagtgatccgcccgcctccgccttccaaagtgtcgggattacaggcgtgagccaccacgcttggctaattctataaatttttaagcgtatctttatttgtttttcagtgatctactgactgtaaatcattctgtcagcttcatagtaacatttaatttcaacctacccagtccctaattggccaaactgttataaaaccaaattacgcagcagtgaggaaaatagaaacttgaatgaatgctattaaaataagtttagaccatctcaaatttatcctcataattcagactttctctgttttcaaagaagacgtctcatacacactgagtgttattggcagatttgacatggctggagtcttatgtgcagaaatataatatgtatctgtcagtggttttcaggagcccctatgaaagggcttgattttgctggtttgaagcctttgttggcatcagcaaagtcaaagagttgtaggcaaggttaacagccacttcatatttaatgggtttatgcaaaccgtgatctatatattgattatataaaatacatcactgttgtcttaacatccagatgaaaaggaaaaaaatgttttctacatcaaaatctttagacttaaaaatctctgtgattcataatattaattaaaagagaaaataaaaatctgaataatttgctttgacctgtgtatgtataagggtcattataagggttagtgcttgggttgcttgtgagttttcaggcaaagggacatacagctcatcttttttatattgcaactgatcagtgattaatacttaagaggcttcaggggctaagtatagttgctgatttatttgcagctcttactccacttcaattatttaaatacagcgaagagtccgtcgtgagaaacacaacagagtaggagaaatttgagatctatcagcataaacagatacaagtgttgctttgccccaaatcataaaaagtaaaaaaattaaaactacctgttaattcattgtgatattatttgtaaaacacagtgacataaatgatattttcctacaatgtgttatttattattttgacaatttctgtcactatgttgagaaagaatctcttatccaaattaaaactaagtaaaaaactatttaaggaacattatgagacaaaaggttttttcagttatcactactcagcatagaatctgaagcccattgggggaaaaatgaagtttataaaattgagtaatttataatattaaatttttccaaaaacactttttaaattttctgaaaattattttttgttcaccatataatcacattctgtttaagcttctacgttttaaatatttgatataatatttagtgatttttaaagttcttcctgtgtgagtaaatgagctgtttttgttttccatgtagagaagtttgtctgctttcactctggaaatgatttcttatgggttaacgcctttggatacatgtgttccaagagctaaacaactgctatacaagtgaattttgagacatggcccattcctgaattggggattgtttgcaaattcaagaccatcagttaaaagtactaatagtgaagttaacttaaatcactgtatgacttttatgtattttttcctacaaaaaatataataataccttattcacaactcaggtataattttcagtttttggcaatttatactcttgaatttttaaagcagtgaatcattttgttttgtcagattaattttgcaactacatcagaaaactaaatgatgtggttatttgtaaaagctgcttgaagtagacagatagcaagtcattgtgaggtgaagtatctccagagtgataatcatagccatttagaggttatttttgcattataaagatagtaatcataacaacagatatttaaattactctatttaatacaaacagcaatcatatgtctgggtacattgcttcaataacaagcgttattttaaacaaaattatatatactaactgccttatctatttatattgctcccatcctaggctaagcttttatcatcttgcaactggatcacattctctctctgtcgctctcttcctctgtctctctcctcccccagccccaattctgtcaatcatcacaggtttgagtacttactatgtgctagaaatagtgcaaaaacctgaggacacagtgggaatcgagaaaaacctggtccttactacattgagtttacagtattgcacagaagactgatattgataggtaattaggatttgatacgtggaatgtgttgcagaaggaaccatgggagactataacaggatcaactgtatccttagctgagagcagaacagttgagtagaagatggctagatgattaagaaagaggtgaggtgggatggagcgggtgctgtaagcagagcaaagagcacctggaaaggccgagactgaaaaagagctggagctctaaccagtattgttatactgatgaagactgttgcacacagatttcagaatatagatagatgttctagagtgtgtgttctagtcagacctgaatgctaatctggactgtgtaatttattatctttgtgatttaggcaaatgacttaatgactgtaaaccttgatttcctgatgagtaaaacaagacagtaccttcttgtacataggattattgtgaggatttaaacaaggcaatgcctgtaaagctcttagcatagtgcctataaatgctcagtaaatggtagctattagttaggtagaatagaccaaacttgctgatctctgcaagccgcctttttagcctttgattccttctttagtttattctcaatattacaggtccataacccttttctgaaattctgaaatatgaatgctctgaaaacactcttatcatttggccacaagccccaaccttcttaaggccgtataggtactctttatttatcctgttttgtgaaatatccatgttttccttttaaacttgaatacatttgagttaatgtgttaccccagatcctgcttagtgtgttttgtaagatatgatacacctagcatattcctttctaaaacatgaaacatgctgagttccaagacgtgtttggcttgaaaggtttcaaataaaagattgtacacgtgtgccaacccaaagtcagctttctaaaataccattttctccatgtctgtcttcaaatcagaaaatcataagaacgcctagtggttttccagtttagttttgactattccttgtggttttcaagactgcctctaatccaccctacatattcaaaatttaatacccttgtacttgaaccatttgtttcataagtctgttctcttcaacttccctgaagtaaaatgttaatgctgctccttttgtctgacttccctctctttctctctttgtggctcttcagatccctacccaacaattaggccacaattctttgtagtttctcaatgaagctatatttatctatttcttctctgaattcttattgtgcttaaatgaatttatttaacagtatttgagcagatattatgtgccagctactgttctaagtgtcagagatctgaaagtgaataagacagttaaggtctctactgttagggaacttgttttctagaaagtagaagacaacctgtaatcccagcactttgggaggctgaggtggatggatcacgaggtcagaagttcgagaccagcctggccaagatgatgaaacctgatctctactaaaaatacaaaaattagccgggcatgatggcgggcacctgtatccaagctactcgggaggctgaggcagggaattgcttgaatccgggaggtggaggttgcagtgagccgagatcgtgccactgcactccagcctgggtgacagagggagactccgtctcaaaaaaaaaaaaagaaaaaaaaaagtagaacacaaataagtgaacaatatcatttcagataacagttaatgctgtcaagataagacaggaggatagtgccttgggagaagcgacatacctgagaaactcatagtttcgcatttagttatttttgtttttatatggttagttttttttttttggtttgacggagtcccactctctcgcccaggctggaatgtaatggcatgatctcggttcactgcaacctctgccttccaggttcaagcaattctcctgcctcagtctcccaagtagctgggattacaggtgcccaccactacacccagctaatttttgtatttttagtagagacgggggtttcaccatgttggtcaggctggtctcgaattcctgacctgaggtgacccacccgccttggcctcccaaagtgctggtagtacaggtgtgagccaccaagcccagcctatatggttagtttttactccctggttagactgtaaatgccttaagggaagaatccttaaacttctatgtgccataaagtgttgggtataaaatgggtgcttgattaaggtttggttgagaaatttgtccttttttgacagagaaggtaaaaatctatttattaaatataaagcactacttggctaaatcattgatctaagagtatctgttatgtacaaagtactgtgttggttttgaaatttttgtatttgtctaaatctagctttttcatttctattgctttttattcatagtctaagaaagaagaactttcatgtctacacaacttttttttcccatttgaaatgctttaatattgtgaaccccataaatttgagacaggtctcagtttagaaagtttattttgccaaggttgacaatgcgcttgtgacacagcctcaggaagtcctgatgacatgtgcccaaggtggtcagtgcacagcttgcttttatacatgttagggagacatgagacatcaatcaatatgtaagaagtacattagttccatccagaaatgtggagacaactcaaagtaaggcctccctactgggggcttccaggtcacaggtaggtgagagtcagatggttacattcttttgagtttctggtaagtcttttcaaaagaggcaatcagaatatgcatttgtctctgtgagcagagggatgactttgaatagaataagaggcggttcccagcttgaagaggcccaagatattttcctttcacagtataaagcaaacaaacattctttctatacctgtagaggatgctactactctaaaagctggattattcctgcaattgtttctgcttaattcaggcactaagtgacttcctccaattcattagtgtgaacattcttaaagacctaagtggcagacatatttcctgaaccatttacccttagtcctgaagctgatcaggtttgtcacacacagactgctatagtcacccctcctggcagttcaagattgagctttatggcaagacaattcatttaagattgagcataacttgttatgacagatttatcaaaattatccagtgaagtaacatagacttctgctttgtgaagaaaactgaaaccctatactgtgatgtcatatttgttctcttatagataaatattttgttctttataaattgaaagagcatcttgagaagagaatctcaaaaggatttttttcttgtcataaaaatggtggaatgaattttgatttgtaatagcaaagaactctggtgggttaaaatttgaggcttttgaattgactgtacttctgagatggtgtgcttatggtcacaaaaatacaaaagtattgctctactaaaatgatgaaatggacagttcaagatgttaacaatggcaaagtaaggtggagaactggaacttcatatctgtaacttcatcttctcaactactaggcttttgagctttgagggcagggccatatctctctaaatccccagtgcctcacacaccaccacttgatctagcatctattcttaagtgctaatggtgatagaggactacagtgcctaagatgaagtgtaggtggctgaaaatgactcttacttttagaaaggagatgaaagaatgattgggagtaattttaagtacacgcagtaaatagttcagtgattgcaaaaggaaaaatttgttttctaaaaggtcatcttagactcaagcctgtactttgagcttagttctaaaaataaaattagacattgctttcttggtgaaattaaacacaactgagaggtactcaactaacagaaaatctttataataaagcatttgaatgcctgaacagaatgttcagcttggttaccaggtgattggccttgagttgtttggattggccttactggtttttaaagttcaggagtgagtatagggtctgaaaagttggaaggcaggcctttgaatagtaactacttccctctgtgactgctgcttatctgaatagggattgggcagggatgtcgtccagagaaatcaaaccctgaatcattggttgatgttgattacctttctcaaggtccattctgacttggaaaatatatggagattataatagagtattaccatatcagaactctcagaagctttatattgtgattgttctttcattcttctgatcttcaactagagtgtaacctccttaaaggaagacagcatgcttaccttgtttaccactgtattcccagtgcccagtactgaacagtttcacttatgtcactcgtgtccatgtgaagagaccaccaaacaggctttgtgtgagcaacaaggctgtttatttcacctgggcgcaggcgggctgagtccgaaaagagagtcagtgaagggaggtaggggtggggccgttttataggatttgggtaggtaaaggaaaactacagtcaaagggggttctctggcgggcaggagtgggagtcacaaggtgctcagtgggggaactttttgagccaggatgagccaggagaaggaatttcacaaggtaatgtcatcagttaaggcaaggaccagccattttcacttcttttgtggtggaatgtcatcagttaaggcaggaacaggccattttcacttcttttgtgattcttcagttacttcgggccatcggggtgtataggtgcaggtcacaggggatgctatggcttagcttgggtccagaggcctgacaaacagatgcatagtagatgcttaaatatttgttcagctgaagtgaaggttgttttttgtgtcctattgtacctgccattcttggaacgcaagaaacttaaggaaggtaaagagttgacccttcatctctattgtaatggccaacttaattcattttctttaagagagaagaaaatagtcaaatagtgcgaatacgtttttgagttggtggtgagacttttgaattatatgcaacttagttgtccaatttctgtggtagtagagtaattgcacgatgtttataaaacattgtattaccatgtaacattagctataagagagttgaatctttacatcttgctctttttgttaatttctgcctgattgagaaaattaaaacttaattttcttacaataatgactcttgcattgcaatcacaacttcagcattagagtttataagtaagtcagtcatttctcttagtcttaaggggttgagactctggagtgatacttttatagttacacaatattcatataatactgtgctaagttatatttaatatagctgatcataaatgaagtttaataaactctgattgcttgactaatgcacagtcttattgcttttccagagttgattttaatgaaaatatatggtcactatatttattggtacaatatgccctcattgtaatgagcatgatcattagatttgcataataaaaacttacaaaaatgactttaatcagtgcttttaattcaggggtatgactctaataaagatttttgggggggtcatttttgtttctgactttttttaactccatagtagctctgtagtttgtacacaggaatgaaatccatgtttacttgcatgtggtgtgagacagatgcacccatccacataaatgaattttgagagcttgtcccagaagaccatcattataaatgaaaaaaatttttttggtgtttctgttgttattctcaagtccttttatacctttcttttttgactaatatagaaagataattgtgtagcagaaatgatttcgttttgtttgcagatcatttaattgtaacttatacaatgatttcaatgcatgtttaatgtacagtggctaaaaattaccccttctgaaattcagcccttcatatctgcttaaagattttccttttcgatagaccatatttgttcttttttctgaacagttataacgaagagctttaaatagtattatatttatgaaagcagatttttacatgagggaaatctgagaaaatattcgtattaaatgtatgtggttatacaggatatccactctagttgaatgaaatttacaaatcaagaaatcaggagtggggtgtttttctttatgtttctctatcacacgtaattaggataattttttacataagtataatttcctatgtgccttcgggtactctatcattcttgtagatgcctgtcaggaaaaaagaaaattctttaagaataaaacaaagcacagtccttctccagtattatttttgaccaggggtccacatttggtttatcaacaactaaactttcaattcaagggcagctctagaattagaaatgtatatagcagaatggacattccaaatcaaagggaacagtaggggcacaaagaggacatcatgggagtatgcattgggaagaggattttaatttttgttttctgtagaatagggatcataagagaagaagtagaagatagcccagggctgaatcatacagggctttgaattccatattaaggatattcatctttattctataggtcatcaggaggcattgaatatttatgaacaggagggagtatgatagtcattcatactctttattgagcctcaatgtgccaaacactgctttaggcgttagggttacatccctaaaccagatgggcaaaaatccctgtccttgtggagcttatattttttgttggaaaaacagaccaagataatgataattaagtaaattatagactatgttagaacgtgctaaatcttgttcaggagtgccaggaatatgtggagggaggcagatgtttccatttgaaataggatggccagggtaggcctcactgagcaaaaccttgaaagcaggaagagggagtaagccatatgggccatggagaaagagcattccaggcagagagaagagccagtgcatgtggcttattgcctcattggggagccgtgaagtggtcagtgtgactggagctgggggaatgaagggagagtagtaggagatgaggtcagagggatatggagagtgtatagatcagtagggccttgtaggtcattgtaataactttgacttgcactaggagggaaaatagcccttggaaagtgttgagccaaggagtgacatgacgtgacttcagttttcacagtatcactttgtcagctgtgttcaaaattaactgtaggagagcaaaggtggaagcaaggagatagattaggaagtcactacagaaatttagttaagagctgatggtggcttgaaccacatctttgcaaatggcagaatgattatcatgggactggatagctgcttggctattggaaatgaaggagaggaaggagaacaagatttggaaatcttaaacctagacaagtggaatgcaggtggagccactaacaaatgttaccctcttgtttgtaaaatgagaggctttgactagattatcttgaattccatctaacttgaatagtttctacctctatactctgtggtttactatagataaaaagtatgttaattccaaagaagagtactgaggggaagggaagacttcagtctcgtcccataggaccaagtgaaaatattgctagcaatgctttttttcttgtgtctgtctcccatgattaaactgtcaacatgtattcaattgagatacagatttgaaacattttaaacatatgtgtaccttaatttagataatttgactaaagcaaaaagtattttcccttcatttacattcttgctttggagatatagatgggtttccagcctggagtttataaccccaaaagatgggaagagaaggaaagcagtagttgcatgaagaactgtataatctgtctcaaaaacacatgtggacaagcgcacatagggatggtagcagaattagttcaggcacttttgatactttgtcattttctctctgatttggtattgcaggaaatcatgaaattggccattgtgtttaaaacagttttctataacccactagaaaaattaaggagaaaatacctggtagagagagttgcagggtgaattcatccttcttaaagtggtttcagttctgatataaataattcccacttttttcctaggcagtaaagattgattggggtttgtgtcagcaggatgtgatgaagacatggtatagagattagaagtttagatccctgagggaatcagtggattaaaagtagaaaagaaaagagttatacatagaatagtatatttgccccagctgatctggggaggatggtctttaacagcattggattggtggtatttgaagacaattttctgagatccaagcaattttcattcacttaaaactcataatggaatcctccccactgtgagaagaccctattttttttttagtgtgcatgaccaagttgatatacattattcagcttctgttgtaagaaataaatgtataggatctggcagaacatttaattcaatttctaacagacaattaaaaaaaatctggttctttcctaatcacacccctaattggcacttcaacatatttataataaaaactatatttcatgcttatcatacattattgtaaggtcttgaactatcccgtgaatcatggaacataactacattattaggtattgctttagtattgctgtacttaaattcttcaaataatgttgctcatatatgttcaattttatgttcaaataagttcaattttatttagaatattttaaaaatatttctaatttatttataaggatagtttttaaaaataagttcaattttatttagcatatttataaaagtgtcctttaaatatccatcaggaataacacagttcttaggccaagctgtttcattatatttcattcttgttaaatgtgacatttttcctattgtacgtggtgttgttttttaaatttaggtatcttagcttgaggattcatttccaaacttatatatagcatgccagggcttatgattttgttgtatcttttctcacatttcagcactgtggtagtgacgtctgatttagatctgatttgggacattgggagccgtatttaaaaacaaatatatacacctttgccaaaccttcatttttaatcattaaaaagatttttttctttaaagaatgtattgtttatatgtttgaactttctgattctttttgactgtttacagttaataaaaatgaaaattattaaattattttattgtttgatctatgagtttctcttatctgatgggttttttttgtttgtttctttttggttttaatagaacattcaaataaaaactttggcagatgatgtggtaaggtggtcttagcatgttattacattacttatgcatgttgccttttaattaaaatgggtggacataaaagcattgatatatgtaagatacaaaatgtctggatatttacaaagtatagtagaatggaataattgtcaattcagtgacttccttttcgaatattaacacaaacaattatatgagatcccaacagaattttcatatcatcctaatatttaccttaaccaaatgttttttaaaatcttgtgaatctagactctggaaaacacagatgcttccttttttgatggccaaataaattgtgaatgtattaaacattaatattggaggaaattaatttccattagaaaggaaattaagttcactgttagtcagatgtgtgctactaaatttaaaaaccagtattttaaagctgaatttgtcatagtatatctttttaaaagttatgggctcaaaatgtaaatatacccttttatagctaaactataaaaaatggtattttaagccttgtcagttttttttttcctatgtgaaattacctatttacaaataatttaaagtagtgatagtgctcaaaggagatgaaggtatgtggcttaactacattttctttttgagacagagtctcgccctgtcacccaggctggagtgcagtggcgcgatctcggctcactgcaacctcgcctcactgcaacctccacttccctggttcaagcaattcccctgcctcaccctcccaagtagctgggattacaggtgcccaccaccacgcctggccaaattttgtatttttagtagagatggggtttcaccgtcttagccagactggtctcaaacttttcctggtgatccacccacctcagtttcccaaagtgctgggattacaggcgtgagccaccgcacccagccaactacattttcttaccaaggtatagctgaaatcaaaagctaattttctagataaactgaaagacacagtggaatatcaaatatatatgttattaatgctactcagtaaaaaggctagtactggaaaagtaaatattaagtgatatgaagggaaaggagaagagatatgttgatttaatggtcagttgcatatttaaatgctttcatgtccaccatatttttagtgaaatttgactattggatatatcctcagcttattttggattacttaacttttttcttgagttgtttgaagatatactatataactaaaccaacttaatttccctcaaaaagttaaaagaaaatgtgaaaatatagttcaagatgattagaagaaatgaatcttaagttaatgtgaagactgggataggaaccaggggctgttggatttaggaaaatcaccttctctgtgaaatgaggggattggtttagattatttttcaagtttcttctcagctctaaaatactatgatttatataatgtctttgtcagcaactgtgtactcaaattgcttttgtaatcctaaataagctgcttaaaactgctcatatttctttcaaagtatactttttggttttaaaaaagtgttctttgaatttaaaataaaagttatgctcattaatgaggagttcacataattttacataagctatggtaataacttctgtgatgctctttgtattgttgaagtaattatataaggattctggttacatggcggtgaagatatattctcctgatatttaacatatctgcttgtttaatgtgagcttgatggtatgcatgtgcttcctaacagaaaccataataaaactgagttgcattcagttttatgcacattactaacttttgatgtcccatgttttgtggtttaaaatagaatatcctatttacatgcaactgaagtcattaactcactttatgtgaaatagcaagctaattattagagattttacatggaatcagtggttcgaagtcaatatccgtaaaatagcaagtttttcttaatgatatttgtaggaataagaaatttctgtttgttacatttccagtaaatggaaaagccgatgtttttatctttgttttgcttcctcattggcccaacattttagggaagaaaatgctgggggaaaataataatagtaacaacaataataaatagcagctaagtgcaataaacatattaacttatttaaatttcacagtaaccctatggtgtaagtaatatcattatccctatttcagagatgaggaaacagagagagaccaagtaaactttcacaaggttactcagctagtaaatggcagagcttggactgaaacccaagtaatctgtcttgagtccacgctcttaaccattctactgctacactgacacattattcatttatacttgtcacaatttttgcaactttgaaggagaaaaacattaccataattttctcttagaattggaaatcagtagctctttttcagtttctttctcttttttcatagttctaaagttgccaccaaagacacactctcccagaaacaaccaacaggactttgatccgagactttttttttcacttatttactgtgcaaaacagaaatgacaagggactaagttttacttttgaagaatacttttcacccccagagttctgaggctgaagagtacttcaaggtttcaaaatagtacaatctctaactggagcttgctgcttaaaatagtattttgtcagaagacaataatgatatgtattatactaagtgccgttttgatgtttcaattcttcatgttagtagttcttgatctttttctcagggctttttatttatttatttttgtttgcagcgtgaccgaattacaagttttagaaaatctactgtcaaaaaagaaaaacctcttattcaacatcctattgattctcaagtcgcgatgagtgagtttcctgcagctcagccattatatgatgaacgatctttgaatttgtcagaaaaggaagtattggatctctttgaaaaaatgatggtaagttatacccctaattttgatgtaattttaaaatgtgtgtgcccagaatagcactgagttttaaggaggtgtgtttgtatggacagtgtttatatcacataaagaagagaccagaaacttgatataacaaaactatttgcaaaagtatcctttttttttcttttttcttggcaaaaatgtccttacctgtctatctcttccactgtgagctcctaaaagtagaggcagttttatttatctttgttttctactatttagtagtctctaggacatcgagtcagtttttcagttaactgatttgtgtgtctgtttctacaaagcaaaagaggcctaggtcctctgctgaaaacatcacaaggtctcttgttgggtatatgaaatagacttgggagggtagagagtaacaatagaagggacagagaaattaattcatccaagtttgttctattagcaacattcacacaacctacattttctagcatgtttcctgtgttttatagcttgtggcctaaatcactgcctatattagataatgaataccatattttgagtattcagaagtttatggcaggagaggggagagatgaggaattaaaccgtattacattgttaatttgaccagagaagaactagagatcttgatttgtgattcattcattcaaaattatatcccacatgttactgtacattttttgtggttgtctatttacctgtagttgtccacaggagtttcaaaggtcgccttacaccaaaataaaaggttaaggatcagtgaaatctagaccctactgtgcccactgtggaacatcttgtcatcacctctcctgctaccctcatgtttatttctctcctgcacctagaagagttagtaggccttgaataaatatttgttggtagctgttgaatgaatccaaacaaaatttccctttaaaattttccttgactattccttccatctagccacaactggcattttgggtattcccctgaaacgagtcctgacacttttaccctttttcactcttcttcctgcttctgtggtgcaccctttttcctgctgctcctttcgtgctatcttctttaaaccatctttcaacaaccttttctcttttgaagtctgttattgctgaccttccttgatgatagcacctggctatgcttttgtcctttacccttgctactcattttggtgatttcaactattacgctaatagccttcaatacattttttgctcttagttccttgtttgctaaactctgacttttgcatttatatatttagctaattataggtatgactgtaccttggactgtgtcatcctttagaataattccacctctaagagctttaactctaaaattttccttagaagctaaacaatttacactacctttccaagacccttaattttatagagcatgtattgtgtagtggttaaaaacctggactttggggtcattcagaatgtttgtagtgtttctttcctttatcaaataagctctgttgtgtctttaattgctagtattttctgattacctagatacccctcagtttatcaccctggtgtccttaatcactgaaaacaatgatgacagcaacaaacacagaaacattccttgatactattaacactttttatctttttaaatctttcttctctttaaataaaaattatactcattgctttaagctgctgacaatttggttactaccttttgcagtattgaaatagttctccgagttcatcagtggcattgctgtattcagtttttctacactgagcattacagggctatcttcccttcattgattatctcattcacttctaatttcttgccaaatcccattggttttgcttttgtaataactgttacatttgtgtcctcagatgtcctccagctgttcttgccctactttagatgataaccctctctagttgtttctcatggctattaaaatagcctcccaactggtcttcctcccatcctccaggttttgcctattccaatccagtattgccctatgatttggacacagagttcttttctgaagccccaggtgggcctttatgttttcagagaatcagtttatatgtccctactccgttccctcaactatgcccctagatgcctttcacacctttgcttttctgctccaacctcagagctcttccccatctttattctctgctgatgaccttgctgcttaatttacgagtaaattgaagcattcagaagagaacttccacaggctccccccaccacatttaccttttagtatctgcattcatgtatctgtcttgctacctatcaccatagatgaaattttcatgtccgcattcttctgcttgtgtataaattttcattcctttcagctactcacagatattgcttcaataattttttcttctctctcctaccattctgagcagcatgtaaacatgcggtcccatttttcaaaagccttcttttgaccctttctctgttgctagctatcactccatttatttactctccttggaagcaaagcacctcacaatataattttattcatatgcactgcttccagttttaatcctctcactttctcttctaaactcactccaaccaggtttccatcccaccattctatcaaaactgctcttatcaatgtcaccagatatcttcatgctgccaaatcccatggtcaattctcagttctcatcttaatttttttttttttttttttgagacaggatctcactctttcacccaggctggagtgcagtggcataattatggcttactgcagcctcaatctcctgggctcaggtgatcctcccaccttaacctcccaagtaactgggaccacaggcatgcagtgcaccaccatacccagctaatcattttgtattttttggtagagaccaggtcttgctacattgtccaggctggtcttggactcctgagctcatgtgatctgcctgccttggcctcccaaagtgctgggattacaggcatgagccaccatgcccagtctctcatcttaattgacctatcagtagcattctgtgcagttgattattctctccaatttgaaacactttttatttttttgtctcctcaacattcatcttgttttcctcctacctctcaggccactccttttcagtcttctttgctcattcctctttatgtcctgaacctctaaatcaaatttacattcaacttagtcctcacatttgaactccagactcatatattaaacttcataaccaacatctttccttggatgcacaatagatctctcaaaataacacaaccaaaactgaactgctaatattcccctccagacctgctcctacaaaagtcttccctttctcagttgacggtatctccatccgtccacctaggccaaaaactttggatttgtccttcactacccttttctcacattctacagtcaaaccattagaaaatctcattagcttttccttcaaagtaaggcactttcaacagctgaccatttcttacccacctccactgataccacactagttgaagtctcagctggaccactataataatggtaggattattaggattaccacaacccctaattgatcttcctgctttcactcatgaccctctattcttagcacagaaagattattcatttaaaatatgaacatcatgtcacttggctcctcaaatctccaccatggttctcatgtcactcagtgaataaaagccgatgtacttgcagtagcttataagatcctatatgttttgacacccaccacaccttacctttttgatatcttcctctactattctctttccgctagctcacagcttcagttgcactcatgccttttattttattgtagctctaaggaacaatgattcctgttagtttttctttcttttttttttttttgagatggagtctcactctgtcatccaggctggagtgcagtggcgtgatcttggctcactgcaacctctgcctcccaggttcaaacgattctcgtgcctcagcttcccaagtagctgggattacaggtgcatgccaccatgcctgacttatttttgtatttttagtagagacggggtttcaccgtggccaagctggtctcgaactcctgacctctggtgatccgcctgccttggcctcccaaagcgttgggattacaggcatgagccactgtgcccagccgattcctgttagtttttaatttttaaatttatgtacaacatttacagtgtttttaaacttcgtacatttctattttgtggtttgaatatcataatgtttcatcagaaaattactatttcctctttatgattttttttaaaaaaggatttgcttgttggattcataaatgtgatttaaagaactgtacaactttgtgccacattttctcaaatgggaattttttcttccatgggaattttgaaataggatattaagaaaatatgtttttcaggtactatcatattgtgttataattttatttgatggatctcttttatgttatgtgacccacataatcattatagacttgtatatgcagatattaaaatcctgtttatatctagtagtggaattgctggatcatatggtagttctgtttttaatttttaaaggaaccttcatactatttatcatagtagctgtactaatttacatttttaccaacagtgtatacaagtccccttttctccacatcctggtcaacagttgttatcttttgtcttcagtaatagccattctaaaagatgtgaagtcatatctcattggtgtcttaatttgcattatgttaagtgaaataggctaggcatagaaagacaaatagcacatgatctcattcctatgtgaaatctaaaaatgttgatttcatagaagtcgagagtagaatggtggttaccaggggctagggtaattgggcagtggggagaggggtaggttgaggagatagtggtcaaaggatacaaaatttcagttagatagaggaataacttcaagagatctattatacaacatggtgactattgtatttttgaaaaatgctaagagtagatgtaaagtgttctcaccacaaaaatcacaaccatgtgaggtaatgcacatattaattagctagatttagtcatcccacagtgagtatatacttcaaaacattgtgctgtacatgctaaatgcatacaattttatctgtcaattaaaaaaacttatttataaatggacatatattatttttaaataacagtataatataataggatatcagagaaatatggtttgattaaaagtaacaaccaaaagttaaactgaaaactttaaagattatctctctactttgagagaagtctacttataccctgaatattgcgtattttctatattagtttgacggtaataaccttacagtgaacaaattattttatgaataactatagttttcatctactgtatacttatgcctaaggcatgaaactaaaacatttaagtgtattatttcaattgatccttatgacagtgccacaaagtaagtaagattgttataccccattttcagatgaggaaagtgaagcttagagagaggcaagaaaattggttcattaacttgactaagctagtaagtagctgagccgaaacttaaatttaggtacataaaaatctaaaacattgactttttgtaacatctgcctttaataatgcttcatttaaactaaatataaaattagtacattttccttgcacacatagtgaggagaagtagaaggcaaatcagaggtacattagagtggtaggtaaagccagcctgggatggattatttcctactgataatggaacattgtctgtaattgctttttatggagcatcaattgagaagaatgagtccaaaaatctagcaatggaaaactgttaaaaatgtcattatcacagttgattgggagaaagcacttaagtcattctgtttctaaaacacggaagtagacttccagatatgaaatttatctttttttatttcactccttgtgggtgtctttccttgtacaaataacgtaaaaggtgttcttgtcgtatttgatggctcttatgacaatcttccttcttctgggtcttttgatggtagctttattgtgctgtttctcttgattggcttttctgactttagagaactacaaaggtttagaccatttggtttcaatactatatatgtattttaggataacatactttgaggtgtaaaacttttttttttttttttgagatggagttttgctcttgttgcccaggctggagtgcaatggcgcgatcttggttcattgcaacctccacctcctgggttgaagcgattctcctgtctcagcctcccgagtaggtgggattacaggcacgcgccaccatgcctggctaattttggatttttattagagacgggttttctccatgttggtaaggctgatcttgaactcctgacctcaggtgatctgccagcctcagcctcccaaagtgctgggattacaggcatgagccaccgtgcccagccaaaacgttttaaataattgcagcacatagcatgagattatgcacagtaataatatatgagacacttgacaagaaataaattaccttacaatttactatttagaatttctgggtaatgatgtattggtgaaacttttggttaaaaacttaacaaaagataatattcaaatataatcctttcttactctgaaaattgaaactcttgttatacctgaggatcacatctatcaacagcagttctcattggataggcttgtagatgtagataattgagctaaatctaaaattactgcaggatatgttttttctaaaagaaggtagctgtttttacttaattactaatagatcatttcacaaatcacttgattcttcatagctaagaaaaattgtgaaatgagtccagttaactgaaagatctgagtagtctggttttactagtgtattagtagactactaatgtctcattgactctggcatctattctgtgcattggtgcatcacttttcatattgtgcttattcaatgatgcaattttaaagggactttctaagtaatggtatcaatggctattgctggcaagtttaaagttccaaatttgaaataaatatttatttatttttttgtttagagacaggaccttgctctgttgtccaggttgtatcatgggtcacagcagcctcaaactcctcggctcaagccctcctcccacttgagcctcccaagtatctgggactacaggcatgtgccaaataaacgtgatttttttgtttattttttgtggagatgaggttttgccatgttgcccaagctggtctccaactcctaggctcaagacatcctcctgccttggcctccaaagtgctgggattataggtatgagccacggcacctggctttgaaatttcttgatgattgtttattttatagaatataagctctttattaagagagtgtctttcatagtttgtaaaagtgaattttgtatttagagtatggttaccaactactaactgaaaattgagaagtggttcttttactaaagttttcaagaattaaaaccactgcttttataagattgataaaattacctgcatggggtaaatcacacttgctctttaagattcttgtctccctcccatacccagagtcatgttttcaaatcttccacaagtgggtaaaggtagtaggatgaaaacaatactccttccatgttattattattggtaactttttttttcttttgttttttttgtttgtttgttttttcgagatggagtcttgctgtgtccattaggctgtagtgcagtggtgtgatcatggctcactgtggccttgaccttctgggatcacacaatcctcccacctcagcatcctgagtagctgagactgtatgcacgtgccaccatgcctgcctaattgttttgtagagtgtgggtcttgctattttgcccaggctgatcttgaactcctgggctcaagcattcctactgacttggcctcccaaagtgctgggggttacactgtacccagcctatatttagtgacttttaaagatgactgaactaaagcggttcatattcgtaactcttctcatattgatcagaagcattttatattgcctctaattaggattggatgaaatatctcctcaattccactttaaatgtaaggaaattaataatgctgtaattgagtaactcttcaatattttaagttgtcataacctttgagcttgctgagaataactgatctggtttttgtacattgagtatactgcttagggactgttaaatgcttattagtgttttcatctagactgaattatgcaattagagttctttttggggagaggggtgttgggagaggggagattttcattttaagattaaaaaagtaaacccatagaaatttcttgggagttcatgttggaatttgatttctattagcagcacaaggaactcccaagtggaggttcaggttgcattggcaacatatagatacgtcaataaggactgtgttctgatataggtaattaaatagtttgtcttatgcaaaagatgaggctagtaatgatttatgattaacctctagccatatttcatttcaacctaatttgttaaaggtaatgtttaatatatgattatacatgcaaatttgatgttttacactcttttctattcagcaatttatattaatatactttgcatttttgtcataatttaatgataatagttatatgcaataaatactaaattattccatctgctagaactctcataagtaatcccaaaccttttaatttttgttctctcacttttctctttcattaatttagagagaatagttgtgcttgaacaccaggtgttatacattaacccaagcatccttgttctccactgactgctattataggtttctttctcacccaaccctagtcttttagaagttagttagcttggatgaatcttttcatgccctcagaataagtaattttaattaatagtttaaggtagcacaaaataaattattggtaaactaggtcttaaaatctataataagccatggaaatagttgtcagaaatgattagaatctcagaaattgtctagacagcataatatccataggttatatttacattttcaatatccttactccatatcattagacggagataatgccagaagcatttctagacaacatgttttattttcttataaaactcctatgacgagcttataaaagaggagcaaaacttacccagtaaacagatctaaaaggtaactaaatctgggtcaatttttaattttattgccgagcatgattttttaaaaacttggctctgttcttgatttgtacagagaaatgctttcaaaaatatttcttctgttttgaaggattctactagtatttatttgcatgagtgtatttaagcaactatttattcatatgtgcaatgtgccaggtaggatgctacatgttggaagtgtaaagatgaatgcaacacctcccttaccctcagagagctcagtgtttactcagggagaaaagtacataaattatttccatagcactaggatagctgtgaataggctactgtgggaacttagccctgtgtaggggctcaggatggaagcagagaacaccacctaaatacactgtgaaacccagtgttacttctgaattatccgtctttattttttggcataaatgttctcaaaatttgaacagtttagttcatcaaagtcccatgccttccatatgcccaatactgttttaaggtctgagaagagagcagtgaacaacttaaagaaaatccctgccatcaaggagcttatgttctggcaagggtgatatactggaacataaggtggagttataaaagaaaaggaaaagacaaatatctgtgtcatggtgaagtttatttgacaactctctactgaatgccagatactttgttaggtacagcagacataaagatgtcaaaggtactatccctgccacaaggtttttattttgtatatcctgctgactaagaatggttttatatttttaaattgttacccaaaaaaagactgtttcagggcacatgaaagttatatgaatttcagtgtccacaaataaagttttgctgaatgtatccacgcccatttgtttatgtattgtctatagctcctttgtgctacagtagagttgagtagttgagacaaagattatatagtttgcaaaacctaaaatatttactgtctggcaatttacagaaaaagtttgccaacctctggactagtccaagagtctctaaaccttttatttcctaccccatcagaaaaaaaaaaaaaaaaaatatatatatatatatatatatgtttgagtaagtagccctaatatattttaaacattatatacatgcatgtatgtactaatattaatatgtacattacaaaatatacacagtaaaaatgagaaaaacatgaacaagattttaaaatgatttaaaattagtttatttcttaatcatacagaagtctttgctgtcatgattaataactttttagtgagaacagtgtcactatgtcatttttttatgtcttgcttaaaaataggcggtaattagaaagtttagctccaagttcattttattttgatatttggtttaatttctctcataattgaaacataaatctgacaaagatttgtaggtccaaatcgaacaaatgcaccattagcaacttactaaattgtagtattaacttttatcagaccaatccatgaatcaagcaaagatttcctgctgaaccatgactagtaaattcctgtcttacttgatgacagccagttattcttgcaactaatctggggtgttgcatttttatatttctaaataaatgggtttaaattggactttaataaatgggtcttcaacaagtgccattgggaagatgggctctttccattttttcttctacattattaatgtgtagaccctcatcctcatgtttgtgtactcatgcctgttccagacagtacatctaacaccaggaagaaagaggaagtaattcaagcaagggtgaaggggactgacttggaagttgagtctgttgggactgacttggaagctgggtctgtctgtgtggcttttccagtaaagtaggtttgaaaaggagttactttcttactaattgttaaaacgtcaaggaatttcttcactttttgtaaatgaaaaatgcctaactcatgctatatttcaagttttttttttttttttttttttttgagatggaaactcactctgtcacccaggctggagtgcagctgcgcgatctctgctcactgcaccctttgcctcctgggttcaagcgattctcttgcctcagcctcctacgcctggctaatgtttgtatttttagtagagatggggttttgccatgtcggccaggctggtctcgaactcctgacctcaggtgatccgcccgccttggcctcccaaagtgctgggattacaggcatgacactgtgcctggctaatttcgacagttttaaaatactttatcttgaaataaccagaaatatctctggttttcatgttaacttcctatttcatttcaaaatattgtaaatattttattgtatttgaaatatcttgcttttatttaaagaagaacaatcttcttgactctgtagtattctgtatacttcagtttcaacttcttgcaatggccttgaattttacgtgtaggtttacctgactcaggaatccttccctcatagtttttccacaaaacctctttttattaaataaatcatttattttggttatgtgttttctctgttaaattgttctaacggtgacacaaagaaaagtagtttatatatgtcattatggaaacaatctagcaaatactataaggtgaggtgtttttaaaaaggttatatttttatccaactgtatagtaaacctcctacactaattgcttaaatacttgctttagcaaattttcagtaatgatctatacgtgtcttctgatacgtcagtatttgctgacaaagaaatgtacttcagcttcctgccatgttgttttgcatggattgtttcagctgcttttaccaagtgtttctctaatgccatggtaccttttgtcagttgttattaaagaaaattcatgagaagcttctaaacacatatcattaagtttacaaagtatcactaaggtactggatttgagtataacattctaattattgcggagaaaaatgacgaatgactgagaattgaagaatgaatgaatgagaatacaaatgaatgaataggcagctggttcaacttttgaccttctcatttgatcctattcttatggcttctcagtaatagctttaagaatataatgtttgctgaagtgaaggaatttgtctataataggaaattgtatcatggcatatgagaagcataaaaaaatggtttagtatttacaaatgtggctttaaaaacattataggctgggcgcggtggctcaagtctgtaattccagcactttgggaggccgaggcaggcggatcacgaggtcaggagatcgagaccatcctggctaacacggtgaaacccagtctctactaaaaatacaaaaaattagccgagcgtggtggtgggcgcctgtagtctcagctactcgggaggctgaggcaggagaatggcgtgaacccgggaggcggagcttgcagtgagcctagatctcgacactgcactccagcctgggtggaagagcgagactctgtctcaaaaaaaataataataataataaagaaaaaataataaaaataacattataaatggtcaactagacttcagtgttttgtttttttttttttttttttgagacgaagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacagggtttcaccgttttagccgggatggtctcgatctcctgacctcgtgatccgcccgcctcggcctcccaaagtgctggtattacaggcgtgagccaccgcgcccggccgacttcagtgttttttaaaatcacaaaatactacattttttctcatgtattatagatatatcaaatgttaaacatgctaaaagcttgcttttgttttgaataccataagaaatcagtatgtttagaaatagtttcatattcaattacgctgtttagagttaatattgaattatgaatattgctctatttagctttattattgtattatggatctggagttaatgatttggaagtgttagctgcctaattagtagaatgtatcttatttctatagaataaaatgagtcattatggtcttttcacatgaatgatactcatttccaatcaacctatgcagcaaatttataagtataaaaaactgttgctgattctaaagcaagttaatatatttaaagaaaaggtcttaaatatcacattggttcaacaaatatttattaaatgtttactgcattccaggaattatgctctttgctaggagtacaaagataagtaagttcctattttcagcttcgagtttagaagagatagatttatcacataatttcaatgtaagtgacacataaggaattaatatggaagactaggataagggtaattattttcaaatcaggtgctttaggagaagtcttcctgaaaaattagtggttgagcacagtcttgaagtataatagccagatgtgaatttggagggggcaaggatgggcattaacagatggagaggatggtaaagatgaccacatttcaggcagggagaacagcgcatcatgagcaaaataatgagtgtgtaacaacacagtttatgtagcaaaactacaaacaacctaacattattaaaacataaggggtaagatgaaaagcggttaaaaggctgaggttgggaggtgataacgctaatagctagcattctttgaaagctagttaatatacaccaggcttgtcatgcatgatcacacccagtcttgacaacattcctctgaggtgtataatcttacattgctcttattgtcctgcctgcctccctacaaaataattctgtgatggcgtgatatcagcagtgtgtgccattaaaaactgaatgggtacacggtaatgtagaaatgtcactggaagcagagaaactctctacctagagactgccaaaggtgacgccaccacactcttaggccaggctgtgaagtatacaaatacagacacttaatcttgtcactgttccagagttgattctacttggaggttgcggattgatgataaccacatttacaggagactgaaatttaaccagaatttttttaggcaatagagacatagcccagcatatgtgagcagaacatagggattttgatgaaaacaaaaacaatatgagtcagcagaatgatgtacttggccagtaagataataaaatcaagagggtgaattaacagaggtgtaagtatttcaaggtgagggaggtggacattctttcctaccttgcatttgttaaaccacagagtatttgagagagagagagatgtggacaccaacccatgttacatgaagataagttgagtactttagcctgaaagaaggaatgtggtcttcaaataacatttatgtggctcttgaattaatttccttctgtccaatctgagttttcttcttagttcgactcttatctctagtcacttaaattacttcagcccaaattattgaacataagaaaaatccactctggcaggtttaaatagaatataattttagaggatattacgtagtcttgaattaacagagttgcagaaacaggctctagataacattataggactaacttccagaaccacacaactgaaatacagttccaattaaggagctcttatcccagaactatttgatcaaaatgtcttaatgaaaaagacacagttaatgccatcagttctgtaacaacatcacctctgttgccacctacatcagcaaaatgaatggcctattcgtggcctgcttcctcacatagttcacttctaaatctacacctcctatgcatgcattttattggtggagactaagccacatgcctgcactctagttaaaagggagactgacaaatgtagtttttatggattctacctttgtcaggtgggactgacaatgtgaggatgtattaaattgtagagggtatgttcaagtgatgttgagcagcaaaaaatgacacatgaccgctagagtttcctgaccggtctccttccttccagtcagatttttttcatcctttgagacccacaacctggtgaagacttctctgacctttccatctgccctgtgtttccaaagaatctgatacatgcctcagttagaattatttgttactactggaccataaattatttattcaacaaacatatatagcatttactaagtatcaggcattgttctaagtgctttataaataatatgtaatttgagtataaaaacagtctaccagattagacagcctagcatagtttctggtgtgtagtatgtgttcagtaaataagtgattcagaattttaaaagagaagaaaaaaggtcatgccacccaccttaacacacattattttgttgtacatatttcatgtccaatcattgaaggaaaaatttggcaaaaattaaactaccctaagatgagtggggctgtctgaggacgtagggagtacactgtcagttgaaatagatacatatgctgggtgtggtggctcacgcttgtaatcccagcactttgggaggccgaggcgggtggatcacttgaggccaggagtttgagaccaccccagccaacctggcaaagctctgtctctaaaaatacaaaaaaattagctgggtgtggtggtgcgtgcctgtaatcccagctacttgggaggctgaggcaggagaatcgcttgaacttgggaagcggaggttgcagtgagccaagatcaggccactgcactccagcctgggcaacagagcaagtctccacctcaaaaaaaaaaaaaaaaaaaaaaaaaaaaaggaaatagatacagaacatagatgagcatctgtggaccacattatgagtgctatccaacctagtttctgtgattctactgtgattcaacaatgccagagcctatgagagagagatgaaaaagatgtcttctgccttctagtaagtcattaacaagtaaaatatccaaatgagaaataacattagatagaaaagtggggatagggacagtgatccagataattaggaagaaaggtcatgtatatatacacaaaatttataggtattgactatgaatgaatcatcataggagttgctgcagtggttgcaaatatagatttttgctgtcaacaaagttattattcaatagatagatgcaatttgtctacttttgaggattgtcttccacattctcacatatgcatctttaaaataactttgatgccaggcgtggtggctcacgcctgtaatcccagcactttgggaggtcgaggtgggtggatcatgagatcaggagatcgagatcatcctggctaatgcagtgaaaccctgtctctactaaaaatacaaaaaattagccgggcatggtggcgggcgcctgtagtcccagctactcgggaggctgagggaggagaatcacttgaacttgggaggtggagcttgcagtgagccgagatcgcgccactgcactccagcctgggcgacagagggaaactccatctcaaaaagtaaaataaaataaaataacattgatactgttcttcgccaattagtttatttactttatcaaaaaaaaaaatagaatgctcagaatttctgtaagagtaaagggataaaaatactgatttgttttcttaaaaaatttagatatgattcacataccataaaattcacccttttacaatgtgctcttttttttgctttttctttctttcttccttttttttttttggagacagggtcttgctcagatttccaggctggagtgcagtgacaggaacacagctcactgcaacctctacctcctggtctcaagcgaccctcctgcctcagtctcccaagtagctgggactgctggtgcacaccaccatgtccaggtaattttttaaaagtttttatagaagcgaggtcttgctatgttgcccaggctggtctcaaactcctgggcccaagtgatcctccttcttgggcctcccaaagtgctaggactttggcgtgagccactgtgcgtggccaaattcataattttttttttgtatattcaaagagtgtgaaactagcacaacaactttgagaacagttgtatcaccccataaagaaacaccatacccataatcagtcagaatccaaactccctcctcttctcccctggccctggcaacctctaatttattttttgtccctataaatttgcctatttgggacatttaatatgaatagaatcatagaatatatggtcttttataatgcttctttcacttagcataatgtgatttcaagattcatccaggttatagcatgtatcagtacttcattcctttttagagctgaataatatttcattgtatgatatgccacattttgtttatccattcgtcaattgatggatgtttggattgtttctactccttggctattatcaataatgctgctatgaacattcgtgtgcaagtttttgtatggacatatgttttcattttgcttaggtatgtaagctgggtcatatggtagataaatctgtttaacttttggaggaactgccagactgttttccaaagtggttgtatcatttctctttcccaccagcaatgtgtgagggttccaattttttcaattcgttgccaacatttattattttcctctttttttctagttatcctagtagaagtgaagtagtatctcactgtggttttgatttgcatttccccacagattaatgatgttgaatatcttttcctgtgcttattggccatttatatatcttttttttttttttttttttttttgagatggagtcttgctctgtcacccaggctggagtgcagtggtgtgatctcagctcactgcaagctctgcctcctgggtttgcgccattctcctgcctcagcttcctgagaagctgggactacaggcacccgccaccacgcctggctaattttttgtatttttagtagagatggggtttcaccgtgttagccaggatggtctcgatctcctgacctcgtgatccacccgccttggcctcccaaagtgctgggattacaggtgtgagccaccgtgcctggcctgtatatcttctttagaaaaatgcctattcaagtgttttgctcatttgttactggactcttgtctttttattattgagttgtaaaagttctttgtatatctgggtacacatctatatcagacatatgatttgtaaccattttcacctattctgtagattgacttttcatttggtgttgcattttgaggcacagccatttccaacttggttttgtgaccctgtcaagggtgtcttcatatgtcacaaggattaccatgaatttcaaaatgaagaaaaacaatttgtctaatcaaagtgttataagtgtatatatcacaaaataaaggtagatttccaactgaattaaagtttattgaacctcaaaacaatgtgttcttgtaactgaatacttttccttctaatgagtgacatttattaccgcaataccgctgtttctgcttttttttcttttccaaatccaacaacttcttgtgaactttcttcagtgacatattatagatatatagaccctgacaatttgcaaattgtatttgctttcccaggtaataatgatcctaagggagcatatgccaaacagcattttgtgtgtgtatttgctatcaagataaataaagagctttgttagcatagataccatgtatatctatgttataaactgccaatttattctgtggaatagttttaaaaatatttttttctttctgctcagtagttggctaggtagagatgtgaaccgtgaatacatggtagaatttacacaaaactgtggtatctagagtgaaaaataatagcgaagtatcccaaaaaaggatttttgacattagtcaccacatgaattagtattttaagacatagaaattattaatgtttactaatcacttttgaagctcttaagtggaaatttatcaatgcccacagtaaatgttatctcttacaggaggacatgaaccttaacgaagagaaaaaagctcctttacgaaacaaagactttaccaccaaacgtgagatggttgtccagtatatttctgccactgccaaatctgtaagtagggagatttttctagctccaacagaatgagcaatgagcttagcatcattttgcttaaaaataaacaaacctcagctcttcagattacctcattgtactcatatagactgttcagaagacaatttatatatgttatacatttagtattaagtatatatttttaaactattcatcattagaaatgggacgtttccattattacaagcaagacaaaggatacaaagctctgaggtaatccagtccagtcctgagcttttgtgtacatactaaaaatcgactgcattttgcagatattccaccaaaatgtggtttgttagatgaaaatttcggattttgaagaaggtacaacttagtatagtcacagcttaagtttacattaaagctacatgtctggtgtctacttgcatgaaacttttagccatattttttaattcgcagttagcttttttcataattttatatgatgcaaactaagctgcctcataattgctattgtatagcttcatttaatgtaaaggatgtcacctaataggagctttaatcaaatctgtttgtgagtcccaagacttgaaagtaaagttcattgaaaggacttgttgttattaggaaactgtgtgttttagtggagtattttgctctgttctcttcctaatgcacttccaaatatagtcttaagctttgatttttttttttttggtaagaaaaaattgtatttttgaaatagcaaaatgcatcttttacatttctgtaaagaaaaagcttttaatacctagagttcataaaatcactgtatgtgtgtatatgtgtgtatatatatgtatacacacacagtgatattttgtgtgtatacatatgcatgtacacacacatacactatttaggtcatgtgttttaaatttcataagttgaccattgcagaaaacaagtcttcattgaaaaaatatattctaaagttatttggctatcctattaatgctatttcagtacagcaattccagtggcaattactaatgcattttgccatgaattctacgattgtattgattctatattgtacttgaaacaagctaaatctgaatgctgagctatttaaacataacacattgcagctccgccatagcagagcaacagcatgtttttaaatttgcttctggtatccaagggcagaaatatgtttcaagtgataagtgaaatttgccatgagcgtcgttttcaatagaattaggtgatgcatagggttttactttgaaattctgatgaatctcttctcatttttgcactcaagttattgttcaccataaaatgctttaggaaatgcaggatgtacattcaatgttatttttcaaagacctaaaggctgatacactagtaaatctatatgactgaatctgagtgcaaagtacagataataacatatgaataatcatgtggtggttttaatgataagattttgttagagtctctggctcatttgttgttgtttgtgtaagtgggactgaatataatgattatatgaaactcttattccttgaccttttgagtattacatgatttctgtgcagaacttgttttcatttattctcatattatttcctcttcaagtgaccaaagaaatgcacacttcaagttatatactgatttttcagattaaaatgcaaaaaattggataaatattagatgagctcacttgaactgcattattcaaaagatggaaattcaatgttcctcaaaagacatgaaaattctatgtttaaggcattagcctcaaaatcagaactacttaagggcccttatttgtttcattcagtgtacatatgagcacctgaaatatgcacagcactctgataagatttccaggattatacatatttttgctaatatttttcgtgggccagatactatgatggaagaaagcctgttgacaagcatttttgaagctttctcatcttggaaagacgttaattagtactatgttttctatcattaaaaccacaaaaattagttatgtaatttccttttgaaggtgagagggttggccttcagtgacaaacaataatctaacctttttaccttttcattatcacagcactaaagtttgcatttagagtagacatgatagttaccactactttatgaaaatgctttctagttagtcacagctttcatcttgaggtagcaaagttaagagctagagtccctggtggagaaatgttttatagtcacatgtaaaacatgtgagaattgtagtgaaatttaaacgtaaatcatacattttccccgtttaacacctgcattaatcattttgtatgggatctaaaaccagattttagatagaaatgtctatcatgctcctgggttcttgagtaaggacataaaagtaaaatgaagctatacaccaatatgtggtcaaaactcgtttctaaagcaaacaagagtcttttgtcgtataattaactttgctaaaattagcatggaaaaggagactataaaggaaaccataagataataataaaaactattgcttagttttttcttctcgaagtcccataatagagaatgttaaattgtgtgaatgttaaaggaaaaagtttgaataactctgtccatgatgaatgaactttaaatagagggatggagaagaaccttctttctgcattttatcctccattgttcattgtaggaagcgtagttatggatctgacgtagggtaataggaatatgtagataatttgaccacaaataacctggaagagtctatattttcaaaacaccagcatatgttttcagaaaatggaaaaccaagctttgttaatattgcaaaagttgtcctaccgattggtaatcctgaaacaatatgttggtaatttagaggggatctcacgggcacttaacagcacatatagacatttatgaggaaaagttattcaccgaagtcccaacgttagtttgtcaaatgccagtgtcattcctagaatgttaagggattggtttattttgaatttaaatcataatctttgaaattttaaaatatgtaaagttatattttttaagacatgtgaaccattgagaggcagcattggtttttttttttttaatctcagtaggaaataatttaaaatagtggtgctagctacatctgcagatttgttagactgacctgtataatgagtagttaaaagttgcagtatatctatatgtgtatgtgtatacatgtattatggttttgcttttgtcattatcagatactctttcagctcttttccaggtatgatctggatatgatcaaacagttgaacccagacatggccaaaatattttctcttagcttctgttgggtactaaatcttatctattgccgtttgtgctttagctaaatgcagttattttgcaatgcaaatgaatcattaaatgggccatattctggttgtttcactgagtatagacctgctttaattgttaacgcaggctcacattcttttgttagtctcatgtctgtgctaaataaacaagggacaaatacgacctctgtcttttcggtgggaggaaataattgaggtcaatagcatatcttttaattcagaagactgttaatggcaccaaagaggcttttattcaactaaataatcactgcttgtaaatagtctactgaatgaatatttaagaaagctgcttctgtattctgagattcatggattcttctgaaataatttacttggaaactgtcattatctttttgtattttatgatatccttttcaacataggattcttactggggtttcagttaaatttgatttttatttttaaagcactagctgaaaaatagaacacattttgataataactgctatcggattaatggttttgtattgtggcttagctgttttttggacactgcttgatattcaagtgtgggaatctgataacagtgatttgatttatatttggatttttggataaaattatgtttaggactatgagtttacttcctgctttcttaaacacaattctgcctctcagaaattcttttatcacttatccattaggaaagctcagttggagctgcaatttttgaactatttcctccttctgaacatgtgcatgtttagatgtaaaatgcttctttgtcttcacattatgtagaaaattctgatcttataatagaaatgctaggattacctagaaaactagaataataagtaatctatcttttttataattttcaagtataatataaaacagtatcgtacaccttaaatttataacaataaaaaatatttgttttcaacctaaagtttacttctgaacttaatgcatgactttaaatgtaacatttatatactaaaataccttaatagtatacctgccataagaaggtgtactatttcaaccttgatagtatacctgccataagaaggaaagaaaagaaaaggcaatattggaaaaaacaaaatttctattgataattttttcagggactatgagctggtaaaaaaatctgatgcctgattacacttaacattgcataacttgatatttagattatactatatgagaagcccattatagtacattaaaaaaatcctcaaatagtaattatcacttatttgagaatccttattctgtagactttacacatttttgaaacatagtagaaattaatattgatgtatctattttagcctgtatatctaaagtatcaaaaatataaatagggttagctatttactaatttactaaacacttaacctctgtgaaaagcttctgactactaatattgttgctgtttgttttttttttacaccataaccactcttcgttgaccactgcatgcagatagttggaagtaaagttacggtgagtacaaaagatgtgttttacccttagatatgaatttgtggttttgtaaattgtgatttttgcttgtagtattttatatgtttggttcttttggtatatattttaccaaagcaatgagatgaatattatgatcaggtgattagaatttagcctggacaagtattttttctgtggtttttgggagatgttttagaactagaatatgcttgtatattttatcttagaagttttcacctttttttttgtttttggaattatgcctgtgtcagtctttatgattctgatgaaattgtatgttttacctcaatttatcaggaggagaatcctaaaatgttggtttatgctaacaggaattcttattaaaatatgtcactttgatttcagtatgattgagcacatagagtaatgaaaacaaccctttccatgcagtcgggaggcctgggtgcttgtctttgttgtatgctactaatcagcttttgctactttgggcaagtcatgtaatttctctggggctcaattattaaatggataaattgaaatgattagctgaaattatcttttaaggttctttccatggctgtcatttaaaggttttatattcaaggcactatatttcagtgctataattacatgatacactattatataacacgcccaaagtggcccgtactgtgattgagagctgtttgtaattaccttatcttcatgactaagcactccctagagaacagggtggtaggaaacattatctttaacatcaccgagtactgaggtatctagaatagtggatttatttgttcattttgcttttaaaaattgattccttcttttcattatcttactcttcttttttttttttttaaattcacgagacatctagggggaaaagccatcatcctttcaggataattttaaaaatcgaatatttatttagtgcttattatatgccaagaattattctaggtgcactgatgactggaaaataagaatgagataggacctagttgatatgtgttgaaataatcaaaccttaaattatgcatgctgactataaatgtaataggaattcataagtaggagagagaagtaaggttggagtaattagagaaaaatctgtgtaaatttctgcacttaaattgggctttcagggaataattagttatgatggctggtgtttggctagggaggagagactgtggagaagctctcagattctggaagtaatattaaatgcaaaggcctgaagagaaccaaaccatgtgtgtggaggcagagaagaaggaagtgagagatgaggttgactttgttgaaacaaagaatgtatattggaaagagtaaaaaatcaagttgaaggatggtcttgaagtccaggcggcaaattataaattagtttgagcaaggaggtaacatgatggaagcagtgtttaagaaaaataaattcgataggtggataggctggattaggctaatggttctcaaactggaaagtacatgaaaatgcaaattttgtcctgctccaggaagattgtgattcaggtggcctgggatatggccaagaaatttgcatttttatctagcacctccagagattctgctaaggtagtctgagaagtatacttcacactttaagaagtactggattctgatagacttattcgggaagctacctaggagatttttgagtgattcagtgaggacttgtattaaagtcctcactttgaggctaggtggggttaaataacgagtttggggagataagagatttttagcttattttaataagggctggaagcagcctgtatttctagtcttggtaccaactctctcccctaattacccacactgttacttccttagttcagactgtcatcatttaacacccctgtgattgctgtagcctaccaagcagtctccttgtcttcagtctctcacccacccatgcatattctacactgttaccagttatcttgctccagcagtaccctcttatctgtggtttcattttctgtttcagttacctgaggtgcagcacaataatacattttgagagagagagaccatattcacatgttttttttttttttttttttttgagaaagggtctcactctgttgcccaggctggagtgcagtggcatgatcttggctcactgcatccttgatctcccgggctcaagccatcctcccaccttagcctccagaatagctgggactacaggtgtgcaccaccatgcccagctaatttttgtatttttttgtagagatggggttttgccatgttgcccaggctggtctcaaagtcctgagctcaagcgatccgcctgccctggcctcttaaagtgctgagattacaggcgtgagccaccacgtccggtccacataattctattatagtatattgttataatttttctattttattagctattgttaatttcttactgtgcctaatttataaattaagtgttataggtttatatgcataggaaaaagcatactatatttagagtttcaaaactatccacagttttaggcatccactgggtgtcttggggcgtacctcctgtggataaagagagactactatatttccctcctcaaaacattcaaatggctccctgttgtcctttgtgatctcatccctgcctgcttctctagtttcatctccagcttcgttcttactggtacctgtcttctatctgcataggaacacttggcaattccttcatgccttattctttaatacctttaaatcaagcatgttctatttttttgagctggaatgccgttttcttctttagtgtgtccgccaagctcctaaatatccatcaagattaagcttcctgtcagtcttagaagaagctgtcctaggtaactccttccttcccatagcaccatgtttatagctctattgttatatttaacatattttattataataagtcatttatatgttctttttccacaatgtacacagcttctgtgttcaagaaactaggtctaacggggaagacagacaggtaaacagaataaagataggacctgaagatgcaatatggtaaaatggcaggccagcaggctatatgtagtgtatatatatatatatacacatatatatatatttcccagagtgttttgaaaaacagtataatgaggtacgtgttttgatccacaatgtaaactatttcatacccattgtcttatctgtgacctcctcacatttgagtttgcaaatcctgctataaagggaagaaactataggaattagcttctagaggaaatgattaggggtttgttctagagtttaggtgggatggttgtcttaaggaagaaatttttttgtttgtttttttttctgcaactaaagggaataagaaaacaatatgtaagatcactggtgaaaaccaggtacaaaagggcttttgcatcatggtctcaatcttcaacagatggagaggtttattcattgataaaaagggcaggtaggaaatttatagaggtgtttcaaaaagaaattctagaataatcactttaagtattgcatttgcccagagattacgtacattggtccaaaaatgagtgatacgaaagctagactgaaatccaacagatggaatatgtaatgaactaggaggtcggcatgggcctgttttgcgtttgtctaaccaatgttgattagaagcagaaatggaggcatttgaggccctcctgatcttgagctaccatcagtctttacttttcactatcctatataaattgtactttaaaagtcaagccaggaaactgcctgttacctgaacaaaaccacccccttagcctcaggcagtattgcttctgactttgctcaagggatcttttttgtatagaatgttttctttcctttgtcaacattctagccatcctccacagctcttccatgaagcctgtcttgatcttgatccgctctcccatttccacctacagtaatatatctgaactcctatagcactttatttttaactcttagggagtcactcttaactttatcttatagttcctatttctttatatattccttaagggctttcagaatactcctattttactttatgcctgtagtaatttatatccttaaataatactgtctcacatactatgagtctttgtatatccacgatacagactctatgaaggaaggcaaattttagtagcaatcatgggtttagaggcaaatggacctggtttcagattctgtctctgctatccaaggtcacatactagctgtgtgaccttggataatttacttctctgaatctcagtcttttcattgataaaatgaagagaataatactaaatttgtgatatttttgaagtatattgtttatgtttaatatatttaacatgtaaagaatcttgcaaatagtaggtctgaattacatttttgttaaatgtcttgaattctacaaaatgcttgatatgaaagacataaaacataaagactacatggtaaaatgagataagactgagctgccttttttgttgttgttcagtgttcaagatgtttgctatttgaagatttaaagggaaaaatgggatttattctgggtcaagaatggtgggaaggattcagctggatgctggaaggagaatgttttgcctgtttattggaagctatttgttatgtggtgtggattattgctgggctttgaggaaaaaagtaaaatcatatatgatctcaagttaatattgacaagattattttaaagatttaataaaatagttgaggatttggtatagatactgtctgtgatgggaaatgataaaatatctttctggtagatctctagaaatagcaaacagaatttggagtagggaagagataaaactgaattacttttttcaatggcttctcgttctaaataactgttgcagaattttgtgaagcaaaataaattgtttttattatttagtaacaatgcatgaaacagatttagaaaacagctaaaatgattgattttatttcactacaagccaggaataatttatccacaggtagaaaaataagcattcttctgtgacaaaaagtaagaattgatatgattacatatgatagttggaaaatagcaaacattgtaatgaccagaccttataattttaaataagaggtaatttaataagttggcagcagcaacggctttttgggaaagcatttgtctcgtcatcagaagagtctgagtttgaatcctgattcactactcattcattccctgtgagcttgtaaacctctctagactcagtttcattcctttcttgaacacaaagttactgggtacttattagtgccaggcattattccaggtgctggaatgatgaaccatacagataatgtcttcatggaacttacattcaagatggggaaacagacaatatgacacatataaaatataatgacaggtaagcgctattagagaaagcagagagtgatcagggtgtggtattttagataggcgagctctttgggcaaatgacatttgaaaggagacctgaatgaaaatgggaagagccatgcaaatatctagggaagagagaacatcaagtgcgaaggccttgaggcaggagtgtgcttggagtatctgaaggaatagcagaggtcactgtgcatggagtggggtgaacaagggaaagtatgggggtgtttaatcccaagagttagggtgactaaaaacatatgttaagcatagttagtgggttgttaatttggaaaggtaagttcaggtcattttaggagagatattttgaagaattgtcactttaatagccagccaggagccctggaagggtttgagccgtggaacgacaaaatccaaggtgtatttggggaagagaaaggtagcagtggaaattggagaggttagacataagggcaaggagatcaagttgggggttgttgctgtagtttaagtaataagggtgctgaactggagtgtggttagtaggaactaaatggaggatatagatgagagacagagactgtggaagtaaaatatcccagcctcagcaaatgattttaaaagggcagaagagatgtatgaatcaataatgactgaaatttcaagcatgggtgaccaaaatgacttgagcattcatagagtagtcagggacgagaccgagtttggagtaaaagaagattgagttcagttagatatgttaatcagggagaaattactagaatcacaatagcaggagtaaaggtatcaccatgcaagaacatttatttagctcttacagcattagcagtataattttataatttggttctctgtttcaaactactgcttttaccattttaaatgtactctctgtatattgctgctgagactatgttgctgatcattctaataacatttacctgcttaaaagctgaagcctgaatatctttactaggtattgaaggccaagtatacttgtagatgattcagtggaccaagacagagaagagtgaatcattttggtggcttgtagtatcatttaccagataaacaatctgacataaaattaagaggtcatatttgtaccttttgcaatgttcctaataatctcagtcaaaaaaacaagcccataatagtgaaggtcagatacaaatgcatgcttctttgccctaatggagcatgggaatcatgagcactaactgaatgactgttgcaagagttttctcaaaatagagccaaatgaactcccacccgccagccggccctcttccaggctgacaatgaaggtaatactgagagtaagtttctgttaaaagtataaacatggctgggcgccgtggctcacgcttgtaaccccagcactttgggaggctgaggtgggtggatcacttgaggtcaggagttcaagaccagcctggccaacatggtaaaacaccatttctactaaaactacaaaaattagctgggcctggtggcaggcccctgtaatcccagctactagggaggctgaggcaggagaattgcttgaacccgggaggcagaggttgcagtgagccgagatggtgccactgcaccccagcctgggtgacagagcgagactgtgtctcaaaaaaaaaaaaaaaggataaacatatgatcaggcttaaaataataaatttagtgttatctatgtattacttactataagctgcctgatagtaatatacctaaaataccaccaagtgtggcagcatgctttgtaggctgttaagctgctactacattaataaattgaagttttattagtttatttatagaatagtatttgataattacctcacgtaatattacacttgtgtcaggccaattatttgaatatgttctgtgaaaaaagattaaatcttatttttccttttttctcctttttataattgtgtagtccagaagggggagacaaaacattgattattggaggttgaagtagctgcttcgtgatgataaaacattgtgttcttgtattccaatttgatttttttaaatgggtttagaaattgtaggatagttgctactgtaaaatatttagttttatggtggtgataattttgttaaaaatctaaattcagtcagaataaaaataatgccattattttaaactagcatatataaaatagaaaaactcatttggtgatcagatgaaaataagacctgaaactatttaatgatggtatattataagtgatcttttaaaaatagcacaaacactattaaagtaccaatttcagtcttttctaatttcacattcattatatgcaacgagtagctactttcccatttcctaatgttttaacactgcaagctaacttgtacattatacttattttggataggggtatctgtatatgttttgaaaggttttgttatttgaatttcccttcatttttggaacactatcgtatcagttccttcccttcccgtgcattgtcataaattgcattatttcatcatgccagattaaattcattgttcaatgaatgctgaaatatagattatgaaatattaacaagtcatcttaccttgggcatttggaaatgtctaaaagacagcatgaatgttagtattatgtttagacatgtattttgaaaattgattatattaatatttatgaataggggtcattatgttttataatctatcctgatattagaaatgaaaagatgtatatttcatgtatgattttgcatcacaaattcattagctgtgcattttgattgtgatcatgttggatatttctattgaggatatttttctgtgtgtataatcaggtaaaagaatcaatttaaaatctgatgcttgatataagacatttaagactagtatagccattattttttgtactggattggtttattttactaacaatggaaaaaattttgatcatctatgtagaatgaggtaattatatgatgtctttttttgtgtgtttttgttgttaagtaatatagtctctacaatatatatcctttaaaagctctgtataaaatttgctgttgccattataaaacttaaagtggcataacagagggattttttttatgaggcaatgcttcctctatccagatagccttgtcggcaggggaaaaagaggaaacaatcagattacaatcaatgtttagaagttaccttaggctagatgtagttggctcatgcctgtaatcccagcactttaggagggtgagatgggaggatcacttgagcccaggagttcaagatcagcctgggcaacatggcaagaccctgtctctacaaaaaaataaaacaattagctgggtgtggtggcacactcctgtagtccaatctcctagggaggttgaggtaggagaatctcttgagcctggaagtcaaggctgcagtgagccgagatggcgccactgccctcaagcctgggtgacacagttgagaccctgtctcaaaaaaaaaaagttagcttagctactgtatataaaattttgggcccttttctcatatatttgattccatttttcattttagttaatcaagtttcttctgtctgtttatctgttcggaaaggactgtttggttgaacaaacattagttcctttgaataagtagaataagataatcttaaaaagaaaaaggccgccttagatttatgaagtgtttcagagtgtttaaagcccttcatgtatttcctcacttaagctacgtgttatatgtatttctgtaggttcgtgcatcagtttttcagaagacattgcctccatctccaaattcttggaggctagttagagtctggccttatcccatggagatttttttggctgaaagctatatggacagtcttttgagtagtttgtactgaccaaggtatttcctgtcagtggtccactgatattcataacatttaaaaatgatacatgatattcataacttgtattaatatctagtttatatgcttgtatgaaatgctttctgggtctgcattgctaaataatggtgatgtgaccagtgacatttagagtaattttttgtactgtggtcaccataattcggataccatgattattacattaattgcatgtgcttttatagttgcagccataattacctattaaaacaatatagaaaaaaatgaactttaacagcatcaaagatattaaaagcatttgggttcattttttatgctgatctgtttgtaaatttttagtaacctgtcatggttcttttctttaatgaatttgtgatctaaggagaaaataactgcttgtgcaatgtaactcttgtgcttggagaacataactgctttgtatatttctggtaaatcatttatttttattgatgattatgatgcttttttggcagagtgcttatccactcaaagagctgttctacgaagtgtgattggtgtctgtatccaagatataacatgtattctatgtgtttatatatgtctctctatatctatttatccatctttctgtctatcctcccaaagttaaatgagcttaaataggttgcctctgtgttagaaagcagagaagtattactagagaactgaggctcttccccaaaattatttcagattttcttattgtgtggagtggttttgcttggaatgagaaaagctatgtgttaccggctgaattgtttccccccccctcccgccctccccaaatttgtatgttgaaaccctaacatatcagaatgtgactgtgtttagagatagggcttttaaagtgttaagttaaaaaaaaaaagatgcctttagtgtgagccctaatccagtctgactggtgtcctggtaagaggacatttggacacacagagaggtgccagggttgtgtgcagacacagaggaaaggccatttgaagacagagagaaaagatgaccatctgtaagccaaggagggaggcctcagaagaaaccaaacttactgacactttggtcttggacttttaatgtcaagaatggggagaggggccgggtgatgtggctcatgcctgtaatcaccaacactttgggaggccgaggcaggcggatcacttgaggtcaggagtttgagaccagcctgggcagcgtggcaaaaccccatctctactaataatatcaaaattagctgggtgtggtggcacatgcctatagttccagctactcagcaggctggggcacgagaatcactggaaccaaggcagaggttgcagtgagctgagatcgcgcctctgcactccaacctgggcaacagagtaagactctgtctcaaaaaacaaacaaacaaaacacaaaacaaaacaaaaaaataaagggacaacaaatttacaaaaataaacaaaacaacaaatttctgttgtttgtgttccagtctgtggtattttattatggcagccctagcaaactaatacagtatgtaacagtcattttgttgtatttaacactgaataatagtgaacttttagagaacactaagtgccaagaaccgtgctaggcaagcttcatgtaaaacctaatttaatcctcataagaattatcacccccattttatagattaggaaagtgtggcttagaaaagtaggtacattgtttggggttacatagtaagtaagtgggagagctgggatttgaatccagtcaggctgacttcagagcttggcctcttaaccaataactaagtaagatttggtggatttcaggcagttgtggataataattgacaccacaggtgttcatcctctctaacactgttaatatttagtctttcaccatgtgctagtaggcaattcttattttctgccaactggagaatacctacagtcatacctacaacacagagagaaccttgcccatggaaaagctgctacattacagagaattaaagacctctgtgcacgtgttgctcaatgggccaaaaatgactctgccgatatggtctttgtggctttcatagcagatgttcacgaacaggtaacatcaatgcagataaaccatatactcagcaatttaaatgtgaggaaaaagatacataaatattagaaagaatcccatttttagcaatggcctataattctaagccatttttcctgtgtctgaaatagattaaccattgtgcctcttcgagttttttttctatctgtgtgttcacctttcttatgcacgcttgccttttataattaatttcaattaaacattagttttgtttaaataatactgtgtaattaaaatgcttatgtgctctcagagggcaaggaccatgtcttaatacactttagacatttttaaatacactaggctataacagcaataaaataattaaacatcgttttgttcaatctctacatattcacaattcctctgacactgaactgtgtataaactaaaatcagaaagctgctagttattttataatgcttctcaaaacagaagtcctcttccattggaaatgcagtctagcatcttaaaatctttttttttctttcaagaataaaactaaatttcttctattgtaatttaggtcccttgcctcttggtaagttttctatttctgctgaggaccgttgttcatcatcacccatgcaatctctcttagagtactcataggtttaagtggtccctcagctgctgcttctcccacttcctttaatttttccatataatactgccttctttttaattgcttttagagtgtctacagtttggggcctcagaagtggaaatgctacttgataatacacccaatctaaatgttcattcttattttactcaacgtgtgcttgtgtgtgtgtgtgtgtgtgtgtgtgtgtgtgtgtgtgtatacttcctcagttttggtggtgcctcttctattgatggtgattgttatttttttgttatacagatgtgactaaaattgagagttttttctccccgttctcttcgcattatctaggaaactccaaagatagctcttcatcataccaactagaaacatcttgagtgttcacctggagtttttctccagttgttttcgcttatagcttggtgtgcgaagttaatcatacccgtaggaaaaccaccacatgaaatggatgcttagagcgtacgttaaaacacagtgaaaatcataatatttgggctttgaagacctgggggtttaggtcatggctctctctcttaatggctaagtgattgggggtaaaacacactcaacctttctggagcctaagtctctttatctgtacttactctgtcatcctaatagagttactgaatactttgtaaactgtaaaacacagtacacatttaaatcattatagtaatcagttaaggaagtgattctcatggtaattcctaatatatatatttttgaagaatgtgttgatcacaactactgccaccttttagtgacacatacatcaatgcatttgttcctttattactcagtgttagtttagaagccagttatagttataaactttgtaaaagctgacgtcttctaaggtagcccctaggctacagactacatgtaaagttaccctttttatgaaaagccacaagcaactgtgaagattatccctaatcttccatctaaatatgaaaatatttgcattttaagctgcataaccatggtatccttttcttcttttcttttcttttctttctgtgtttttgagacagagtctcactctgtcacccaggctggagtgcagtggcgcaatccctgctcactgcaccctctgcctcctgggttcaagtgattctcttgtgtcagcctcctgagtagctgggactacaggtgtgcgccaccacacctggctaatttttgtatttttagtagagacggggtttcaccatatcggccaggctggtctcgaactcctgacctcaagtgatccgcctgccttggcctcccaacgtgctgggattacaggtgtgagtcaccatgcctggctgcttttcttatttcatttgaactcttttctccaggtatattatatatactgtataaatattattaaattaaatattattatatatagtatataaatttggggtttaatgactgtttctaaactaagatcacatgaactcagaaatggtaaagtagtactttgagatttgtggtagtaaagaatttgactttttttcctcctaagtttactaaatatttcaatacaaaagcccatatttccttaaaagatatgatgtaaaccaactatgcaatttaaagcaaatcatttttcaagtttgctattctcattataagaagagttcaatacattttagaaaatgtgagaatgcagttaaggagaaggaatcaaaacaattgcctataaactttacataaactattgttagtaatttggtatgtttatatttaatcgtttgtcagctgtgtagttaaacttttagaattctttctaccactttttgtagctatacttccctttcagaaatgaattcctattttattataaggtacactgatacagataattttggtagatgatagcttctaatagcaaagtagtattttaataaatcctggcaccctcacttcatttaattatagtctggttactggaaattcagtatctagaagcattttatgccttgaatagttgtggcataattttatctttagtcatgtttgagtatgtcagtagtcataggccatttttatgtgttttgctggatagctttaaaaacctaatgaaaaatgtttatgatttatccctttatcggattaaaattatacacaatttgctatcaagatgtaaaacaacagaatctcagttttctcagattagtaattataatgatacatttttcttatttttgagatgggaataatttggaaaaaatctagaggtgtagagtggatatgtagtactagaaacatatcaacaagtttcaggaaatcttgtaaacctctattttcattattttgggatgggggggttctattgaattaccattgcaaatgaagcaagatcttcatttggaaaatttacttgtattaaacagatgactgggctgaaatggctgctaaaacaatttcatgcttttgtttttaatgtagtccagttataaaatgtcacatcagattgtgtgtgagtacacaaatgcataattttaattttatttctgagttatcacattttaggaagttgattaaaatcacccagaattttttctaagctttttatatataacaaattaactatttgaaatgagttaaaacaagattgatattttggcagtaatacctttattaaagaaattgatcaattcttcagtagttacccattttgtccttttttaaattttattattattatactttaagttttagggtacatgtgcacagtgtgcaggtttgttacatatgtatacatgtgccatgttggtgtgctgcacccattaacttgtcatttagcattaggtatatctcctaatgctatccctcccccctccccccacctcacaacagtccccagtgtgtgatgttccccttcctgtgtccatgtgttctcattgttcaattcccacctatgagtgagaacatgtggtgtctggttttttgtccttgcgatagtttgctgagaatgatggtttccagctttatccatgtccctacaaaggacgtgaactcatcattttccattttgtccttttatttttgaatatgtaactcactgccaaattttatttgctctaatttcttattttagaaatgtcaagcctacagaatcattgtaagaatattacaatgaatagccatagacctttcacccatattttaaaattgttaacattatgttatatttgctttatcattctcttttaaaattttttttctttttttgccttttctgagccttagttgcctatttgtaacactttactcctaaatacttaagcatgtctctcttacgaacagggactttctcctatataaacatagtttaattactaaatcaggaaattcatcactattataatgttgttgcctaatatagagcccgtattcaaatttctccaactatcccaataatgccctttataacttcttgttttctagaatctaatcaaggattgcacattacatttatttgtcatatcttcctaatcttctgtagaacaagtcctagacttaaaaaaaaatttcatttcattaacattttcaagagaccaagacacttattttgcaaaatgtttctcagtggattggtttcattgtttccccatgattagattcagggtaaacattgtgggcaaggatgctacacaggtgatgttcttcctcagtacatcacatcaggaggcacagggatatcagtttgctccattattgatgatgttacatgtgatcatttggttggagaagtatcttccctatttgtctttgtaattaataagtgatatgtaggataatactttgagatcatgtaaataacctatttctctgaaacatttcacatggttttaaaatctgttgatgagattcttgcctgaatgaattataactaggattgctacaaaatagtgatttttctaattcattgttacttctgtatttatcatctggtattcttctgtaaagtagaactttcccttacctctttaaccttctttgactttttaaaagaaatatcagcatggactcacagattctttatttaaattcaattaactaccctaccttattgatagaaactctataaaatccattcaattgtttactgaaaataacacataaaataaagaaatcaaacaattaacatctgttggtttttactttatgaggtaactatacccatactaactcattaagtctcatctagaagcagttctacttttccccctagaagaaaacattagacaggtgcagtggaatttgaagtaatgaaatgtctgatgtgatacatttattcactgcatttgttatatttaggccttacttatattcattgctgcataatccttctgaatatcttaaacattaaaatctacttttctatcttatcagatacaagtcttacttcagattgctatttgaattagaatgcctttagccatcttcattttcaggcttccattgtttaaaaagtcatgatggcttatccttaactgttatcaagcatgaatctataaatacctacaaatgtgttttctaaaaacaaaaaaattatggtgtttacatatagaaatgtatgttgccatagtgttcaataatccagagcaatgcttttcagcctatcttccttgtaaaaagctgttcaccttaggcttttgtagcggtgctttgtaagttctacgtttttttccgattctgttttagaactctatttattttaaaaatttacaaaaatagcacccatgttcaaagacctcaaaattagtaacttgtaagaccagatgaattcatttttgtgtacaccccagaatgtagtttatctttgcatctttaatggcaaggtattctaagactgcaagagatgctattttaactgttaagatttgtagatacttatttgtgaaaatctggattttctttgtatgatacaactaaaacaaaatgtgtaaatcatctggatgttttgtttaataggactgtagctcttctataaaatgcctggtgttagatgttaatgtttattcaaatagtctcattgttcttttcgattaacttataaatcaatccccactaatggaacactactttaatatgcttgaaaaaatgtttagtcttggggaaaaaagctttaaaactactgatcttacagaaaatgtccatttcaatatgtaaatttagtatacccattatttaaaatgtgtgtgtgtgtgcgtgacacttttaaatgcatttgtatttgctatcatgggacattgaatcagggttttatttttttattttttgttttttatttttaattttgagatggagtcttgctctgttgcccaggctggagtgcagtggcacgatctaagctcactgcaacctctgccttctgggttcaagcgattctcctgcctcagcctcccaagtaactgggactataagtgtgtgccaccatgcctggctaatttttttgtatttttagtagagacggggtttcaccatgttagccaggatagtctcgatctcctgacctcgtgatccgcccgcctcagcctcccaaagtgctgggattacaggcgtgagccaccatgccctgtcgagtcaggattttaaaactagctctccctgatctttttttttttcgatgaagtctcgctttgcacccccaggctggagtgcagtggctcgatctcactcactgcaacctccgcctcctgggatcaagcaattctcctacctcagtgtcctgagtagctaggattataggcgcccaccaccacacccgactaatttttgtatttttagtagagacggggttttgccatgttggtcaagctggtctcaaactgccgacctcaggcgatctgcctgcctctggcctcccaaagtgctgggattacaggagtgagccaccgtgccgggcctctgatctttataaaaataagataaatggtgaaaattgggaattcttactgctcttatgtaaaaacaagaataattttagtggtctgaattgaagggtcatgagaagcagcaggtatactaagctgtaaatctgtgggactaaactataaatcgtggacaagtggtcaagcagcctttaggaaggcaacaatatcatggcaatactctatttctgagctgatgttagagtttgtattgtcaataagatcatggtaaagtttaaccacaagttttgcagcctttcatgtttcctccatactcgtggaatattacccttccaacacagacatttcccttttaatagagggttatccttattacctccaccacattcactatccattttatatccatatcttgatttctgcccttctaattagtctactttgagtaattaggataaagcatttctgaaatttcattatataagcattaattactgtctcttaggtctaaaataatttttcggtcacattttctaattgccaaaattattccttggatcgacattcatactatttttctacaaacattatattacataaataaaaagaaaaagtttatatatatatataagtattttatggatgaaggtaaaacatgagataatttccttatgtatggaacaactaatattaaattaattctttaaggttgtatttatagctctcttatgcaaggagaataacttaagcaaaatagtacaccagataactgttatgtggtaatagagagattgaattaacactaaaatgtgttaaaacacatatatttataaaatagacttaaatttcaagaaataaaattaatactgttgaaagaagtgtagaaatcatatagtgactttaaaagtacacaagttcccctcatttcaaaggtgtgaatcttttgtgacttttatactagtatttaatactatataaacctcactgtttattctaaatattttattttattttattttattgtagagacaatgtctcactatgtcactcaggctggagtgcaatggcacagtcttggtcactgcaacctccacctcctgggctcaagctgccctctcatctcagcctcctgagtagctgggactacaggtgcatgccaccacacccggccaattgttttgtatttttgtttgtttgtttgtttgtttgtttgttttgagacggagtctcgctctgtcacccaggctagatggggtgcagtggcgcgatctcggctcactgcaagctccgcctccggggttcacgccattctcctgcctcagcctcccgagtagctgggactacaggtgctcaccaccacacccggctaattttttgtatttttttagtagagacggggtttcaccgtgttataaccaggatggtcttgatctcctgacctcgtgatccgcccgcctcggcctcccaaagtgctgggattacaggcgtgagccaccgcgcccggccttgttttgtgtgttttgtagagatggggtttcgccatgttgcccaggctggtctccaactcctgggctcaagcgatctgccctcctccgcctcccaaagtactgaggttacagacatgagctgctactcctggccaatatttcttatttatttatttaaaatatttagtgagtgcttacagaacgtgccggctacttttctaggtactggggtgggggcagggagaaaaagacccctggggtatatagtctacttgggttagtgttagagtagaccattgataaatgtatttgttttgtaaggggatgggggaagccacattttctagttttcaatatacctttataaatggagcatttgctttgataaaattgcaattctgttaacgtctcttaaagtattttgtttctccacaagggattattcagtattaatcattcaatgcgtacgatcagtgaaatcttagcaggccaaggataactcttgtgatactcgtaaaacaaccagaacagataccactttacaaataaaggacggtgtggggatctactgtggtggttagaaaagccctgaatatctgatttgtgactaaaatgtggagagggaggggaagaaaaaagggagaacatgagggccagccagagttaaagaagactctggaattacatttttaattgttaagtcattggtttaacgacaagagaaaaaggcatgttctggctggtaactgacttcagaagcctagggcttcttggacagaagatacaaaggaaaaaactaagagaccaagaaggaagagagtgaacatgatcgttcatagtggtaacatcgatggcttgtagatattaaagccatcactggcagatgcaaactagagatggtggtaacaattttctgatggactttaggagtagtgaccaagctagttggatggagataaatgtaatgaagacatatgtagaagagctctttatttcagcaggtcaaggagtaaccaggcccaaagggcaaggtcacaaggcattgcctctgtgagttttcaacatgcagatgagtgatgtcaccagtttgagaagcctactcaccctcctcccagtcttgattctgaggacagatacttgtaacttgaaaaagttctctcccttcctcctttgggaatcactcctctattctgtgggttttctgactgtatagaaaaatctgctggtatcttaaaataactgctaaggatattgtgtgaatgtagaacctgtaacacacactgttcggtcatttggccctagttaccatccatctgcatctgaatatcccaggcatatctatagcagattgtaacatgttcagatcactgggaggtataatagtacattgtagacagacagagacatattttaacctaaaatcttaaaaatagatgcattggaatggatactctgatctccccagaatattttattttcctaaaatgcctcattcttttccgatctttaggtaaggaggtattttgctttatcaatctgctttccagctgtttgggatttaatattccacatagatgcatgcattttctttgtaaataatgacaaagacagattacataattacaggcataaaattatctcatcttgctaaaaataatacagtaacaggattagtatgtgtatcatctgtatgaattaaccatttatttttattaaaatactaagatccatattatgaccacccttatgtgttcattgtctacttgtttgaatcaagaaacattctggcctttgatttcttgtagttatagatatatggaattggtaatgttgattgaaatataacatagtccctttagcttcagtactttaggaaaaggttcctctgtccactataacatttctcaaacccatgtaaaaacagtagtgtaaatataagcatacacaattaaatgagtgaagtaaaactcattggtgtgactatcagggctttaaaaaagtgtgcagtttgaaaaaaaatgaaggtgattatatagtaaaacaaacatctgtctctttcctactatccctgcactatgtataggacttgcttaattagaaagaagaagacatgatggaatatggtccaaaagtttgaagaacagtgaggggcatcagggcctggatgataaagctggacttcagtggattctgtgttaactgtctagatactgaattattgtgtagtaaatcatcaatgcagagtggaaaccttggaaatgttggctggaccttgactacagttggagaatagcaatttctgtaaggctggctgaatcatagtcagatcatctcagaaaagatgagcagcagtggttaagaaggcaatctctggagtctgtctgcccaggtctgaatcgtggcaggctgtctaatcttgcttttctcatttataaaatgagatgacaaaaatagtatttatttccaaggtatgttgtgaggattaaatgtcagccattgctattgttgttgttaggaggggagttaaatggattttggttttggacagaaaaaatggatttggtttgtaaaagtaatcaaatataagcagaaatatctgctaagctattggagagactgaatagatactaggtgaaagggaagagtaagagttgttattttgtgagtccttgtttttgtttgtggttctatcacagaatacctgaggctgggtaatgtataaagaacagaaatgtattttctcacagttctggaggctaggaagtccaagatgaaggtgatggaatttcgtgagggctctcttgctgcatcctctggagggtgccacggacaatgccatgtcctcaacatggtgaaaggtggaagggtaaagagacaaaaggtggccaaacttgccttttttttttttttttttttttggagacagagtttcgctcttgttgcccaggcacgatcttggctcactgcaatctgcgctcgcctcctgggttcaagcgattctcctgcctcagcctcctgagtagctggcattacaggtgcctgccaccatgccctgctagttttttttttgtatttttagtagagatggggtttcatcatgttgcccaggctggtctcgaactcctgacctcaggtgatccacccgccttggcctcccaaagtgctgggattacaggcataagccaccactcccggccccgaatttgcccttatataatgggattagcctacccagtgggacatagcacccagagccgtatcacctcccaaagttcctacctcctaataccgccacaatggcaaccaaatttcaacatgagctttggaggggactaacattcaaactgtagcagtccttatataggagccacaacccaaaccttagaaaattttgagctccctggagcaaatggaagagcagaggagaatgtccttgaggactacagggaacaagtagatgagtagggtcaagtagaaactttcacaaggttaaggacacctgtgtatgtttgaaggtagagttggagaaaccaagggaggtaatccaaaatgtgattatacccacaggcccttttccacagaaaggtactgagagtcccctgttgccatcagtgaaactttacactattatgtagtattaaagttatttagtgcagtagtagtcaagaatttggcagctgaaatgagctaaatgcccccttgataacctgtgaagatgttactatcctactgtaagtgctcatctgattaccagggagtcatgaaggtactgtggagaaaggggcttcaggtaattagaacttggaagtagccatgtctgttgtgaagagctgggattgtaaacacattttgcaacagtataaaaactgataacaaatataatttagttattctaaatgtaattgttactacagcggagataacagatgtatttagatcagcttctgtttgtgtaaagaaaaatgtaaactattgattccaatttaatgagcactcacaatggttatagctgtgttatttacatagctatgtaacagaggaaacaaatacctagagaagataaatgagagaaccccaaactgaaacacctctcactgggctttactttcactgctgatgacactaatccttttactttactccagcaataatttaatgttttgttttgcatactagaatccttctagtattaggaagaattcaaaaggtaagggagaacccttgtcaatactatataggtaattgctagtaaattttcttttaatattgcctatgccaaattttagaaaatgtaataatcgaagctagtatgcaagcagtagcttctgtaataaaataactttatattatgtaccgtgatgtaaaccttattgcttgctttgatttatatgcaaatatttctttttcttatagtttatactgctttcagctgctatcttagtttttgtgctctagacagtctccattttttccgtgattaccacaataaaataggcaagcaggaaaaattatggctacttcctgtctaattttgtgtatttgtttcagtagcagtaccaatcttttaggcaaccagtgttgtcgatgccatgaatttacagtaaacctgtggaattcacgtatataaaacatagatgtcatgctggtgaattcaacttacaaggcatggaatagaactcttgcagtgaggctattagtttcaggtaatttaaatctcagtgggaaccaataaatggattttgaactaatatatttttgaagtcttcaaagataggagaagattgtaatattctgagtaaagaaaaaaatcatgggtgatttttttaaggtaaagaggtttaaatttaatgaagtgattaaaagtaatttcaagctttattttccctctataaacattgtttttagttgatttaaaggaaattggttaaaaaattaggcttcttttcaatataatgccaaatagaactaaacatatctttcaatgttgagaactttttctaatgggaggaatgtgaaatgacatatttctgaggacctacacagagcctaatgtaatttattcaccaatcccattgttgattaggatggtagacattactcttttctcttttttttttttttttttttttgagacagagtctcactctgtccctcagactggagtacagtggcatgatcttggcttactgcaacctccgcctcccgggttcaaacgattctcatgcctcagtctcctgagtagctgggattataggcacctgccactacgcccagctaatttttttcttttttttttttattttttatttttagtagagacgggtttctccatgttggccaggctggtctcgaactcctgacctcaggtgatctgcccaccttggcctcccaaaatgttgggattacagacataagccaccatgcccggccctagaaattagttttaaaggatattttacactagtttttcatcaggaaaagtatatcttgataaaatgtttttctaattttagaacttaaagggaaatgtataactacattaaagtataggtagtagtaataatcttatagctaattttaagactctgccactaaggtgttataattcttagctccttctcacacatttgttttctaacataaatgatgtgtaacggcagagatcatgagttacatgttcctcatttgccttgtcatatcacctagtgcaaacttctcacacctgtaacctggaatgataataatttatttacttctttgtctcttttaggacactgtgggatatttgaaggttagagcttggtttctatttctatgccagacaaatcttacatagggtttgatacttagttgttagccagtaaaaatctaggacggctcctacaagaaacatttaaagggtttggcaagacctagggccaaccacctcccaacccgtccccaccctccaaaatgttttgaggaaaattaacacccctattattattagggaagcatgcaaattgtgtaagtaaaattataagtcagagaaaatcgaaatgtccatgtggaatagttaacatctttttgtttctgttatttcagggactgtcatatccaagaggataatttgttactgtgtgcatgttctattagtactgtaagcccctttatacaaaggatgcgtttaatttttatattcccattatgtctgttacctagcattgccaagaatacaatagaggctcattaaaatcttgaatgtatgatcagtgtatgttgttgccagcacaccctcccaactctcccattagatgacaagcaatttgaggggagcacccaagtatttgtcatttttaaattcttctctctttcacactcaacacagtgccacaggtatagtaggcgtgtgtgttgaaggtttttaagagcattcccactttgggggatttgttagaaggactcacaggactcagaatatcatttcactaatggcgaagatttattacagtgacatagtagagatgcacagccagatcataggggaaaagatacaggcggagtttggaggaatctactggtgggctgccttatgctgtgtccctcccacgaggggtcacatagaacactcttttccttcagcagtgaaaatgcagcaatatatgtgtgatgcacctgcccaaggaagcccattagagagtcagtgcccaaggtttttattgggggccggttatgtagacacactctgtttagcatgtaccaagatttcagactccccaaagtaaagcagatattcaatatagactgcattgtttgtacaaacaggcatagtaaaccatccttatcagctaaggagcagtggggacactccccaaaatccaggttcccagataccagccaagggccaactttgcatgcaagcctttctataaatagcagtagtaggcttgctatgtccacttttctgcatagcatggctttgtatgaatactgctttaggcgggagaaggaaactgtatggcatttctttcagtacttagtcttaggctcaatttgttagggagattaaggtttcttttctttgttagaggtgcttctaatgtcttggttgttttaagtgcctgttcgtcgacttgcatcattgctgaattccttttttgaactttatgaatgtaccaaacatacctgatccccactcccccaactagagcttgaaagcttgctgaaagtacagggcttaaactccacgtctccttgcaaatacagtatctaggcatattctctgttgattcctggtttcaggtagttgtttgagttccatataatattatgttggcttttattcagatcgtgcaattttctttattttggttggtgggctggggtattcatagtgcaggacctaagaaagcagtaaagcaaagaaaaaagtgagaattccagaaaatctgggtatattattatagtatcacatgtcctaaaatgttcaaaatttaatttcttttttgttttttgtttttttttttttgagacagagtttcgctcttgttgcccaggctggagtgcaatggtgcgatcccggctcactgcaacctccgcctcctgggttctagtgattctcctgcctcagcctcctgagtagctgggattacaggcatgtgccaccacgcccagctaattttttgtatttttagtagagacagggtttctctatgttggtcaggctggtctcaaactcccaacctcaggtgatccgcctgcctcggcctcccaaagtgctggaattacaggcatgagccaccatgcctggcttcaaaatttaattgctgagctgtttagatgaatccctgatagcatctccatggtgattgttagaaaatcatctttgattactgcttcatgtgtttttctgtaataacacattttctgattgtaaaggtttctatcaattggtcattaccttgttgcttttggaagaacaattatggctgttttatattcaacagaggcccccttatcagaaacagtattgtcttcactttgcaaataattgcagtattgtcttcatttttgcaaataaagagggaaaaaaaatcctatgtatcttagagaattgtgggtgtcaactcaggttctcacccagttaattgtacgttttgaaaatttaaaaaaaatgaaagggctattgacagtgagatgtgacagctaacaggagaaggaggaactataaaaatatagtagtcttcagttgtttcacagagaggaaaacaggcccaggctcttcagtggttttggagggcagtgctgtatgattgcgcagaatagaaattgatcttgatgaggtattatcaagaggagattcaatgtactcctcatcagtgctgtctgtgtgtaatattttcaaaaagttttcatcgggaatggttagctttctccccccttttagttgttatacttaaagagatatctttgacgtacacagcacacattcatggatcactgattatgcctgataaaggactcattgtattttgctctctttatgaaaactcatggaaaaaaataggtatctataacttatttagcacttagtataatcaacaatgttatgggtacaacaacagagaactacaccaaatgaaagagggagtttccagaaatatttagtaaagtttggagcatgtttttcatgctcaccatttccccacattaatatttctgagattaatttccaaagaaaataattggtcaccaaatatattgttttaaaaaatgtttcatgtttttgctgaggcaaagaagtcttaacactttgtggagaaagggaaggcaattaatcattgaaataagataaaagatacttcagccacttgggaggctgaggcatgaggattgcttgaacccaggaattggaggctgcagggagctatgatcatgccactgtcccccagcttgggtgacagtgagactccttttttttttttttttgagactccttaaaaaaaaggattaaagatgcttgaaccttggtgccatcccatggggaggaaaaaacccctatttttcagatttctgcagtgcagttctttggctagctggtagttgtacttgattaagtagaagagggatgatgctggttttattacataatggtctatttctgtcctagcatgttcggtaggcaagcctccaataacgtttactgaccacttactgtgcttgccaggcaatgtgataaatgtttttttttggatgacctcatttaattctcaccgtaatcctttggggagatcatttttatctccagtttaggaggcggctgaaattcagagaagttaactaacttacccagggttagttgtgcctgatgctcaaccctgatgtcttaattgctatactgtgctgcttcctacccaaatgtgctctttgagtttcatgatatggtatttagtaggtttgccccagtctctacagggaaacagggaagattgtagacgtaagaatatacaagaaatgctaagtggctctttattcttctgagagtttctagtaggggaatttacctataataaatgaaatatagacctatcattccttacttttatgttccaaattgtgaaacagaatgttgttttatgatatttacagatctctatatggttttgtacagttatacttcctggattgttttgatactttcttacaagcagtccttgattgctccttttatagacggtttatgtaacctcctgaacaagaatgcatggccaccataatgctggagctctcctttgttgtttttagtgtcctagtgctaccaaagctggaatggtggtcctctgctcctgacaaacaactccattttcagggtttcctcttgcctccatccttccctgccagcagttgcaaggggattcagagcttagtacttttattattatgggagtatttttcaggatagctttactgcttaagcattttatttaaacttacttttcttgtgaaatatgtcccagagggttttattttttattttttgccaactgatttacaaatagactttagaatacaaaccacttataaattgggactgcttgtataacacatagaggtttgaggatactttttctatcagattagattgaatattcttattaatttgaatcctgtgataaatatgatattgtgtatgctgcagttagtttaacacttcagttgctataaaagcataatttcaatagtatgtaaatttaatgtaactttggagacttagagttggtttgttcattttgatgttaatttatttaaattttagatattttaaaataagtttgtgtaggcctggtaatgtattttattccaatgtcattatattttgaaattaaagttactttaaaataggctccaaggaggtgttagttaaattactagtaatgcatttggatgctctgaaaaaagtatacttgtcaaggaataaacataatgggatggcagtagaatccctttataatgctgctgttacatggacactatctgttatgaggactgattttgctatatcattttactatatagagtaataatttcaagagcaataagttttttaattttttattttttgagacagggtctcactctgtcgcccaggctagagtgcagtggcgtgacctcggctcactgtatcctctgtctcccgggttcaagcgattctcctgcctcagcctcctgagtagctgagtagctgggattacgggcatgcgccaccacacctggctaatttttgtatttttagtagagactgggtttcgccatgctggccagcgtcgtctccagctcctgatcacaggtgatctgcccacctcagcctcccacagtgctgggattacaggcacaagtgaccgtgcccggcccccttccactttttaaacaacagaaatgaaacttattaagtaggggccttcgatctggaggctgggaagtccaaggtctatgtgctagcatattccttttttggtgagggcccttttcctggctttcagactgttcccttctcactgtatcctcacatattaggaagaggaagctttggtgtttcttcctcttataagggtgctaatcctatctggggtttccaccctcatgatgtcatctaaacctaattacttcccaaagatcccacctcctaatacaatcacattgcaggttggacttcaacatttattttgcgggggacataaacatagtccataattggtgttttcataaaaagaccatatatcaaacagtagtgtggtgcacagtaaataagtgccatgggcgttcagattagagaaaaactattgaggtgagacagctagtaaggtagaaagacagacaatgtgttgttcatttatgtatctggcttaatctgttcaggctgctataacaaaataccatacgtggattagcttatacacaacagaaatttattgctcaaagttctggaggccaggaagtccaagatcaggatactaacagatttgatgtatggtgaggacttactctatgcttcatagatggcaccatcttacaaccttcttacctgacaaaaggggcaaacaagttcctttgggtctcattatgtggcactaattccattcatgaaggttccatcctcatgaaatagttgcctccccaacggccctaactcttaatactattacattgggattaggtttcaaaataaattttggggagacataaacattcagaccatagtagtattcttagtgccgagtacaatgcctgaaacaaagtaggcattcaagaaaggtatgctaaattgaagaattaaaaatcatggaaatagatattttgaattggcaggcatcttacaaatcaggtagtccaagttgcccagaccatttcaactccgctaggaacattaaaataacacaaagccattttacactcattaaattgccaaaaaaaaaaaaaaagtctgataataccagctctcattttctgctcatgagactgtaaataggtaaaatcatgttggagagcaaattggcatcattaactgaagttaaagataactctatcctgtgatataacaaatctcatttaatatacagactctagagaatgtctcacctatgtgattgattgtattagttttctggggctgccataacaaactaacataaactcggttgcttaaaagcttagaaattcattgtctcatagtcctggaacccagaaatctgaaattaaggtatcagcttccctccctgtgatggctctaagaaagaattcttccttacctctttcagctttggatggatccagagattccttggcttctggctgcataactccaatcttttcttccaaattcgtgtcatcttctgcttttcctagtgtaactcttctctgtatgtcttttataagtttatttgtcattggatttagagcccattcagataatctaggattgatctcattttgagatccttaattatatttgcaaagatcctttttccaagaaaagtcacattcacaggttccatgagtttgaatatggacattttttttggtggccaccattcaacccactatttcagcaaatatttaaagcagtggtctgtaccaaaactaactatgacctccctgtcatttgttctggtcttctagttccttgtaggtcacaggttatctcactgcaacttcagtaataaaaaaatttgagggaaaagtgatagtagctttatttcattacttatatatttcttgagactagttttatggcctggcatatagtctattctggttaatgttccaggttaatgttccagttatgcttgaaaaaaaaggtatagtctatatttggttaaagcatttcataaacatcatttagatcaagtcagttggtagtgatgttcaagtctcctatttttttaaaaactattttctgtctacttattctaccaattattgaagaggcacagcgaaatccccaattataattatggatttatctatttttagttctatcagtacatttgcttcttgatttttgaaacaccattattatatacacattgaagattatgtcttctttattaaatgatcattacataatcatagattgtacttctttatctttggtcatattcgttgtcctgactctgttgtgtaattatttacctactctagcttttttattattatgatttgtgtgatatatcattttgtatccttttacatttaacccatttttatctttatattaaagtgagtcaggtagacagcatatatttgggtaattttttaatgctttgtgaaaatgtctgccttttaattgatatggttaatgcatttacatttcatgcagtgggccctttgtgtctgcagttttcacatctggagacacaaccaacggagaaatagtggatgcagaacctgtggatatggagggctgaccatgagggacttgagcatgtgtggattttggtatccaagaggggtcctggaacaaagcccccatggatacctagggataactgtataattattaatatgactgtatttatttctaatttcctttttttgttttttatttttttatttttagttttgttttgttttgttttgttttgagacggagtctcactgtatcactcaggctggagtgcagtggcgtgatctcagctcactgtatcctctgtctcccgggttcaagtgattcccctgcctcagcctcccgagtagctgggattacaggtgcatgccactgcacctggctaatttttgtatttttagtagagacggggttgcaccatgttggctggaatggtctcaaactcctgacctcaggtgatccacctgcctgggcctcccaaagtgctgggattacaggcgtgagccaccacgctggcctcttatttgttttctatcctatctgtcctttgttcctttaactctttttttgccacatttggattgtgtgtcattttaactattccacttgatctcatgtattggcatattagatatggctctttgtttagttttcagtggttactatagaatttatattatgcatcttaacttatgacagtctagctttatatagtattgtatactttttctataagcaccttgcaatagcatccttatgtttgcacccccatcttttttattcttctcagacattttacttgtatatatgttataggtctgaccatacatcatattaattttttctttaaataatttgttttggggaaaaatagactgtaaacaatctcttatatattctcacactctatttcacacacatttctggcactcttcattcctttatgtagatctcagtttctatctgatattaattttctttagcctgaagaattttctttaagtatttcttatagtgcaggttttcttgcattggattttgcactgtatattttcagattatgtttgtctataaatgtatttatttcaccttcattttggaaagacattttcacaggttgcagatttctaagatgacagatttctctttttttttggtttgttttctttcagaaatttaaagatttcatccattgtcttctgagttccattttttttttcatttagaaaagacatttgggccaggtgcagtggctcacgcctgtaatcccagcactttgggaggccgaggcaggtggatcaccgggggtcaggaattcgagagtagcctgactaatatggtgaaaccccgtctctactaaaaatacaaaaattagcaaggcatggtagcacatgcctgtaatcccagctactagggaggctgaggcaggagaatcgcttgaactcgggagccagaggttgcagtgagcagagatcatgccactgcattccagcctgggcaacagagcaagactctgtctcaaaagaaaaaaataaaaagaggtttaattggctctgcagaatgtataagaagcatagatacttctgcttctgtgggggtcccaggaaactttcaatcatggcagaaggcaaaggagaagcaggtacttcttacatggaaggagcaggagcaagagacggagggggaggtgccacacactttaaaaaaatttacaacagtcttttttctttttcttcaatttttaagttaaagggtagatgtacaggatgtgcaggattgttacataggtaaatgtggagttgcattgtttttgataagaagtcaccaatcattttaaactctgttcccctctttgtaacatgtctgtctttctgactgctattaatattgttttatcattaggttttgacaaagtgattatgatgtacttttgaggtgtttttaatttttacaaatgtttatagtcagctctctgtatctgcatctgtggggtattggtgcaggaccccctgcaaataccaaattctgcagatactcaagtctcttacataaaatggtgtggtacatttggctctccatatctgcgggttttgatctgtagttggttgaatctgtggctgtgaaacctgcagatatagggagccgactgtatctcgtttgggattctttccgttcttaaattcgttggttagtagttttcatcaaatctggaaaattatgggccattatttcttcaactatttgttttgatctatcccttcaacattttggaaattttttctgtagtagatcactttatattgtccatatgtcactgaggctctgatagtttttttagcctttttttccctctctgtgcttcagattggtagttctttttaccattatcttaatttcactcatcttttctattgaagtgtctaatctgctggtaagccatacagtgaaaatttcatttcagatatggtatttttttcagttctcgagtctcatttgatttctttttttttgtagtttcatttctcttatttatgttaatgttttgctttatatcttgtatataatactaatatctgttttaaagtgcttacctgctattcccatcatctctgtcatgtctagatttatttccagtaagcaatctttttctgcttcttcaattacctagtaattttttgataggatgctagttattagaatgcgacattgttgaatgttggaatttggttgtcttaaaagagtattaggctttgttctagcaggtagttaacttacatgcaaatcaacttgatcatattaagacttgtttttaaactttgcatgaatctaaagtagcatttactctggatatggtttagtcctacttctaacatgtgtcctttttctgatttccaaatgctcaatgaagtctctcccctctgactgatcagaactcaaatgtctctcggtcctgtgtgatcttcagtgggtatttattcttctctggtagttcttctgatagttgttctgtgcccattctcgtggagtctcctctaaacttgtacggattgatattcagccagactcaactagactccactgcagatatctggaactgtttttttttttttctgtggggattcctcttctctggtaatgtgccctataaatccaagctgccactgccttcctgatctcccatctctcttttttcagttctgtaagcctgcagtactctgcatggtttgtcccctccctgcactgtaatgtgtacttccacacacaaaggctgggtggctatagggctcacttaatttgtttcctttctctcagggatcacagccctttgcagcctgttgcccaatgtctaaaaacagttgtttcatatattttgtctgattttctagttgtttacagatggaggtctagtctagtaccagttacttctttatggccagaagcagaaatctctaaatgtagcttttatagatggatgaggtgtgttcggttgtctttctttagttaataggcccttgaatttgtattcatttttatcttgggcactgcattttaaaagtaacctttcttggccgggcgcagtggctcacgcctataatcccagcactttgggaggctgaggcaggcggatcacgagcttagaagttcgagaccagcctggctagcatggtgaaaccccgtctctattaaaaatacaaaaattagccgggcatcgtggcgcgtgcctgtagacccagctactcgggaggccaaggcaggagaatcacttgaacccaggaggcagaggttgcagtgagctgagattgcgccattgcactccagcctgggtgacagagtgagactccatctcaaaaataaaataaaatgaaataaacctttcttaattctagaaaattttacatatattattatatataagattatatataaaatatataaattaccatgggttaatcctataagtttaatcagtaatgtagtgatccttgttgtttctacaaaataattcttatatgtgtgagagacatttacatgctgaattcgtaggtagtctgtttcaagtaaaagaaaaccattacaattgtgacctacttttttccatttgattttattcactaatagccatgtgttttgatagtgtataaagcaacattttattagtttctcaaatcccttgctatgctcttttgcagaatgaaatttttcactatttatgtcatactggagaatatagaatgtgaaaatataattgtccacttctcttaactgcaattatagtcgaatagtctcacaagatacatttttttttccccagatgtaagtgaagcctcttttgagttcagagctaaaattaaggactattttagattgagtccccaggacactcagtttttcattctaggtagcactatctcatttttacatttcctgtgttgtctctgtagatggttagaaaagcatacttcatcagaacgatgggttactgccagcacccctctgtgagatggttattaaaagcatgtcctttcctctccaattcagagtgcaaggttttcactgatgttatatacttgagctcttctgacacaagggagaggatagctaaaacagctctcaaagctgggtttatagcctttcctatcatttggcatttcactgaactaggtgaggtggttcttaatctttctctacctctctatcattaacatggttgatcgtcagtgagagctgcagtcaaacaaaaatggaaactttgtaatttatgtatagctttaaaaaggcaaagaaatgaaggattattgcagttggtgcaatccccgatacaattaatatcaaatgcatataaatcctattagagatctgtcatgggtgaaaaaggaatatgaaaaatgcgtgacctatctttattagattcagttagagagagaccatacagagctaaggagctttacgaactgcatattaatcataaccagtcttctgagataaacctatttcttgtaacttatcaaagccatacagaagattagtcattccctttggtaaaggaatgttttacatattgttctgagttttgaacatcacagctttaaaagctgattaacagatattttaatactaaaatatatctcattgaattatatagcttaggcagctattatcctgtaatgctacctcaatagggagatgggctctttgtcaaaacctctgcatcattgttttgttgcatattgaacaagacactctagggagttgtattagagaccagacaaaagaactttgctacagcaagcaatcattaaatcatgcagaaatatttctttcttaaatctttactttaagcaacaattggtagatgccagcaccattttttaaatgtcactttcaattcctgaagtcttttatctctttgagaaggaggggaattagcttaaggggacggttaagaccatcatgttaatacacggtattactaaagataggggatgtattaacagctctaatctgacaaagataattaagattgtattttaaaaatgtgagagagggtttcataagattatgaaacttttagataaaacataaagactaacaggtataaaatggattttgtattactgtctcacaaaacttagagatgttgagtgatataagcatttagtttctgacctcctgttaccacttcagtgcccagaatttatgtcatgtcaataaaaatacagaaccatctcatgatgaagatttctatacttgataatatataccattttatatatttgtttttatatttctaaaataataatcttgtttaaaaagctaaaaaatactgaagtatatgcattagaaataaaatctccccaccctacatggtagaggtactactattaataatttggtatataatccttctaaatattttttaaaatacatttattgaagggatacatacacagaaaagtacacaaaccataatattacagctcagtgagttatctcaaagtgaatgcacacatataaccaatacccagttcaagaaatagaacaatactgtctcttcccaattcctactgtccttgtcctccctaaagacttccagtaatttgacttggaacagtacagtttatttctgcctattttttgagttttacataaaataaatcacagagtatctacttctacctatctggcttctttcacccaatcccatgtttgtgagaatcattcacaggcctgagtataactatagttttaaattttgttcttctgtagctggggttgggcaccttattctaataagccgtaaatattttaggctttgtgggtcatatggtccctgacacagctttcgtaaaacaaaaacatcaatagatgatatgcaaatgaatgtgattttgctctattaaaactttatttgtaaaaataggcttcaggctagatttggcctatggactgtagtttgccatacatgcaataaataaatagaatactctagtatactgtagtatttcattgtatgaatatatcacaattagctgagccattcaaatattagcagacatttgtgtttttggtatgaatgcccttggaatgtggttttgtataaatatgcatgcatttctgtttggtatatggaattgcctcatgatagggtatatatatagggtaaacttaagtagtattgccaaatggttttccaaggtggttgtattagtcagcgttctccagagggacagaactaataggataggtgtatacatgaaggggagtttattaaggagtattgacccacatgatcacaaggtgaagtcccgcaataggccatctgcaagctgaggggcaaggaagccagtcggagtcccaaaacctttaaagtctggaagctgacagtgcggccttcagtctatggctgaaggcctgggggctgctggcaaatcactagtgtaagtgcaagagtccaaaagctgaagagcttggagtcttacattccagggcagggagcatccagcacaggagacagatgatggccggacgactccgccagtctactcattccaccttcctctgcctgcttctatcctagccacactggcagctgattagatggtgcccacccagattgagggtgggtctgcctctcccagtccactgactcaaatgttaatctcctttggcagcaccctcacagacacacccaggaacagtactttgcatccttcaatccaatcaagctgacactcaatattaaccatcataatggtagattaatttacacccctaccagtagttatactcatcatcacttgatattgtcaatcttattaaaagatgttttctttactaacttagattatacataataaatgataattttatttttaaaattaaagaatgagagaccctatatatcaatttatgtttgcctgctcagaaaaattcatacagaaaatctgatatgttagcccctaatttaaccaatatgttaaatcttaactagcctttaatcttaaaatgataaagaatctccacagcgtatattatgtaatttatatactgaactgattttcattctcaacagttgcctagtagtaacattagtgtagctatgcagaacaaagaaagaatacctaagccctagataacaatttctgcacacatactctattaatagcactttccaaaattatctacgatctttttcttagaactcaaatccaaagtccttttttcaaatgtaatcttcaaacttgttttggcatttgataccacctactacccattctttcataaaattcctgtgctggctgggtgcggtggctcacgcctgtaatcccagcactttgggaggctgaggcgggcagatcacaaggtcaggagtccgagactagcctgaccaacatggtgaaaccccgtctctactaaaaatacaaaaaattagccgggcacggtggcacgcgcctgtaatcccagctactcaggaggctgaggcaggagaatcgcttgaaccctgcaggcggaggttgcagtgaaccgagattgcgccactgcactccagcctaggtgaccgaaaaaaaaatttcctgtgctttctacttatctgtaccctgcttctctgttgtctgtgtcctagtatctcatctccctgaccggaataattttgtctgtttcctgagtttttgttcaaggctgtttgttcttctcctattaaaatttgcctggcatcttgagttcatattatcagccttatttggatgctcctaaatttacatcttcaatccagacttctcacctgcctaatggccttatattttcagatacctagaaggtatcaccttttatctcattttctcaaatttaaatatccaaagtaaaactcaaaatgttgatattcattttctctctctgcctctgccatcctctctaccaccctaaagtcccaacattccccattctccatttagcaaataaagatagtagaaagaagtgttttattaagcattgataagtagcaaaagatagaataatttctattgttggttaaatgaaagataagggaaggaatgacacattttatataacgcttattaggaaagaaatgtgctgtagtccaagtaatatgaaatattattaattttaatattcattcaccaaacaccaatcattttacagtgataatttgggatagttaggcaagttaattttggaaaatagtgcaaaagtagagctagatcattctaattgaacaatgataatagttcagttcttttagtgttccaaaaataaaataataaatatatgctaaaatttaaaaataatttattcagcataaataaatgataactatcatcttgaaaaagtaattgctctgggtagtaacaaaaagcctgtctttccagtgaggcactaatgtcctctgaatctaaatggagttattttcaaacttttgagaaaagcatataatttatcagggtgtcatttttaaatgtggaagcccttaatctcataaggaatgaggagagccactgaaattctttaatattctctaacatgcaaacaaaaagtagggtaatactgaggtgagttccctggtgataaccctggcaacttattagggtttaatataggcaaaataatgggaatgcctagatgttccaggcattattctagcagattatcagtacattctagtaggacagattaaaaaaatgtatgtattcatgcatacatccatatacatacacatatatatttatacacacacacacatacacacacatatatatacacatacatatataatcataggtgtaagtgctatcccgaaaagaaatagagcagagtaaggagtaccatggggtgggtgttgcaattttaagtaggatgatcagggtgggccttgtggagaatgtgatacttgagcaaagatgggaacaaggcaaggtagtgagccaagaagatatctggtatggttatatttagtaggtttttttttacttgtttctcactttactcctgaaaggattcagtgcctgcattatttaggtggtcaaaactaaataaaaacttgatatattaacattttattcctttggtaatatagggggaccatgctaaagagaacttagtccactctggggaagtgctacgtcaaacttttgtttgactgtcagagctctcactggggtacctaccatgctgccacggggtggagtatttcactgtaatgtttctataccttatgaaattgacttagattgaaaatatcccaccactttagcccctgagcctgattctttttaagtgcagattttctaatctaaaaatcaaataagagagaatatgagaaggttcaatggaaaatcctaggtaatgtatagctgtgtaacagtgactctttggaaacgtttcttctgatgttattatctattgagtggaataatgctgattatttctggttagataaaggggaaggcagataagaccttagggtagcccataaatcacatagtataggaaattaccttttccaattatgtagaagctgcccttgttgctgactttccccattattcaccatcactataattgggaaaaccagaaagcttggcaagagaaatttgaatagcgagctcttagtttgttatgttgctgctatcactggtataaacacaggtgtagttttacaggatgtttggtgattattctatgcagaaacctaatagtcgtgtcacaaatttctacctcagtatccagaatcctataatctgttttgggaattttccttttacttatatgtaattttacagataaatcctcagttttctagtatggcatttcaccactgatgctgaaattagaacattgagggcttgtaatttgaaaatgtaaagattagaaattatatttcatagtcgggtgtggtggctcatgcctgtaatcccagcactttgggaggctgaggtgggcagataacctgaggtcgggagtttgagaccagcctgactaacatggagaaaccctgtctctactaaaaatacaaaattagctgggagtggtggcgcatgcctgtaatctcagctacttgggaggctgaggcaggagaatcactgaaacctgggaggcggaggttgcagtgagctgagattgtgccattgcactccagcctgggcaacagtagtgaaactccatctcaaaaaaaaaaaaaaaaaagaaacaaagaaattatatttcatttgtcctgtctatatatgatccaatgtacttttgctttctggcttctggtttctgcattttttttttttttgagacggagtctcgctcggtcatccaggctggagtgcagtggcgtgagctcagctcactgcaagctccgcctcccgggttcacgccattctcctgcctcggcctcccgagtagctgggactacaggcgcccgacaccacgcccatctaattttttgtattttcttagtagagacggggtttcaccatgttagccagggtggtctcgatctcctgacctggggatccacccgcctcagcctcctgaagtgtagggattacaggcgtgagccaccgcgcctggccctggtttctgttaaactggacatgccactttaacattagctcattctttatttgcttagccaattatatacatttttacccttgcaacaaagaaggataggcatagatgttctggacttattgttgaaggagaatccaggttaataatctgactaggctagtggacaaatttaagtaaggaaaggaacatagttaactatcataggtctgatacacacgtttcagtgttaaagaggaatcactaatagtctattattcacagataaactgaggtacatgaaaatgttaaagagtttattttagcaaataaactcttgaatccagcaatcccagatgataagtggctcaggagttccacccaagaaacatgaggtgaagacttttgtcagatgaatacagaagcaaggcaaagaaaatagtttgattggctaacgtggagcggtagccttatttggatcattcaaatgaaaagtccccagttagagattagtttcgaattgattacacttaattttcgttttcctaaaatgtgattgttacactgagttgggtttcagtttgcttacataggatcccaggatgctgggtcccctcagtcttatggcctcctgattaattaattttaacactaggaaactgggaaacagaatctgggactgaagaagagggtctgagctaagaaaaaagtcctaaacagaggtcagagacactaggcaaaggaaaaagtgtgccaggaattcaataaacttggtgtggagctaaagcctttacaattatgggctttcctactgataagagtagatcactgcaggaaggacactcagaggacacctggtctatgaggctattggggaggatggaactccatctaccacaagtgagatttggtattgtagaaatagcaaaaaaaaaaaaaaaaaaaaaaaaaaaaaaaaaaaaaaagtctccttgtgatccttaaaaaaagatttgagccctgtttgaggttgatcttttatatgaattaaaagtaattatatctcaaagaatcagtgtaaaatgtatgtattgtttggtttcatgaccctttgttattacttaccactctaccactgcagttcctaggtactttaattcagttgccatccttcccactctctctgagctccataatagtgctgatttaacaaatactcactaaatagacaaaaccctacttaccattaattatgaactgaaatgaagcataaatgtggaataaataaaggatataatgagaaaatgtacaaaatgcttcaaatgcaccagtacccattatatatcactctaaaaattaatcattatattaaagttatagtgacaaaatgttttttactaagcagaagtaaaatttttgtgcattctttctctatcccacctcatattttgaatatatctgcaaagctggtttaaatcttgcttaaaattttatgttaaaaaatgtatgcacatcacataaacatggtaatgctcaattgtccattaaggaagacatttcacattttcaacatgaatgcttttctattctaaacatttttattaagccatttattcaaccagaggcctgcacagtaagcaatagtgtagttgtttttcaactagtactctgtcaggaacttagatagaaataccacattgagaaaaaaagtctttaacagaaatctaaaaacaatcattggtgttggactgtaaaattagtttagagttggattttatgactttttaaggatactacctgtaagttcttttactatttttaccatttctcttaaattttcttctattgatggttgttttaaattacgtgatgccagagattgtatttgtatcctttttctccactcggaaatgctttttatactgccttgaatagtaccatgtatttatgtattttaaaggtgttttaagacatgcttggtaaagatgttattaattgcttatgcatatttcactgattgacatatacaataaaatagtaaattattaaactttttaaacacccagccacaaatattgtttccttgatattgcatgacaactttgcatagtgctctattaagtatttaatataaacaagatatctctctctccacccacttttcctctccgtcttctctccattgcaacttttctggaaacttcttcctagtccagtagtagctggaagagaattcctcttattccaaaaaagtaatctccctatttcaaagtacaaataaatcaatatgtttgcagatcccagcttcatattgtatggcggtctttaaaaaaaaaatgtggttaaaaaaaaaaaaacataacctgagatctaccctcttaagaattttttaagtgaatagtacaatattgttaacgacagatataatgttgtataacaaatctccagaacatttacatcttgcatgactgaaactttatgcccattgcaccacaactctttttttttctttctttctttctttttttttttaatcatactttaagttctagggtacatgtgcacaacgtgcaggtttgttacacaggtatacatgtgccatgttggtttgctgcacccattaactcatcatttacattaggtatttctcctaatgctatagctccccctgctccccaccccatgacaggccccagtgtgtgatgtgccccaccctgtgtccaagtgttctcattgttcaattcccacctatcagtgagaacatgcagtgtttggttttctgtccttgtgattgtttgctcagaatgatggtttccagcttcatccatgtccctgcaaagaagatgaactcatcattttttatggctgcatagtattccatggtgtatatgtgccacattttcttaatccaatctatcacagatggacatttgggttggttccaagtctttgctattgtgaatagtgccacaataaacatacatgtgcatgtgtctttatagtagcatgatttataatcctttgggtatatacccagtaatgggatggctgggtcaaatggtatttctagttctagatccttaaggaattgccacactgtcttccacaacggttgaactagtttacactcccatcaacagtgtaaaagtgttcctatttctccacatcctctctagcatctgttgtttcctgactttttaatgattgccgttctaactggtgtgagatggtatctcattgtggttttgatttgcatttctctgatgaccagtgatgatgagcattttttcatgtgtctgttggctgcataaatgtcttcttttgagaagtgtctgttcatatctttcacccactttttgatggggttgtttgtttttttcttgtaaatttgtttgagttctttgtagattctggatattaaccctttgtcagatgggtagattacaaaaattttctcccatcctgtaggttgcctgttcactctgatgggagtttcttttgctgtgcagaagctctttagtttaattagatcccatttgtcaattttggcttttgttgccattgcttttggtgttttagtcatgaggtccttgcccatgcctatgtcctgaatggtattgcctaggttttcttctagggtttttatggttttaggtctaacgtttaagtctttaatccatcttgaattaatttttgtataaggtgtaaggggggaatccagtttcagctttctacatatggctagccagttttcccagcaccatttattaaatagggaatcctttccccatttcttgtttttgtcaggtttgtcaaagatcagatggttgcagatgtgtggtgttatttctgaggcttctgttctgttccactggtctgtttctctgttttggtaccagtaccatgctgttttggttactgtagccttgtagtatagtttgaagtcaggtagtgtgatgcctccagctttgttcttttggcttaggattgtcttgacaatgtgggctcttttttggttccatatgaactttaaagtagtatttccaattctgtgaaaaaagtcattggtagcttgatggagatggctttgaatctataaattaccttgggcagtatggccattttcatgatattgattcttcctatccatgagcatggaatgttcttccatttctttgtgtcctcttttatttcattgagcggtggttggagttctccttgaagaggtccttcacatcccttgtaagttggattcctaggtattttattctctttgaagcaattgtgaatgggagttcactcatgatttggctctctgtttgtctgtttttggtatatagaaatgcttgtgatttttgtacattgattttgtatcctgagactttgctgaagttgcttatcagcttaaggagattttaggctgagacagtggggttttctaaatatacaatcatgtcatctgcaaacagggacaatttgatttcctcttttccttattgaataccctttatttctttctcctgcctaattgttgtcctggccagaacttccaacactatgttgaataggagtggtgagagagggcatccctgtcttgtgccagttttcaaagggaatgcttccagtttttgcccattcagtatgatattggctgtgggtttctcataaatagctcttatgattttgagatacattctgtcaatatctagtttattgagaggttttaggatgaagggctgttgaattttgtcaaaggtcttttctgcatgtattgagataaccatgtggtttttgtctttggttctgtttatatgctggattacgtttattgattttcgtatgttgaaccagccttgcatcccaggatgaagcccacttgatcatggtggataagctttttgatgtgcagctggattcggtttgccagtattttattgaggatttttgcatcgatgttcatcagggatattggtctaaaattctctttttttgttgtgtctctgccaggctttggtatcaggatgatgctggcgtcataaaatgagttagggaggattccctctgtttctattgattggaatagtttcagaaggaatggtaccagctcctccttgtacctctggtagaattcggctgtgaatccatctgatcctggactttttttggttggtaagctattaattattgcctcaatttcagagcctgttattggtctattcagggattcaacttcttcctggtttagtcttgggagggtgtatgtgttgaggaatttatccatttgttttagattttctagtttatttgcatagaggtgtttatagtattctctgattatagtttgtatttctgtgggattggtgctgatatcccctttatcattttttattgcatctattcaattcttctctcttttcttctttattagtcttgctagtggtctatcagttttgttgatcttttcaaaaaccatctcttggattcactgatttttttgaagggtattttgtgtctttatctccttcagttgtgttctgatcttagttatttcttgccctctgctagcttttgaatttgtttactctcgcttctctagttcttttaattgtgatattagggtgtcaattttagatctttcctgctttctcttgtgggcatttagtgctataaatttccctctacacactgcattaaatgtgtcatagagattctggtacactgtgtctttgttcttattggtttcaaagaacatctttttctctgccttcattttgttatgtacccagtagtcattcaggagcaggttgttcagtttccatgtagttgtgtggttttgagtgagtttcttaatcctgtgtcctaatttgattgcactgtggtcggagagacagtttgttgtgatttctgttcttttacatttgctgaggagtgctttacttccaactatgtggtcaattttggaataagtgtgatgtggtgctgagaagaatgtgtattctgttgatttggggtggagagttctgtagatgtctattaggtctgcttggtgcagagctgagtttaagtgctggatatccttgttaacctgctgtctcattgatctgtctaatgttgacaggggggtgttaaaatatcccattattattgtgtgggagtctaagtctctttgtaagtctctgaggactagctttatgaatgtgggtgctcctgtattgggcgcatatatatttaggatagttagctcttcttgttgaattgatccctttaccattatataatggccttctttgtctcttttgatctttgttggtttaaagtctgttttatcagagactaggattgcaactcctctttttttttttgctttccatttgcttggtagatcttcctctgtccctttattttaagcctatgtgtgtctctgcacgtgagatgggtttcctgaatacagcacactgatgggtcttgactctttatccaatttgccagtctgtgtcttttaattggagcatttagcccatttacatttaaggttattattgttatgtgtgaatttgatcctgtcattaagatgttaggtggttattttgcccattagttgatgcagtttcttcctaccatcgatggtctttacaatttggcatgtttttgcagtggctggtactggttgttcctttccatgcttagtgcttccttcaggagctcttgtaaggcaggcctggtggtgacaaaatccctcagcatttgcttgtctgtaaaggattttatttgtccttcacttatgaagcttagttcggctggatatgaaattctgggttgaaaattcttttctttaagacttttgaatattggccccctctctcttctgtcttgtaggatttctgctgaaagatccactgtcagtctgatgggcttccctttgtgggtaacccaacctttctctctggctgcccttagccttttttccttcatttcaaccttggtgaatctgacaattatgtgtcttggggttgctcttctcaaggagtatctttgtggtgttctctgtgtttcctgaatttgaatgttggcctgacttgctagtttggggaagttctcctggataatatccttcagagtgttttccaacttggttccattctccctgtcactttcaggtaccccaaacaaacgtagatttggtcttttcacatattcccatatttcttggaggctttgttcatttctttttactcttttttctctaaacttctcctctcgctttatttcattgatttgatcttcaatcactgataccctttcttccccttgatcgaatcatgtgttgaagcttgtgcacgcgtcacgtagttcttgtgccatggttttcagctccatcaggtcatttaaggtcttctctacactgtttattctagtcagccatttgtctaatcttttttctaggtttttagcttccttgcaatgggttcaaacatcttcctttagctcggagaagttggttattaccgaccttctgaagcctacttctgtcagctcgtcaaagtcattctccatccagttttgttccgttgctgtctaggagctgcaattccttgcaggagaagaagcgctctggtttttagaatttgcagcttttctgctctgatttcttctcatctttgtggttttatctacctttggtctttgaaatgggtgacctccagatggggttttggtgtggatatcctttttgttgatgttgatgctattcctttctttttgttagttttccttctaacagtcaggtccctcagatgcaggtctgttggtgtttgctggaggtccactgcacaccctgtttgcctgggtatcaccagcggagactgcagaacagccaatattgctgcctgatccttcgtctggaagctttgtcctggagggtcacccgcctgtattaggtgtcagttggcccctactcggagctgtctcccagttaggctacacgggggtcagggacccacttgaggaggcagtctgtctgttctcagagttcaaacctccgtgctgggagaaccactgctctcttcagagctgtcagacagggatgtttaagtctgtagaagtttctgctgccttttgttcagctatgccctgccccccgaggtgggggtctacagaggcagtgggccttgccgagctgcagtgggctctgcccagtttgagcttccccagccgctctgtttacctactcaagcctcagcaatggtggatgcctctccccctgccaggctgctgcctcgcaggtcgatctgtgctagcagtgagcaaggctccatggacgtgggacccaccgagccaggcgcgggatataatcttctcgtgtgctgtttgctaagaccattgggaaagcacagtatttgggccagagtgtcccgtttttttaggtatagtctgtcacagcttcccttggctaggaattggaaatccccctaccccttgcacttcccaggtgaggcgatgtcccgccctgcttcgtctcgccctccgtgggctgcacccactgcccaagcagtcccaatgagatgaaccaggtacctcagttagaaatgcagaaatcactgtcctctgtgtcgatcatgctgggagctgcagaccggagctgttcctattcggccatcttggagagctctctgtttttttcttttttttgagacagagtctctctgtcgccaggctggagtgcagtggcactatctgggttcactgcttcctcctcctcccacgttcaagcaattctcctgcctcagcctcccaagtagctgggactacaggtgcacgctgccacatccggctatttttttttgttgtattttagtggagacagggtttcaccacgttgcccaggctggtcttggaactcctgagctcaggcaatgcgcccaccttggcctccagtagtgctaggattacaggcgtgagccaccgcgcctggcctgaacaacaactcttgtatttctctctcaccccatcacctgtcgacaaccactttgagttttttttgatgagtttgactacttgaggtataaatggactcatgcagtatttgtccttaagtgactagcttattttaattaccataaagttagctatgttcactcatgctttagcatatgatagagcttccttattttttatgactcaataatattccaccgtatgtatgtatgtatgttttctttatccactcatccatctatggacatttagcttgttttctcctcttggctacaatgaataatgctgcaatgaacatgggagtgcagatatcatttggagatactgacataaattcttttggatcaatacctagaagtgggtataaggataaaagggtcaccatcttgctgttgtcattcccttatttgtctgtcttttgcatcagtatatgaagtaatagaaaattaattgaagaaggagagagatgcatatgaaaagatgctcaacatcattgatcatcagagaaatacatattaaaattacaatgaggtatcatctcacccaagttaaaatggcttttgtctaaaagacaggcaataacaaatgctggtgatgatatggagaaaagggaaccctcatgcactgttggtgggaatgtaaatcaatacaaccactatggaaagcagtttggatgttcctccaaaaatttaaaattgagctaccatatgatccagcagtcccactgctgggtatatacccaaaagaaaggaaatcagtatattgaagggatatgtgcactcctatgtttgttgaagcactatttacaatagtgaagatttggaagcaacataagtgttcatgaacagatgaatgcataaagaaaatgtggtacatatacacaatggagtactattcagccataaaaagaatgaaatcctgtcatttgcaacaacatggcaagaactggaggacattatgttaagtgaaataagccaggcacagatagacaaacttcccatgttctcacttatttgtgggagctaaaaaatcaaagcatttggactcaaggatatggagaatagaatgatgattatcagtggctgggaagcgtagtgatggggaagtggggatggttaatgtgtacaaaaaaatagaatgaataagacctagtatttgctagcacaatagggtggctatagtaaaaaataatttaattgtacattttaaaataactaaactaactaaacgtgtataattggattgtttgtaacacaaaagataaatgcttgaggggatagctaacccatttaccatgatgtgattattatgcactgcacgcccgtatcaccatatctcatgtagctcataaatatatacacctactatgtacccacagaaattaaaaattgaaaaataggcacacttccaggatcaaaaaaagaaggaaaaagatggcttaattattgtgagtttccaaatcatcagataaatatgccatatttaaatgcaaacaatgtcatattaactttttatatattggaggctattttctttcgggctgctataacaaagttatgttaatatgtcacccaccatagactgggtggcatatttaacaaaagaaatttatttctcacggttctggaggctggaagtctgagatcagagtgccaaggtggtcgggttctggtggtctgggttgcagactgctgacttctctttatattttcacatggtagaaggagggcgagagaactctctggggtccctaataggggcgctaattctattcatgaggtctctccacccttgtgacctcattacctctcaaagttccccccaatcacattgggggttaggatttcatcataaggatttgggggcacacaggcatttagcatttttgtaacaaaggaaaactatatactgtattcccctctgaaaattagtgaagtgtgttagctgttgaaacttctaagaagtctttggtttaactttctttcttttttttttttttgctttttttgagacggagtctcgctctgtcgcccaggctggagtgcagtggcgcgatctcggctcactgcaagctccgcctcggttcacgccattctcctgcctcagcctcccgagtagctgggacggcaggtgcccgccaaaacgcccggctaaattttttgtatttttagtagagacggggtttcaccgtgttggccgggatggtcacgatctcctgaccttgtgatcagcccacctcggcctcccaaagtgttgggattacaggtgtgagccgcggtgcctggtcagtttaactttctttaaacccagcatttcttaaatctctaggatgatgcaaaagtaattgtggtttttgccattaatggcaaaaccattacccagcaacctcttttggggttacccaggaacctcttttggggttgggggaatagtatccactaagtatccacttgtcttctgaggcaaggcactgcttttctactgcctacagttaggttagtgctgaatggtatatttaagtataaagtaaccccaggtcacatatggctacttaaatttaattaaaattgattaaaattattcagatcatcagtcacattagccacatttgaagtgctcagtagctgcaagtggctagcgactatttttattggacatatccataagaaagacacatattgggatccgttttgtcacctaacatccctacccccaaagaatttactgatttgttatttgtttttgtgattttacattaactgaataatgttacaaaactagtcttaaaaaaaatctgttgctgctttcaatataacaatgttgtatagcaatggtcccccaactttttggcaccagtggccgattttgtggaagacaattttaccacgggacgggcggggtgcggggatgtggggatcgttacaggatgtaattgttccacctcagatcatcaggcattagttagattctcataaggagtgcacaacctagatactttgcatgtgcagttcacaataggatttatgctcctatgagaatctaatgctggtctgacaggaggtggagctcagagagtaatgctcattggcccgctgctcacctcctgctgtgaggtatggttcctaacaagccacagtagtggtctgttgcccaagggttggggacccttgttgtagaggacagtgtgcactgttattgtgttttttgtatgaaaactcctatgagcccttttatttggttctaaaagttagaaaatcctttgcttctttgaaaagtaactgattatatttttatttccttttatttgggcaccagaaaacagttaaatctttgtcctaacattctttttaatctcattctattctgatttatatttttttctattcctgttttctctcgatatttgttttcatagttttgcaaaatacttcaaattccataagagcaaatcaggtataactgaacattagtgaattacagtcttttttcacaattcatcataagtggtcaacattcttggctgtccatttttgcagggcatttgatagttgagccatttttccattacaagtgtttctagtatcaatggttaagttttctgtattgtctgtaagctgtttcttgctcaggtatcttataatcaatagtacatgatacagaattcctgagaagtaggaatagaaaatctatttgtagtctgtgtttctccataaggctttagaagtagacgagactaagcagctttgtttctaattcagtatttggaacttattgtatattcattcatttactctttcatttattcattcattcagtaaatatttgttgaatgcctgctatgcactgagcacttttctgggtgctgaagatgtagcaagaagacaagaagacaaaaaaaattccctccctcaaggaactgacattttactgagattaagctcaaattccaattcattaaactcttaatttttgagatcattaaaagaaaagattgtctcttattggcatctcctctccacgtacaccgaaagttatttcatttccatggccttatttgctgtggcagtaagagagataaataggccaaatcgaactgggaggcaggaggaagaactcttgtccaactttcattgtattcaagaattcaagaatatgagtgagaaaaggctgataagaaatatagtttgttgatcctaggctgagtgcaatggctcacacctgtaatctcagcagtttgggaggccgaggcaggcggatcatttgaggccaggagttcgagaccagcctggccaatgtggcgaaatcccatctctactgaaaatacagaaattatttgggcatggcggtgcacgcctgtagtcccagctacttgggggaccgaggtggggggattgcttgagctagggaggcagaggttgtagtgagccaagactgtgccactgtactccagcctgggtgacagagcgagactctgtctcaaaaagagaaaagaaaaaaagaaatacagtttgttgatcctaaaatatttggagagcagatttatggtcaaaataagacatagtctctgagacctactctgttcttagaagtaatcaggaatatttatagttgattggttttcaaaacaaaaatgcaaagcagttaaatatatatttgctaaacttattgaacacttagtatatgacagtgttctgaatgctgaagatagatcaatgaacaaaacaacaaaactccctgccttggagcttgcagtaaagagtagaaaccatgagagcaagtaattgactaaggaagcaagacagtgagtgctgtggagagaaagtgctataaaaagaattaaaatggaaagatgtgatagtgatagactaacccctttatagcgatacttagaaaaggctttcctgatgtagtgatttgtaacctgaaacctgaatgatatgaagaaaccagccacatgaagatcaggaggaagacctttctaggctgagggaacagttaaactaaaagcctttaatattggaaagaacttggtctggtggcaaaacaataagaaagccagtttgggtaggaagtagtatgagcgccaagtgataggagaatcgatcacagagtgagggggaggccagatcaagtagagctgtttacttatgttaactgaactaaaactactatttgtctttaaagtaaaatgctttctgagtagccagtcctgagtactttccagctgctcataagccaaaagtcaatcacaatagtttaggcttcacttaaacacaggcaatctaatgttccattctttcatttcatttcattatttgttttatattctccttcactcttttttttctcctggtgaagcagcagaacccattgactttttgctgtactttggatttcagtctctgacttccttgcacatgtgcacacagaaggaaagagctgtgaaagagcttcagccaaggggttgggaagcaggagtccagaactttctagtttgctagatggatatgcagtcagtgatgatcacacccatgtctcactggtgattgattgaatcaaccatttaacatttttgaggttatttaaaaagttggaaataaagtgaaatctctaaagaatatactaatatttataattttgataatgaattttttttgttcttttaagttactttatggttgaaatgcagcttttcagtcttaaatctcatatcagtcaccttcccataattttaagactgcagtatttatttggttctattatataacttttatggcctttgaaagtaagagagtgaatgtaactgatagttttctgtcacttatactggtactggatctgacttttagctcttttaaaagttattttcactttggaaacactttaaagatgcattgaactctttttctacagctctataatccatttttatacacaagacatagtagcataaggctcccacatacaaggctcacaacaggcaaaattccatatgtctgcttcagatttgcctgctgaatacattgttgtggctgcttctaaaacattaaagacatacctgccaggttgtggatttttttttttgtcttgactttttgaaagtttctgcactattttttcttagattacatatagaatataaagtacagttaagtcctatgaaagatgagaatcttatagaccttctggccacaagaaaccatcaaatttacattaaactctacttctctgtattatcaatttctctcaataaaaatatgaaaataattattatggcatgatacagtaaaacacaggaatagtggatttagttccctgaatactgtattcctttcttccttcccttcctagtacccactggcttgctgttggattgtgcatgaaattaaaagaaacttgaatacattgtgccctggaattgtttgaatgaaagtgattgcattaattcaaaggtttggatgcctttaagcatacgttgtaaaatttttaactggagagataggtgaattttaaaaattagagacatttcaaatcagtaaaatgttactagagcagtagacaaagtggggggaaaagataaattgattccctatatcataccatttaccagaataagcttcagaacaatgagttataaatataaaaccatacacaaactaggcctgaatataggtaatatttacttgaaataagagcagctttgtgaaaataaaaacaaaagtagaagataaaagaatatatttttgactgtacacaaatgaagaacttttataaatcaagaacatagtatatactattaaagggcaaatgccgattttataacaattttagacaattttgataatggattaataactttatgagtattcttatatagcaacatgaaacatgtgtatcctaatagaaatatgaacaaaggtattgaacatagtattcataaaatataagttacatatatgatgtgcatggtgtatatggtatgtatgagtgggcttgtatgaatgtggatggctgtgcatatattcagcctaattagcaatagaagaaatgactattaaaagaatactgcagtttaatagacaaaaaggatctaaaataatgatctgatatgtgagggtgcagagaagcatgcactctcatttcatgatggttggtttgtagaatagtacaacctttctggagggcagtttagcagaatgaaacataagcaatgaaaatatttatattcatgcctagcaattccatttctagaaaattgtcctaatgaagcagatgtataaaaaatatatctgtagtattcacttcagaattatttctagttgtgaaaaattagagcataaatgcccaataataaaggaattttaaaataattgtatgataatttaaataatctatataattatatgggagatgtttatgatatagtaaatgataaagcagaatgtaaaagatatgtacagccaatagtatgaccccaattttctttaagaatatattgcacatgggaaaaatgattagaccaagtgataaaatatattaacagtacgtctctctatgtgagaaattatggtgatttttaaattttcttctcttgcattaactctgttttccaaatttttaacaatgaacttgtattagttgtgaaatgaggcaaaaggaaaaaatgataaaggagaaagggttcaattatattatctttattctctcagtgttgcaattaatgatagaattaataagccctatttttgccttgtttaccaactttgagtttagcaacaggaactatttgtattccattatgtttataaaagatggaaatatattttctgttttttcttggtggaaggggcaaagtaagccacagcaattcttttagttagcatttcttttagatattcaaaaggacaagtatgttatatactcttgatttgattaaaggaaaacatatataaagaaatataaaggtatatatataaataaagaaatatatatataaagaaagatgtataaagaaagaaaatagatatataaatatcttcacctttccctccacactctgatcattctagtcacatctggtcttaaactttagacaggacatcatattagtaatttattttcaccacatctgtaggggtcttttatttgtagattctatagtgataattaatttaatgggagttaacatttagaaatagatttgtagccaggttttgtgctcttttaatgggctgggaagctaaaaataacgccttgtaagggaaacaattgcaaacagatgaaatttaactgagcaccagacattcagagttgaagagcacacatgggggaaattgtatgtccttaaattatcaacttactggaaatgaaatgctttggtacagatgtgaagagtaaaacaaaaacaagtctggtagttggttacatcttcccgtctgctcttcgtattacaagtaggagtcccactgtccaagctcatgacactaagctcttaaaaaaaaaaaacaaataaatgctttacaatgtcagctttagataatatattcagaaagagatgataacatcatgtatagttgtaagggacaaatatgctagttcaatttatctacagatgttcattgggatgcttcccctcaaagtgtttttgattttctcaaaagaccaatctcaggagctatttaagaaaatgtcatttgatttgcatatgtaaacaatcaggtctatgaaccatatgattttatcccctaattatttatgtaagggtttaaagtgagcatacatcacctatcacaaacctatcctgcaaattagcaaatgcatacactaacaaagacaattgctctgcttagctatatctcttaaggtgagacatttaatcccttggtaagtggttgtttatatgtaactaaaataagcttttccctccttcaccagtattaatgtttttctttctttttttttttttcttttttgagacagagtctcactctgtccctgaggctggagtgcattggcgtgatctcagctctttgcaacctccgactcccaggttcaagtgattctcctgcctcagcctcccgagtagctgggattacaggcgcatgccaccacgcctggctaatttttgtatttttttttttttttagtacatatggggttttgctgtgttagccaggctgatcttgaactgctgacctcaagtgatccactggcctcggcctcccaaagtgctgtgattacaggcatgagccaccatgcctggccgtattaatgtttttctaatacttccttaatcagataaaaatttcaatttgaaaaacttgaaatattgatgtaaattgtttgattactacatgtgttttcttttttttttttttttttttactattttgctaaagaatatggttagttataagttgatactatgtatatcttcatggagatttttaagtaggtttttttattggccctgtttatatgtgtaggaaattatgctaaatcacaaaactggaaacaagagctatttcttgctgtgtaagtcagtttatcaaaaatctagatagctgtaataatctttttttccttgttacatgagaacattctgtattctctatcccttaataatgattattttaagttatacttgaatgttccactggcattttacacttattatatctaatatggactttgtaagttttcgttattacctactctagtcactcctcatctgccttctatgtagtccttattactgttaacatcatcattcactcagttaaacaaatctgggtaacctgtccctcattccttcactctattctccagggtcaaccactcctccttatctatcagttcctgagtagtttcctgaatcttcaccttcatcttctctacatcctatctctgaactcatcctccagaatgccttcagaattacttttataaagcttagtctcctctctaccacttttaaaaaatataattcttttaattttgtccagtgttcaaataaaacactcctagaaagagtatttcttcatgaattcctttttcttatatcactatttggctcatactttcactgcatttttgtaatccaagtccccctaacacaaaatgagcttaaaatatggttattttggccgggtgtggtggctcacgcctgtaatcccagcagtttgggaggccgaggtgggtggatcactcgaggacaggaattcgagaccagcctggccaaaatggtgaaaccccatttctactaaaaatacaaaaattagccaggcgtggtggtgcatacgtgtaatcccagctacttgggaggctgaggcaggagaatcgcttgaacccaggaggcagaggtggtagtgatctgagatcacgccactgcattctagcctgggcgacagaacaaggctctgtctttaaaaaaaaaaagaaatgtggttttaatggttaaagccattaaaaaacccttaattatataaagcaaataataattacaattaggacatcagagaaaaatgcactttactatcagttaccaatatgtgaattaccacccttttacgttatctgtgagagtcaaactgtataccaccatgtaagttgaatatgtgtacactttgccttggggaggagctctaggctgatgtttctaaatggtgaggaacacaccacacctgatttgtaaagtcagagaaggctagagctggaatcgatcatttagtccaaaaccctcttaaaattttttaaaatttattttatttttattttttagagatggtatcttgctatgttgcctaggctggacttaaacccctaggcccaagtggtcctcccatctcagcctcccaagtagctaggactataggcttatgccattgcacctggctcaacactctttttttaaagagggaaagggcagggtcttacccaaggttatatatctagttctagagctatattgctagttatagattacttaaatgtactatgtgaaatttaatgtttaaattatttggttgaaattattaaacatttgaaacacaattatttttaatgaagtgacaaatatgtattaagtttaaaatattttttgaaacacattcttgtacttgaacacattttcttgattaaatattggtataaagcaggaaatgatctattaaaacaaaacattcttagaaaacttagtagcagttactccatatcaatagttgagcctagattagatcataggtttaaagcatacttctgatattatctgttatctatctaacactttgaaatgatctgaatgtcttattgcaaaacacggggaagatattagctaaagatttaaagagaaaaagcaaaccaagggctggaaaatgattctctgagtagcaaattggcagagttaaggagtttattgcaaagaaaaaattattatgtctattatatagctattaaaccatagtccaggtgaagagagcatgttagattaaaaatagcattagcaccccaaaagatctggaaggctacttttcaaaggatagcaaaaccaattgtgttacagggacaaaccttacttagaccaataagttataatgcctttcaaactttttggtcttaggggccatttacactcttaaaatttttgaggaccctgaggaacttttttgtgtggttcatatctattgttattttctgatttgatttaaatctgagaaaattgtaaaacataagaacagtccatttgccgtcagagtgatgatgccattccaggtcatgaagcctctggaaaacaccactgtacacttgtgagaacacaggagtgaaacagacaaataacttttttttgttttggaccgagtttcactctgctgcccaggctggtgtgcagtggcgccatctcggcttgcagctgggactacaggtgcccactacctcgcccggctaattttttgtgtttttaatagacacgaggtttcactatgttgaccaggctggtatcaaactcctgacctcaggtgatccacccacctcggcctcctaaagtgccgggattacaggcgtgagccaccgcgcccagcctcaagtaacttttagtcttgttacaacaatagttttgaatttacatacacctctgacagggtcccaggaataccctggaatcctttgaccacattttgagagctgctgctcttctcacggaggtcagtgtatatggacccagtaaggacagcagtgaagcctgggacagggatgagaatgggcctgtattactagaattttgtcattttctcatctcctcttctcttaatggatcagctcattctctcctattggagagaggcttcttgatttggccgaagtcttagttatcagcagcaatgagagcaaacagactggctggacaacaatttctgtgtttcaatgccagtgcctagtgtgatgttatttgtcacatatgcatgtggaagatgtcttggccaaataactttgggaaattttgcatgctctacacctgtcccctccctttgaagaatcacaatgcacattaacatattaaattatctgaaatgtcctatggtagaaaaattaattacctttattgaactcactgtttccaaatcttaggtgatttcagagcatttatcatcatccatggatactagtgtctcacaaaagagtttagaaagttggatgttataaaatttttatttcatttttacattgtagaattttctactcccctttcaataccaggcaaatcgatgtgatttctgtgaataagtaagcaagccatatacatttatacaaatatgcatcatttgatggaaaggcagcacattgttgccagggaaaattgtatctaaatgatgtttagatttttgtttggaatataaatggatagataaatgaaattattccacttatacttttaaaatgccactgacggaagaaaaaaaaacccatattatctcaatatgtattgtcaaaaagtccttgataaaatttagcatgctttccgattataaaattaatacaataggacaagtacttatttccttaactggctctttcttgttattcaggtctcagcttaagtatcactttgtcaaagaaacctttcctaacttcctgcatgaagtagctcccactccctattgtattagtctgataaaactatatattgcaagccaaatggcactgttctgtttaatgctaaaacacttgaagaattcccatgtgaagagccagactaggatgttcacaatcactagtattttttaggcttttttccccattttttagagaggaagggggagtgtgtatctgccaatgcaattaaataagagagagaaggaaataaaaagatttagaaagatatatgtaattttttcacattatgtgactatctgataaagtatgtaaaaatcaatagcatttacatatatatatgtatatatatatatatatataaaacaaggcaaatgattgtgtgtgtgtggtttttttgtttgtttgtttttgagatggagtctcgctctgtcgcccaggctagattacaatggcactatcttggctcactgcaaccttcacctcctgggttcaagtgaatctcctgtctcagcctcctgaataagtgggattgcaggcgcctgccaagatgcccggctaattttttgtatttttggtaaagacatggtttcaccatgttggccaggctggtctcgaactcctgacctcaggccatccgcctgccttggcctctcaaattgctgggattataggcgggagctaccatgccaggcctaaatgattgataatggaataaaaagtcctatttagtatagtaataagagagagtcaatgacataccaatataatttcaacagaatttttctttttcttttttttttttaagaaattgacaacatgatgtgtatttttatctggaagtaaacatctgggaatagccaggaaaaaactggaacggaagtgcactgaaggggaactagttctaccaaatatatatataaaaaaaggttaaagttataggattaaaatagtttattcttgtttataacagagtcaaatagtagaccataatatatgcaggaatttactgtatgatagatgaggcatttgaattcagtaaagatcagttattcaatccaaaatttaatttgataaaaggatcataaagttaaatattacattacaggctaaaaaatatatttgcaacacatatggcaaagggctcattatcttaatatacaaagattttttacaaaataaatatgagtgggccaggcgtggtggctcacgcctgtaatcccagcactttgggaggccgaggcgggtggatcacgaggtcaggagatcgagaccatcctggctaacatggtgaaaccccgtctctactaaaaatacaaaaaattagccgggcatggtggcgggtgcctgtagtcccagctacttgggaggctgaggcaggagaatgacgtgaacccaggaggcggagcttgcagtgagccgagatcacgccactgcactctagcctgggcgacagagcgagactcagtctcaaaaaaaaaaaaaaaaaaaaaaaaaaatgagcaaatgaaaacccctattaaaaaagtggcagagcccctgaaaaggtagttcatagctacagaaatacaaataagcaataaaatgcatgaaaaaggatttaacttcaaacagaattaaataattggagatgaaatcagcaatgacataacatttgaaaaaaaaagtaacaaattaacaaagttttaaaatgttcgataatggtataagagagaatatggaaagaaagctcttccttctattgacacagtttttttcttttgtcatctttttggaggggcatttcgtgatatctaccaaaattgggcccagcagttccagttcttggcacgtatcctacacgtaatcctatacaaatatgtgaaggtacatgtaaaagaatatcagatgaaatattgcccctcagtgaaagactggtaaaatctgctgttactcttcccctggcttagtgtgctccaaccacagtagctttctatctctttatgggacatacccagtcttttccaccttaagacatttgtactagctattctttcctcttgggatgccttttccctaggttttttacgtgactttttttttcttgtcattcaggtctcagcttaagtatcatttcctcaaggaagcctttcctaacttcccactacaaagtagctcccatttcccatcatagtactctgttttattgtcatcatagtagctattactatttaatattgtcttctatgtttacgtattatctgtttctctagaatatggaaaggcagaataacttggtaattaaaagcattgactctgtagccatagctgggttcaaattttggctctgccatttacagtctgttggcacttggggacaattctaacttaatctctagtgctttcactttttaaaaaaaatctgtgcaactgtgattaagaatagaacctacctcacaaatttgtgataataaaatgaacttaacatttaaaacacagcactattgaggacatggtagacactcataaaatacttgtagatcaattgaattaaattatcatttattcatttaaaagaatattatgaaaccatctcagtgaatgaggtagatctgtatgttctgatatgaattttcttcaaaatgtagtgtgagtgaaaatagactgtgaaggtaacctcaaaatctgggtctttaaacaacagagactcatttcttgctcatgttacatatctattatgtgtcagtgagggtctctgtctcatgttgtcctcactagtgtcctgggctccaccatatggcgaaaggaagtagaatattcagagtggcattttagatgcttccatctagaagcactaccctccacttatcacattgcattggccaaaataagtcacatagccacacctaacttcaaggagtaggaaagtacgatcctactgtgaccttctaaggaggagaaccagaaatgttgatgaacagcaattattaatgagaatgtaataattgagaaaaaaggtacaaaagagtaggtataaagagagcctatttttcaaagatgtgtgtgtacttggatttatattataaaaatgtatggaacaatctgcaaaactaatagtggtctgctctgggaaatgggatatttactttttacattaaaccttttgtactatttgatatatttttcaatgtggacatatattacttccataactaaaaaaaaaattgtctcccaactgcctctcacatatactttgacaaagtgctattgcaaatactattacaactcagtaaacatgggatggcttatattgagagaaggaaactgattcacaatgagagaaaaggggcagaaatagataggttattttctgggtagagaagtacagagaggggctcctaaaagaccagtggcaatactaaagttctttataaactatctagtagagaggattgtgtggtagaaatttacaagctttctagtaacaaagtttcctgggtagttaagtgccagacagtaggggcagaccacaaaaatatttttatatcattttgtatttggatagaagaaacatattaaggataatatatttctgaatagatatcagtgataaatttgaagattctgaactattgcagaagactgggaaagttccctgaaagtctccatttttccatgatttcataaaagttgctgttggcaatgattccagggcttttcccaacttggaaattcttagttttcaaagtactttaaaagtaagatataaaattattttaagggaaaatgataagataatgttttatccaactctgcttgccaaattatttttagatatatatgaatatttgtgtatgatttgcgaacaatggaagaagtattgattttagataaaaatcacttctgttttagatttttgttatttgtagtgacaccagtgtgtgtgtgacaccaacacacacatacatacatacaacataattagatatatgtacacctaattagctcccttgtttttactttttttaaaattccttggaaatgcctactttttacaggggaggcacaaatatggaagttctgtatggaggcacagatttagctctaaagtatgtggaatggtaaattgaaaggattttggaattaaacatttattgaatcatctccaaagtagtataagatatttgtatacagaaaatgctgtgagagaatttgaagcaaaattttctattatccctaattgctctttgtaatatattttaaatattgatattaaatatttatttttaattagtgtgtatttaaaactatagttaaggtaggaaattatgatttagtgtattttaaatatgtatttttattcctttcctcagccttctgttaaaatgagttgcataatgcttacattttacataggaatgcaaacagtcctattttaagtctggtcagaatttttaaaggattaaattcaggtatttaaaaaaatcattacgtcattatataaagacaagtctagaaaaatcagatagattcacaggcctttttacttactcagtctcatgacttttctcaggggtttattttattttattttattttttgggactgagtctcactctatcacccaggctggagtgcagtggctcaatctcggctcacggtaacctctgcctcctgggttcaagtgattctcttgcctcagcctcccgagtagctgggactacaggtgtacaccaccatgtctggctaaattttgtatttttagtagagacaggacttcaccatgttgtccactagtctcgaactcttaatctcaagtgatctgcccacctcgctctcccaaagtgctgggattacaggtgtgagccaccaccacgcccggccaggggtttattaacatatatacatacaccatgagaacactatattttgtatctcacattcttgcatgatcatatttaagacaacaggatttgttcaacattcctagacacctagtatgtcaaggaatgtttctacataagtattatttattgaaataagctgcatttagactatgctactcaccatataaaggttgactatgcctaatccaaacatctgaaatctgcaatactccaaacctaaaatgaaatactcattagaatatttctgatttgggaattttgggttagtgatgctcaactggtgggtataaagcaaatattccagaatccaaaaaaatctgacatctgaagcagttctggtcccaagcatttctaacagggatacccacactggactcgggtggtaatctgcagcagctagtgaggtagcattcctgccaaacaatttgagatacattttgaagtatttggaaataggtgtcatattctccctttcctgagtttctagtaattataagcttttcacttcaatagttactcatgtataatcagtgagtttaagaaaattccagatatggtaattagatactaacacaatatggtgaaaaataggaactaatatacaaacttgcagattctttatatatttaatacagatggaagtccttgtttaaattttaatagtatgatacattaggagaaaaggacatatttggtaaatctatatcatatatagtgtcagattttacaggataacttgtaaggaagggatttatgagaaaaaaaatgttagcggggccaaacaatgtaaataaatacatgttggcaaatgtgctcaggagtattttgtaaggaaggagttataaacattgcctttaccttttgattgtatttgcaaaacaatgattcttaatggaaactaaaatttaaagtgttgagccatgagtgctcaactttcattgcatactctgtcataaagcatgctggaaagaaacaaaaacaagcctactagttgatcagttatttattgagtttttgttatttactcaacactacaattaagtgtggagaatacagaaagaaagtgtaacatatctttatttcagttaaaattttactgtttgacctgccgagagaggttaattggatagtcaaattggactttaaaggatcttcctgggagaagaccaacaagaacggaattttaaaaagtggcagtgaggaaactggctcaatccaaacacagggcatgtcctcagcaaataagggaataacaacaaaaccaacaacaataacaatggtgcttcacattaatcgaatacttattacctgctgaacactgttttgaagtgcctttagttcatgaactaatttaattctcacagtgcctccttccaaatagaggaaaaagagatctctcccctcttccatggctacctgggctgaccccaggagggcattaaaagcacctaaatattcttgggttggatggaaaatccttgtttgggattttaaagacctttccaaaagaggagtcaggggcattttgtaatcagctttcacctttccctaccctgtcaggcctaatgccaaatcggaaggaggagctttctatattttatacattgtaaacatttattgccttggaaatatattcttataagattttgttttagattttatgtttaaaggattttaaaaattgagtagagatttgcttttatcacaaagaatgctatttatgtacaaatgcagttatctgtttaactacaaaaaatgagttctctgtgttgtacatgggagggtgatgtccaagtatcacacttgaccaccagtctagttttaatctttttcttttacgttttttgaggcagagtctcactccagttgcccagactggagtgcagtgatgtgatcatggctcactgcagcctcaacttcccggactcaggtgattctcccatctcagccacccgagtagctgaaactatagatgcacgccaccacagctggctaattttttgtatttttagtagagacagggtttccccatgttgcccaggctgttctcaaactcctgggctcaagtgatctgcctgcctctggcctctgtcactgtgcctagccaagcatggaattttttttttttcataatttacataggtttttggagaacaggtggtgtttggttacatgtgtaagttctttagtggtgatttttagtcatttacccctcatccccctcccaccgtttctcctaagtctcttaaccacagaggtggtaagggccttgaaggctaggcaagaatttatggccaagtctttgccttataggattatataatctaatgatttagagaacttttgttatctagagtttaaggtactcataaaatgctgtttggttatagaatgaattttctcttgataaatgactgtactcaaaggcatattgatttccatataattatatagctagttatactctattttattagcaaaacagtcttgaattttgcataatttaatgaatataattaatgactaactattcttccttcctctgataggctaagtaatcaggctgacctagcccgattcattatactcattacagaatagaaaaaagaaaagctgcaaaatagtattttgcatgatggctctatttttctcagtttccaatcttagggacttgactaatttcattttaaagcagtacaggtatatatatatatatatatatatatatatatattttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcagcctcccaaagtgctgggattacaggcgtgagccaccgcgcccggcaggtatatatttaatacaaggaatagagacattctagccaaaatagtggtgaagtaaaattcacgtgtaaaatatccctttccttgcatgcttcaaagtaaagtggtgtcactggaaagatatacactggtgttttagatattagtttttaaaaatcatttaattattaggtaagggtgttttattttgtgaaatatggataaaaatctgaaatataagtcatattaggtaatgaccagttcccaaaggaaccttataaagagcttcatggatgaatgagtttacatctaataagatataaactcgctgataagtggctttctctctctctttctctgtctctctgtctgcctccttccctccctcccttcctccctccctctctctctctctctctctctctctctctgtgtgtgtgtgtgtgtgtgtgtgtgtgtgtgtagtactagtagtagtagagagcatagtcaaggaaataactacaagatgagatagtgaaaccttttgtttgatcaaaaaaagcaactctttgagcaattcagctccactggggcaggaactatgttttctttattcctccctctgtgcctagaattggtagatatttaaaagttttgattgtatcattgtaagtaaaagggggacttggattttggttataaaaacgtttatgccactttcaggaacagatatattgtatcataatgcgataattcttaattgaaatggcggcctttttgaactcttgtgggcacatcagaactattttactatatttagattgttcatgtgtggcttttggaacttatttcccatcgtgtaaatacagtgtattcatctgttgatcccctacttattaggcaccatgccgctactcttatagatgtcatcttatttaccagatatcttcagtatgtgtctgaaagcagatattttaatctcagtttttcaaattgggagatcgtgactcagaatttaagaatgctgcccagtaagttgcttggcagtaagctcttgggcttacatttgaactcaggttgtgtttgtcttgaatatccttgatggtcataaatctttatcttctaagaatggaaataatctttgaaaatagccaaaattttctcccttaaatttgatgaataagatgagtgactaaattgatcaaattctggccttaaaatataaagcaatgagacgtgttttattatttgggtggtaaactgtccctgaaggtaatttcttcagaatcaaaacagggatattcagcaatgttttcagcagtggcagcagaactatagtaagcatgtggcccctgagataactgtgatagtcaatacacattaggaagattaacttctgtttgttataaaacaaaacagaatagttattttatagtaacattttcatgatgccaaaataaatactttcatgtcattatctaattgtatacattgttttaagaaatgtaaagaaatactgtattagtacaaaattacaccatttatgttagtgtggaatgtttgatcattttatttctaagggaaaattacaaaactgtttagttcacctcagtttctataatgcagcctctaaagtctcatttctttaacagggccttgtgggtgttctaaaggaatgattgaaatgaaaagaaatgagagagtcaaacagtgtaccgtaatagatgaaatggaaagtaattatgttaatgttgactcattatgaagctctaaccatttttacctgctcatttctgtgtggaaacctgtgcagctgagatgctgaataagaaattcttgtacaaatgagcctagaggcatgtttctagtataggagctaggtctatgcagaattataatgaatttccctaagtcattatttaaatatgctatcagagtaggtgattctcctgccagaaaatttggcttctaatgtttatcatcaaatttttagatgtatatttgaatcttcattgctgcatgtaattctcatttgttaattagagagaaaaaaccctatattccacaatacatctatatcatatatagtgtcagattttacaggataacctgtaaggaagggatttatgagaaaaaaatgttagcagggccaaacaatgtaaataaaaacatgtaagtgcttaagaacgtgagatttggagtcagatgggctagattgaaaccaaatctgtctgactccaaaactgaagcttttattcatggtcagaaaattttgaaagtgtcactcccctaaatgcctataccattccccccattgcgcttaaatgtttctttttgccagtattctgtttctaaagcatgcatttttcagtcataatgtataataaagcttaatggtcttgcctcctatgactaaaatgtcctgccagtattctggaaataaaatattatagagaatctctctgattatgttaaattgctaacgatggcttaattacttgttagaaaaatggtacattgtcatttttaatttacagacacttaattttttcctatgctaataagtgacttctaaaacaattaaatccctgaaacaattaaatacctaatttttgttaaattatattcaacattaatttaagagtttaattaaagctaaagaacattttacctcgggcatgaactttttcccctttctgtcagatgtgaatgcttttaagtaataaacttaaatttcatgttcttaaaattaatgttggtgcttataatgttattttgtatttggtggtttttaatggcagtcttttatgtttggaatttcaatttttgtattatttcctacaaagatgcaagaactagttatactttacttttaacagtgaagtcttgatagcatagaattattacaccagaaggaatgtaaaaatttcatctagagcagagctgtctagaagaaatataatgcaaaccacatatgtaatttaaaattttctagaagccacatttaaaaagtaaaaagaaacaggtgaaattcattttaataatttattttatgtaatccaatatatttagtacattatcattttaatgtgtgatcaatataaaattaatgagatatatctttttattaactctccataatatgatgtgtattttacatttatagcacattttaattccaactagccacatttcaagtgattggttgccacatgtgactaatgacttccatattggacagtgcagatctagagtctcgatttatttcccatccctgtatccctgatgatatggcacactgtgaatagtgctattggcttatcaagtggtgcatacttccctagtaagggattattggaaaatccaggtgagaggagctgtcttctgtagttttggagagtaaatgcattcaatatgatcctgatcagcccataacctggggtaggggagcttacattctccactgggaatcactgatcttatttgacctctttatattctgcaagaggaaatgaggcccaccttcattccagggtccatgttctgcaataagcttggccctcttacatttctttctctcttgaagtagccttttcctgtgttgtttgttcattttgggatttttttttattattatttttgagacggagtctggctctgtcgcccaggctggggtgcagtggcgtgatctcggctcactgcaagctctgcctcctgggttcacgccattctcctgcctcagcctcctgagtagctgggactacagacgcccaccaccatgcccagctaatttttttttttgtatttttagtagagacggggtttcgctgtgttagccaggatggtctcgatctcctgaccttgtgatctgcccgcctcggcctcccaaagtgctgggattacaggcgtgagccaccgtgcccggcccattttgagatgttaatcagtttcccttctcttctagttttggatatctaatggaagattatcacatatcatgaatgatagttctgttgatgctatttctcttattaaatgttcattgccattatcttctttaaatctctaccatttaagtcacactgttgaagactcaactaatcagaaccaattgccttgcattttgaatgtgaactgcccatgaattctctggattgaaaaatattctccctcccctctattgattagtaatgtgttttttgttccttttcaacatatattctaaacgtttatagagtcctcttcactttcatgcttatgttatcctcttattaaataaagtaatgccaagcccatcatgtgagtgtttcttgggaattgagaaatttagaattgggaaaatagagaaagaactcagaaatcaaaggaacctggctcactgtgttcaatttgttcacatttcaacctcttaagtaatgaaatatcttctgaaataattgccttctcctctccattcccttcccacttccatatttttaggccacgacttttataagagcctctcagattgcactccttatgccttgaaagtgcatccagagttgtcattctaaaaataaatctaatcatgtgttcctttttgtctagcagtcatccagcatggcaagatccccagggttcttagaagcttggttccaaaacctacctttctaccagcactacctatcatttccttttgttctgctacccattccccactaaccagaacacccagcactctagcctgattgttattcataatttcccaatgcactgtaaactttctgtcatgcgtgtccctgtgaagagaccaccaaacagactttgtgtgagcaataaagctttttaatcacctaggtgcaggcgggctgaatccgaaaagagagtcagctaaaggagttaggggtggggcagttttataggatttgggtaggtagtggaaaattacagtcaaagggggttgttctcttgtgggcaggggcggggatcacaaggtgctcagtgggggagcttttgagccaggatgagccaggagaaggaatttcacaaggtagtgtcaccagttaaggcaggaaccggccattttaacttttgggattcttcagttatttcaggccatctggacgtatacatgcaggcttgggctcagaggcctgacactttcctgcctctgttcatgatgttcttcctttacagaatgccctccttccccaagctacactaaaggtccagtgccatttctgttggtgtaatgtccctccataaagagtaattagagttactcttttctttttattctcctaacacgttttcatttacaggtttcttgttttccactttgtgtggtaacttcatgtctcttgcttgtttgatagtaaactccttgagctggaaataaacgtagctggcatttattgaacatctaggtgctagacatcatgctaggtatgtttcctttatatttgcaactccagcatcagaatagtttatagtagatgtgcagtaaatatctgtggagttatatgtttgcatttttaaatatccattggaattcctttaggaatcctaacttagcatttccataggaggaggaaaatgccatgtataaaatacctactaggtgctttacaaatattatttcatttagtattgtcaataacactgcagttggagtatccccattttagagatgattaaatgaaactaagtaaagtggtctaattacccaactctttcacctagtaaatggcagaactatgatctgaatccaggtatgactgaagagtgtctccttagatttgaaagtacagatgtagagtaaagaaatatactttagtgggggtaggaggtaacagtctttgctaactagatcaattgattcatgcaaaatgggtattaaggtgcaggcatttccatctgatagcctttacttccttttcccaaggtgcactagtttagtcatgttacttaatgtttccattcacctgtgttggtgaatactaaattttgggaaggttattattggtaacatactgatacagtttggatgtgtgtccttgctcatctcatgttgaaatgtaattcccattgttggaggtggggcctggtgggatgtgattggatcatgggagcgtttttctcatgaatggtttaccaccaccgccctggtactgtccttgagatactgagttctgtgagagctggttgtttaaaagtgtgtagcactctccgtgccttactctttctccatgtgacatgcaagctcctggttcgccttccaccatgattgtaagcttccagaggcctcccagaagtagatgccagtgctttatttccagtacagcccgcagaactgtgagccaattaaacatcttttcttataaattacccagttttaggtatttctttatagcaatgcaagactgacctaatacatgtacacatgtgaaatttcagttagtaagacatgactgtggaagggaaaactcttctaagttagtaaaaagtctgaattataggaccttttcttgaaagtagagtggtcgggagtaggccagcatcattgctagcataggactgttgtaggaaaagctgggttcttgtcacatgaccaggaaaggttagactcacagatacttggaagggcaagacaaatggaatttatggggcgaaaaaagaaaaagaaaaaaactttaagcagtgcacttaggaagcctgttaactactctcgccccactacacaggaattcaagagcccagctcctccctgcggcaaaaggcaggaacttccttggctcaaccctgctctcccagtatgcatgctggtggaagattatccgtggaccctccccgttatctgcctcctgcatctatcaggaccttaggaagcctgttttactgaatgtatgaaagcttttagtaattagcatatcaattatttgtccataagaaggggcttcacaagtacttgagggcatttgaaaaggagtagaaaactagcataaattgagtggcataatttatgaaatcctcaccctatgtggtaggttaccagagatttgtaaatagaggctctaagaggttaaatcatttgcttaaattacaaagtaaataagtggcggaatagcatccaaatatacatttttctgacttccccaatgcacatactctttcagatatgctaaaatgtaatttcaatattttctctgtaatatttgatactccattaatttcattaacaagcatatttcataagtagtacaaagatgaatttcaaaatagctctagcaataggcaccaaaaatccacattcataattcttcactatacatgctaaatgaaaacatattttaaccatttaaaccaccatcaatcaattttttctttttagttatgcataagctttacataggtaaagtggcttatttttgtgttaaacaaacatgcttaaaagcacaatttaaaggtaatattcactgttatacctttaaagtgaaattaatattctttactaagtcattagtttacttttcctttatttttagatcaagtttttaattcagcttcagccaaaaggagataatataaaaataaattccatttaaaaaatggaaatagtacaactttcattgatttatacacagattctgaggatctaaatgcttaattgttttaatcagtccaatttccaaacccatcgtagtatatggtgatacttccgtttcatatatttttgtggataacggtaaacctgaatgagtctagaaaatttatattcacacacagagttttcagggatatttagcatattgcagaggaagtgttatttcacgtcaatacactaaacttctctgaacccccctattcatcgaaaacactgaacaccccattcattacacaagctagagctcttaagagctagaaagctttaacattctccttataattcagttatggttatgaaatatgaaaaataatattttatgatttattttaaaacactttgttaaggaaaatacatttcttcttagtctatcattaatctggctttacatatgggctggtctcacttatcctggaggcagttaatcattaaacatttttagtggcaaaagcctttccttatagaaagattttgtcttcctgtcataaatttctcatttttcttcctggatttttaagctagaaaacactgtaaatattttaaggttgcactgcaatttttctgccatattgaaatgatagctgtctgacatcatttttccttctttataagtggcatattgtttactagttcatgacgtacgtcttcagagatacttaggtactcaactctatgcaaatatacactgattacctttgccatagacactagatgactacttgattaaaataacattaagacgactagccaaaaccaagactaactgctagtgaaaagaagcagctatcagttaattgaagaacatctatatctttatttccctttaagtatttagaaagtcttattgatgaggtaccatttccatattcaaaagacagggatctgttaaccttttagtgaatgagacaattcataatttttccttgtttctgtctctgttaatcctaacacacaattactctatgtagggaagcaggaaactccatttacaatgattatttggggttaatttcatttaatggcattcttgacaaagatatgaatatggcaagaatatttttatattttacgtttaacctttgtaatttaatctttctaatttcatttgatataaagcgtaaatgaaagcaaaaacaccatttatagttgagtgtgaatttttttctttttttgaaaccagtctcactctgttactcaggctggagtgcagtggcatgatcttggctcactgcaacctccgactcctgggttcaagcgattcacctgcctcaacctcctgagtagctgggattacaggcacatgccaccacgcccagttaatttttgtattttttatttattttttattttttagcagagacagggttttaccatattggtcaggctggtctcgaactcctgacctcaggtgatccacccgtctcggcctcccaaccaaagtgttgggattacaggtgtgagcagctgcctccggccgagcaatacatttctttgtgtctctgcattagcgttatacttttttttttttttttatattgagagggagtttcgctcttgttgcccaggctggagtgcaatggtgcaatcttggctcactgcaacctccgccttctgggttcaaacaattctcctgcctcagcctccggagcaactgggattacaggcatgtaccaccacgcccggctaattttgtatttttagcagagacggggtttcaccgtgttagccaggctggtctcaaactcctgacctcaggtgatccgcccccacttggcctcccaaagtgctgggattataggcatgagccactgctcctggcctagtgttatactttaaatatttttatttgaatacctataattatgaaacctgcaatattaagcatagttaaactttcaaataaagcaaatgtataaatatatccaattctattcatattcacttagtccactttctcatttcacacatttaacaaagcaagcaatgataaaatatgcatgtcttgagtattataatttgcatttgaaactgcagaatcttctggctgaatgaatcaataatgcaaatatctttctaattagatatttagtgttttttagttgtattttgtaaaatctaaagttttgtgtacaaaatagtttttttttttttttttaaagaaatctgacagatcttttggtcctgtgtttcaaagtacattgtgaattttgactgaaatcacagttgtctttggtataccaaaattaagttctgcatagtacctattttagtgttacagtcagtgtaactgctggaatattcaggtctagtggaatcagtaattatgtaagcctttcttgttagaggatttcttggcttagatacatcccttatatgtgcattgccccttattgccttattgtcattctaattactaccactcctttgtccccatccccaccccatggccttcattctttgttgctatctttgtgagtagaaagacaaactataaggaaaacttgtatgtgagctgtgtggggggagcgggtgagttacagttatttctaatatctaaagagttgtgtagaagaattagacttgcttgatgaaggcacaaaaggaataagtagaaccaaggaataagttgctgtgataaaggcatgaaataattgataacccaagatgcctcgatttggacctgctgccttaagagatactgagttgaatgttaaggcagtgaagtgcaatggaaggaatctgtgagcttggaaccaggcagacctgtatttcaattttgggtctacttcttaaataatagctgtgtggtcatgagcaagtcactaagtgacagaaccttggtttctttatttctaaactgggagatgatgcttaccttgcaggttgttgtaaaaactaagacatgatgtgagtaaagccccttggcacagtgcctgtcatgtaataggtctgtctattattgttgttttattcattttttgagtgatcaaaggttgctctttaaaaaaaaaaaacaactctaggtttagtggtacatgtgcaagtttgttatataggtaaattgcatgttgagggatctggtatacagattattttgccacccaggtaataagcagaggacctgataggtagtttttgatcctcaccctcctcctacctgccaacctcaagtaggcccccttgtctgttgttcccttccttgtgtcaaagaccactctttagaaatgatgttgaaagattgtacaaggtagtgaactaatataatttgtattatcccgtttatcttgttgatatgattctatattacttttaaagatatatggttgactggtaatgagcattatccccttctcttgttattggtatactgactaggttagtaattcatttttatttttatctttaaaaattattattattattttttttagagacaaggtattgctctgttgcccaggtcagagtgcaatggcgcaatcatagctcactacagcctctacctcctgggcttgagggatcctgccatctcagcctcctgaatagccaggagaataggtgcacaacaccacaaccaggcaatttaaaaaatttttttgtagagttggggtctcgctttgttgccaggctgatcttgaactcctggcttcaagcaatcctcccgccatggcctcccaaagtgctgggattacaggcatgagctgttgtgcctggccaaggttagtaattcatggagagaaaatgggattgatgctttgctttccagacttccacaggctttttaagtgaaaatgcaagttgacatatgggaattttaaaattatcattttgttattgattgctatgccaaccaatactcttttgtttgtttcttcccttactaatttaagctatttgacctggaactatagttcatgtagatcttgtgggcattttccaagtcgttatttctacaatgcctattaatatgtgtcttctatatcaagcaatggcactttttttgttgaataaatggatacaggggttgagctgttcataatttgatgcattttcaggctgttgtaagtgaattgaccatttgctcaaaatcagtgaacattaagctattaaagtaattttcatgtctgcattactgatgttttttttggaaaaagtatgaaattgaggaggatcatgataaaatgcatttatctttattctgcctttttgaagagaatcttaaagggcacaagcctgttggcagagatattcttaagtgataaatgataatgacaagagtggcgatggttttttccatcacagttttggggatcaaggtgagtcagagagaatgatatcctaaaccttagcttcttcattaaatgacaacaaaactgtcatttgctgatttttggccatcagaagtattatctagatcatattatctatttataactttgggataatgggtttctgattttatgtaatgtacttctcagcccttttatttatttttttatatagctttgattctttgaagctggtatgtgaagcacaagctttatttatttacttatttagagacagagtctcgctctgttgcccaggctggagtgcaatggccggatcttggcttactgcaacctccgcctcccaggttcaggcaattctcctgtctcagcctcccaagtagctgggattacaggcatgtgccaccacgcccggataatttttatatttttagtagagatggggtttcgccacgttgaccaggctgatcttgaactcttgacctcaggtgatccacccagcttggcttcccaaagtgctgggattacaggcttgaggcaatgtgcctggccgagcattattttcaaagtgtgctcaactggagtgcttctttctcctaggatgcccactatttgtgtagggccaatacttaatgattgttttttcatgattgctattaaagatactatttttgttacccaccctgatgctcgtgcttcacataacagcttcaaagaatcagcgagcatttggaaatgtataaaatgactcctgtcttttgtcaggagtagaatatactgataaaatcctttctcatgaatgatgaagttgccagaaatttggaatacttttggactgacaacaattacatgataaaatattgtgaaaactatttgtgaataaataatgaaccaatactacttctgttcactcagaacaaacataatacagtggttcagaagagcgtagtaaccttcatattgcttaatagttcagtaaacttttaatgcctctgaaaatgcataatagttccttaagaaagcatggtaggataatcagaaaagactttttttttttaatttgacaccaaagggattcatatatgacatctgttcattttttccacttcccttcttctagtaaaatacctagaaataattattcctagagaccatgtgatatttccacctttagtgtctagcctgcaattatttcaacaaagtcctcttggtacagtaaatagtaaaccccactggaccaaatcctaatagtatagtattggctgccatagtgtaacacacatggtatgtttacattaaattggtctcatgtcttaaaaagcatttgtctttatatttagtatagatacaatctagagatagattaactggctagatgatgatgataataataatagctaatctttattgagcacttactatgtggcaaacattgttctaagtgtcttatgtgtcttaattcacttgttataacatcccaaatgaagtacgtagtgtttttattccactttatagagacctaaactgaggcacagggatttaagcaactttcccaagattacacagctagttaagtggatgtaatccaggtaatttgattcaagggtccattctcataaccattatgtgatactgcttcatagccattgtgtgagactttaagagatgctgcagtgctttctcctttttcactacttcactatttctcgttcatagccctttgttcacagggaaaacataggaagggaaaaactagaagctccttgagtttcacctgtttattccagatttttatctcgtggtgtctcccattgtataaactgagatcagtaagaactgttattatgccatatgtttctaatcatagcaattgcttcattctctgaggcatacaacacatgaaattattgtcagacatactgattttatacgtttacaaatgctcgtttaaatagccattgaaatacaaacttcagtaaagagagtaatgtttggtttgcatgatgtctgaattctaagatttggcaatggagtaaagattttgcctagatcttatctttttccccccattctacagtgaggtacaatgataattgttatcatagtgatgaccctgggagagcattaacatcttttgttccctagaatgtacttattgaagcaggaatgtggatgattatgtttatgtttgattttgtttgtttttgagacagggtcttgccctgtcacccaggctggagtacagtggtaccatctgggcgcactgcaacctctgcctcccaggtttaagcaatcctgacacctcagcttctggagtagctgggactacaggcgcatgccaccatgccaggctaattttttgtatttttggtagagacggggttgcgtcacgttgcccaggctggtcttgaactcctgaactcaagtgatctgcccgccttggccccccaaagtgctgggattacaggcgtgagccaccttgcctggccggttgcttatgttttagatgtacagttgtccttaggtgtctgtggggaattggttccagaaccacccccccttgccaaatcccttatataacatggtatagtatttgcatataacctgtgcacatcttcttgtatactttgaattatttctagattacttataataccaaatacaatgtaagtgctatgtgattagcagctatactgtattgtctagggaataatgacaaggaaaagagtctgtatatgttcggtacagacaatcatccatttgtttaaaaaatatttttgatctgcaactggctgaatccatggatgaggaacccacagccgcagagggctgactgtatttttactgacaaaagtttaaacataaaagcaataaccaaaaaaggtagtttagtcacaaaaagtttaaagtgaaaattaaattaactacaacatactgtaattcatgccaaacagttgttcctcctaatcaatatttgaattttgaaagagaagtaattgtatatatattgtaagaattccactgtagatgagtcacagagcagattgatgatcgtatttttttgctatggtagttaaaactttttattcagatttttatttagtgctaaatgagttcaaaatgtatattacctctctggaaaagctcttatgttagactgtcagctatctagtccattttatattttcaacttgaaaaatgtttaaaatgttaatttatttcaattaaaatttaacaggttgaaataaaatgaacatcagatttctcttttgattcactccaattcagaaaaacaacttttgaaatcttacaatgtggtaggcactgaacgtttcaaagactgttaggaaatggttcctgtgttttcaagctttttccagtggccagttggtcacatttatcaaatgtactaaaactatgtttttagacatactctttaatatattcatgtgaagtttacagaattatgtttgaacacaatcctttttgtaggtgttcacagtttctatgaggttttacttcactggttttcatgttatcttcataatagcattttaatgaatatttatttctacccaactccttactattacagctggagggagctgtgctacaaagagagcactctctgttgagagaaacttggaaagttgagttaacatattggcctgggttgctaatcccaaagaacaggaagtcttagggctagagtgagggaggagattgggtggaaggggtatagtctgaagtctccaaagcttagagctctgacagcctacagttttattttgcccttccaatccatccaatgtgactcttttgacattcttaaaataattgagaaaaaatttctgatatagcttgtaaattctgctaattgatcctttagtaaattgaccatttggcaaatagtcttttctgcgactacatcaagagtccctgttgtcaaagaaatgccttagcaaatggaagatataaataatacctttaccaagttacaggtaaaaaggtgccctattaattaagtctgattttcaaaataacccactgaagagtacagggattattatccctaattaatatctgtatttaatactggaagattcagagaggctaagtgagttgccctcagttaaaagataatgaaaatggaggaatcaagatttgactcaggcattctggccagtaagtgtatttccattataccattctgaagataatcactttgtttaaataatttcatttttcacattttgagggctagagagatggggacgggagatgaaggagtactgaagtttgctcacttgatgacatgtttatgtatacttttcctgtacttaggaaatcaatttcacaagacattgttttaagaaattttaagcctgttattatagacatgaattaactacacactgttaatttagaaattattgttagagcagttattatttttgtacatgacagcattagaaaataatgaagttctaatattttgatttttatagctcacatccctattctgggtctcctttccaagttttcaaacttagcaggaccacagaatttcttgttttagactgctaattatcttaagacaaaaagggatcatcctaggttctgctggttctcacattaaagagaaatttccattttccattaatgtattcaaatacattcactttaaagatacctatactgtactgctaaagagattaccctctatgtcttattctctattttaggacttcagctttcagaaacagctgtaaaactttcttaagcattatgaatataatatttctcaactcatcttaaaacacttactatttactatttctcttattagatatggcttctgaaatggtttaattgcacttcaaaactatagcattttattgattttattttttgaaagctgctttatgttctgtagtgtttaatggaggataagttactagtcacatatgatactgtgcatacgctagatttaaatgtttagtgcttacttttgacaactacgtaaagaagatctatatactagttctggatttatttttgaaatggaaaattgtgcttttaaaattattatgggtagcttcagtttgtatcacagtataccagcaccaatacattactggtgtcatcttacgtgatgtatgaaaatttgaggtactagagtattggtaaaatgctatttacccctatattcttactcatttaaatccaaagctaagtctttctactggtactaaatattttacatcgcaatggaaaattttaataacgttgtacaaaaatatatagagaaactaacaaaaatccaaatgacctcattcatcttttaagcagttaaaggcagtggaataaagtgtgcaaaataatgacatgcaagatgaaaaccacctaaaccttattttcctttcctagcctagcttgttctattatgggttttatatgaacatactttgaaatgaaatccattagttgaaaaacaaaaataaaattcttaaccaagtggcaggcatatacaatagtccccccttatccacagggaatatgtttgaagaccctccagtggatgtctgaaaccatggatagtacctaaccctttatatactctctctctctttctctctctctgtagtgtatatatataaaaaaccaagactctctctctctctcatatatatatatatatatatatatatatatatatatatatatatccatctgatagccaaggcagctaccaaatgactaatgagcaagtagcctatacagtgtggatacactggacaaagagaggatttgtatgccaggtaaaagagtgtgggacagtgcaagatttcatcatgctactctgaatggtccacaatttaaaacacatgagttttttatttctgcaattttccatttaatatttttggaccatggttgattgcaggtaactaaagctgtggaagggtaaacaaaactatggataagtggggggctactgtaacataatctttggtttttaggtatatctcagatgtatctgaaataaacattgagatactgaatgaatattttatagcaaccatcttttctttaaatctaagcatccttcttaactctaaaattatgaatctaatttgtgttacattttatattgctaatttcttatttttttattttatattttatgttcagtccatctttccgttgcttggaatatttttctgaggtaattagaaatttatatcttctccttagatttttttctgaagtcttgttacagtgtgatggtttttcttcatttaattaattagagaaactatagtataactaaattcatgattgaacacattttatacaaattacaattgagagccgagggactatcttcagcattaaaaactcaaacattcctaactttactgtaatgcccttcaaattaggattgggtttatttagcatataagagcaagggctatgcagtacgtaaatacaatacgtactaaaaaaatgttttgttgcatattcatttatttattcatatatattattacaattttattgaattttgtacaaaccaatgcagcaataaaaaactatggcttagtctatatcctcatgaagatgaggatagactaagatataaatatagatatagatataaatataaatatagatataaatatagatataaaaccaatattcattttaatcatcctaagtgcttaaagaaaacatccaggagattagagggacctagtttgggaggacagggaaggcttccctgaggaagtgatatttaagctgaatctttaaacatgaataaggattagataagcaaagagaataggaaattttttttaatatggacaaattagagcttaatattttaaaaatatataaatctgagattggatattccgaactaacaattcaagttatttaaacattgtgagctttataacaacatggaaataacaatatatggcagttttagaaccttgctgaaaaataaccttggtaaatctaaattttatttaaaatgaagctgtgtggcacacattgattcaaactgtctgtaaatggagtattgagaaggaatatgacagccagcaaatgtcaatggcgactttgattaagaacagaatgttgaaaaacaaatacctaacaaaaactaatcaattaaagtgtgtgtggagtggagggaggaatagctcaaaacacgaaagatgtttataaggagccactatgatatctaattctccatgccatttaataagcagactagccatgactgtgtacctgacctgttgaccccaataactcattattcaagtgtttactagataattttcatccaacagcaaatttcactgtgcctattctaggtaactgtatgctggggccctctgggtgataaaaggtgttttattagctgcttccagacaccccagttctcacaaggttaaataaattgtatgcctgctaaatgagttagcaggagatttaaaaatagaattcaaggttttttttttttttttcctttgtgctttcttactgtggttacactatctttaaagtttgtgttggtttttcagcagcacaggtctagattagttgcatttgtatacttccaaagagttgcatatttatttgtcctaatatatatatttaaaaaaaaagttgttcagagataaagggtaaacacaataagcttactgatcattcaaaactgcctgtacctactcatttgctctttcagcaagtgtttattgagtatctgtggtgtgtggtgttgaagggttatccttaggaaacccaagaaaaaaaaatgtggtcttggccgggcgcaatggctcatccctgtaatcccagcacttggggaggccgaggtgggcggatcacttgaggtcaggagtttgaaaccagcctggccaacatggtgaaaccctgtctctactaaaaatacaaaaaaattagctggacgtgttggctggcacctgtaatcccagctactcgggaggctgaggcaagagaatcgcttgaacccgagagtcagaggttgcagtgagccgagatcgatccactacacttcaggctgggagacagagtgagactgcatcttaaaaaaaaagaaaagtggtgtttgcacttgaggagtttttgatattactaatgttatgaaaggtctgcatattctcacaagacatgaagctgaaaacgtaaaatatccttctgaattctggggttttttgttttaaattagggagatttggaaaatacctgctatagtatttcatttctgctgtgttctatgtgaatataatgtgaatgctcactgaatgtatatgctataccactggttgaaacttctgcaagtttattttcacttttgaaggtgtatattatttccatttttacaggaaagagggagtaaatacactcaggactaatagttgcttatttacaaaaatgttcagaaattacaagtcattactttaataaaaagtttatcatagtactgagtgtttcaaaatattatttctagagatattgtttattttcagagaaacaatctgttgaaatgtagatttctaaagtattttctgcatttgatatcaagtgtccatagaaaaacgcagtatcctttaggggtaccaagctaactaataagtgtgtttcacatacatttcgaaagttatgttgcttttattataagttggaattttcttcccattggaataacgagcgttttctttaaaaaggctgttaaagagaaaaaaacactgacccaggagtagcccaaacacctggattgtgatgctttcagcgatatagctgcatgaatttcaacagcacagtcacctagcatgaatcttgttttctttgttgttatctgccctgcatgtcacacatggttgttacgaggatcaaatgacataatatatgtgcaaatgcttgtaagttacaacttgttgtataatgtaaggtacacctattttctgaaagctaagctataagtattttttatccagtagagggagtcaaccatttgcatgttataaaaaccagatctaaatttcttctcctcttaaaataatttattcttaaatcaaagtaaatatttggagtaaagtatatgtgtgtgagaattcatttttattgatagaacagtgataaaatatttgatgaatacatgggtatttaataatatattacatatattgacaaaactcatttgattcccttgaagtacacttttttaattttgtattccagggtactaggtaaaatcattcatggtggtcattggttgtttatgctagatattggactatttcagccttgatgtctactgtgaacactgatgtagtggccagtggtgacaataaagtaaattgacaaccatgagtcagaattttagaacttggttgaaccttccatgtggcatggctgtagatgaaatgaaggctcaaacagatgtggtgaaatggcattttatctggcctattgacaatatccaaggagtctgctctggtcatgagaatgcagctgcatgttctttcaggcagacctttggcagaattgtggttccaggagatcagtctggtttggagcaaaaattcttgccaagctttgggattcaccatgcaggatgctatattcaattcctagagggaaaggttagcataatgccaagttagctagtgttcaagtcaggttcctggcccagcaagggacgtttaccctaagtacctgggactcaagacttaggacaggaaagataaatctagatgtgacttacaggcaatactgtggatcctaactattttgagttcccttgtcataattgagcctgcagacagtaggtgtcattgcctggaagcagccatttgtgaggctggaggaacatactaagaaacacacagctgaaatgtgacagatatgtccgcttctctctgcttcttttaactgatgtgggaatttgattgatacaaccaagaaaaacttgttatttttgatacctctgaagacaatccctgtattagaaatttaaaagcctggagtcacatgtatttgtgtctcatgttccaattgaaggtttgaattttgaaagagtttaggaggaagataagtcaatggttgactatgtacctaaatttattaaaattttaaattaaatatttagtaaagtgatgtgttatcaataccatttccttataacaatagtagccagtttgagaacatgatgaaaaaggtcacattcataatagtaaacaagtataagctgattttaataagcttaataggagggtatataacctacataaatctacagcactttgagagctatagaaagcgactagaataaatacgaagacagtgcaattctagatggataaaggccataaatatataaaatttctcttgtaaatttatacatctaacataattataaataaaaacaggaattttagttgactttattgaatttagcaagattattatacagatggaagaggaaactggcaagaatgtaaaatgccattttgagaaccatgggcaatattttggtgatgggggactaatcctataaaaagatgaaggattcacatttttaaaaaagggagatattataatagcacacacattcatgtaaataagtgggaatagaaagaaagttcaataatagattcttatttatttatttatttatttatttatttatttatttatttattttttgagagggagtctcactgtgttgcccaggctggagtgcagtggtgcagtcttggctcactgcaagctccgcctcccaggttcatgccattctcttgcctcagcctcctgcatagctgggaccacaggcgcccaccaccacgcccggctaattttttgtagttctagtagagacggggtttcaccgtgttaggcaggatggtctcgatctcctgaccttgtgatccgcccgcctcggcctcccaaagtgttgggattacaggcgtgagccaccatgcccgccctagattatgtttttgcatatgtatattataaatatgaactatgttttctgtaaggatagaaaataatggggaggaaatatacattccaataccattcattaagtaatctgcctgtaaatctggctccataactcatattgtgtaccaaaatcatagacagattaaaagtaaacattgaagtgaaaatattgtaagctttgaattaattgaagttacaaaaggacagatttacaactttgaataaataaaagctaaactgtatagaatgctgtaaaatataaaacactcagaaaaatacctgcaagtttattacacacgggattaatattgttagtatccatgcactgcatagaatgtgatggaagcatctaggtttggatagataaatgtgcaaaaaaatagacaatacgtatgagtggaaataaaattagtaaaatgggaaaaactttaacataccaattgagaaatgcaaaatttgaaaatgaggtatcattttccatcttttcaattggaaatcttaaaatggcattgcctaataccatgaaatttgtgcattactgtattatgctggtagcattaaatctgtttgaaaagaatttgacggaatataccaatccttgtatctattgacccctgtgatttagtattttggacaatttaccctaaggaaattatccaaaagaagaaaaaagtatttatttgcaggattgtttatactaatggaaaattggggtgggcagaaaccttaattccaagagggcaatgcttaattatgagccatacactcaggagtattatcaggtagacactagaatgacttagatatgctgtgtagaaaatgaaaacattcctctgatacagtggttaaaagaaattacacgtgtcatatgatgtatgctttcagttatgtacaatgtaattatataatcgtatgttagatgacaatgtgaaaactaagcttctagtctggtgggatttttaatgacttataaaaaattctccccggactttatggggtaaaaggaaaatgagaatggcagagatttttaaggttttaatgttatgaatgctaaagtattctgctaagtaaaaatgataataacttttattgatcatgttctatggaccaggaaccatagagtgttctgcatttattctttcgttctgaaatgcttgaaaactgaaaaggaggtttaggcaggatatacttgtctccataagatagaagggctgtgataggatggaacaatttgaatagtcctttttcattccattggaggttaaaaaaatctattatcagtaaagtaaaaattataaggaaacagatcttaatgctaacaaaacaaaacaaaacagcaacatacgtgtccctttctttgctttctccacctcaggaaattgacattgccgtacttccagatgtctaaactagaaacttgtgtttcatacttgattccttgcacttcctcattctctacttccaatctgtgaccacattctatctattctaactgctaaaatatttctgaaactcatctgctccttcccattacccctgtcacctttttagtttaggccaccatcctcatcaccttgattacaatagcagtctcctaactggtctctttccttccatccttaccccctttcttctattcgctacacaaatctaaacatgtcactcaccagcttacaaaaatcctcagtgatttcacttcgctggattaagtccaaaccccttaatggggctttcaaggtcttcatgacttatatttacttcaccagcatctgctccccagcaaataaattcattctccctttcctgctccttgtccctttccccaccccatctctctcagtcacacacatgcaaatgtacacacaaatacatgtacacccctacagccataccgaacttcttccatttccatgactctgtttcattctctctcatcactgaatcttccacggtgctgtgccctccacctggaacactctccgttacttgtccaacctcgcctgagctttctcttatgatctcttgttcttgcttatccttcagttttcatattagacattccttctcctacaaaggctttttggacatctgggttgcatcctcctatgtgctaccctaataccccattccataccctttatacttacattactgaaaaataaggaccacctgagtagcattgtacctttggtttactaccatatccgtagagttagcagagtgtctggcacatagtagatgcgtgctaagtattcattgaatgaatttgtatggtttgggcctgtgttgtcaactacttaagatttatatttttaacttcaaatttgagcactgtcttcttggtcatcatattattaacaacaagcacaatgccaaacacggtacattttcagtaatgattggaaatgaatgagtaactcagtaagtatttgaatgaatgatcattgtaatggtgacacctcactgagattaatgagcattcatcctttctttaagttccctgaagggaacttcatttgtctctgttttacctaacatagtgtcttacatgtagtagacactcattggataattaccttcaattcccaagactgaccactatgtacagagttccagctagtgctggcgttaattaggtgatcttgaccatatctggaatttgaacttgagctggatttctctgtatatttgtgtatgtgtgcctgtatgcatggtcatgtcaacatatattttttaaagacatagactggttttgtattatgtatacagtgaccattaaaacaatgccatcacactacaaccagtcagagttctcttcttgttgttggttgttcatttgttttactgtggttgtttttgccttggactttgagagaatcctggactgtaaacttttaaggcaaggtttaagtcttgtcctaatcattcactgtgtagtcaacaagaaggtgttaggacttgagaaaaaaaattacctgaaggaaatatatatgagaaacgctttatggggaaatttttttgtcttttctgcttgactgtagaacttcaggtgttgtgtaatacgtattctttcacctccacttccctctgtaaatgtgctttactcataaatgtctgtctataaagatgtgtcctgggtctttaacaagtaggaggtggtacatacttgaataaacatcctctaagtggttgaggttgaaaaggtgcaaatctttcctagttgaagtaggagaggctgtacctgctttgttatgagtcctttctttgtgttctcattattcctttttttttttttttttggttctacatttttttcctgtactattttgtacagctcctttcttatttttttctttcacctctcaactctttcattatcactcttttttcatttattgaaaccatatatccatgttttttgagtgactttgaccagaacagttggttcagctttctttttaaaataatatttaatgtatttcaattataaaagtaacaatctttaatttagaaaatctgaaaacaaaggaaattttaaagaagagagtatgtatctaaaatcctcttacttaggtataattatcattaacattgctataaattactatttagattttttacctaattgaaatcattctgtacctagagttttttttacctaattgaattttttacctagttgaaatcattttttacctaattgaaacattaggtaaacatttttacctaattcaaataattctgtacctagagttttgtatctcattttaaataatattgagtcaaagatgtatttccacatcattaaaatactttaataggccagacacagtggctcatgcctgtaatcccagcactttgggaggccaaggcgggcagactacttgagcccagaagttcgagatcagcctgggcaacatggggaaagcctgtctctcttaaaaatacaaaaaattagccgagcatggtggtgcgcacctattgttttagctactccggatggggaggtgggaggatcgcttgagcccaggaggtcaatgctgcagtgatatgtgatcacgccattgcactccagcctgggagacagagtgagaccctgtctcaaaacaatttttaatggctgcataatattccattttaaatagataaagcttacctctttatttcccgatatttgcactgttcaatgtatttacaagtttctctgatataaaaatgatgtcatgaataacttagaacgtgaagtcctagctacagttcagattgtttcctgtgaaagattcctagaagtagcattatcaggtcaaaaataagtcatactttttgaggcactttttttttttttttttttaaccacatggctttccagaaatgttatgccaaatctgctcattgctatcagcattgtaaaagaatatccatcttaccccatgggtagggctttttagtttctttaacggtattgtagtttctttaacagaatattaacagaatactgttaaaaatggataaaaatggataactgtgtgaactgttatcaaattaattaaacaaagaatattatttggcatacatatttgaatcttgttctgaaggcagtgggtacatggtgtgttttcttacaattggaatgtcttgtgtgtgtgtgctgggttgttattctctgaaattgcattactgtgttaaatccccaaactaaagcagtgaatttttttgtaagttctgtatctttgtggccttgacaactgagccagtcctttggagaataagcaatcctggactgcattttaggacaatgagaactgccaaagtcatgagagagaaagacgaatggataggacactgaagtagaaatcagatgccctaggctttattcccacatccatttgtcattgtgtatcatggccaaatttgattaaagaactttcccaatctgtaaaacggggataatatgtctcaccttacagggatggtaaagggattactgaaatatttttttctaattcattttgtgttcttccaaaagagctctaatattcagaaccaaatactgaaatctatccaaaatctgaatggtagaaattaactattatactttcaagcattttaaaccccagtttattaagaacctaaccccttagtgaagagggacagatagtcaacagaagaataaacaaagaaaataccaaatagtaatgagcctccaaaagactaaaacattgagtgttcttttttgttaagatgccattttaacccatttatgccagaggctgcagattttttatgtgaacaatcagaccttggcgatgaccttgagcagtaggatataataactcccacaagcttagtgttccgatactggaacagtaggcataagtgggttagttgtgtgctgcatcatattggttggccagagaaggcctgtgcaaagaggggatatttgaatgatgggaaggagacaaccatgttcaaattcaggaaaggggccctctaggcaaaaagaagaacacatgcaaaggtcctaatgtgagaatgggttttgagtgtttgagtgccagataagagaccagtttggaagttagtaatttggggcaggggagggcatcagatgaagttgtagaaagaggtaggggaaaaattacccagggcctggcaggcccctggaaggagtccaaatagtccatagtttggatctctcatacttactagctgtgtgacctcagataaagttttttaacttgtgtgaatttttgttcccatttataaaatgtgtgtgattactgcttttcaagattgtttctaaggattaggataataaatttagtgagtagtacagtgaatggcacatagtacactcaagaattggatattgttgatgatgatgtttggacaggaaataaatgtccattgtgtacctaactatgtgtcaggcatagggccagacactttacatttatttatatttaaatcctcaaaacaattctataagatataatgaaactgggaaaaattgttacttgtacagttaaacagtggtcttaagtagcagactactggattcaaatcaaattttcatgactccaaaattagttatccctcactcctgtatcatatcgagggagtcaatcagttgtaatgtgttggttgcttttgtatgtaaatataatttgtgactagacgtgcttttagagatgaggccagtctttgaccttacatgaacagctcttgccaggtgggaagtttgtgaatgttcatattcctctcaatgcttaggatcatgcctcgttcctcctagaatttcttattatattccttgactaagtggatctgcataacaatattaatacttgcctgcaacatgccccaatttttaaaataacctaaggaatattcaggttttttgtttttgcaagatttcttatttttcccaaagacatatttcatatagcagtcttttcctttgagagtgttttgcccttaattgtactagttggaagtgtcagaatagtgcattaacctactgagctccagatggctgacttttttttgttattttatcttgtcttgtttaaaggaatatagaattggcagcagagcccactaactgatgtcagatttggttagcataaattgtatgtttaatatcaagtaaacatgcacttaaaaatcatatgagttgtactttttattctttgctgtacaaaatcttcactgaatatatttgataagttgaaaggctcattcattttgtgagaaagtttatgagattactgattatattacttattgaaaatatttagtatctatatcctactttgggtgtagaaaaaagaaatgaagccttttggaggtatgtgtgtgcatgtctgttgaattgttagattatactaattttttctctgagaagtaaatgacatgctagaatagtaaattgtataatgtggaccatgaaaaagtattatttctaaaataattgttttgaggaaacagaaatgtgtgtttccttatattcaaattcacaacttaggtccttagaggtaagaatgctaccagcagaaacagatggttggtaatctgtaaaagtaatgccatcatattgggtaatgccatactgctgtttctattggcataacctctaactatgacatgatatatagcacttatgggccagaacattgtttgtacttttataaaaaccctacaaagtctatacgctcaagtactagctcagtattcttatcaggttgggtttttgttttgttttgttttgttttttttagacggagtcttgctctgttgcccaggctggagtgtagtggcatgatctcggctcactgcaacctccgccacccaggttcaagcgattctcctgcctcagcctcccaagtagctgggtttacaggcgcgtgccaccatgcccaacttattttttgtatttttagtagagacagggttttaccacgttggccaggctggtctcgagctcctgacctcaagtgatctgcccgcctcggcctcccaaagtgttgagattacaagcgtgagccaccgcacctggccagattgttctttcaagttaggataggactttggggtaagcagtatttcgtgatattcactgtataccattttagaactgaaattggttcatgcagcaaagatgaattatttatcacaaaaggcttgaataacctatacatgcatcactgctatagaaaataaacacatatgtttgagtttgttaggtaaaattagtttattgaaatgaaatcccccaaaatcaactttcatatattttttgaatttatatatactaatataaacaagtcattcctcttttaaatattaaccagaggagtatcccactaagatactatttgatttcaaatatgtcagtgttaactttaaatattttaattatactgtttaactacgtggcaacatagggtacacactatagcagcatctcttatacaacttatcaaatatacatgttaaatacaaaacccataaaatttaaattaacattattttaagtaataaatcatttgctgactctaaattgccaattacaatgtgaatatactacagtgcgggcacttttgggttctctgtgcctaccgtgccgtaggataacccaactgtgccactagtgttctctgatctatggttaaattttgattggtatagcatgctgcgatgtcatttggtctttattttggtacatatgtgttttcacactaaggccatctcattagccagaggtaatgaaagttgtacttcctggtaacagtgtgaatatatggatgctgagactaattggcaggacttggttataaggtagttatctagatgatccagcttatgcctagctttatcatattaagaaatgaaacttcagaattttaacattaccttaccagactcagggatgattaaaactatgttcaaggatcccagtttgagtaccattgctgtgagctccaggtatattgatctaacaaatccccgaacatagcatgttgtattatgacccaatatttattgtaatttctaactgaaatagccttatctacctttggtgaacagtttttacagctgggcagaccttcttcccccgcatagagtcaagtcctttaaccttcaaactcccttatcaccccctatctattttgaaggcacatatcacattgacagtggtctgcatgttgttgcttaccatacctgaataagctctgctgggatggtgaggatatatcatcgcttatctctgtactctcagtgcctggaacctcatgggaactcaattcatgctgactggtaatattctaatacaaaaatgataccatatgcacagtaagagatagatgccttgtgtctctgtagtctattttgtgaagaaaccgagaatctgtataatcaatgtgtgtgcagagaatatagtgaatgtgtgtgcagagaatatagtgtccaattaaaattttatgctttaaagaagaaaagcttttgctttagtatgcatatagtggcatattccaaatcatagattcaacagggcaggacctttgggatcatctagctcagtgggtttaaaaccttattttatttaacataagagcagcttattcataaaaaatcatatgtgggatatgaataaattagaagataaatgtgtaaatgccctcatttttgggggagcagagacttgggaagtctccccaggagccttccttttttgcacattccctactcaccctccaaggcaacctggaaaacacctcaaggaattccatggacccctgtgaaaataatagtcttctcaggccggacgtggtagctcatgcctgtaatcccagcactttgggaggccgaggtgggtggatcacaaggtcaggagttcgagaccagcctggccaatatggtgaaaccccgactctactaaaaatacaaaaattagctgggcgtggtggcgcacgcctggagtcccagctgctcaggaggctgaggcaggagaatcacttgaacccaggaggcgcaggttgcagtgagccgagattccgccactgcactccatctcaaaaatactgctactactaccactactactactactactactactactactactactaatactagtctcctacctaaggtaagaatccttttccagcatctcagacctagtggcaggtctttgcttgaataatttaggtgaacagaaactaataacttcataacatgagcagtcaactaggcaattgttaacgaaagtactcactaaattaatgataaaataatgtataatggcaccaaacattagttaagtgcttattatataccagaccttatgtttgaccaggatccttatttcacccttatgacaagcctgaggagggtagatgctttattgttcccattttgccaataaggaacctcaggcccaggaagtcaagtaatcacttgactaaattcatacagctattaaggtaaggaatatttcagaaacttttgcctgcttttccctttttgttataatcctcctttggaagcaaattatgcccctttttaagatggttttgtactgtcctcagagggcgactctatagcctgggttctagccttgcttctgacagttagatatagtctcagacaagacatgacttctccgtgactcagttttcacagcagaagaaaaaatggttttagtaatattttccctgttgttagattcagatgaaatagtatgcaggaaaagttgtgaaagctgtttttgctatagaagtttaaggtatcctttatttatttattttttttcttgagacagagtctcgctctgtcacccaggctagagtgcagtggcgtgatcttggctcactgcaagctccacctccggggttcacgccattctcctgcctcagcctcccgagtagctgggactacagacgcccatcaccatgcccagctaattttttgtatttttttttttttttttttaagtagagatggggtttcaccatattggtcaggatggtctcgatctcccgacctcgtgatccgcccgcctcggcctcccaaagtgctgggattacaggcaatcccattcagtgctggaggcacacatccatttattcatgtgacaattagttacatttctttttatttttccttgttttcctatcctttggccattttactattgatgcactacctcccatcagcaggtagacaaggaactgataaaattcagtgtgttcattttgtctgatagcacttactaaaatgtttagaaggctagcgttttgaaaataatagggtaattttttgttttgtggaaggaatatttctttatttcatttacaatgtatagcttcattacctacttaaaatgcagtttatatctaggctgtaggatacatttataatctgcaaaagtattattaaacttgctttgttacactgtctaaagttactcttggaatcggatttacaaaatggtaaagcagagagggaaaccattttatttaaataccttcataatctttgccccaacacaacaaatgttggtaagtcttactgttgttcctatctttaaacagtacaatgaagagattgcctatgcgaaatacattggttatcctattgcacattatcattgatcaaatcctgcccattttttaaagtcactatttacatacatgaactttctttatttaaaatggtagtgggccgggcgcagtggctcatgcctgtaatcccagcactttgggaggccgaggcgggaggatcatgaggtcaggagatcaagaccatcctggctaacacggtgaaaccccgtctctaccaaaaatacaaaaaaaattagccaggcgtggtggcgggtgcctgtagtcccagttactcgggaggctgaggcaggagaatggtgtgaacctggtaggcggagattgcagtgagccgagatcgcgccaccgtactccagcctgggcgacagagcgagactccgtctcaaaaaaaaaaaaaaaaaaaaaaaaaggtagtgtactttttcttctgtcctaggacagtgggtggagtaaatgcagtgtaattccaaaatagaggtaacaggctactagaagggttcttactcattttgtgccatgggcccctctgaaagttggtgaatttatggggacctttttagaatcatatttttagatgtaaaacacaaaagacataggattataaaggaaaccaatcatattaaaatgtacttataaaattgtttttaaaaattatgacacattccagagacataaacacatatgttcacacaaaaacctgtgcatggatgttcatagttttattcatagtagacaaaaactggaaacagcctaaatgttctttaacgggtgagtggttaaataagctgtattatccatactatgggatactgtatggcaataaacaggtataaactattgatatacacaataacttgtgtgccttcccagggcattatggtgaatggaagaagtccatgtgccaaaaagttacatatagtatgatttcatgtaaatgacattcctttttttatgggtacatagtaggtgtatatacttaaggggtacgtgagatgttttgatacaggcatacaatgcataataatcacatcagggtaaatggtacaatctttaattgtacaataaattattgttgactatagtcaccctgttgtgctatcaaatgccagatcttacccattctgttaaactatacttttgtacccattaactatccccatttcccctccccacccacttcccagcctctggcaagtatcattctactctcttatctccatgagttcaattgttttaaatttttgctcccacaaatgagaacatgagatgtttgtctttctttgcctggcttatttcacttaacctaatgtccttcagttctatccacgttgttgcaaatgacaggatctcattcttttttatggcggaatagtacaccattgtgtatatgtgccacattttctttttcttttttttttttttttgagatggagtcttgctctgtcactcaggctggagtgcagtggtgtgatctcggctcactgcaacctccacctccctgattaaagcaattcccctgcctcagcctcccgagtatctgggattacaggtgcacgccaccacgcccggctaatttttttgtatttttagtagaggcggggtttaaccacgttggccagactggtcttgagctcctgacctcaggcaatccacctgcctcggcctcccaaagtgctgggattacaagcatgagccaccacgcctggcccctgtgccacattttctttatccatttgtctgtagatggatacttaggttgcttccaaatcttggctattgtgaatactgctgcaataaatatgggagtgcagatatctctttgatatactgattctttctttttggcatatacccagcagtgggaatgctggaccaaatggtagctcaattgttagttttttgaggaagctccatactgttttccatagtggctatactagtttacattcccaccaacagtttatgagggttcccttttctccacatcctcgccagcatttgtcattgcctttcttttggatggatacaagccattttaactggggtgagatgatacctcattgtagttttgatttgcttttctccaacaatgcatgatgttgagcaccttttcatatacctgtttgtcctttgtatgtcttcttttgagacacgtctactgagatcttttgtccatttaaaaaaatcagattattagtttttttcctgttgagttgcttgagctccttaaatattttggttattaatctcttgtcagatgtatgtatagtttgcagatatgttttcctattctgttgtctctttgttgattgtttgctttgcagaagcttttgaacttgatgtgattccatttgtaaatgatacttttgaaaaaaaatgatagaagtggagaataggttagtggttgctggggtggagggttgtgggaaggagatgggtgtggttattgaaaggccaacttgggggatccttgtggtgatggaactgttccatatcttgattgtggtgttggtatacctgaatttacacatgataaaactgcatagaaatgcgtatatatatacacacacacacacacacacacacacacacacatataaaaatatatatacacatgtatatatacacacacacatatataacacacaaataagtacaaataaaactagggaaatttgaataagatagatgggttttatcaatgtcaatatcccagttgtgatatcataatatagattaccaggatgttaccattgggggaaaagggatctctgggcattatttcttagaactgcatgcatatttccaatatctaaaaatagtttgattaaaaaattgagacacagtaattgtagttctttacaatatttgttaaataacaagataaagtggcaggttgtataactcaagtaattttgaagaagtgataagcataaatgatagttaaggtattttcacaagtgcactatgtgtggtataacaggaaaataaatgtgacttggtgaccaagttgcaggggctgctaataccactgtaatctgtttcctatattcatagttgaaagaagtactagatttaagtaagaggttactgaaaatatgttttcctttccaaattcacataccccctaaatttagaccccaggataagaacccctgactttatatctttttacatttcattatctgttatatctcaaaggcctctgtcaaataaaagagaaacataatgtgtatttgttttgcctcaaataccatggataatgatgggggctcatagaaaatactagtggacacacttcacagttttaatgatttacttgctattactcacccatatgcccattgttcaccaaaattgcttaacactagttttaaaagagaagtatatgtggattttaagtatagaataaactacacattattgatatgaaaaagaaatatgtcaaattgattgcttattatccagattgactaatattgactatcattaaatattttaatttgctttcgctaggaaatcagttaatgatggtttagccttcaattgtccgtatctctgagagtatctagatcaaatgaggctattgttttataagaaaggaaggttagtgttttgggattaatgttctactttaaaatatcacctttttgtttcctctaatgttaaaatctaaaattttttgaatatttgagtaattatttgaaattattatgaagtatttcctctatactctattggttaaatatgtctttcataacataagaagtaacaatatggacacagaattaaaaactatgtttagagtttgtgtacttgacatttctaatacaggctgagcatctctaatccaaaatcgaaaatgctccaaaatccaaaacttcttgagaaccaacatgatgccacaaatggaatattccacacctgacctcatgtgttgagtcacagataaaatgtggccaaaactttgtttcatgcacaaaattattaaaatcattgtataaaattatcttcaggctatttgtatgagttgcatatgcaacataaataaataacatgtttcaacttgagtcttgtccccaaaatatctcattatgtatttgtaaagattacaaaattggagaaaatcagaactctgaaacacttctggtcccaagcattttgaataagggatactcaatctgtaatacaagtgctcaaaaaatcatctaaatatttgttctgtgatggtctaagagtctgtaatttgggagtgaaatgcttaattgatatttagtagacagaagcttcaataagggaacaataaatgatttcatcatatacaaccttatacttttctttcattaaacattttagctaatcatattttagtaaacttatttaaatttttttgggaaaaatggcacatataatctgaagaattatgatgcttatacattgctgtagaaaagcttttatcacccctgccctataatttgcggtatattctcttgttttgcctattattttcatcctctgaaaatgccttagttagaaacagtgtttcctgcaatgggaaatgacacaatatgaagttaacctgatgacagtaattttctgtgtaggtttttttcttatagacttcaattgataatatgtagtatcttttaccctacatttttttgtgtggttaaaaaaaataaattaaaaaaagacttaaaggttagacctaaaaccataaaaccctagaagaaaacctaggcaataccattcaggacataggcatgggcaaggacttcatgtctaaaacaccaaaagcaatggcaacaaaagacaaaattgacaaatgggatctaattaaactaaagagcttctgcaccgcaaaagaaactaccatcagagtgaacaggcaacctacagaatgggagaaaatttttgcaatctgctcatctgacaaagggctaatatccagaatctacaaagaactcaaacaaatttacaagaaaaaaacaactccatcaacaagtgggcaaaggatatgaacagacacttctcaaaagaagacatttatgcagccaacagacacatgaaaaaatgctcaccatcactggccatcagagaaatgcaaatcaaaaccacaatgagataccatctcacaccagttagaatggcgatcattaaaaagtcaggaaacaacaggtgctggagaggatgtggagaaataggaacactttgacactgttggtgggactgtaaactggttcaaccactgtggaagacagtgtggtgattcctcagggatctagaactagaaataccatttgacccagccatcccattactgggtatatacccaaaggattataaatcatgctactataaagacacatgcacatgtatgtttattgtggcactattcacaatagcaaagacctggaaccaacccacatgtccaacaatcatagactggattaaggaaatgtggcacatatacacaatggaatactatgcagccataaaaaatgatgagttcatgtcctttgtagggacatggatgaagctggaagccatcattctcagcaaactatggcaagaacaaaaaaccaaacatcgcatgttctcactcataggtgggaattgaacaatgagaacacatggacacaggaagggcaacatcacacaccggggcctgttgtggggtttggggaggggggagggatagcattaggagatatatctaatataaatgatgggttaatgggtgcagcacaccaacatggcacatgtatacatatgtaacaaacctgcacgttatgtacatttaccctagaacttaaagtataataataaaaaaatttttcaatgcaaattgcatattaaattattttaagttttattataaattgattttaatatattttttatattttttgatacataaattacataactgtattactctcccagtaagagatggctttcttacataaatggagagaagccatctaaaggttctgcactatatagcattctctgttcaaaccaaatataccgctatcagaataaataaatagattcacttggatagggcacttattttgtgtttccctttcctccttgaactcaaggaactgatggtgatgaaaatggcattttgatttcttatgtttgaaagttataggagcctctccaagaacaacagtatgaacctttgtagatataatcccaaatatgttaatctatagcattatattttcagagaacatgatgatagattagaaacttatttgattaaaatagccaaagaaatggacttcattagggtttgtaaatcatggtcaataacactaacaaaattactgttttcatgaaaatattgcccatcctatttgaagatgacatccctgatactaattgctatctatgtgcatgctgtatagctgaaaagacctgtgtacaatcaatagttctgtctagtgtctgcagcaagatacctttacagctaagaaccataaagccttttcccaagttgtaagtaagtctgtttttacattaaaaaatgacagaccatgctcagactaagtccatctaaactcagaagtgattatctccactgcaaactagaagtgttctttcttagaatattgcttctctgctgttgattttaacatttcatatcagagcaaggggaatctgtgactattaaactggcccaaactaccttttgattatttgtgtactgtcttaaaataatacaagcccagtcacattgactagtatctccatcctaatgattttcaaattaaggaatggcttcaaattaggaaagctctttgttcacctaggtttggaatagcatgatgtatgctaattgctaactttgtctgcattattttttaaagatcaaatgggcacagtggtaattttcattaatctcatacagagcagctaattaaaatttccattattacccatccattatctagttgtttcctttgttcagtatcagaacaggatgttaataagccattcttgtcttacagccctattaagtattatgagaattaatgtattgcactattttgtttttaggtgattttaaaaatattttcttgcaccatattgattatactgaaggtactttgacaccttgacattttgtaatagagatttcagaattaaatacttgttgctttaacgttttattcaatattgagcaaaagtagtatatagtagagacaggagctatccaaggaccagaatatttgttttagtctcatactcttactgattatgtgaacttaggcaattacttggattcctcatttttgtaatgaggatattagaagaactgatctttaagggccagtccagccttagcttgctatcatattttcataattttcaaatatgaacttatgttaaaatctcaaagtccttctaagcttggtaaaaagcatctgttctataaagttatatattctctgtcatgctctagtagattgtttgcttccattccttataaccagagaggatcctaaattttataatttaagcttgtttctaagacttgggtggggagtgagccacaaagtgatgggctggctcacttgtccacaaggagtacctcggccataaccatatgtcccaattagactaatcctgtagggaatcaattagaaaaagggaaccaacattttctcagtagattattctgtgtccatgagatgcccaatataaaatacctctgagctgtcctcagcataccatacagtgtctcagtttacctgttctatattcagcatctctgaatatattacaactgaaagtctcagaactataatattctgaagcaaaactaagcttagaatcttcagcatgttgaaactcatcactcatctacccttttgtttattctctatccatccatccacccaaccatccatccattcattcattcaggaaatatgtattgaatgcttacttaagcactgtcttaagatctgaggatatagtggtgaacaaggcaggcaagaatcctgtcataagagcttatgttttagcgcagaagacagtaaacaactaaattacaaaaataaattttcatagaggtaatactgtaaatgatatttaaaatggtgttgcgatgataactagaatgtggggtggggagaagactatggagctgagattaaaatgatgggagccagcaatggagaggttgggataagggtcttcaaggcagagaaaactgcaaaatacaaaggtcacgcaacagggttaaattccatatacaatcctctaggggaagattagtggtgcctttttatatattaatttagaaataactttgaggattatatgaaagcggtatgtgactacagacttgaaaattttaattcgttttactagtagttttcagactggcacatgtagtaaatagatcccttgttactgatgaactttgtgttgttgtagaaagtgagttggccgagcaaaaataaaactataattttgaatttgcaaaattatgctttaaatatttacttgctattattccttgtgaaataatagatggataaggaagttacaggaatatggacatgatctctcggtgatggttttacttactgtgccatttaggtgatgatgattcatccagtatacttttttatttgtggaggagacggagtcttgctctgtggctcaggctggagtgctgtggcgggatctcagctcactgcaacctccacctcccgggttcaagctattctcgtgtcttagcctcacgagttgctgggattacaggcatgtgcctccatgccagctaatttttgtatttttagtagagatggagtttcaccacattggccaggctgatttcgaacccctgacctcaagtgttccacccgcctcagcctcccaaagtgctgggattccaggcatgagccaccgtccccggcccatccagtatatttttaacgtctactgtgtctcataacgaagcaagaaataccaagtcagtggccattatacaaaatatgggagctcaaagtatgaaatcgtattccttgttctgcagttattatggagaagttcaataataacacacttttattgaagctcactaaattcatgaccggtgttagttatgtggcatagatggagttcccaatgtagaagtgagacagacacaaataatgacctctaccacaatattttaagtgctataataattataatattgccacagcgctaagggaatagagttcccctatatgttataagcctttatcagactttaaaaatttagcatctaatgggatttttgaaattcagaaattaagaatgattaacactttctacattgaggaggcattctcaataaaaacccaaatagtgtgaaatcatagggaactcatttctcattattaacatttttttaaatgtcatatcctctaatgataatacctctacccaatggggaaaaattcctttccttatgatctccttataatattatatttcctatgatagtatatccttatgatgttattttatagtaagtatccttagatgcttagcagaaactgagtgtaatttttatgaacctgtaaaatgggactcaagcttggagtcttaattcagggatatacatttacagtataggaaaggggcaattatgattaggtacgtctagaatgtgaaactatcagttgttagtatagtgaatgtgttgacaatattttcctcccagccttttccctgaactacttatatagttatagcaagatgatgaagttaaggagctgtgatgagatgagttctagaaacaactccatctatattgaaagttaagttaaaaactagtcactatcagataaatgtatttaatgactttttaagattaatctacaacctgagagtaccagaaaggaataattgggaactggtgaatgctttcaactgatttgattaattaacatgctaattggagactatattgttttacattttaataactgttttcacttattttttttagaaaggctgatactctgatatctttcaatagatttgggttatgtataatggtatatattaaattttatttgctggattttgtggaattgaatatacatatcttaactaggaaaattaataagatgatttttgaatgcttatcctctgggttaaggaggactagctaatattaattctaatgcctgaattgtaaatttaagcacccctgtcaatgacactttatgtaattcaagttcatattctattcaggtcatgagcaccagcactgtaattttttttttaaatgaggttgaggaaaatgttgagatatatacaacacaattttactatatcaattctgtgatcaagaatttttaagtgtgtagcactctgcacacatttttatataacaaaataaatattctatgcattattttacttaaattttttttgaaacattgtctaaaatggtctctttgtttattttatagggtgggctgaaaaacagcaaacatgaatgcaccctgtcttcacaagaatatgttcatgaattacgatcgggtatatcagatgagaaacttcttaattgcctagaatccctcagggtttctttaaccagcaatccggtcaggtaagtcgttcttatcatttcggtatgattcatacaatttgtagtgcatataattgtttgggaatataataagttttgttatttaaacctcaagatttcctgactaaaaatctgatgttaataaaacagcagcatctgattgtgaagtcgtaaacttttaaaaatatatttagttagttggatctctagtaatgtacaattttaagaatacaaatgttaacatagagccagaagttaaatatccacatttacatggaaatctatttgtgggatcagataattattatatatttatttataaagcaaattaagtatatttgctccatgattttattcttttttttttttgtgagacagagtcttgctctgttgcccaggctggagtgcagtggcacgatcttggctcactgcaacctctgcctcccaggttcaagcaattcttctacctcagcctcctgagtagctgggactacaggcacgcaccatcatgcctggctgatgtttgtatttttagtagggaaggggtttcaccatattggccaggctggtctcgaactcttgatctcgtgatccacctgccttggtcttctaaagtgctgggattacaggtgtgagccaccgcgcccggccgattttattcttttaaaacttgaaaggtatatataactttatgttcttctataagttttagatatactcttcacatatttctgtaattttgagatagcaaaaagtgaattattttaaccagtaaaagaagtgagagcattaataaacttctcaaaactctactaatttaggctattaactaactacaaaggattgttattaggttacttgccaatggtggattccagtaactgtggttcctttattaagcctttaaatcaataacacccaaaataaaatgttttataaagaaaaataaaatttcaataaaatatcaaaacattcttggccgggcgtgggggctcacacctataatccctgcacttcagggggctgaggcaagtggatcgcttgagtccaggagttcgagaccagcctggccaacatggtgaaaccccgtctctaccaaaaatacaaaaaagtcagccaggtgtggtgatgtgcgcctgtggtcccaggtattcacgaggctgaggtgggaggatcacctcagcccgggaggtggaggttgcagtgagcccatatcccgccactgcactccaacctgggagacagagcgagaccctgtctccaaaaaaaaaaaaaaaaaaaaaaaacaaaaaaacaaaaatccgggatctatttatgtaactactagaatcttaagttcagaatttactccataagagtatataaaaaacttactgtgattttatccatgtttttcctaatatataataggtctaagtcttgtacttttctgtcctgtccacagagccttgaaaataatttagagctcagtcattcagtttggatttatgtataaattgaaatatattaattacttatttatagtgcacttggcaaaatgcccagaaaattacaattttaaaacaacaaaaaattttttaaaagccagtgttaagatgtgacttatcttagagtatgataatcgttgaaagacgattgtcttgccatttcttccaaaatgctcctaggttttttgttttttgttttttgtttttttttttgagacggagttttgttcttgtcaccgaggctggagtgcagtggtgctgtctcggttcactgcaacctctgcctcctgggttcaagcgattctcctgcctcagcctcccgagtagctgggattacaagcctgcaccaccacgcctggctaattttagtatttttagtagagacgggatttcaccacgttggcaggctagtctcgaactcctgacctcaagtaatcaacctgcctcagcctcccaaagttctgggattacaggcgtgagccactgcgcccggcctgatgctcctagttttaatggtttgaatgaacaggggacgtgagttcttgagaacagtaactacggtggtgcatttttcccccctgcacgtaacgtacagcactctaccgttttgccaagcactttgtgctcctaaaatttctgttgcattgttgtttgaatgaatgaataaatgagtcttttaaaagtaattgtagaagttgcagcattaagaaataaagaggggggctagtaaaaatgcatttttatagagatgttgggaaaggcttgcttgaaattacacgtgggacttttaatagataggcgctttgaccagctaagcaacagggctcccctcgtgtgggacttttagaatgtagcaaccactgacacacagggaaggattatgcgatcaggtgagaaggtggccgaccctgactggctggaagcagatgcattctggtagttgattggtccacaggtagcgtgacgcttgtcacgtcctcagcctcccagcattcaatcgtagcctttcggacagctcgaagccttctgtggagagctcgaagccttctgtggagaactcaaagccgtccgtggagccccagacgagccaaagcccaccttctcctcagcctgagctgtcttgaagatgagtaagagtgggtttgggagctatggcagcatttctgctgctgatggagcgagtggaggcagtgaccaactgtgtgagagagatgcaactcctgctattaagacccaaagacctaaggtccgaattcaggacgttgtaccgtgtaatgtgaaccagcttctcagctctactgtgtttgaccctgtgttcaaggttaggggaattatagtttcccaggtctccatcgtgggggtaatcagaggggcagagaaggcttcaaatcacatttgttacaaaattgatgatatgaccgcgaaaccaatcgaggcccgacagtggtttggtagagagaaagtcaagcaggtgactccattgtcagtcggagtatatgtcaaagtgtttggtatcctcaaatgtcccacgggaacaaagagccttgaggtattgaaaattcatgtcctagaggacatgaacgagttcaccgtgcatattctggaaacggtcaatgcacacatgatgctggataaagcccgtcgtgataccactgtagaaagtgtgcctgtgtctccatcagaagtgaatgatgctggggataacgatgagagtcaccgcaatttcatccaggacgaagtgctgcgtttgattcatgagtgtcctcatcaggaagggaagagcatccatgagctccgggctcagctctgcgaccttagcgtcaaggccatcaaggaagcgattgattatctgaccgttgagggccacatctatcccactgtggatcgggagcattttaagtctgctgattgaggcagggaaaacatcctttcatttttcgaagacccttgcatccagctgtgagtaattttgacctgttgactttttaggaagtaggactaaaaaaaaaaatctcaagtggcattctttgtcaactcgctgcttttctaactgctttgaacttttcggattttctgtatttgaagctcagagagagacggtgatggataaattgacaactctgtaggatttactagcaagctaatggaaacatgattttcggggaagaaaaactacagaaaatgtagaaatttattatttaattgtgttggagcttctttttccaaaagaaaaactagttgcagtcagggagccagcgaaaagacaaaaaaaaaaaaaaaaaaaaaaaaagtcttgcttgtttttatgttagacttattttccgtgtttggatttagcttattataatgatactgttatctcttgctcaatatagtatttagtatttgattaattcaaatgagctgaagatactaatttgtgaattctaatgctcagttcaaacatttatgtgtgatttgctcttattactatgaatttatgttttcttaaaataagattatactgtgtttaaataaaccatttttgccaggttatctttgaaattttttaaaatgtggtgaagttcaatgattatttcatatatgatgtggtatttggatgaaattacaatttattgtagttgtatggtaaatggatgccagagtttctgtaagtttgatgtgctggtgtattatttattttactaaatgctctgttttatgtataaaaaggtaatttttaggacgttagggaaacagctcataggaatatgaaacttactgagtttaacacaaatttattcaaatgttttattaaagtagtttacaaaatcttaactttcctgtgtgatttttttttctaagtacatttgaaaaagcctttttgttttatatccttgaggattaatagtttcacttatccagaattttttcttttctatatataaaatacccagaacatatgctatagcctagttctaacaatacattttagtgtagattatataaattatgtgagacttttaaataattgaccattaacgaaagccctcagttacctatacactaaagatggtgtctttcaagatgctaatttttttacattagaggaaataaaaaacatatactttttaatgaatatatgttatattttatatatgtatattcatatataatatacaaatagaagaacattatttgtcaaattgaatcatgaaaactgcaacaaaaaaaaaatctcttaaatggaacattgccagtactccgtactttcaggaaaactttcagaaaatggcctgtgtcagtggccattagaaaaaccactaattcttgcctaagctttgtgatgcatatttttcttccccttgaaagtaaagaaattgtaaatggcactcttgaaaagcacagatgaataacatactataaacctgttacttaaattatcagacattttgaaaattctggtcttcataaacctaaaatattcggaaccactttttgttgaaaaaggttacctgtcctagggaaaatcatactgggggagaggcaacaaggggcatatatacttggaattgtggagctgaaagagtctagcagatacaatattcttttgtgacattaaaatctgatatttatgagtataattataggtcactcccataattgcttgagctgattcagctggccagtggatgcgtagccacttgtttttcctatactaggagcatgcggagggggaaaaaaactcttttttttttgtttgggaggccaaactgcttttgtccctgcaaactgatacactgagatatgtacacctgaatttaaggcagaagaccaacctctctcccatcctgtgaggggaaatgtcctctatctgtgttcgttggggtttttttaggcttttaaaattactcctcccaacgcttattcttctgaatggaatcgtgtgctttagtggattctgctgcaggtaagagatagcagtggaaaaatagtaagtaggtctagatataatgtcagtggaaataaaacacttttaggcagaaaatcactggattgttttatacatgtatatttagtccatgttaaaggtagcagatttttaaagttcattttgaacacccacctggcatgcatactttttcaattttgtttagactgggaatgacttggctaatatcccctttctccaaggtcctgccctgatagttagccacaccttttgaggataagatacaaatcctggggacatactattgactattttgggcagggacatttaagcctgaggaacctgaaaaacataattgatgattataatccacccaaggttttttcctatggctcacaggcttacgaaatgtatgtatttatattgaggttgattctaaattaactatgaataaatatatttgaaagtgttttcaaggccaatataataatcttactatggtcataattattagtgatcattttgttacttttacctactaaatttagtaatatttggagtagaagctgaaaaacataagttcttatattttttcaatttctgtttactttttataacagcaatttaaaaaatgtaactagcaagaattatgtttgttcctgaaacctttattgagttcctactatatgcatttaagtgttaactttaattttgataagcttaaattttattgacttctgaaatgcttattaaagatagtaatagttaacattttaacatttatttagtatttattatctcccaagtactgttctaagagtaggagttgtgtgtatgtgttgtgcgtgtgtgtatgtgtgtgtgtgtatgtgtgtgtgtgtatgtgtatgtatgatccctgtgatgcgtagatttacgttttcagctcagacctctctgtttctctctctctttttttttttgagacagagtcttgctcttgtggcccaggctggagtgcaatgtcacaatctcggctcactgcaacctctgcctcccaggttcaagtgattctcctgcctcagcctcctgactagctgggattacaggtgcccgccaccatgcctggctaatttttatatttttagtaaagacggggtttcgccatgttggccaggctggtctcaaactcctgacctcgtgatccgcctgcctcggcctcccagagtgctgggattacaagtgtgagccacccacctggccagacctctcttttgaaattgagactccatctccaaatgtcttattggatgacatataggcatttttaatacattaaaaaataatgaaaaattatgtgtgatatgtgttttttatatatatatataacacagatatatatctctatatatgtacacacagatacatatatctatatatatacatacagatatatatatctatatatatacacagatatatatatctatatatatacagatatatatatctatatatatctatatatatacacagatatatatatctatatatatattaccatgtatatacagatatatatatatctgtgtatatattagtatgtatatggcatttactacccctgtgcaatgttttaagacctttaaatgtacatatacaatcaggataacagtattgttcgtattttgtagatgaacttgaggctcagagaggttaagtaatttgcgccatattaaagttgcatgcccagcaagtgtcagtgttaagatttaaacccaggctttgtatctctcgagagcctaggcctttaacaactggtttgtacagtgtcacaataaggaaagtctattaaaatagtattctttcactgttgttagtattctttcactgtcatcacatactgaatattttgactttctttcattaatatttgtctgatttaaatgaaaaagaaactatgaaaactttcagcaaatgtgtagaagataatataaaaacacctttgtactcatctatcagcttaagagacaaaacattattttttgctgtggtagagaacttagttgaataacttgggagtttttttatgatatcgtaataccatttgggcctatattttcattgatttaaaagatcgtctgaaattctacattttctctaaatctatgcatgtagtttttgcaatataatatcttaagaatatatatcagtgtattgaaaagcctatttttttttctgatcacatagctgtgtgtaaattgggacttctttgccctatccattgtggatgatacttctagtaattctaacaccatctctatgatatttattccaatttgccatcatgtgataaattacgaaaacaattttttaacattaagagttaatttcctttggtaataccttaaattggagaagttcaataaatagcacttaatattatgtggtttgtttttacatatcacatggataatcctacaaaggaataacaaaactaaattccccttgtccatatggggcttatatatatggagcttacattccagtacaggaattcagacaatttttttaaaggtgtacatcaaatatcaggttgtaatatgagctgaggaggagatgttgctattttatattagatgatcagtgaaagcctccctgactttaatgacatttgcacagaggtctaaaggaagtatggcagtgacctatgttcactggaggagtaatgttgttagaaacggaaaacagcaacagcaaataccaaagatgggagcatgcttggcatgttctaggaatgtcaaggaggctagcatgctggaagcagataatgtagagccttattgaccattcaaaggactttggcttttactttgagtgagctgggacactgttagagagttttgaggaatggaatggcatgagatgacctacatttttaaaggatagccctgggtggaagcagggagaacatgttgtacattactcaggcagaaggtgccactggccacagaggtttctagctggtgaagtgacaccccaggatcctgtgacaatatgataaatcattctagttcttgatcactcctctgtggtgaccttggtccagtcaatggacctctttggtcctcagtttcttgatatgtaaatgggattggagccttccagctctaagcctctgtgttctgtattttcttttgcttagttttaatcctcttacctttgctattggaactagattagtgtttaggtattattttgaagagtgagaagaatgttcctctataaggctagaggatttcctaatgtttcattattttttgtatttataaatgtatttaaccacccccagacagatatttataatttcctttaaatacggatgaaagcagttcctaaaactctgttgcataactgtttttgaaacctggtgttcattagaacccacaccgttgtcctctcgtgggtaattctcctccctaccacagttttaattggtttctttttgttcagcccctcgtaaaatttaaaaatatatataaataagtgtacacacacacacatacgtatacatactaacagttttaccaaacatcctcaaaacagtcattttggaatattaagtggggtcatgaatttcaaattcacatggtatttaatcactcaggtgataaaggctctaagaaagtcattttggtatattattttctgctaaagcaaatacttaaaaatcccttttataagccctcattaactggtcctatctcagatcactctgttactgtacatttccctcaacatttattttttactatatacatttacctgtgtctgtttatactctgtaatagtttcatgcatgcatgtctgtttttctcatttagattttagtctcctctggggaagggaccctcttaccctcttatttgtctcgtggtggctggtactgtgtaatttatatatactaatgtgtgatttgatgtagttattgacccaccatcaataaaaacctatgcttctccaccagtgggaatgaatttgcattaatcggcactattttgtggccatgcatttttagctgtaatcagaaaaagaatgaagctaacttcttccacataagaatgaaaccttggtttgaatcatattcacaatccacagacaacatagcatgctttacacaatagccttgttacagttgcatggtgaattaatgaaattgaatgtttacaactctatttaacactctaaaaatccatgtgctttgaccgtaaagtaaatcccaatctgccatcacaaattgcattagactttgcacataccatggtctatgtgtgatttagaatgaggactctgttatttagagatttttgttcatatctctttactaaagtttatgaaaggaagcagtgcctgctgagaaatgaccaatgagtttggacagttttattcccagccaattcattgcaagatgtataggtatttggcaatacattttatgaagatccaaagaaatacgtagcaatagatcattgtcactaaggtttcccagcacatgacaaaaacagcaaatattgctttgaagaatagtatcacagaattgtgattgcctagaattcttgttagagttgttgctgaaattgcctcacagctttaggggtattttaccccacgaggaaattgttttttctgtttggttgggatccacttatctgccaaactcatggcatagtgtctgtattcacatcctatgatgatagcttcctcagccaatatttccaagccagtgaaaacataaaatatcttttcaagttgatacatgtgcagttatttgcattacctctggaatatttgtgtttatttgatgctatcttccctttagatttaaacatatttttctagtgtatttacaaatgtgcattttaacataatcataatgaaaatagatggatcttgacaacaatacaaattaggactagaaagcactttctgaattgtaggtcttaataagtatttaaacaacctgtattaaacttattaaaagcttggcaaagcggccaacagtacttagaaagttaatataaaggtaggtacagatcaatactcttagaacattttgcaggggactaactatgaaagatggaataataaggatactttttacaatgtagaaatgtgaacacggcttaaaattgtgagcacatctcataaagcagcattatgtgcggtattactaaagcaggtttttaaatattggtatttggaacttctttgctttcactttcaaatccataaatcattttagaatagcactagtatatttatacatacaatacgaaatggtaaactcattgcagttgtcaatttatatgccttttgttaaaatcttggtcaacaattcaaattcgtatcaagtatattcaggctcatttgactaagttgataccatatatattaagtgacatggaaattttaattatatactattagcttcaaaacataattctgacttcggcacatgcaatgatattacctcttaatagaagcaaagtagatttatgtgtcatacattattttaaaaaagaattaggcacagcaaatactcgagtttttgaagtattattaggagaaaatgctacaggcattaggataaatagtggttcttgtgttggatttattttattactatgtaagctccaccaaggcaatacattttctcgtttaaatgatgtgttttaaactagaaagccaatttttatataataatcatctaaaataattagaaacatgtaactggtcatataaaggtatgtataatctagcagcagaatctaggcacactgattatatggatttctgagtagaagcctaacttccctcttaaaacacttatatgcattttctacttattcaaaattagtcttgggaagaaaatgcttataaatatgtcatttgaaatatatttatttcgagttatatgaactaatttaactaaaggtcttgggcacatactagagttttaatacttctctcattattttgagaatattgtaaaagtagttgcagcttaaaataaaagaagcagatattctacttccgtaagacaaaggtaaaaatgccaagctccaattaaatgaggaaaggaggtggaacttttccaaaaacttaggacaatgtcaggtaatgatttgagtataatgtagatccaagtttctttgtgtggagtggagaggggtcggggggtgtttatcaggtaaacagttctgtctctcagtaaaagtctctcaataaaaagagagacatagctgttacctgataaacgacattgcatctcttttgtgttgttgtttgtttgtttttcaggagggtcattcttcctaattctgaactcattttattttgtggttctttaaatgagggatattggacaacaacagtagaatgagtccttgatagttttccataaagtacagaagatttctatgaatgtccatttcctgcatttagccaaaaagtaaaaaaatcaaggttatgatatttctacaatgaccaggaataatagtactggaatgcagctttctagtaatctaacctgctaccaaggtgtacttgagaaatgcccctgaggctctccccttggactgtctatcatctcagctggacttttgatagaagttggatagctgacaactcacaattaagatgccagctggcacctggagtgcaagtagtctgtatagttgattgaaagaagatccatgtgcactagataacagtatttgctctatgaccccagctgttcgactggtggtagataatggacagctaatttggggagatttgccacctggtcagcaaagctgtaagtgtatagcctctcacaccaggcagtttaaacctggaatcttctgttaagatggaatccatgaaggcagaatatagaagataacataatgttatagtacttctaaaaactaaaacatcttcaaatgagacagttttggtgacctcttatatgaatatgaatttcaagcctttcatatacccgaaatcaacctactcctgttaggtcagttctgcagcatccagtgttattgaacatatgcagattgactctatttctattttggaggatattgcctgagtactgagtactgctacagtttttttttttttcttttatgtggtaccatacttcccttgataccagcttccaaaagaatttcctggagatcatatcttaaattggtacgttcaacatttattcatcaaaaactattgaagattggagtgctgtagttaaacacatttttaaaaattgagttataaatttccatatgtgaattaatatctgtcaaagaatatcttgaagtggatacagcactaaaactatattaagtattaatgaatttttcttcgatatagagaatgcttaagaattttatagtgcctttgaggttcgcattatgagcatttattaagatggtataatactttaagtgtaagtggtgtgggacatcaagctgggggtattctctgaccttgtgatatgctttggatcttcaaaaacttttctgtcagtttatgtgcttgatgagcaatgatgttgctttctcctgggaaggagatgggttattatgtgggtttatcattaattttggtttctgttaccatttttgtattgtttgcaaattataatgatttatctgttgaaatcatgtgtcttaatttgctgatgaccatagtttgattcaagtattcaccttattgcatttcacaatgtgcttagaaagttggaatgataaaagttaagaataaatcgctatagaggagttcatttggggagcaggaaaaaatcgcatatacagattagtttttcttaatttttttttttttttttttttttttttttagtttatttgtttgttttgagatggagtctggctctgttgcccaggctggagtgtagtggcgcaatctcggctcactgcaacctctgcctcctgggttcaagcgattctcctgcctcagccttccaagtagatgggattactggcgtgcgccaccacacctggctaattttttctatttttcgtagagatggggtttccccgtgttggccaggctgttctcaaactcccaacctcaggtaatccacctgcctcggcctcccaaaatacggggactacaagcgtgagccactatgcctggtccagactggtttttaaaatacgtgactggaaagttctgaatcatattgatataaaggatattagataaatgtgaattatcaaatagcactgtggagattacaagcattatgctggacacatactgcagaggtctatataagcatgatattgggcttattaatctgtgaactcacagctgatttggaatcacataataatgttccactatttaaaataataatccttagtatattctttgtcttagaaaactcatccatgcattcaggatcttggctctgatccttgtgtgtatgatttagcatctttgatattcctcgtatgtcacatttgctcattttttcacttgtgatatctaaatggcttttacatttccattggcaataatctagctcaggcctcactccatttggagacaaaaattgatagaggaagtgattggtctggcaaaacatagttactgggtttattgaaaattcagtataaccaaagtgaataaggtaaagtgcaaaaggataatgaagtcaaggaagttagtaggaagcaaccccaaaatggctgaccaatgtctttcatgttgagtatggaagcaaggaagggttaccaaggactgttattcccaaatgaaaggcgagtggctttattttttcaaactgattcctaatatttgtgaagtattttgtgtcagaccaaataccaactaatagttactacattttttgaagtgggtatttacaggtatatatcattgacatgtctacagccaatagtcataaattgtaatatgatagggctcagtattttatctattggtacatggaaaacagaaagaaagtatattttttggacatctctgatgtttttattatctaaagtatcctgtgccttgatgatgcaacccaaaattaataattaaaaagatgaaaaccacctcattggtattgtttttacttctacatataaccattggtgatatttttaatatattaacttttatccaatatttgttcatgaaaggaaaataaaatcttgtaacctctaattaatgatttttatgttgttgataatatagtttaatgagagtatataagaattgagaagtgctggattctattgttttactattaggaagctctgtattctaagataagtcactaaccttctttagtttcttcatctacaaaatggagtaacttattttatttcacaaccagaaaagctactcttattggtgtgagttctttcatggaggtttgtttgtaaatgaagaaaaatccatgtttttaattaaaattatttgtttgttttggcttttaactgttccaattaaaaagagagtctttgttattttgaataaggccaaagttatttcagcaattaagacgtgctttctttacaaagcatttatatgtttgaaaagctttagcaaggataaatgcatatcttttaggtgtagctatatttctagagttttctgaaaataggtacaagtcaggttgacaataacagaaggctgatatctcttagggactttatactgcatttagtcctacaaatgctttgtttgtatgtcatgtatatatttgttatttttgtgttgttattgctttagatggtttatttcactataatataagaaaaataatagcagatttggcttattttgtcttggataaaagccttaacaagttgtttagtgggggattattaaggattttgaatattcgttgtatttatgttggtcaaaggatacaaaatttcatttaaacagaaggtgtaagttcaagagattcatcgtacatcatggcgactgtagttaataccaatatattgtatacttgaaaattgctaagagaagaaatttttaaaagattatttttaaaatttcaatagttttgggggtacaggtggcttttggttacatggatgagttctatagtgttgaattctgagattttagtgcagacatcacccaagcagtgtacattcattgtacccaatatgtagtcttttatctctcacccacctcccaacatccgcccacttactttgagtaatgatggtattttgatggaagttgcaatgaatttatagatagcttttttttttcaaacaggtcttagtttattccaagttttacaaagtcaaagttgcataagtcttacaaagtcaaagttgcataagtcttacaaaattaaagttgcaaagtgaatagtgaagcaaatcaagaagatttttttagatcatataagaaaaggtagtaatcaaaaagtaaaacccagttgctgaatttaggttagttaatataaggcatgattatgtaaaactgactgtaaaattgagatccagtttttaaaaatccaagttatttgtaggcaaatgttaaacaattaaaaaaaattttttttcaatttttttaaattttattttattattattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgatggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccgcaatggttgaaccagtttacagtcccaccaacagtgtaaaagtgttcctatttctccacatcctctccagcacctgttgtttcctgactttttaatgattgccattctaactggtgtgagatggtatctcattgtggttttgattttcgtttctctgatggccagtgatggtgagcatttattcatgtgtcttttggctgcataaatgtcttcttttgagaagtgtctgttcatgtccttcgcccactttttgatggggttgtttgttttttttcttgtaaatttgtttgagttcattgtagattctggatattagccctttgtcagacgagtaggttgcgaaaattttctcccattttgtaggttgcctgttcactctgatggtagttcttttgctgtgcagaagctctttagtttaattagatcccatttgtcaattttgtcttttgttgccattgcttttggtgttttagacacgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctaaccagttttcccagcaccatttattaaatagggaatcctttccccattgcttgtttttctcaggtttgtcaaagatcagatagttgtagatatgcggcattatttccgagggctctgttctgttccgttgatctatatctctgttttggtaccagtaccatgctcttttggttactgtaggcttgtagtatagtttgaagtcaggtagcgtgatgcctccagctttgttcttttggcttaggattgacttggcgatgtgggctcttttttggttccatatgaactttaaagtagttttttccaatcctgtgaagaaagtcattggtagcttgatggggatggcattgaatctgtaaattaccttgggcagtatggccattttcacgatactgattcttcctacccatgagcatggaatgttcttccatttgtttgtatcctcttttatttcattgagcagtggtttgtagttctccttgaagaggtccttcacatcccttgtaagttggattcctaggtattttcttctctttgaggcaattgtgaatgggagttcactcatgatttggctctctgttcgtctgtttttggtgtataagaatgcttgtgatttttgtacattgattttgtatcctgagactttgctgaagttgcttatcagcttaaggagattttgggctgagacaatggggttttctagatgtacaatcatgtcgtctgcaaacagggacaatttgatttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattgttttgagataagtcccatcagtacctaatttattgagagtttttagcatgaagtgttgttgaattttgtcaaaggccttttctgcatctattgagataatcgtggtttttgtctttggttctgtttatatgctcgattacatttattgacttgcgtatattgaaccagcctgtttggcagcatggtcattttcacaatattggttctacccttccatgagcatgggatgtggttccatgtgtttgtgttatctgtgatttctttcagcagtgtttcgtagttttccttatagagatattttgcctccttggttaagtatattcctgagtgcttttttgtttgtttatttgttttcgttttgcagctgttgtaaagagggtcgagttcttcatttgactgtctgcttggtgccactgatttgtgtacattgattttgtaacctgagactttactgaattcatttatcagatctaggagccttttggatgagtctttagggttttcttggtatgcaatcatatcatcagcaaacagtaacagtttgatttcctcttttccaatttggatgctctttatttctttctcttgcctgattgctctggctggggcttccagtactatgttaaatagaaatggtgaaagtaggcatccttgtcttgttgctttcaacttttacccattcagtatgatgttggctttgggttggtcatatatggcttttattactttgagggaagtcccttctgtgcctcggttcttgaggatttttatcataaagggatggtggattttatcaaatgctctttctgcatctattgagatgatgatatggtttttgtttttaattctgtttatgtgatttatcacatctattgacttgcttatgctaaactattcttgctaaactattcatccctgggatgaaacccacttgattccgatatattatgtttttgatatgctgttggattcagttagctagtattttgttggggatttttgcatcaatgttcaccagggatattggtctgcagttttcttttttgttacgtcctttcctagttttggtattacggtgatactggcttcatagaaggattcagagaggattccctctttctcttttggaatagtttcagaaggattggtaaaaaatttttctttgaatgtctggtagaattcagttgtgagtccatctggtcctggagtttttcttgttgacaatttttttttattactgattctatttccttgcttgttactggtctgttcagagtttgtgtttattcctgatttaatctaggagggctgtatgtttccaggaatttatccatttcctctagattttctagttttcgtgtgtaaaggtcttcatagtagtcttgaatgatcttttgtatttctgtggtatcagttataatgtctccagtttcatttctaattgaggttatttgcatcttctctcttctttctttaattaatctcgctaatagtctatcaattttatcttttcaaagaaccagctttttgtttttttaatcttttgtatttttttttgttgtttgaatttcatttagttctgctctgatctttgctatttcttttcttcttctagctttttggattttgtttgttcttttctttctgtttttttttttttttttttttttttttgagacaagggcacccaggctggagtacagtggttcaatctcggctcagtgctgcaacctccacctcccaggttcaagcgattctagtgcctcagcctcccaagtagctgggactacaggcatgcaccaccatgcccaactaatttttgtatttttagtagagacagggtttcaccatgttggccaggctggtctcgaactcctggcctcaagtgatctgcccgccttggcctccgaaagttctgggattacaggtgtgagctactgcgcccggcctttgtttgttcttgtttctctagttacttgaggtgtgacattaggttgtcaatttgtgctctttcagactttttgatatagacatttagcactgtaaactttcctcttagcactgcttttgccatataacagaggttttgataacgtgtgtcactagtaccattcttttcaaataagttttaaatttccatcttagtttcattgttaacccaaaaatcattcaaaaccagactaatttccatgtatttgcatagctttgagggttccttttgcagttgatttccagttttattccattgtgttctgagaagatgcttgatctgattttgagtttcttaaatttattgaaacttgttttgtggtctatcagatggtctgtcttggagaatattccatgtgctgatgcgaagaatgtatattatgcagttgttgggaagaatgttctgtagatttctgttaagtacatttgttctaggatacagtttatgtctattgtttctttgttgactttctgtcttgatggtctgtctcgtgctgtcagtggaatattgaactctcccactcactatgttgctgtctatttcatttcttaggtctagtagtaattgttttataaatctgggagctccagtgttaggtgcatataaatgcaggattgtagtatcttcttgttggtcctgagagaggagatttttaagtgttctcataacaaataaaatcaagtatgtgaggtaattcctgcgttaattactttgatttacccatttcacagtgtatgcatgtgtcaaaacatcatgttgtacagtataaatatataccgtttttatttgtcaataaaaataaatataaatttaaaaaaacacatatttaaccatggttaagaatgtatgtatgtgcacactgaagaacatataatctccacggtatctttctcagcattaggaggaatggattttaaaatattatataaaaacaagaaaagactaaagcagtacctgttacagataacattctgaggaaaaagaacatttggacttgctaaaatgtttttgacatctacattgaggacccaagaaaatgattttctttttaggtttggtttcagttatcttgtgctaaaaatgtctgtgaacattaaatttctttgatctttgtctacgtagctatcacactctgtaataagtctttaattatatgtttttggcactgcacctggtaggtgagaaggactgttgcatttctgttgttcactcatcaaatagcaattacccttcaactctccttacccctgttactgtgaaaaaaaaaaaaaattcaccaatttctctgctgcccactagaatcagatagtataacatacaaactggtttaggagaaaagaatatgtacaggtggtatatgctaatgcctctatgtttcttcattgcattcaaataacttcttactttattcatgacataaacttggtatgagctctgtttcatttgcagggcttatggattgggaatgtgattttttggaatacgtttactttaacaaaattccacaaaactaaatgaaattggacatcctgtggtgtgcatgatagaattttaactatattacttatcttaggaaaataaaccaatacatttttcttgtggaagttaacattttattataagtttgactggttatgttactaagaaggcatctttaataagtgtcctaacataattatatctactatttcaaacatctgaagaagatagaaaatgtgagtagcttttacttgaatatttggaatactctttcccttcgcttcccttattgaccgtagattgaagagtctattttcattgtcattcaaattttttggtaattttttcctcatcattactttggaacaagaccttctcttatacttttctaccaataatgtttaaaggaaggtggggaggaaaatattcttgattgttagcctgttaggcattcagatagatttgggcataagccatttcttagactatctccaaagtaacttagacagcttatgaaattgattttaataaataaggaacttttatccttttagagagtgtttacttatactgttgccctcaagagatttttatatgtaactagagcatttaaaattattttgtaaatatgtaagaggaatttgtctttatgcaatataaacagctagaaagaatgcacatttcctactttgtaaggaactcctaaaaatggatgagaggcatgaaacatagtaggatttttgcagtaagactgatagaataaacgcagccagagagaaagatggaatgtcttctttggtgtttctaaggcaattgtaatctatcacaacattgaagtcaaaaccactcagaggtagaactggtaaactgatgcattcaaactttctatgagtcacatgaaataaatgatcagtgactgtcaggcttcgaaggtttatgcacaaatgtctgaaaatggtagtgttacgtcaaatagatattttataattggtcagagatatctcatggattaatctactatgatgaatagtttccaaggacattcaaatgcccaaagctattgtgtttgctttcatgtagagaaacctgagtggacgtatatgtttttatggatctaagaccaagtcagttgtagtgtacacaaatccacgtatatattatacatgtttatatattttttagtgggtatatatattgacagtgaaactgtttatgatgtttatttagccgaacaaattttccttttaagatgcggaaaatactaaggtttacttggttactgtttatgcagatttgatccatggactgaatatgtgatactgtttatgttgggctacatactggttttaatcacatggaactctttctttccttaagtgtatgcaactaaaatttggttttagttgcattaaaaaacattacagtagcaatattggtgtttaagtgagatgttttcctattttaaaaaaaacaaaccaaaacccaccactcaagataacatttaaagtctcctcaaccttttgaattagttgtttcacatgttataattttaccaaatttctgaattcccccaagaaaccctgaactatcattcattttatttgatgttccagtgattcaggttgtagtttgagattacacatgggaatagaacaccattagagggaaataaaatcctttgtacagaacacataaccctctatactagcctttagcactgcacaaacagtgataaagggatgacatgactaatattggactccttcacatgagaccaattgcctttacagcttatgggattcagtatagaagtttctaattttagctttaactcttttgaaagagatgttaatttggataatctaatcattgatggacatgcagtcactattttctattatatcttcattgtatatagcatactgaactcatctgttcattacatctttggttttacattatatttaagtgaaatgtaactaaataattcagagtctgaatctcaaatttatgggagaaaggttgaggttttgggaaactgtgaaatgttgtcctttataagaatctatgagggagcacagtcttattccctccttcaataggtacatttatagaaaattttcctcgttttgctttgccctgaagagctagagaggggagaatcttgctttctcttagatttagggttaattgaatcttctgataccttcattaaatgtaagattttctttcctttgatcatgctgatcagtataagtgggtcctttaaaaataatgaccttagaagttctaaaggcttgagataggtttctgttttaaaacttcaatatatttttgatataattctgtcaggattatacatgaactaaaaattctctccccctcaccattataatttccatatctattctgatgtgaattggccagcactaaatacaattagaattaagtatacacaaaattggatagtgaccagttaaaacacatgaggttggctgggcgcggtggctcacgcctgtaatcccagcgctttgggaggccgaagcaggcggatcatgaggtcaggagatcgagaccatcctggctaacacgatgaaaccccatctccactaaaaatacaaaaaattagccgggtgtggcggcaggcgcctgtagtcccagctactcgggaggctgaggcaggagaatggggtgaacccgggaggcggagcttgcagtcagccgagatggtgccactgcactccagcctgggaggcagcgagactccgtctcaaaaaacaaaaaaaagaggtaatatgagtaccaaatatttaaattataaagtctggcctcaaactcttgggctcaaatgatgcccctgtttcagcctcccgaatagctgagatgacaggcatgacactgtgccccagtcttatttttaaacaagtcaatagagtaagtttagtataattttagtcatctgcatgttttgtaaaaattaatataattttcattaagtgattaaaagttgtgttaatactgtggaaaaggattctttaatttatgcctaaaattcatactgcattttggactagaagattcaaacaacattcagatttttggtttttaacattttccaaaaatttcttaatggctttattgtgatgttttatatacattatttcatttaatagtcacaaagacttcatggggtataggtagtattctcatccctattttgaaaatgcaaaaacaagcttagaaaatttacgtatattatcaaaagtaacacaactagaatatgtagagatgagattagaacctagatctgttttcctctaaagcttatgcatttagccatgcagctatgtggccccacagcataatccaatgatggatgatggaatattttctttatttttgggtgaacttggaaaaaagtctttaatttttagctttttgagcagcgtaacagatattagcctccctgatagatacagccaaaccttttttacatagggttggaagatgctgtctcactgtgattcagacctcttgttcccaatataagcttcctggcttcctttttagtctccagatataatcttggctgctggttcactcaaacattaatcttcctgactggtctattgtttttgtttgggtggttcatttgttccacttggtctcctgacatgtgaccacaaatgtcaacttggatgtgtagcatgttaagacagttctttaacttaggtaacttataacacaaaatcaccaatatgttaataccttaaaaagtgagatcgtggacttacatagcccatccaaaaagaaatagtataagctacattttggccctattctttctgataaactaccttacctaaatgttgactgaaaattttagctgaagtctccagttatctgtccttaacagtattttgtagatttcttatgatgctcaggactttacttatcctatctaaataaatgaactaagctgttaaataatgaaacgtatgtttgtctgtctaggcatagatatgtagatataaaccgttctgtaacaccactaattcttcttaagcaaggtattagagctattagctagatgttatagaaaattgtgtaccggtcctcttttagtaatttctaaggatgtggttgaaataagcatgtgcttaagagtcagatatggatttgaggcctagaactgctacttacttgttgagtgatgtttgggaagtcacttaactactttgcttctcagtttctttacctagaaacaattttcagaatggctaaacttaaaaagactgacaaggatttggggcaattagaactgtgatattttgctgaaggagtgccaaatagccactttggaaagcagtttttaaaccgttaaacatctacttaccataagacccagctgttccactcctagatatttttttaacagaaatgaaagcatgcttacacagataacttacatgtcaatgtttgtatcagctctattcataatcatcaaaacctggggacaactgaaatactcatcaaataattaatagataaacaaattgtggtatattcatacagtaacaaggaatggaatactaatacatgcaacgaaatggttgaatatcatagtattcatgctaagtaaaagaagccaaacacaaaatttgaaaactgtacaattcttttataattatattctggcaagcacaaaactatagggacccaaatcagataagtagttgccaggatgctgggagtagggaaaagggattgactgcaaaggggaataagggaatattttagggtgatgaaaacgttttatatcttatttgtattggtggttacatgactatacatttgttaaaatgataaattttactatatataaatcatacctcagtaaaaaggaaagaaaaaataactcatgtttgggttggttatgaaaattattaagagtaattttcctccgtttttccttctgtttggttcttcattattctctgcctgttctatgtccctcataaatgtaaggtccatgagaaatgtcagtttcttatttcagggctgagatagtacagaaaaatttatgtctttgtctgtaatctctgagtaagattttaaatcaggtcatcaactgtattcttatcattctagatgttccagttagtactaaataattcagagctggaatttgcatactccatgaaatataccaaatatatctgtttcaactggattccttttttttgtttgtttgttttttttgagaccgagtcttgctctgtggcccaggctggagtgcagtggcgcgatttcagctcactgcaacctccgtctcctgggttcacgccattctcctgcctcagcctctccaagcagctgggactacaggcgcccgccaccacgcccagctaatttttggtatttttagtagagtcagggtttcaccgtgttagccaggatggtctcgatctcctgacctcgtgatccgcccgcctcggcctcccaaagtgctgggattacaggcgtgagccaccgctcccggccctcaactggattcctgatctgtgttctgcggcactgggagggcacagtatggttgggagggcatgtaaagcagccttgagttctgagcctgagtcttgcctgagaaaggcttcccctgcttctcagcaatccattgttccctgccagtggttctcaaacttgagcaagcatcagattcaccaggagaattagttaaaacatacacttctatcttcctcccagctactgattcagtaggtctgaggtagggcacaagcattttgatttctaacaagttcccagatgatgtcaatgctgctgatttggagtgcacactttgagaacccttgatttatgcttacttctagtgtttcaatgtcagaatttctgcccacatgctcacatacaggagccaacattttgtttttaaactgcctcctcatttcatgaccacttttgtattggctgaaatcagtatactctatgtatatgagaaagggaggctgggggaggggggtggaggagaaagagagaaagagaagcagtaaaacagtaagtgcttggctggagttcacaaagtgtttgatgtctgaaaggcagagaaatggtggtgctggcaagagaaaaaggaaacaaagctatgtctagccacacctccttccttttaacctcttgcgcatcgtcatcgttcgtaattattttatccccttagcaacgggctcatttcaggctcccattctctctactttaaaagttttaaagactcttactaggcctcctctgcccattggcctaaaatattctcatttaagacttttccctgtctagcttgtaataataggtcctgcctcctcacacttaagttgtatgattgtatcttattttttttaagaaaaatagtaattttccctgaataaaaccaaagtaccataaactgcatcatttgaaacaggggatgtgtgggcgactgatttcaattgaacaaatatgaatcatgttcttgtgaatcatgcttccctacaccaagaaagaaataaccctaataattttaatagcagtagacataaagagaatataagtaaaattcagaattttagaaacaatttgtggtaaatttaaagaaatcatggattatttcatcttcccaaataccaaagcggatattgaggactatatataaatttgttcagaattcctattatgtaaaggttattgcagggtacagtgtgctgtagtgatatctgctgatttttctctgtgataaattatatattacatattatttaagtatattatacttaaagctgatgtccctttatccctctaccaccacctcactgattatcgaggctttagagaaaatagctggttgcactagatgattacatgcctcaattggatagtagcttgttgccaattatcattacagtgccatattgattttttttcttgtttccattatggaaattaaagcagaatttgtttaaaatgagcttctatgtatattgtggatggcgattggttctgaatatgagctattttaaaaatatattttcttcagtggtgtgatgtctctgatattcccttaaaaatttaggtctctgctttgttgataagatttaccttaggtagctatgaaatggataaagactggaatggaatggtttaaatatagacagcatagatgttattatttcacataagtctatatattgatttatgtttatgatgttcttgggtagtatgagattgcttattctattaaccatacagccagtaaatttaattaaatttaaattagcaaatacttacttagtgttggctctatttaatataaatatttagtggctatatatgagctaccttgctaaacactatgaaacatagaaatattaatgaaatgatataactatctttagagaatttacatgccaaaggggtaggtaagacatggcaagaatcattatgattatgtcaagcagtaagagataaatattacatggagattttgaggaaaaggaactcatttgatcggaggaattacaggggaaaacattaatgacttaaaacagccaattttagttttaaatagttgggagaaatggagttgaggttactttctgggaagaaagaataaatgagctaacatgaggaagtgcaaggtgggctccagcaatgataatttgtctgattttattggcacatgtgtcttaaggcctgaggctggaaaggtagattgaggctacatcagaatgttgagccaaatgatttaaaatgtattaagtagtccagggaaaatttttggacagaaaactttggttgagggcaatttaatctgtcattttataaaatgattaagagaaaagaatgaagttggggaatcaccaattgggagtctccaggcttattaaaggaaagataactaggactaaaccagaatgttagcagaggcattggaaaggaagaaaggggccatttggaggaggcattctagaagtagaagtagaagtagaagtagaatatttgtgaataatgctctacattagcagtgtttcagccttctgccacacaggagaatttatgtccagccaatctcctaaacctgcgtactcagctcctgccacatgggtctcctcacagttcctggaacattctaaacacactagctaatgcctcatgacccaatttgcccttaatccttctacttggaaagtcctcactttcagagttctgctgaaatacctaaccttatcaaagaatctttcctgatcacacaatgaaaaatagcagcctgccactcctttcattctattttccaaggtttatttttcttcattgcatcaaagcaattattacatttattatatagttagttatttgttcactgtctccctatctctagatagtaaagtccatgaggctagttgcttagttttgttgcttgttatgtatctctctcacctagaacatgcttggaactttgtagacactcgacaaatatttgttgactgaataaatagaataaatgcaaaggtgaaagaaatgggtcatcaaataattatgccagtatttcaagtctgaagaattaaaagggtagtgatgttattaataaagtatcaaagagtggaagataagttgacttaggggtatggagacagaggaagatgaattcagcttgtgaattcatgcttaagtatgtcatgctggtgaaacaaccaaggcagtgctgtgtaatgggcaatctaaaatgtggagaagtctaggattgaggcaaagatcactgagtcatcctcatagagtcaatacttgaagcagtgggaattgaaaaaataatgacaagcaatattgagacagaattatcagatttgaaaattaaaattttattttggatatttaatgttttaaaattactaacttacttatacatctaattttttgtttatttctcagctgggttaacaactttggccatgaaggtcttggactcttattggatgagctggaaaagcttctggacaaaaaacagtaagaataaacactgaaattaaaatcaccaaagggaaaatgtttcagcacaacataatatacatttttcttttatttaggcaagaaaatattgacaagaagaatcagtataaacttattcaatgcctcaaagcatttatgaataataaggtaagtagtatttatttctgcccctgtcacaaaaggtgggaacttgcccaacactatgaaagtatgaaatgaacaaaatatttttttattattttttttaatttccagggtacatgtatataggcgaacatgtgccatggtggtttgatgcacaaatcgacccatcaacctaaataataaacccggcatgcattaactcttttccctcatcatcttccccaccccgtacctattttttacttatgtttctgctgtactaattaattgtagactagttattacaggcttataaataataagtgtttataaagttttacagtgaggttaaatacacatttgaaaccatatataaaagataaatttgatgtttaattttccaaaatgtgagctattgttagttttctcgatttttttttttttatttctatgctgatatttcattttaaccaaagaagtcctcacagcatccagaggatttcagggatgatataacttctgtagatctaaatcttttaaaaaatggagccctattccaatgtttcttctattcaaatatattgctttcatatagggaagatagataaaacagtactttccattgtctatgctgctaatttcctcaggagggtgagctagtcaatgaaacaaacaaaaaaaatgattggaaaaagtgtatttgactcttgtctataatttagaaatgctgtgtctgattcttattctgtttattcctccaataatttctttcatgtgaacagaggtctttttgattttatagtatactaaatgttcagaaaacataacaaaaagaaagaaatgaacaaaatagtgagtgcttgttcagtttacaaaagggtctttatgatgtaaatccttataatatttaagtaatacttacatgaaagttatactttgcttcacaaaatatttattggtgggtttttgaaatcatgcaaatgaattagtgttgttcccaattttggtaataatgctttttctttaatggtagtaggaaaatttaaatgtcgtttgttgaatatgtttccacacagagaatttctgttctattgaaaaggaaaattatagggatgggttgacttatttgctaagaacattgtaagattgagatttctctttcttttatgttttattaatgtcagcaagtttacatacatataagacatctctgaaaaattgcagggctttttatgtatatgtataatactagttgtattataagggaccctgtgaattttagacaataatttttcttctaaaaatagactttactcaggttatgaagttacagtattttttctataaactattttttttactgtcttagaaatgacctcttcatacctatagataaaatactattgactaattcacttaattacctaattccctttacatagtattttaataatctcaaaatagataatagaaataattacaacaacaagtagaagtttgccaaatgtaaaatatggctattaataaccaatgcaataagattatatattaatctatagacagtctcaagcatatggaaatacatataagtatttatatattatacatacatgtatcagcaaagaatgttactgtatgagcatatgcaatgaatgcttgctagtggacatgagactcctgaatatgctagttgtactgtttctggaagtttcttacagaaatattcccatcactactagtacagattttctcaaaatctgggctcttagtctttggctacaaagttaaacagaatctgatgcccaacaaggaaataatgagcattgcttcttcacagctcaagatagatctctttcgtcaattgagggaaacaatgacataatggaaagataacacagttctagaattcaggagatatatatagttcatgctttgttcctaataagttgtgtggcctttggaaaattacttgacctctctgagtatcagtcccctcatctgtaaatttagctataggacactttgttctaaattcttattgactcatgttgtcaattgtcgtggcttttcaggatgctaagtaattttaatcaggacagtcactagagagagtcataatagtaagattcttatagagccctttttttttttaacagaacatactttgatttgtcaacatttagtttcttaagagtttggcagtttcggaaagcataatgatttgacttagattattcgaaattgatgtttttagttaggccacgttaatgtcttgcacataggtgctcagagcatggattaatggatcttttgaattatagacatgtgaaacaataggcataaaatatgccttcagaatagaaaatatgcagtgatcttttcacttcatgttggaataaattgtccagatcaaggaattaagcttttatccaaaatgacttacacatcaaattttttggccccatggagtttagattacctacttcaaaaactcctttcttttatccaatacatgtaacaataggatcataaaaagcaacccattgtttcttaacttccagtactataatattgctctgatgtttggattaatgattttccagatatatttttcatgtcttcttttttatttttgatgtgtctctatatattaaaaactacttataaacattaagtaaaatttttaaaacctaatgatttcactctcagtctcaatgactcataaagctattaagtttggtaattgcgtggtcattgtctctcagttttgcaaatgtgtttttcactaatattcattacttttaatcatctactggccacctttatacatacttatctattttgtttttgttgcttctttcaagacttgtttcttgcattttctttttttttttggtcttatctccatatattttcctatttattatgacctgtgataaactcacatttaagagctttagctatgttccccatctgccactcggagttcttttagaaattaaattagggctgatggaactattcatatggttggtaattaactgaagtttagctgaaatggaaattttgctccgatgaaatatccaatttcaccattagactgtaaaatgaagcaaaaatattttataagaaatctgaaaaatactttgtgggacaaagataaaataatatattgctttcttaatgtaatgaaaactcaagttttagactttcattagaatttctttacttatttattaagtgcgtgcatgcacacgcatgcacacacatattcatgcttagaaaataaatgaaaatggtgttttctctccttagttgacttgtgacacttaataaaacccaggtgccatttctttaggttcacagcttttgtagtgcagcacagctgtctgaatcagggaggataagagagagaaggcatgggaatatccatactgaggcttatactggcatatagtattcaaaagagccttttaaaaaaaatttctctttttcttcaccttaatttttcatacaaacatattggacaatttaaccacgaattccagacatctccagggagacccagtgacataagtagaatcttactttagaaaatcatatcagtatgcgctttatatgttattctttgttgaagaaatactgattgttcccatatttctccaaatttatggaatttttagggcaggctaatggagatatatctgatcaaggagcaacaactccaagatgcagtgatttcatataaaaaacaaagacagataactgcatttgaagaatattcatataattaggtagaacctcattgtgggggtatgggtttttggaagatcattgtacgttgcttttttaaattaaagatatattccatagacattctgaatgaaggttttttttttttttttttagtttggattacaaaggattctaggagatgaaagaagtcttttactattggcaagagcaattgaccccaaacaacccaacatgatgactgaaatagtaaaaatactttctgctatttgcattgttggagaagagaacatgtaagtattgctatattattatatttgctgcatggaaaatgacacttaagaaattaataagtcctacttttgttctctttctttggataactttcatgaaaacagtattttagataatttttgattgaaatttttatcttgcctgtttatattttggcttctttgttgacattatagaaactcagtttaaacagataaaatcctagtgggaaattcttgaaagttggattcaaagtgattgagcagaattttgttttgctggaggtacagcaatcattagaaagtggacaaaaatcagagagttattttggcaaatacacacacatacatacacaaatactgtgctgcatatcacacaatttgaatagatgcctttattttacattatcttataatagtattttactttatatgccatggtaaatgaaaattatttgtaaagtgaaataaacccacctgttagaaaaaaacggttgttgataattattcaaagtgtatatgtgccaccaaatgcagcaagttgttgctgaacatgcatttgatcacatcttcttatggaaataatattgaatcagaagcaaactttcagatttgatgacattaataagtctagtttgtaatgaacccttgtgataaagaatcaaatatctgctaaggacccgaaccaaaatatttccttggaacactttgcgtgacagtaataatgtcaatttgagtcagaacaggactatgcaaagatttaaggatgttggaatatgttgactttctcataactgttagagtaaaatgagatgttgcttagtgttagctactgtcctcagaaaccaaaagacaaacactaaacaaaaatattatcatattaagtctcacctcaatgataacaaactgagaatgagataacatatgtaaaagcaaggatccttaggattttattttttaaaagtcagtttatacatgtgtaagaaatattttttaatcacttagattttcaatattcataaaatacaatgtagtccagtataactgttatgatttaattataatttcagatataatttgataagagtagtatactatatagagattaatttgttttaggcattgtgtggagataccaatatttttggtcaggttaataagtttcttgtgctagataattatacattcttctttaatcacctgggctttcctttttagagtcttttttctttttccattgtcaaaaaatgttgattaaaaaaattctttaaaaaataatcactctttccagaactttattataaaattacaatctgtttatgctccaataaactgttaacaattataggtgtcatattatgtttaagtgatattaatgttaacacatgaaatatcaaaacctgaaaatttaaattttaatgtttatcacttaagtattctttttttaatgtcacccagaaaagttactttccttaagatttttaaaatcgaattttccttttgatgccctaaaattatttagagctatcaatatttgccttaaagaaatatacggacaggaacacaattcctatattgtaatggtctttcagttagactggaggaatcagttcaagaaatctattttatgtgatagtgactgtagttaataacagtgtgttgtatactcgaaatttcctaagagtgtatgtagactttaattgttcgtaccacaaaaaaatgtaagtaggcgaggcaatatatgttaattagcttgatttagccattccagtatgtatacatatttgaaaacatacaatttccatcaaaaaagcaaatgataatttttaaaaattctaatggtatatataaacatcaaataccagaaagaaaacagggaatactgaaaggaccggtgctcatagtgtctgtataagaagtatttctcatttctgtttcttcttttttctctacagtctagataaacttttaggggctataacaacagcagcagaaagaaataacagggaacgattttcaccaattgtggaaggtttagaaaatcaggaagccttgcaattacaggtgagttagttttgtcttaaattgcttctagagttatatttagagtactcattttgtatgacatcaactccattttagctggcatttaagtagtatggaatgtaaaactaaaattttttctgttgctagtttgtgagaattgcaatttgtttaaaattaggaaaaatacttttgaattattataaatgtggcagttatggctgtcattgatatttagacaagaatttagtaattaatgtaataaaccagggaaattgaagcctcagcagtaactaaggtaaaagggcaagcagttcagccaatgccattatcctaacaagtgttagtgaagtcggtgggcttgtagaaatgtaagacaattaaacacatctctctttgtgccattcagacaatattcaaaggtgtgactcaccagaatagaagggattgaattgcaattcttaggttagcgttaatttgatagccctgtgtagacacaacttactaaatgcctcctttagaaaatgacaaaactcactatctttacctagatggtttcaggaaatgatccattttatgaatagctctgttcttgagggatgagaatgcatatttattggctgaacttatggtatgaagtcctgcactaaacattttaatttgcatatattatttgatttaattctcacaacaacctagatatgaaggtattgctatagtatctttgttttgcttatgggacgaataagttgaatgagattaaataactggtctaacgtgacacagtttttaagtgtcacagtcggaatttgattccaggtttttggtctctgctaatctctcttttagacaatgcataccatttaatgtaccatggaaaattctctgaatttttttttagttctcatattgttgttcaacaaagagaaggtagtttccacatttaattttatcaagctacttagcatcgaatgtttaactcttcaaatttcttgcttgatgtgaaacaaacacaattaattttttatgtattatgaagtattttttgtattatgtattttatgtattatgaagtatttgtatttttgtttgccagagtttgaaacggcatcagatagatgaattggcttgtctaaagagaatctgtaatgttacaaaattgtaatacctctccaaatgttgaaggatctttgttaatcatgacttctactccaactatattgaaaattttggatcaacttttatggtgtacttttatgtcaaatgtattatttatttatttatttatttatttatttatttattaagatggagtctcactctgttgctcaggctggagtgcgatggacgtgatctcagcttgcggcaacctctgcctcccaaagcaattctccctgcctcagcctcccaagtagctgggattacaggcatgcaccaccaagcctggctaatttttttatttttagtagagatggggttttgccatgttggccaggctagttttgaacttctgacctcaggtcatccgcccactttggcctcccaaagtgctgggattatattacatattttaaagattagtatattttttcccagtgttttttaataatacattgtttcttataaaatttaatcttgataaaattttatacctctactgaaaggttgaaaactgccttttttagatgactttgaaagttttgttcatgttcctgtggttgggcttacctaactaaatttcactggtttttcagatatatgtgtatgtttgtacttctcttcgaaagtttgttgagtaggaatgaactcttttatttatattcaaagttttcattacattgatatatttttaaaatcttctttaaataaatttttagctacaactctgtgagttatgtattattacctctggtttactgatcagggaattgaattggtggaaggcactccaaaatcacccagctgtgtaagggatagagctgtaatttgaacccatgtctttgtgatgccagaatttgaatacggcattgcctatactttgaagggatgcctctgccaatgagtagttcaccccaaacaatgagatgggaaagacatttgctagccttcaggaagctggacagaatggaatgataaagtgacaaattgttaacaagtaacatatggaagaatcatagatgtcttgttaagtattcaataaattgttgaatactgattatagatgcaaacatatgcagaccacaatttaaaatttcacattttaatgagctacaaaattagtaatttgttatatacaaaaactagtactctcacaagaattgtgaagtgagtttgtttatttagactatttaatgtgaatgaaaagatgtcctctaaaagttcaaaaatacatgcagaatacagaaacaaaaacccaaaagtttaaatctgttgtttaaaaaatataattagtgttgtattttaacagaatgacttttctatttctgtagtatcctgagacttcccaaaatgttattacagtctcgggaagtaattttgttaaaatacaggactaattattttttaaataacaactatatacattttcccccctttttggggttttaaaaaaggttattaacttctcacagattttttttcctagcttttaaagtgaaattttgtacctatgataggattttcattatcttcaggagttcaagaaataggtggaagataaatcgcatatcttcatacactctctcttcattgactttccttcagcttagtagcattctccggtctcttttgcaaagcacagattatacaccagcagcttcttttgatctgacttaaccttctaactagcctcttgtctctctttttcattttaaagtccatgcctctagaataatccatatttgttttctatgttttctaaattaccttttacaactctattacagttctcaaaaagatttacagtgagtgactaatttcaaaatccaatggcctctttccaatcttgatcacttggcactgttgatcaccttcttccttgaaaattttacttcccttgactttctaggcaccattctctcctttgttctctacctttatggtttttttttttttttctgtcttcctaatgtatttctcctcctcttacttcctgggtattttgttccctatgttctatccgtggtcctcttttagtatcattttatgtacatacattcatatgcacatacacgtatctacatgtacatgtatatacatacagacacatacttttttaaacaattttgtccatgaatgttctgaattgcttatctagttttacaatccaactgtggtagtgattcttcagatttatacatccagctcagtgactggtatcataaaattaagaaattaaaaataacatttacaacccatatgccggacagtgtttaaaatactttaatatgttatcccatttaaacctcgcagcaattgattgagagagatagaagtattatccccattttatagataattaaactgaggctcataaaggttaaataacttccctagggtcacagtgtgaatagaagggaaagcacagattatacaccagggagtctggctatagataacgtgctttaactactaagctgtaactccttttatattaaaacttagcttatatctctttctgttaacctgatttttcctaagtcttctcttcttcctgtgtttcctattttcggttatagaggtatcatcttctacccaatctttaattttcctcaacacttctttcttttttgtcccctgcattcatcatcaagtcttattacaaagtatagtattgactgtgaatctaacccattctacttccactgcctttatcttctcccaccaatattatttcaacaatttcctaattagtacccatactgacatgttttctctccagacaataccctacactattgtcagttatctgtaaaaaatgagtccaattctaatacattatcattcttaaaaatctatgctcatgacccattgctaactttttcattgtggtcctaacttaatattctggcctttgagcctgtcattctcccaaatgtaccatatgtttgcgccatactacatttggtgtttcccagatatgctgtagacttttaaatgctctcaaacattttatcatgcggaacactttgcctgaaatacctgtatttccccacctatatctgtttcttctgtgtcttgcataagtctgggaaggcttcagtaatgaggtgatattttaactaggcctcgaaggacaagtaagcatttttcataaattatctttgctgatagagaagcagtactatggtaggatgagaggtgaaaagggcttccaggaggtaaaatagaggccagaatagtctggcagtcacttcataaaaaacagtgaggtaataccagcatccagttgaaactgctttctagatagccaggtaggaaaacctaaggtatactgagcatgaataatggtttatagaacgggaaagtagtatagttaaaatacaatgatgtactatcaaaacagccccagtcttcacaggctgctgttagtttgaaaggtgccatgtttttacaatatttcaatatatacaaagaagtggagtagcataatttaatacatttaaaaactgttttctaagatgctgaaaataataatgaactctgcacattttgtaattagatatggtacacaaaaacagagctgtaaatatgccctttcctgatgtgtgatagcttcacttacccagtcctcgcctatttaatagatttgtcctttggaatacaactgagaactaaaaaataaaacaaaaattaaataaaacaatctgagcagcctacaaatgtcaccagatctatcaagtaagcctcatggtgagaacgactttttggcctttaatgagagcctatttattctcttttcatatgttatctttacgaacccaattatctgttttacatccacagcagactagaagtgcaggttggaaggttgggagagagtttattccagaatcgtacactggaatcatcaagaagtgacaactgataagctggcagcaggggaggggtagatagaaatgtaataaaagactgaaactggaatgcaaatgataacaatagacttcacagagcgcagaggctagtagccctgcacacttcagtacctcccgagatactgagttacaccatacctcactaactcacatatttagtgatgaccctgactcaacaggaaattgttaaattatatctagtttattttgcgtaagaatgtgggaattatataattcatttcagagagtgtcccatgtgaaacaagatgttgatacttaaatagataaacagatatatggaactatcctatgtggcttgattctttccacagtggttcttgagtgttgagattttactgcaagcatacttgtaaattagccattaatgtactcagaccatcacatatgagggagtagctttggacaaagtattaatcatttgtcagtgaaagtgcatttataagaaaacaaggcatcgaggcttatgaatatggagaaaatttgtggaaattagcatttataaagtgttgaatgactgcttgatattacttaggaaacttgttctatttattgacagttttatattattgtcatttagaaaatagattactataatgggaggttgtttagagatatttgtacaatgtagtcatttttggtattgacacaaaactaacttctgacttaaagaaggatgcctttattttaaatctgtttcaacactgaataattgtcaaacctatcattttcagtaatagagggttgccagtgacctccatgatataaaaaggaacaggctgcttttgaagtcattatattagcttcctcagcactatttggcactattgatcactcctttatcaaagctccctcctcccttgacttccatgatactaaactgtattagtccattctcacattgctataaagagctacctaaggctgggtaatttataaagaaaagaggtttaattgactcacagttccacaggctgtacaggaagcatgactggggaggcctcaggaaacgtacaattgtagtgggaggcgaaggggaagcaggaggaagagagagaaggggaaggtgctgcacacttgtaaacaaccagatcttatgagaactcactgagtatcacaagaatagcaagggggaagaccgcccccatgatccagtcacctcccatcatgcccctcctccaacactgaggattacagtttgacatgagatttgagtggggatacaaatccaaaccatatcataagctctccttgtttttccttcacctatgtttcatttaaattctcttatttctatgcttgacccttaaatttgcagattcctagagcttgatcctcagtcctttggtactttgcttttctcatattgatgatccttgggcaatcgcatctatcctcacagcttcaattaactaccactcatatgtgatgtctttatctgatctcttctcttcctcccaactcacagaccccatatgttcagctgcctcctgactagatttcaaattcaatattgtccttaaatatacttatcttccttttaaaaaaaatccttctccctactctaatcctctctccagccttgacctgcatttctcttgtattcccaatcctggttgaccttagtattacctaccaattagcatatagcagaaacatactagtcatcttagaatctacccttactccatcttccattccattagtcaccagatcctatcaattctatatccttaatgttatatttcccttcctcgacatggtatccttctctctccaccctcactgccatttttaatttcagagcattgttacatctcactgttttatcctttccctatgttctattcttcattatggccccgtttaaattatcttccccaatgttgtctttctgaaatgcttttctcagaaatgcacttcagaatgcttaaagtccagcattggcttcccatagttcactgcttaaagtccaacaatggcttcccacagtctccagaattgcagtctagtcctagcccaaacaaaatacttcatctggctgttgctttctctttcgcctcatattccaccacccttctacatatgtttttagtctagtcatattgtgctttgtttcctatagattttatgctgttttatacctctaccttcatacctttgtacatgacttccgttggcttggaaagtactccacttctcaattaactcgctctgtacattcacatctttcttctctcatactttgacttaaatcatctttgttcctaactcctgctgggctaggataaagaaagaccttgttaatgtcaacagagtacttaataaggtcaagtgtggaacagtgtcaataaaattttaaatgtacaatttgtcacagataatggcaatatggataatctgtctgagaatgccctggagttgtcaattattgtaccccatagctctgtgaattgtgattaaatagatagatgtttgtatagttttcaagcctgtaagttaaagtcagtaaaaggttctagcatttttccagtaattttatgaagatatttgtgttcaaatatttccctttctctgtcacttaggtaaacaacaacaacaaaaaaacttaaatttctttttgtaatgctatgtcttatgccaataaaattggaaatttttaaatgtcattcacttactatattttaattattttatttgggacagttaagtgttacaaataaaccctaggcatatacagatgagctttgccttttgaaagtttatcatctgttttataatatttcaccctttataccataccaccccagaatgaagacaacagcatctggtgactaaagaatgtagatgattattgtagaaataaaataaattgttatagtaaaggaaggatcttaatgtggtagaaaactgataatgattcagtgtagtatataattatacatgacataaatgattggatactttatcacatgcacagaactggtagtttttaactatgtatgcttatgtattcatttaataggatatatatgcatctcatgttgaaatcttatgacatcactgaatgaaaatgcaaatatagaaaccaattgtatttactaattaaacatcagaattgtggccctagcatatgtattaataatggagaaaattcactgattttttgtgactttaaaattttgatcctcatggaagctgtatttgtaacaatagatatggcggaccattttgaaacatagccattataaagacactaagcaacagagcaactctggataatggactttgtgatattcaattcaagggcatttgttttctttctaagatcaggagaaatgatatcaagcaagatttgtgcgatataatgtggtagaaaaaatgcaaggctaaaggtcaagagagctgagttctagttgtatcattggggcttattagttatgtgatcttgggcaaatcatccaatctttctaggttttcagtttctttacttttaaatagcatattggaccagagtattttatgttctgtctagctttaaaatctcatgattattttctgtctctggagttgaattttttttttttttttttttggaaagcagattgattttgcattgttagaggacaatagagtacactcatctcttaaagatttatatacttggaagttgagcatatgaattttgaaattttcattattcagcaatgagttttgtagttctttgaagtgaaggtttcagagattaggccagatctctttttttctttaaaatctccagtgtagtgctattcaatcaaactttctcccatgttctatatccctgctatccaatgtggtagctactagccacatgtggctgttgaacactggaacaatggctagtgaaactgagcaactgaatttttaattttatttaattgtaattaaattaaactgtgataagtagctcccatatagaatagcacagtactgtagagcgtgtgtgtgcgtgtatgcatgtgttcacatgcatatacatgctgagtgtggagtggggtggcagaagtaaaggagaggagtggtagaccattattttggatgatgggatgccatttatactttactgctcaggatgtacatgaagtggaatttaacccactccaagaaccattttctacttttgctttttttctgcattacattatatattatgatagtcactatgtgtactagacaacatattgtttatattattgtatgtttttctaattaacctatagttttaaagctacatatccccagtatattaagcatgttgcaccagttaaattttatcatcttacccatccttaaaatcttttgttgcgagaatctataaatggagtttatgagacctttggaatgtgctggaaattatatttgtagtaaaattatatcatttatagtcatgagtttcctccttgctgtgtggccttatataaagttattctatctgctttgagcctccacttcatcatctgtaaaataaggataacagtaatactaatcttgtgtggtttttatgaagatgagattagatggtgaattatgtaaaggacctaatacattgtctaataactaataataataatggtgataatagtttgggatttcgtatttagctatgaattcaggatacacagaatgggtttgtcatgtttataattaagtagtaatatattcttccctttaagctaatttaaatttaattttgtatttgtaaatagtgacaattatttcagttttgaatttgagatatcgtttctattctctgaaaagggcagcacttgtgtaacggcataaaggaatagcaaaaatttagatgacctttttgttttccacattcatattacaatatacatatttctgtaaaagaatattattttatcagcttatgttggaaaatgacatgatagcatgtttattcatctgttatttgtaattaattaaatatctattagaatatgatatataataaatggtacattgttaagccagtacctttaccattttaaaactgacttcacaatatctcctaattgttgtgtactatagtcaatggatggaacgtctttgttttcatattaaactatatgttcatacattgtatgtaaagtgagtatttaatatattgaaacattattaaagttatattgatacattcattaattttattgacttttattatctttattgtctcctgatctgaatacttttatttgtataaagatacaattgcaggactcattaacttgtttcttacagaaatgttctctttacttgtagggtattaatacaagccattaagctagaatttcttctggcaaaaacaatcctaacagatggcaacttttctctctattaattttggattggacatgcactttggcttgtttggtcatgtcatagttgtaacataacaagagtcattcaagcaaatacaatgataatatagctgtggacatgtacagtatgcaaatttatagcctagcctatcaaaactatttaaagatttacatgatttcctgttgtaaataggaaggttaagtaatccattaaagcataagcttcatactaacttatctggtatgtctttaaaggtaatgccaaatgtatggcaaatatttagtcagttgcctaagtgttttatcttgatacttgaatgttcatagaaattagactatattgttgtatcattcagatatctggtcatgttagaaacaaccttaatcagcccttttaaagcatgtaacttttgatttttgaacatagatgtgaggcagataggctaatctcccaaaaagcaacttaaatatataagatacagattcaaaagtaaagcataccttttaatctcttctccctattttggaaaaaataactctatcataatagatctgtagatgtcaagtcaaaatacatttgaaatatttgtctttcggtaatatatttttcccatgctaactattaatttatttgtgtctgcttctataaatacttagtatctttatataatatgtttttttccgaggattccccttgtagtttgccctttgagcactcttctactcattgcattctttaaaaataaaaaaataataaatttaaatggcatcttttcagttaaacaattagccagttaccttagatttgagcagcattttccaaaaatgctacttaggaataatttatggaatacctggcacttagcattttgttgattcccttctagattaaaattaccagcaaataagttcctttttataatagggaatctcaaaatcagaaggtaagaaaagcaaaactcatttttcggtatcaatatatttaatcaaatactttacttgaaaacaagctcttacatatgctttattatgaaatgtgcattagtattagtctcccagtgccttctaattgatcttaattcacttccattattttttcaaacctagtaaattaattcatcttaattatatattttaatactttatatattttgtacaaatcatcccattaagaggatggagagagtttaaatcaatgtaataatttatctaagttatcactgttccctgtttaatattagggtacttttatatctttgatttattttagaagtgtttataaccctgtagaattgaggccaagtgtactgtgaggaccactggacatgaaagatacattttgtgatcttttcaaagggctctgtctgcccacttttgcaatttgggtttttcagagggagtttaatatttcttcatattatttttaaaagcataacatacttggtcatcacatctttgttagaattattttggacattatacactttgtcgttaattttattgtttataattaaagtcataatcattatacttctagaaatatttgcatttcttattttatcattatgtgtgtatgcctttagtgaatatattatcttaatgcattatttcattaatttaatgtgtttttttaaaacaaaatttgctttctaattgcaggtggcctgcatgcagtttataaatgcccttgtcacttctccttatgagcttgattttcgaatacatttaaggaatgaattcctccgttcaggactaaaaacaatgttaccagtaagttgaatgtatacatttattatgctgatgaattttaaaatttttttcacttccacaaaagtacttgaagcagagtaaataaatgtgctttgctattttgttttgtaaagcattagacattttgtaagcttttttgtattccagtaatagcattctctacatacaaatgatgattcagaattcagctaataatgtacccagaagcgatgtgtttttgttttttgttgtttccctcaagtcaaaagggacttcttttctttgaattttgaatattgaaaacatgagactttttttttggagtttcaattttcatttaaaatattctgctttcctctttgataacctagattgatttcattggtattcaggataagcatgcatagagttttgattagcatatgctagacacattgcttaagaatgttactcttgttacaaggctataggaacttttcagatcaaaaacaatttgtttcttaaattaaatgtgaatatttgctgtaattatgatagtgttaaaaacatttttggaatgattttgtatgctgaatctgaaataaatgagcacacttatttttataaatacaaatacaactactgtggttttatattttattaagtatattaactgaagagtgactattgcagactatggcattgttcaagacaagtaaaattctgctagtgtctttaagctactcagaatatacctgagagacaagaagtaaaagtaaggaagtgagaaaaaagcactaaggagagaaaaaaacaacaacaacaaatgtcattgaatgtgcatgtgtgtgcgtgtgtgtgtgtgcccatgtgtatgacctagtctaccagaaatacccaaattggggacatttcctggtgaggaatcaatatgtagcataaatttgtaacatatggtgggatacttttaactgaaactagttgaaacccatcataataagttgtgtgattggacctgttaaatccattttaataagatgtatgattgggtccacctggttttggaaatttctatgtcaatcccacctgaagcagttctttcattcttgacacttaaaaccaaggcattggttgcagagaatcaaagcaacattttaagtgacccatctagagattaactgtgcagttaacttaggcatattcaccaattatagttagtgtgacatgtgattattcttgttttttttttcactaattttcttttcatccaaagcctgtagccttggatagctaaagataatcgtatggtcttgattgtagtttgcttttgaatttccttcttgttggtttccatgcttgtttttactgggctggttctctgtttatagtagcatctttgaagacttgctggctgcaagggctctgtagcatcctctactcgtttattaatatgccatgttttctgccatagttgttgctcttacttttctctctttcattcccctctatttataattgaacattcactttctgctttatactactgaatggctagtcaagagaactgtgactctcattttaatttattttagtcctcatttttcagaaaaggtatggtattgtagctcttgtccttaaccttttgcacttttgtctgggtatattaatctctgctgggctcagtggcctcatgttattcatttggttacacagacagctaagattatgtgtctgtgtttctaagctacacttttccattggccatatagccctatataaaactttttgtggtaccatgtgcttcttaatttatatattcttttttaaaattaaaaataatttttaattatggatataaaatagttgtatatatttgtgtggtaaaatttatattttgatacaagaacatggtgtgtaatgatcaaatcagggtgattgggatatccatcacttcaagcattcatcatttctttgtgttgggaatattctaatcctacccttatagttattttgtaatacaaataattatgaactatagtcactctattgtgctactgaacactagatcttattacttctatcaaactgtatttttgtatccattaaccataccctattttcccccacaccctactaccctttctaacctctggtattcttaatatatacttccaattagacttttctttatcacatctcttcagtatgccctgcttctcagatctcagtgattcttcagcaagataaaagtgggaagagaaagttttggaatagaacctacaaggattctcataatttttttttcctctctaagacagtagagctaaatatgattaaatatgactctgattctcaactaagaggttgggcatgtccccctaaaatcttactgtattgaggatagggcagacatatttggttgggaaaaaaaaaatcctccgcaggtatttcttttccttttccttttcctttccatttccctttttctttttttctctttttcattttccttttccgttttctttttcttcttttctttcttttttgagacagggtcttgctctgtcactcaggctagagtgcagtggcacaatcacagctcgctgcagcctcaatctcctgtgctcaagcaatccttccactgcagcctctcaagtagctgggaatacaggtgtgccaccacacccagctaatttttgtgtatatatatgtatatatatatgtgtgtgtatatatgtgtatatatatatgtgtgtgtgtatatatatatatatttatatattttatatgtttatattttttttattttatatttatttttgagacagagtcttgctctgtcaccaggctggagtgcagtggcgtgatcttggctcactgcaacctctgcctcccgggttcaagcgattcttgtgcctcaacctcctgagtagctgggactacaggtgcgcgccatcatgcccggctaatttttttttttttttttttgcatttttagtagagatggggtttcaccatgttggccaggatggtctccatctcctgaccttgtgatccgcctgcctcggcctcccaaactgctggaattacaggtgtgagccactgcgcctggcctaatttttacattttctatagagacagggtttcgccatgttggccaggttggtcttgaactcctggcctcaaatgatccaccccagcctcccaaagtgctgggatcgcatatacaagagtagaatcattattcaggcagatagaccttgagaagattagcgatcatatatttagaaccgtagatttcactactattgttttagtttatcacaacttgggagcaggacagaatggtcatgggttaacatatactacatacctcacatgtcaactactatctaacctactaatgaatgaaatatttaaatttaaaccactggaatttatagtaacattacatatcctttacatatgcagtgaagcttaataatatggtcatagattgtctttaaaatccttacgttttcttctatttattcttttttttatatccagttctaacaagaattccctaatattctagaatacagtatattcaaagcagcaaattagatgtgactagggctaatattaattgttggtacatggatgaaaaattatatgtatctagaaccagtatgagttgggaaaaactagttcttagtatttcagtaatccttgagatcaacactgtagtagagtgaaactttttttcataataattatcagaatcttcaagacaacgaatttttaaattatattctttaaaaatttattttcaaggttcctctcatccctatggttaaatttagatgttgaaaaatagtttgtatttcatttatatggaatttcacgtctgataaatttgctttagtaatttagaataaatgagttgttacaaactctacagtgaattttaaaataggatttttttctgtacttaatttacattgatttcttctgaaattttccccatttgccttttatttagttaaataaattaagaaaatattagttaaatcagataagcgaaggaaaaacatagtaagaaatggtgttggtaggcagtgggcatacttttatctctttaaaagtctgagaaactctttcttgttttaaagactcaattttggttgtttgactgttaatcagcagtgtactggcaatggactttgatttcctttgaagtgcactatgttatagaaaattacatatttcaggaattctgcaaaaaataattttagatctataccgcatgtctttttaaaaaataacaagcatagagtgtttcacataattaataacagtgtgtttcagtaactttgtgatagttcacgttttaaaatataaaacttcagtgatagatttccatttacttttataggatacccatcttattatttgtactatgtaaaaatttttattcagtaaatgattattttatcaagaatttatgaatatttcaaggcttgacattttgctggaaggaagtttcataaagataaacatatatatgtgtatgtatatatgaatatatatttacagtaagttcttagttaatgtcattgataggatcttgcgaactgcaccttgaatcaaaaccatatacagtaggtccttgaataatgtcctttcattataacattgatgagaaaagaaaattggttttgctatacgtattttgcttcaagttgcagtttccaagaactactgaggacaattaaatgaggactgactttgataggtctggagcattattaataaagaatatttataaaatactgcatttacacatgtctaaattttatattgtgctatatgtgctcatatactatgtatattgtataaataatgtctgggcctaattaagaactaaattgcacatttaaccagttattttcactgaaagcattttaattatgctgactgattttcatgttttgtaacgttctatgctaattaaatggcagtacttaaatttttctgtttttctgaaatatttgaaagtgtttaagttttatgatgaatttctgagagagaatatgtggtgacaagaataagacatactgtaaaatgcgtgacaggttgtttctgcagtgaccagtgtattgggtttgtctggcttatgtaattttctaaatagagttcagaaatcacctgataatatgacccagcaatgttagatgattttgcattctaataaatttcttcattccatttcaaactggaaaactagagctaaagcaagttattactaaaaatgaaaccaaatataaatacatttacttgttatgttttatatgaaattgtgtagaaactaattattttcatatgctctgcaggtaaattttcaataaattattatgtatgtgagtgttagaaaaaaaagcatctagaaattgctgaaatttgtttggcttcagtaatagccattacatctctataatagttctattgaataaagatagaaacaagaaatgtatcccattttgttttatcgacctaatttgaagtacaccatgcttgcatttccttttagagttcaagctcagctctgaaaatcctagtcccactttcggtatcacccttgagcatccacagttgtgattatcgatttgggttttgaaagctgcaacttaatggacacatattaaaagatattccaggtgatatatattgagcccaacaatctctagtgtggcatgcttctaaattttttatactattattatgaaaattatcagaggtttgtaatgcatgtgcttataatgtattacaaaaacataacttttatgcccaagttggtattttgtgatttagctaagcaaaaatataaggtgggggaggaggttagatgtacagcttaataaaaagtccaaacgcctttttgctttaaaatcacaaaatagcttttaaaataaatgtgtttatacatcttttcaagccatacttgggactgttgtgcttgaatatatccttgcatttgttcttcattaatacaattgatttgtatttgcattttttgccagaggcatatgtgaatgttctgactgcatgagttcttttgcaatctttgattagtgtgtttagtcaaaatgacagcatttaatttgggttgttagcaattagtttttttctgttgtagaactgatcgttaattttttaatgtgaataatcaaaatgtagggcatggaaaaaatgaagtgaatgcaatgaggtccttttatgttgaaacagaaaaatttagctacaattactttcagaaaaccaagtgcccgcataaatatttgaaattgcttctgtgtttataaatgaataattgtgttctgccctttattacctaaatatgccgttgtcaaactgttattcatgtgttaaattttatgtttatatattaggatctaaaagaaaaagagaatgatgagcttgatattcagttgaaagtatttgatgaaaacaaagaagatgacctaactgaattatcacaccgtctcaatgacattcgagcagaaatggaatatcctttgacaaaccacaaaacaattttgtttgcattgtgagaaagggatttgtgggcgattttgtggaacattattagagttcttgtctgccctcccaatttatatccatttatttatattagaaccttactatgatgctgtccttgagattcatgttgaggaattgtcaggctgtcttgatgatttacacagagtgtattgaaatctgcacaatggctcacagtattatagatatactctactcagtggtcttgaataaagaatagcataaggcaatatatcttacatgtaaggatttttttggggaaaatttcactgcgttcatatgtgactataggtgaaatacttattcagtttattaaatcaagcttcagtgacttagagataaaaagcaattcaaataaatgtcttattctgtattcaaatatttgtgtttcttaacaataacaaaaatgtttagatgcaatagaatctgaatatagcaaagctatgtggtagaagcatctgagtcaaatacagctagcatataaccttccgacggcagcaattttatataaaatgattttagatctaagagatggttgtcacagcattgctggccatttgtttcgcacctgttatgtttcttacttaatggattctggtgaacctgggaaacatgtcaaaaccaaagtgacctttgagttggattttttctcaatgatgttttcttccctttcctactgcttgcccccactccccaaagctggaagtaatattcccctccttgaaatacccaaagtaccttgtttgttctattttatttatgtacacttctgtgcccctgtgagattgagggcagaaatgttatgtttaatcttttttccttcaatgcatctatgaaagtcttacacataggtattggataaatgtgtgtgcaatgaataacaatgttattattttaaggaataatttctagtaatttttattcatcattagtggtgccagtctactgtggcttctataatattaaatgtttttcatatcaattaatatcttgctttacatagattcctcttataatcaaacttcaccataaaactatttttggatgcattgtgtagccatttaaggacctcatgagactttagcacaacactcttatgtggggtctaagaagtaagccatcgtatgcttaattctactttggagaaaatgttgacatttcaggttattttaggatattgaattacatcttgtcttttatctttattttaccttggttttccaggtcctcacttttattacaaaaatggatccatttgtgaaatctgatttctagtttactaaaagcatctaaatttctgcaactctatatcttgtctctactttccattttttatcaaataatgaaatacaaatgaatgcaaacaataataatttcagatttagtatttcatctggataacataaaactgattttgtgacctcttagcagtttacagcatgctcatttgccttctatcttatgtggcagtgaaaatagagtagtagtgatttgcatgaataatataggtcctctatcacaactacagggagatcaaaaggaaaccattttcactgatggcattgctgttccaatggtaccagctataatctggactttaaaatatgtataacggatcatttaagattttgacagtcaaatggtcttggacatgctcttgaggtctgtctctctagttaaaagatcaaaatgattccatagaatcattactttatgcagatgtttaaatactggatcatagagttgaaggtttaaaaacagtaatggaagcaagattataagtcaatgttttaaaaagttaaactcctttgttatgaatgagacttccatcaaggatctttaatatttttcctttactttctactgatatgaatgaagtctaccatcttctatataatatgctgaaggacactgctgctgaaaattacttcttatctattctacaacattttttgcttatcagaaatgattattatatcaggtaagaggcagttctgagagtactatatttataatttgaatcggatattaaaggaaaatgaacaatgtagtggggcctaagcaatatatgcatatgtgtgtgtatgtatatatatatgtatatatatatgtatgtatatatatatatgtatatatatatgtatgtatatatgtatatatatatatgtgtgtgtgtgtgtatatgtgtgtgtgtgtatatacacacacacacacatatacacacacacacacacacagggtataagagtttgactctttaggtaacattttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggcccaggtaacattttttaaaaggtgttcattttttaaatttggccagaagagacagatgcacttgtaaaaatggggtactccagcgacaggactttggtagcaatgaacccaacagattgcactggccctgcaatgaattttctttgctagatagtgatatcacagaaaaagcactgaagattctgggatagaactttaaaggttttatcttgtgcatattaagtaaggttttactgttatttctctttttacagtatttatctactaataaatgtgatcttaacatctaagaaaataaaagtgctaatatttcagttttatgtctagtagtgtcatccttcaaaataaatgagtatgaaaataaccattaaagttaaaagttttagaatctagttaactgggaatatatcggaaaaccacaaagttatgaaaaggcttctgagtgactgaaattatccacagactggtgaccatgatgttacatttaactgttcaagagactcttagttgttcttcatactctgatttgcgtgaaattctgacaacctaggttctttgatttctcaaaacctgcttgattaaatggaaaaggaaagctaccatgaggtcagcacagtctcaacaaaaattacaactgtaaagcagcatagagaactattatagttcagaccagtacagtaatttgttgggcatcgtgacattacagagagataaaaaatgtttaaaatattaaattgtgtgctgttttttaagcaacaaggctggttatacgttaaaaattattgttgtatttttaattaagttctaacaaatttaaaaggggtactgtgcccaaaggtactcagttacctggggaacatcatttatgtgaaagtatccatttctcagcaactatgaataaataagaagttatcctcatatggcatgtttttcatcctaagaacatccatgtgaggcagaagtgtgacaagcattttattccacttagggatgattaacctggccccagctgtgttttccttatttaaccattgactagactgaggttataatccaatattatttactctagacccgaagatgacttgaaaaaaaccagatttgtaatatgtattactatttattcttattcttgggaccagacccattactaaagacatagaagagcaattagagtctatttggcttcatttacaaacttttagtaggttggctatttatcagcacactatatttagggaagtttatatcataatttgtctatagtcgtacttcttactactgatttttctctgttgaatttattatcctttgacaaatactaaatcttacccaaattttaatgcaaaagtgccttttaaaaaattttgcagtatgtgagtggtcatttttaaggccagaattacgctgatggattacagaattaggatatgttttaaaacctctgacactttaaacaaattgaagcaatagccatgcatattaagtgtgtatgcttttataaaatgggtcttttaaaatgtgttgcataaatagatccttggatagtcttgtaatataagtggctctgtccagttttgtaagctgttatagctatcttgactaaaagtgctgtagtaaattcaagacattgcttgccacgtaatgtgaagaaactcatcccttattgaaattgagaacctgtggatgcgtagaaccatttctgtatccatgaatgtaggactaatggctcatttgtttttattaactttagaaacaatagcataagtaaatagaaaaggttgataagtatctttcaacacaagcatgaatccctgcaaactagattatgaagtcactagatgtagttgattacatcacaatgggtttggtactgtaacacccagaccatccttaagcttaggcatgcttgtcctaagaaagtgtagtggctgcaggattttttaaaacaactccagaaaaaagacctagttcttctaatatgttgaatgttttctaaagcaaattgatctgcatggttagaaaggcattcatgagtactttctctccttttcaggccacaatattataaaataattgaggaatgtgtttcacagatagtgctacactgcagtggtatggatccagacttcaaatacaggcaaagattagacatcgatttaactcatctgataggtatgtatcataatcctcattgtcctctgattgtgttttgtgccttctgtattataagcactttttaagtgaagaagttcagtaagaagcttcagttcttactgaacttctattcatatctggtaaatcattgtgtctctgggcactcaattgctgtaattgttaattataatgatcatgagagttctgcctgtgtgattagaaatattaacctgtttaataagttccaacactcctggaggtagtttaagcttagtgttccacaaaaacccattacattattatagatgaatgcattactatttagaaacatgactctgaaatcttttcattttatactggtaccttagtggtcttgtagaaatcatgtatacaatggggtctcattatagttatgttattaatgcccaagttttagaaaagaaatacaggctcatttcaatagcttgagaccttctaagggtatcaaatggatcaatttatattttcatagaccttagagttagaaagaatttgaggtgatcatattcatctccttagattgctgaggaaatgactttatatcatcctagactggtagttagcagtacttttcagaacaacctctgaaggatgatctgaaccttcccttgtgaaatgtgctatgctatctagccttatggctaagcagtcttatttatacttaattggaatcactattgttaaggtttaagcatgaactcatttgtcttatatttaaagaaagaaaacaactattatatgccaattatatattatttttgactccacagcacaaggcagatacacagtaacattcaaagatggataacttattatttatgtattatttctgttttaaatgtaatgcatacttatttcaggcaatccagagacttacataagtgacaaaccaccaatcacattcgtgatcgctcccttttcagcttggtacatttccttatatctctttctctatgacctatctatctctctgtatgctgatttttcttggaactttatattatgagagtttttccacattaaccttcaaaatgtgacttttaatgtctgtataatattccattttgtgaaataccatagtcgttgtaaccagtcctttctttttgtgcgttcataattgcttttagattttcacagttataaatgaatgtgctgtcaacattcttgtatataaatgtttggctttttctcactatttccttaggattgatttctgtaagtgagggtatgaactttcaaaaagccaaatgcttttcagaaagcttgtgccaatttacccagaagtgattgtgaattttagcctcattgcatatttttcaatgagtttgaaaaacaagtttattttgcattttgttgagggagtcataagggactattttcaaatatgtatattagcttataatccattatagaccatagttaggacacatacactattgttgattttgatcttattaatcttaaacatggagtcattgtcacctctcacataataaactatagttttttgaagtattttatagttgaaaaataattgaatacctataaaaaataataatttagtcaagtagtattcagtattcaacagacgtttgttttgtgtactgtgtaccaggtacttatgattctttactattaatcaaaagtgttgggtgaggagagacgaacggatcaggtgagagaggatagtcagcatcataaacccattgtgatgttatccacatgtcatctctgcgactgtgaacaaatcatttaacttctctaggttttagtttcctcaactttaaaattgaataagtcacatatatgagtggctcttaatattttatgttcaaaatcctttgtgagaagttgacaaatacttggaactttgattagaacacacatatgttcatgtacacaaaaaattatcaggtgcttcaagaacttctaggaaacccatggatctgtatttcaagatgacttggacctgaagagattagtctcttgtaatttaacaattctttgagtctgatatctttcataaatcagatcgtatcagatctctgcctgaaactctctgatgcctttccattgaaatttaaattctaaatcattaccagccatggctaggacagcttagattcggctgttctttgacttcgtcatttcctactttcctcctcagttgctttaaacaaacaaacaaacaaaccagctttattgaggtacatttgatgtaagaaaaactacccatatttaaggtatacaatttgataaattttgctattaatatagacacttaaaaccatcatcaaaatcaagataataatcctgttaccccctaactgcattgtccttttagttctttctttccatgtctaccacatcttcccatcctgggatattactgatctctctcttactagttacattttatagtctctctcattagttgcattttttaaaattttataaaaatagaaacatacagcatatatactttttgcctgtcttcttgccttcagcataattattttgagattcattcatgttgttgtattgcatgtatcaatagttcattcctttatattgctgagtagtattccagcttatggatataccatagtttgtttatgtatacacttgttgatggccatttaggttctttcgagtttgggattactataaataaaactgctgtgaatattcacataaattctgggtactggtatatgtttttatttctttttgataaataagtgtggaatggctagatacagaatagagtttatatatacataaaataatgagagatacaatattgcccaaaagttgtttatattctgaagtgtttgatttgacctgagaagtttgaagttagtttccttatgtacatgatacattttgccccagatcagaagttaagtaaaaatcttttcatgaagaagcctgaattatcgaatgttattctgtctctctctagcttttttgtaggacaattttgaatcttgctaagactattcatatcttattaatattattaaggttacacatggagtctttgccacctctccacccataataaaccataggattctgaagtgttttgtagttcaaaaataattgaatacccataaaaataatttaatgaaatatatttttagatgcttggttttgtgcctccacaatactatcagtgaattcagtttgtatgctaaagaaagaatatatgatttttatgttttatgtatagtataggtcaatttccatttaataagggttgacataaaaatgatagtctgcattgcagagttataggctagaagacgtcttttgtctagtgatctcatgccataatttcgaatcacttttgtttgatcttaatagattcttgtgtgaacaaggcgaaagttgaagaaagtgaacaaaaagctgcagagttttcaaagaaggtaagcttataaaatattagccataatcgttaggttaataatttaatcacagtaatactctaccttctttattaatatgagggcttctaaatgtttcatttatgtagtactttatacttttgggttcaaacatagccgtggaatattgatttatttccttataaggtaaggttgctattgttccctcatcatcatgtttaatccattatggaagaaaaacactagccacattatactaaagtgatacatgaaataaaattacattgctgaaagggtatagttggaagcaatcaaccaaaataaattctccctttgctttcttgcagctgtcgcttgcaataggtagctctttggagaactgtgagatgtttagctagtcttttctgttgtggtcttttatgtcagtgctattgatagtaccaacatgttgcagtgttttctctctttctcactctctttctctctgtttagacttagcttctttgaatttcataattatcattttgtaagtgatgctgctacttcatgtaggcctggtggaatttgaggatcccttttctttctgtgttaatgtcttaaatgcctttgagtaaatgccagctttgtgaatatccgaattgtattcagatctaagcttgtcttttccttgtttcatggaagcatagctataattttattagcttctaccacaagtttctctttttttgttctagagcctattaagcattagtatagtatttctgtcctgttgtgtgcagccagaaggattgaagcacatgtctaaaagctctccagttttcagccttctctcagcaagataatgtgcttacatattgctgtctcttcaaagttatgacttaccttggagattagataatcacttttgctatcactctagaaattatagagtattactgaagaagttacttcagggcatctgaagaaatatctttgctcttttagttactagaatagattctaagagcttgagcataaaatgtttgtgtggagctgtcatttttattggtgaaagaaaatgcatgctttttgattaatagaccttcatatttctaatgttcttgttttaagtagcacatttaaaattccctttgaaaaaccttagaatctccttaagttttggctggcactgtgattagacactgcaagactggagcaaattgtgattatctgtctggtaaagtttttttgtgagcatatatattatggaaaaaggagtcctaaagtaatagaaaagaaatttcagtgtttgatgctttagtgtcatcaccaacatttagaatgaaaacatgtatggtctcccagtggttagctacatgcatccccttgttctgggtcattttaagaggcagtataaagtcattttttaacaagtactagaatgagaggcagtagttgtgagatctgatctcagcttttccactaattagctgtgactttgggtaagccacttactctctttagatcttagtttcttcatcattaaaaggaaagaataaaattagcggacttgtaagaagacctcttccagctcacatatttcaggcttctgtgatccccgtttgctgtgtttgcagattaaggtaattttaaattaaaagcagaaacattgtgtgcctctcctccaacatactaataaaccatttttagaggaaaaaatgtgtatagtgtgcttgtgtaggtgccatgatttagaagcacataggagaagctaactttaggagtggggatgggagtacagattgagataaatcttaacacggatagtagtaaaggcaaacaagctcacattggaggatatccatcttcttaatgaagtaggaaaacgaggtcattgactgaaggatatatggatccttcactccaaggatctggggtaggtttgaaatttaaagaaattagagaatatttgggccaggatctgtgggacattttcccgggattcaaggagagatgaataaaagcatttcaggttcgacccaaacagtattattatccagtttgctcacccactcttcagacttagatcagaatggcattttataatttccaaaggtcaaagctactatgaggatgaatatttgttaacagtgaacatacttttgcattgttccacaaactcttaagatggttttgggcagtagatgtatcacttttagaaacagaaataacattgttagaataatgtatagacttctaaattgacttgaaacaacattgacaataaagggcaaataaaatgttctatagccagtcccaggcagtattcactggaaatatgcaggcaggtttgtgcctgcttagagccctgtctgaggtaagggctaaggcaggatacagtgaataaatattaaccattcagtctttttggcttagcaccccatattttaacctctagtttttcctctcataacatgctatacaaatgttttggttaaccatctgaatgagactgctattagggcatcctactgtcagagtttgtgaagtactgctttatggattctagacaactaagattgtaatagaaacaattccaatttgtattaatatacgtacatttgagcattctaaaagtgcaatttcttttcaagattaaatatagttaaggagttgaaactgcttgatggtttatttttagatttcattttctaattcattaaacttaaaagtatgggatgaggctgcacatggtggctcacgcctgtaatcccagcactttgggaggccgaggcaggtggatctccagaggtcaggagttcaagatcagcctggccaacatggtgaaacccatctctactaaaaatacaaaaattagccaggtgtggtggtgcgcacctgtaatcctagctacttgagaggctgaggcaggagaattgcttgaacccaggaggtggaggttgcagtgagctgagatcatgccactgcactccagcctgggtgacacgagtgaaactctgtctcaaacggtatgggatgaaatatttttaaaattattaattctaaaattgaattttcattaccaaaacaataaaaatgttcattatgtgtgaagagagacttttcagtctacctttttgtctttgtattttttttcagaagtgaaaatgtgttttcttaccttgggtagggggcatatttcttctttactaccccacctccacttggatacttaattgttatgaaaataattacaagctgtgattttctgagtgatctgggaattcaactaagtaaaaaccactccacttatttaatacataatgttctttaaagcgttctgaaaactatattattaactgtacattgatggtgatcattgcagttcgatgaagaattcacagctcgacaggaagctcaagcagagcttcaaaaaagagatgagaaaatcaaagaacttgaagcagaaatccagcaacttcgaacccaggtaatgaaagaagatatagactttgtgtcatgtcacaatgagtttgatggtagaaaattatcttgttatatagaaggaaaaatgtgaccagaagcagactttttggcagttttacattttcattgaaataactatacagattttatattccagggcaataaatcattttaatgcttggaaaaaaaataaagcattagttgctcaaatggccctgaatatttttaatagaatatattacacaagcaaaagtgtttttgagatgaaattttcgtgatgatttgaaaaattgggtacatgctattttctttcaaaaagaatgtagaaatagtcattaattgtaattatcccaaaagcttcttgagatctctttgaatctcaagtaaatttccacctacatttcctatggtgaaaagctcccatatatacttaaaatttcaattagggtgtctaaactttcaaactgattgtgtattctcctcaatatactttatgtcttaaattaatattaagaaattgaagatgggccaggcatggtggctcacgcctataatcccagcactttgggaggcggaagcgggcagatcacgaggtcaggagatcaagaccatcctgactaacagtgtgaaaccccgcctccactaaaaatacaaaaaaaaaaaaaaaaaaaaaaattagccgggagtggtggtgggctcctgtagtcccagctactcgggaggctgaggcaggagaatggtgtgaaaccaggaggcagaacttgcagtgagccgagatcccgccactgcactccagcctgggtgacagagcgagactccgtctgaaaaaaagaaaaaaaaaaaaaaagaagttgaagatgatgtcttaacatagtgggtgctcagtagatatttgttgattgactaggtctgtttccaccagtctagtgaacgattacttcaaaagtcaccaacaaactccataatacccaatccgggggccttttcctacccttagcctgtattacttatctctaatatttgatcatttcttttcaataaattaatctctttctctgtctgtttccctccctctctttttcttggacttctttttctacatgtttgagaacttagtttctccttattttttcatcctcaaatggtgaccttccacaatattctgtcctctgctcttttcttttttgtgtatatttttgctgtactgttccattcagtatcatacattcacatatccccttttagtaggggtcaagtctcttgagtttgtcttctagttccagctcgtgattagctacccccataggatggtcctgttgcatgttgaaatcaaacccagttttgtggttttgtctctttcctcaaaccagtttgttgtccatttcctgtttaaattttactaccaattttaaagatggtgaagctggagttttctttcccttttccctgccccacccactgacaaattaagctagtcagttttatgtctgttctttcttcaactccactcatactacacctcttcgcatcaaaccccagaaacctccaggtcccctctcttatgatgtctcgcctggactattacaattgttgcctaacttttctccctcctcaaattcatcctttatgtcagtggcaaattaatcttcctgaaacaattccctgattattgttactccagcctttaatatgttcacttgttgcctgttgcagacaggattaaataaaatctccttaccaggaatgttaagaccctctggcatgagtttttcctcctttatctcccctttgcagcctaggctctgactgctcccctaactacagcctctgttgcagctaagtcacctttcctcccttcacatttggaaattactgtctccatacttaacccttctgccagcatttcccagagattagttacagaaatggcaataggttgttcatgacgaaagcattccatagtccaataaattgagtacgcatgaaattctcatcttagagattcataatactcattagcatattaaaggtcccagatattttacactgaagaaacctgcctacctctttttcatatagatttcccatactcatttgaccacagcaccctttatctcagagcacccttcaacatctcctggaaatagtgttttcatagagcttagttgagaaatgttggcatacattattctctgtaagaaattccctcctttgctcatctgtgtgtgtgaaatgtatcctttaaggagaagctcattaagacatcttttggaaagcttcaccaaaaactccattagcgaatttctccgaactttcatatcacttttctagaccactcatgggatatttgtgtgcctgctctatttcttctgctagagcatagacaccttgaggacagtgtgtttcttattaaaggccccactgtacctagcacaggcctttaccgcacagtgagtagttgcttacttatggttaaattaactgtaaaaagtgcagaatcacgaagcattctcaactcctggcctcaagcattcctcctaccttagcctcccaaggagtagctgggattacaggtgcaggcacagggctgtatactttctagtgtgcccaaaataatgtcaaatactaaattattcatttaccatattcaatttgcaatacgatgtggtagcctaatttaattattcaattcctaattgttcatgggagggaaaggaaaggctgatatgatttgatttttaaaggctggtagcatttaatataaatatttgagattccttattaaatctgtaaaatatatatttaacttgagtaaaattttatttaaataatagcattttgtggttgtataaaattcccaaaataaatgtgatctaatagaggtgaaaaattgactgatgtttacaaatgtatattactttgaattatgttgtccattaattaaaaaatgggaaacgacacacattttgcctttcgaagtatgaaaaatatcatgtcatacacaaaatttgtaggataaattactaattttctgaacctttaattttgccacaattacttttatctcagttaagactataaaatgagactgttttccatagttttgctactttcaaagtaaaattaaaataattttacatattttaatcttgtctttctttctaacctcagagagaaaattgcattccaggagaggatggttatttgctaagtatagaaacactttagttgtatgtatgtatatacatacattaacattcatctatgtgaaaaaactagtgtgagtgaatattatgggtaacctttccatgatcttgtctacctatgagtgttagttttaatatttttgtaaataggtcagtcctttcaactggttgttccaaacatttgcttcagcttactttctaaagatatttatggctgtgcacagtggctcacgcctgtaatcccagcactttgggaggccgaggcgggcagatcacgaggtcaggagttctagaccagcctggccaacatggtgaatccccatctctactaaaaatacaaaaaattagccgggagtggtggcaggcgcctgtaatcccagctactcgggaggctggggcaggagaatagcttgaaaccggaaagcagaggttgcagtgagctgagattgtgccactgcactccagcctgggcaacaagagcaaaactctgtctcaaaaataaaataaaataaaataaaataaatgaaaaaggtatttataaattcagttagaagaactaaataatccaagtagaacatttatattaataatggtgagagggctaggcacagtggctcttgcctttaataccagcaatttaggagaccaaggtgggaggattccttgagcccaggaatttgagactgttctgggccacatagtgagaccccatcttaaaaaaaaaaaaattagcctggggtagtggtgcatgcctgtagtcccagttagtcaggagactgagatgggaggatcacttgagtcctagaggtcaaggctgcaatgcactatgattttgccactgtactccagcctgtgcaagagcgagactgtctctgaatgaatgaatgaatgggtgaggacaaaaaggacactatcccaagaaatttaattagctttttttgttgttcactgaaaatttgtttattaagttgttaatgttttacagagttcgttcaatattttatggaacttaaaatcctgagtttcccctcaataatacagatgtctgtaatacagacatttgtacaaactactacaattactgatgccttatataattagacttctataacttccatttgtcaggtaaataaaacacctctcaaagttaccacaactttaggagttcacaaattcctatttctgcagtttttcattagtatattttaaactttcataaaagaggaaaccaaaacctccaaatcaaaagccttaatatgaaccaacattgagaaacagagtaatgtaagaagctcttttattcatcacggagaacaaaaatacagaatatttttactaatttattttccactaaagagaatacactttgtatttagataaataaatgtttatttactgggagttgcttttggagaatgatccataattgccctatcaatggtcacatattgataccagggtccatctcttctcttccacattaatcttcgtacttccagctcctttatctgcagttcagccttttcagtttcagtgtgaaggatagccattgttctttcgtaattattttcaggatcatcatagaaagtatggacaatccatctcaatataggatgcttataatatgcccattgttctgggatatagccttctggaattcctactagttcagtttcaccaatgaatacattcactagagtttctccaattgccactggaatccctataaacaaaatatagaatttcagtaaattaaaaaaacacccattgtagaatccagaaggtttcatgataaatagtctttttcctatgatctccactgtgttaaacaggagtgacagctttaacaaagccacgggtgaggaagcccctgaatcccagtcgagcgtcaaggcactggccagacagctgtcactgcagtgactgaggcctgttgcaaaaaactcatggctgccttggctgccttaattagttttaaacgtttcattctgttaatctaatgtcgtatcttgattaaaacagatgtgtgttcattggtagtggtttcataagaatgtttataatgaacagctctacttttcatatatatttatctagcaaagtgagccattgtgatcagtactggtttaaggaaatggatatagattaatcatctctaaaaagaacatgatatggattgcagtgttccctttcatctgttatccattgtcattagagaatgagcttgaagttactttctgatagaaatgttatatcctcctcataatcctatctatttgaattaattgtcctcattgtaaatggcacccattcatgaaaagacagtcttttatattgggatgaggatggtattagatgtaagaagaaccacattgaaattctaatcatgttcagactctgaaacttttggttagtcatttaactttttctgcagctaacagtttcctcatctttaagcagtgaaataaaggtgagataataatgccctatctgtattacagggttataataaggatcaaaagaaataataaatgtaaaaatgttgataagcatatattactatggaaatggatgctatttagtatttattattggtgttagaagccagctaagttactagagccatgaaacagactctttgtatgaagctaattagcccccaagggaatttaatccataaccttgtatttattatcccatattcaaaccaactaatctaactggcccaagccatacactgtacttcttttgtacatatatttataaagaaagttaatttttcattattttagaggagtatttcacaaaatctttgaggatactgtattagtccgttctcacactgctatgaagaaatacctgagactgggtaatttataaagggaagaggtttaattgacttgcagttttgcagagctggcgaggcctcaggaaacttacaatcatggtggaaggggaagcaaacacatccttcttcacatggcagcagcaaggagaagtgccaagcaaaaggggaaaagcctcttaaaaaaccatcagatcttcggagaactcagaattatcaattattcattattcattattcaattatctccccctggtcccgcccttgacacgtggggattattacaattcaaggtgagatttagatggcgatgcagagctaaaccatatcattccacccttagcccttcccaaatctcatgtcctcacatttcaaaacacaatcatgcccttccaacagttccccaaagtcttaactcattccagcattaacccaaaagtccaagtccaaagtctcatctgagacaagttatgttccttctgcctatgagcctgtaaaatcaaaagctagtcacttcctagatacaatggggatacaggcattgggtaaatacacccatttcaaatgggaaaaattggccaaaacaaagggactgcaggccccatgcaagtctaaaatccaatagggcagtcattaaacctcagagttccgaaatgatctcctttgactccatgtctcatatccaagacatgctgatgcaagaggtgggtttccacaaccttgggcagctttgcccctgtggctttgcagggtgcagcctccctgctgattgctttcacaagttggtgttgcgtgtttgtggcttttccaggtgcatggtgcaagccatcagtagatctgtcattctggggtctggaggatggtggccctcttctcacagctccactaggcaatgccccagtggggactctgtgtgggggctccaaccccacatttcccttctgcactgccctagcagagattctccataagggctccacccctgcagcaaacttctgcctggacatccaggcgttttcatacatcctctaaaatccaggcagaggttcccaaacctcagttcttcacttctgtgtacctgcaggctcaacaccgcttggaagttgccaaagcttggggcttgcaccctctaaggctatgtcttgaaatgtaccatgactccttttatccatggctgaagtggctaggatgcagggcaccaaagagactgcacacagcgggagggccctggacctggcacaggaaactatttttctctcctaggcctccaggcctgtgataggaggggctgccatgaaagtctctgacatgccctggagacattttcctcattgtcttggtgattagcatttggctcctcatcacctatgcaaatttctgcagagggcttgaatttctccccagaaaacggatttttctttactactgcattgtcagtctgcaaatgtttttaaacttttatgctctcttcctcttgaacgctttgccacttagaaattttttctgccagataccctaaatcatctctctcaagttcacagttccacagatctttagggcagacaaaatgccaccagtctctttgcattgcaagagtgacctttattccagttcccaacaagtttcacatctccatctgagaccacctcatcctggactttattgtttatatcattatcagcattttggttaaagccattcaacaagtctctaggaagttccaaactttcccacattttcctgtctacttctgagccctccaaactattccaacctctgcctgttacccagttctaaagttgcttccacatttttgggttgcttccacatttttgcatatctttacagaagcacccaactatccggtgccaatttactgtattgttgttctcacacaactatgaagaaatacctgagactgggtaactttttttttattttattatttctttgagacggagtctcgctctgtcaccaaggctggagtgcagtggcgtgagctcagctcactgcaacctctgcctcctgggttaaaacgattctcctgcctcagcctctcgagtagccgggattacaggcacgtgtcaccatccccagctaatttttgtatttttagtagagacagggtttcgccatgttggccaggctggtcttgaactcctgacctcaggtaattcacctgcctcggtctcccaaagtgttaggattacaggcgtgagccaccgcacctggctgagactaggtaatttataaaggaaagaggtttaatttactcagttctgcagggttggggaggcctcaggaaacttccaatcatggccaaaggggaagcaaaacacatccttcttcacatcgcagtagcaaggagaagggccaagcaaaaagggaaaatccccgtataaaaccttcaggtcttgtgagagcttgctcatgatcacgatttgggtgggaacacagagccaaaccctatcagataccaactttcctagcatttgtgtgttaacagaagtagtcactgtccagaatttataatgcttataaaaaatctacacaggcctttttcatatactgttaaacccttagatcttgctaaatatttagatattttagtaatatctaaaaaagtatatatgatcttaaaacataagataaataaactacaaatatctattgatatatatttcttcagttttttcaattatattttataagcatttaaacttggattatttatatttcaggcacaagtactctcaagttcatcaggaattccaggtcctcctgcagcacctccattgccaggtgtagggccgcctccaccaccacccgcgccacctctacccggaggagctcctcttcctcctccaccacctcctttacctggaatgatggggataccaccaccacccccaccaccacttttatttgggggacctcctccaccaccaccccttggaggagttcctcctcccccaggaatatcacttaatctaccttatggaatgaagcagaaaaaaatgtataaacctgaagtgtccatgaagagaatcaattggtcaaaggtaatactaaaactagagtttttttactttgtctagcttttgttgatcattgctatgtgtacacattgtataatgtttgagagtatgactgctgactctttccgttcctttgtgggttcatcattttatgtccatctttcaatttaggttgtagataattggaaactctccagatagtttgacattgtgaagcaggcaaaaggaaaatcgaagtgatgtagagaataatatttgaaatataccaacaaatgacaagcaattttgattcttttaacatagcttttctttaaaaattttttattgatatgtaatatttgtacgtatttatggggtacatatgatttttgctacatgcatagaatgtgtaatgatcaagtcagggtatttaggatacccatcacctttaacatttgtcatttgtttgtgttgagaacattcagatcttctcttctagttattttgaaatatacaacatattgttaactatggtcactttactgtgctatcaaatggtagaacttattccttttatctaactatatgttcatacccattaacctatctctcttcaccctcccacctcccacacacacccttcccagtctctggtaactatcattctattctctaccttcatgatactcactttttaagctcctatatatgagtgagaatatatgatatttgtttttctgtgtccagcttttttcacttaacatagtgatctccaattccatacatattgctgcaaatgacaggatttcagtcttttttatagttgaatggtattccattatgtctcaatactatattttctttatccattcatccgttgatggacacttagcttgatttcatatcttgatttcatatctttgccattgtgcctagtgctgcaataaacatgagggtgcaggtatctctttgatatactgatttcctttcctttgtataaatactcagtggtcagattacagcattattgtatggtaatcctgttatttaggagcattattgtatggtaatcctattatttatatttttgagaaatctttatagtgttttccataatggctgtactatttacattcctaataacagtatatgaaagttcccttttctccacatctttgccagcattttgtctttttgataatagctattctaactggcataagatgccagtaagatacctcactgtggtcttgatttgtatttccctggtgattaatgatgttgagcacattttcatatatcttggccatttgtttgtcttcttttgagaaatgtctacttaaattatttgtctactctttaatgtgattatttgttttgttgctattgtttgggtttcttgtattttttggatattagtccattgttggatagtttgcagatattttttcccattcaacagattgtctctttactctgttaattgttcccttttctatgcggaagcgttttagtttaatataatctcacttacccatttttgtttttgtttcctgtgcttttcaggtcttagccacaaaatctttgcctatattagtgtcctggagcatttgtcttgttttcttctagtagttttatagtctcaggtcttatgcttaagtctttaatcaatgttgagtccatttttatatattgtgggagatataggtcaggtttaattcttttgcaaatggatgtccagttttcctatcatcatttattgaagagggtgtcctttccccattgcatgttcttggtacatttgtgccaaatctgttagctgtaaatatatggatttacttctgggttctctattctattccattggtgtatatatctctttttacattagtaccatgctgttttgactactatagccttgtagtatattttgaagtcaatgtcctgctttgatctttttgctcaggattgctttggctattcaggctcttgtgtggttccatatgaattttaggattatttttcctattttttgtgaaaaaatgttaatggtattttgatagggattgcattgaatctgtagattgctttgagttgtatggtcgttttaacagtgtaaattcctttattctatgagcattgtctctttccatttgtttgtgtcctctttaatttctttcatcagtgttttgtagtttttcttataaaggtcttttacttctttggttaaatttattcctaggttttttatttttttgtagctattgtaaatgagattgcctttttatttttttttccagcaagtttattgttcagctatagaaacattaataaattttgtgtgttgattttgtatcctccaacttactgaatttattaattatatgagttttttgtggggtgtttaggtatctccaaatgtcagatcatgttgtctgcaaagagggacaatttgatgttgtcttttccaatttggatgtcctttatttctttgcttgactgatggctctggctaggacttccagtactatgttgaataggaatggtgaaagtgagcatcctagtcttgttccaattcttagaggaaaggctttcatgttttgtccattcagtatgatgttagcaatggctttgtcatatatggcatttattatatggaagtatgttccctctctgcctaattgttgagagtttttattgtgaagggatgttacattttatcaaatgctttttctacatctgttgagataattatatagttttcatttttcattcttttgctgtgatgtatcacgtttattgaatggcatatgttaaacaatcctggcattcatggggtatatcccattgattatgatgtattatcttttggatgtgctgttggattcagttccctagtattttgttgaggatgtttatgcctgtgttcatctgggatattctttaattgttgtgtccttgtttggttttcgtattggggtaatgctggcctcgtaggatgagttaggaagaatttcctgctctttagttttttggaatagtttgacaagaattggtgttagttcttttttacaagtttggaagaattcattagtaaagtcattagtcctggggcttttctttactggggggactttcttggtagattgtatgtgtccagtaatttatccatttcctctggcttttcagcttgttaatgtatagttgtccatagtagtctctgatatcttttgtatttctgtgctatcagttgtaaggtctcctcttccatttctgattctgtttatttaggtctttctttttttttttttcttttcttggataatccagctagtggtttatcagttttatcttttcaaaaaaaaaaaacctaactttttgttttgttgctcttttgtattatatttttaatctctgtctggctcagttctgctctgatctttattatttttttccttctactgatttggggtttggtttgttcttgcttttttagttccttcaggtgcaaaattaaactgtttatttgacatctttccattttttcgaagtagttgtttattgctatgaacatccctcttagcattgctttccacaggttttgatatattgtttttttaattttcacttacattaatacattttttaatttttttcttaattttttaattgacccagtggtcattcaggagcatgttctttaagtctatgtacttgcatagtttctgaaatctctcttattattgatgtctaattttatcccattgtggtctgagaagatactcgatatgattttgatttttaaaaatttgttgagacttggtttttatagtagcatatgatctatccttgagaatgtttcttatgctgatgggaagagtgtttattctgcagctgttggataaaatgttctgtaaatgtcttttaggcctgtttgttctaaagtgcagtttaaatccaatgtttatttgttgattttctgcctagatgatctgtctaatgctgggagtagggtgttgaagtccccaactattactatgttagagtgtacctttccctttagatctaataatattttctttgtatatctgggtgctccagtgttgggtacatatatattttgacatgttacatcctcttgctaaagtgatgcctttctatatatatatacatatatatatacatatatatatatacatatatatatacatatatatatacacatatatatatacatatatatatatacacatatatatatacacatatatatatacacatatatatacacatatatatacacatatatatatacacatatatatacatatatatatacatatatacacacacatatatatatacatatatatatacacacacacacacacacatatatatatatatatatatatatatacctactttgtctctttttactatttttgacttaacatctgtttgatctgatatacgtatatttactcctcacttttggttaccatttgcaatttaatatcttctattttcagcctatgtgtgtcttgcaggtgaaatatgtttcttgttggaagcatatagttgggtcatgttttttagtacattcagccagtctatatcttctaagtgggcaatttaattggtttacattcaagtttattattgataggtgaggagttattcctgtcattttgttaattgttttctgttcattttgtgtatccgttgtttttttctttctttgttattgtttatccatgtggtttagtagttttctgtagtgttaacatttgagtcctttctctttctcatttgtgtatctgctctacatgtgagttttatactttcatgtgctttcatgatatattctctttcagacacgtaggacttccttaagcatttcttgtagggcttgtctagtggtgatgaattccctcagtttttgcgtgtttgggaaagacattatgtatttctccttcatttttgagggatagatttgttgggtatatacaactggcttctttttttctttttttcttttggcactttaaatatagtgtcccattctctcttggcctgtagcctctccaatatgctgcaccacgtgttcctgggatgtaggacaccttgtgggctagagtgctgggacctggtctcattgctggatctagccagtatcacaccactgcagtcatctgggtggatgtggggagatttcagtgggctccaaggatgtggagatagagtatcattcatccccagggcaggatgtagtctggttgggtttgggctctcaatctgttaccatactgcacctgctttggtcttggtggcatgtgtgggatccagtgtgaatgctcattctagagcaatgccattgcacacactgcagctcgctttgtatactaaagactagtttcagggcctgtggaggctgagtggctctcctatggctagaatcttcagagttcacagtgggaatctggaccactggggatatgttatttacccttttcccacattgggggagcgtctctgggctcccagctaatcacagccaggcttgctgcctggattcccgctccttccgtgcctcaggtgttttctgtaacttccctgccaaattccagtgtttttacatgttgtgattatctactctcttttttggccttttatggaggatatgagtgccacctgcctccagtcagctgaagcctattccccatttttcttgaataaaatcctttttattattgagcctttttatcttacttgtttttcttagtgaatgactttttttttaattttacactttcaaatagtgtggaataagtgacaatattcaatattgatataccttaattttttttgatgtatgaaaatactttcttctgaatgttgtttggctttattattattagaaaataatatgtctgttttaaaaggttattatgtagattgacacagtcctcattcactgggaactaattttctaatgaaaatccatttacccagacaaccatctggggaaatgtgtcatccaataacatatttacagtattagacagcatctatgtagtaagttggtttaaacagaatgatggttaaatcatttttcaatcttatgcatatatttatgctttgctcataagagtaaacttggagtaaatggttttagaatgtagttttctttttaaaaaattaagtacaattcatcaaaattcaagattacaaagctgttgcctagttatcttcctgtgttaatgtagtcgtatgcttcctaattttacaatttagtatacggtgtaatggtagttatacatcacaaaacttcatggtgtattggaagataaagttctaatcttgggtagtagttaagaccacagtcctctggagcacttatctaggtttaaaatcccagctctgccatttactaatttgggcagccacttaaactttcttgggctgtgtttcctcatcttttaatgtagagataataacaggtgaaaaaattattacgaggattaaattagttaatatatgcaaataacttaagacagtacctgacacaacgtaggaggcgtgtgtcagctatcattatggttgctaccttaaacctaatgagtgaacaaggggaattcacttttctaagtctgagtttccctgttttaaaaaacccaggaacaagaagattttatgtgagttggggttaggatttcctaagttatttttaagactccttccagtagaatagtttttaaggtgcaatttgctttgtggtctatttctattgttcaccatttcgtcacataattctgaatttcccaatgaatatttactttataagtattatttagatacatcctgaaattgacttagaggatagaggaataaaggaactgtcattcaaccttgctgaaagttagttccttgaaaatttaaatatgaggttataatttagaatctattctttgttatttttgtttcagattgaacccacagaattatctgagaactgtttctggttaagagtcaaagaagacaagtttgagaatccagatctctttgccaaattggcattgaattttgctactcagataaaaggtacatttttaaaaataaaatataagttcccgattcaggtacaatttaatttagtgctttgctaaaaatttctagtaatgggtatatgtatacttttcccacactggacagggtgaaacataaatagattgacatttaactatattttacctagtaaataaagaaggaaatttattttacctttgaattttattatacataaatgttattattcttctgaaaatacaggttttatttttattgttaaatatgtgtgttgcactgctccattataaaatagtcgtttttactgagaagcagggaagatgaatccgttgattcatcatgtaagagaaaataatgtaagagaacactaaagtctcagaatttttcatgaaattgaaataagattggtcccatagtcttaaatagtctttcctgtcatgcttgtattacttatcaatttggattcctaggaaatgttatagtttttgctataattagatattttctattaatatcaaaatccagtaccttataagtattgtttactgatttgataatagagtgctttgtttatgattagatcctttatttatttgcttgtgaatttcacagatgattttgttactatacaggtagcttctcaatctcataatagatcgttatggttcattaatttttggtattttatttcaacatgattatttcactaattattgtagaagtgatagtttagttgaggatattactttttgtctgaatgagtccttgcagttgaaaaatggaaataatccatactctcatgcccttggaattagcacctttatcattcatttgtctgatttgtcacattatgccttagaatatgagaatataaattttggaagatagagaggtgtgaaaattagtttcttttttttagattatgtacactggagattgttgtgctgtatttgttgttctttgtaaattgaagttcatatgcacacacaaatctggggtgattagactattctgaagaattttgacatttaaaaaaagttactactattaggcctacctttcttttttctcatttgatatcgcagacctcacatttaaagaatttttcaatgattcaagtgattgccatttattataatcactgtttaacgttaaaaaattgcttgtagcaaagtgttcatgcttatagcaaattattcatatagtaaaataaggtagtttaacaaatgtaaatctcccttcaatctcagacttacagcattttgcccagataaaatcattaattctaatttttcacattttctcctagaaatagtctatgcctctcaacacatatgtgcatttatcattttttgttttttattccttgctgttttcaccaactgtgcctaaagattattctgtaggtgcttgtgtttatctactgtgttctttttacatactgcatagaattttgtgtatgggcctatcttaatttaattaatcccatatcaatggctatttagattagttctagtcttttgcttgtttaagaaatgctgtggtgaacatgactccatatatgctgtttttcacaaattctacaagtaaaattcctggataaaatgctgtgtacatttacaaattttaaagatagtatgaaattacattctgatgagtttgtatcagtttataatgtcacaaagaatatatatgaatatctgttttcccaaaatctttgcccacctcagaggtgaaaatggtaaatcattgttgttataatttttgctttttgaatatggagtgagattgagcacattttcttatattcacaggcaattttattttactttcattttaaaaaataattttaactcttattctgtattcagggggtacatgtgcaggattgttacatgggtatgttgcatgattctgaggtttgggacgcaaatgatcccatcatccaggtagcaatgagcatagtacttgaccattagttttttaatccttgccctcttccctccctctgttctctattagcccccagtgtctattcccatctttgtgtccaagaatacccagtatttagctcccacttataagtgagaacatgcagtatttaattttctgttcctgcattaatttgcttaggataatggcctccagctgcatccatgttactgcaaaggatatcattttttatttttatatttatttatttattcattcattcattcattcattcattcatttattcattttgagacagagtttcggtcttgttgcccaggctggagtgcaatggcgcgatcttggctcactgcaacctccgcctcccgagttcaagcaattctcctacctcagcttcccgagtatctgggattacaggcgcccaccacccttagctaatttttgtatttttagtagagactgggtttcaccttgttggccaggctagtctcaaactcctggcctcaggtaatccacccgcctcgacctcccaaagtgctaggattacaggcgtgacccaccatgcctggccaggatatgatttttttttaattacggctgcatagtattccatggtgtatatgtaccacattttctttatccagtccattgttgatgggcacctaggttgattccttgtcttcgctattgtaaacagtgctgtgatgcacataaaagtgcatgtgtcttttgggggaaatgatttcttttcttttggatttgaacctagtaatgtgattgctgagtagaatggtagttctgttttaagttatttgagaagtctccgaactgctttctatagtggctgaactaatttacattcttaccaacagtatataagtgttctgttttctccacagccttgccagcatctgtttgggttttttttttggctttttagtaatagccatgctgattcgtgtgagatggtatcttgttgtggtttcaatttttcatttccctgatgattagtgttatgagcattttttcatgtttgtcagcctcttgtatgtctttttatttttattttatttatttatttatttattttgtgacagagtttcgctcttgctgcccaggctggaatgcgatggtgcaatctcagctcactgcaatctccgcctcctgggttcaagtgattctcctgcctcagactccccagtagctgggattacaggtgcccgccaccatgcccagctaatttttgtatttttagtagagacgagttttcaccatgttggccaggctggtctcgaactcccgacctcaggtgatccacctgcctcagccttccaaagtgctgggattacaggcatgagccaccatgcctggcccatatgtcttcttttgagaagtgtctgttcatgttctttgcccactttttaatggggttatttgtttttttggttgttgatttctttaagttccttatagattctgggtattagacctttgtcagatgcatagtttgtgaatattttcttccattgtgcaggttgtctgtttatcctgttaatagtttattttgttgtgcagaagctctttagtttaattaagttcgattcatcaatttttgttacagttgcttttgagaacttagtcatgagttatttcccaaggcagatgtccagaatggtgtttcctaggttttcttataggattttcatagtttgaggtcttacatttaattctttaatccattttgactttttgtgtatggtaaaagagaggctttcggttttgttcttctgcatatggctagccagctatcacagtgccatttattgaataggtagtcctttctccattgtttatttttgtttgactttgtcaaaattcagatggctgtaggtgtgcagctttatttcttggttctcttagtctgttccattggtctatgtgtctatttttgtaccagtaccatgctgttttggttacggtagccttgtaatatagtttgaaggcaggtaatgtgatgcctctggctttctgcttttcgcttaggattgctttggctatttgggctcttttctgattccatgtgaattttagaatagttttttttttctaagcctgtgaaaaatgacattggtagtttggtaggaatagtattgaatctgtaaattgctttgggcagtatgacctttttaatgatattgactcatccaatttatgagcatgagatgttcttccatttgtttgtgtcattcattatttcttttagtagttttttgtggctctccttgtagagatctttcaccttcttgattagatgtgtatgcctaggtatttcatttttttttttttggcctattgtaaatgatattgtgttcttgttttggctctcagcttgagagttattagtatgtagaaatgacactagcttttgtaagttgagtttgtattttgaaactttactgaaattttttatgtgttccaggaaccttttggcagagtctttagtgctttctaggtataggatcatatcgtctgtgaggagaaatagtttgacatcttttcctatttggatatcttttatttctttctcttgcctgattactcatccaagggcttccagtactatgtttaataggaacgatgagagagggcatccttgtcttattccagttctcaaggggagtgcttccagctttcctccattcagtatgatgttggctgtgggcttgtcatagatagctcttattattttgaggtgtacctagtttcttgtggatttttatcgtgaagggatgctggatcttattgatggctttttccatgtctatggagatgatcatatggtttttgtttttaattctgtttatgtgatgaatcacacttatttatagatgttgataaacattgaatcccagaaataaagcctacttgatcttgccagagtaactttctgatgttgtgcttgatttggtttgctggtattttgttgagaatttttgtgtctatgttcattagagatagtggcctgcagttttcatgttctgttgtttctttgccaggttttgctatcagggtgatgctggcttcatagacttatggaggagtccctactcttcaatgttttgaaacagtttcagtagaattggtaccagctcttctttctatgtctggtagacttcagctgtgaaactgtctgttctgggtgttgttgtttgtttgtttgtttgtttgtttttgtcatttttttttaatttaaattactgatttaattgtggaactcaatatttgtctgttccgggtttcagcttcttcccgattcaatcttgggaggttgtgtgtttccaggaatttatctatctcctctatattttgtagttggtttgcacagaagtatacataacagtctctgaggatcttttgtttttctgcaggatcatttgtaatgtcacctttgttgtttcttattgtgcttatttggatggcctctttttttcttttttaatctaggtagcggtccatttatcttgtttatgcattcaaagaatcaacttttggtttagttaattctttgtgtggatttttgggtatcaatgtcattccgttcttctctggttttattcatttcctatgctagcttttgcattgatttgctcttgtttttctgcttcctctaggtgtgaagctagatctttaatttgagatttttctaactttttcaggtaggcctatagtgctattaacttcccttttaatactgcttttgctgcatcctcaagattttggtatgttgtgtctcttttcatttattccaaaaaaatttttattttctgtaaaggcataaaatttctttttctgtaaacttccccctccatttctttgcatattttctattgagcatttacgcttttgattatggacttatttgaattgaatgctacaagaatcatagattttataaaattttagagttagtctggatcttagaagttattaaacacagactctttgttttaccaatgaagaaactgaagtaagagacaatgaggtaagtgtaaaacccattaaagatagcgtggtatagtaggaaaagccagaggaaataaattcacacatacttgcattccagctgtgatacttgtaacctcggagactgaattttctcatacataaaatgaataggctaatgtttacctggtagtattgtgagaattaaacaaggttatatatttaaagcactcagcacattggtatccctttcatttaacttgatgctctgtgtgtgtgtgtatgtgtgtgtgtgtgggtgtgggtgtatgtgtgtgtgtgtcttagttattgatgcttcagtacaactgttaattcagcaaaatttactgctcttcttttcagcacttggtagagctaatcagtcagaattgaagcaattcttactgcagctgccaaaacctaatcaaaccaaatcaaaaccaaacaaaattcatacaaaacctctcatgtatgtattgctgagaatgctttattttcattcctcttaacgttgattctttgaattttctctttcacgctactatgacttccctaattgtggatatttaagtagaaatctggacagtatcacctttcagaaccattacttttactaaaatttacttctgaaaggacatatacaggatcaattatgcatcatagcctatttcagacatgcacaccatagctaaaacaaattttaatgatactaaactgccattcttttgtaacacacagtaactattgattgatgttactgtaactgctgaagttccttgtcattcgcagtgccttgattcatactgtggtcaataggtggcaggtttagtaagaaatcagcaggagggtctgctttcatgaaacttaaacttcaccgcctgggttttcttttctctagggcacctttttcccccggtttgctgttcgttgcagctcactcagctgcattctggaaggagcatcattcctgtttttgctaatagctgtttcaaaacctcttagaccagtgttctaaaacctctgattatttttcactactgcaagaacataggagagctcatgcctctgtcctcactacgtgtactgtaaagcactacaagtctatttttcaggaacttgtttaagagctaaataggagctttaaaacacactagttctcatatctataatatttaaatgtttaaatatttaatatgtgaaagtagcataaaattatacttcctatttaaattagttttagagaaaattatttttaatgttttatttaaaaacagattatttctgttgtaggaaagaatggatgtcttgtttcatttaggttaagtttgtagagtatctattatgtgtgaggttctatactaaatgggagggaaagaaatgaataagatcttgtccaggcaccagggaactcacaatctactgagagaggtaggaggatgcccagtatacttagtcaagttgtagtaaatgttagagtagatactttttaaaaagctactggggtacaaaaacaaataattaattttgagtagggtcaatggagatcctagaggtagtataattagagttgggacttgaaattttaatagaatttctatagggaaagaaggaaggaaagacggcattctagctagagaataccatcagtaaaatgttaaaagaaaaacttgagacaaatcaaattttacagaattcatttgagcaaggaatcattcattaattggtcagcattcagaaccagcaggatttcagtgtgagcatcaacctttcatagtatgaacatgggaacaaagtagaaaagtcatctaattgtctacggatagtcatttatctcatttgggcgtggtgtgatgagacatttgccttgtctgggaataggctcatccattggctgcctacagttggctgaagtttcgctatttgtgattggctgaagctcagctgtttaaaatatacagttggcgtctcatctctgtgtaggcctctgcacccatggattcaaccagccatggacagaaaatatttgaaaaaaattaaaaatataatacgctgagcgtcgtgactcatgcctataatctcagcactttgggaggccaaggtgggaggatcatttggactcaggactttgagaccagcctgggcaacatagtgagaccccatctctgcaaaaagtacaaaaattaactgggtgtggtgatatgcacctggagtcccagttacttgagagactgaagtgggagggtcacgtgaacctgggaagttgaggctgcagtgagccgtgatcgtgctcctgcactccagccaggatggcagagtctcaaaagaaagaaatgtaaaaaatacagtataacaactatttacatagtatttacattaatagcagaaactgcaattccttttgcatcaacataatatttaggtattataactaatctagagatgatttaaagtatatagggggatgtgcatagcttctatatgaatactatgccattttatagcaggcatttgaatatttgcttttttttttttttttttttttttgagatagagtttcgctcttgttgcccaggctggagtgcaatggcgtgatctcagctcacctcaacctccacctcacgggttcaagtgattctcctgcctcagcctcctgagtagctgggattacaggcatgtgccatcacgcccgactaattttgtatttttagtagagacggggtttctccatgttggtcaggctggtctcgaactcccgacctcaggtgatccgccctcctcatcctcccaaagtgctgggattacaggcgtgtgccaccgcacccagccaaatatttgtatattttggtatctgcaagggctcctggaaccaatcctcagttgatactaagggatgactatactctttctttaggtttccatttgttaagttggaatgtaaagtttggagacagtcttgggccaatgatctgctgttcatttaatttattaataaggaggggtgaaatgcatactgccttgaaggcacgggcagtcagccttgggtcaggactctggaatgaagagactttgtggcgtaggtggcaaggaaacttcacgctgaagaattagggttttattctttaagcattagtgatttagtaatttggtgattagcccttgaataggctttttgtggacagataggtgatgggaatatatggataggtgatgggaatatatggataggtgatagatcattgattgtgagtaaatatcagtagactaggtaagatatgatgatatcctgactagtatgaattcttaatctgcatctctaaggtctattctagttcccaaatcttgtaccttcatgcttatgacatttacgttctactcacaagccataataatgtcatattacaaaatatgtttcaaaatactctctgaattcatgaaatatatatgttagaaacagctggagaatatcctgttagtagctttgaatatgtatcatatatgtaagtgttggaatttgtatatatgttctagttttgtttattattcaatttgatgatatttgggggcatagaatcatcaaggctagaatggtagtgtcactctcctttaaaaactatagtaattatagacaataatgatattatataagatttaaagtaatgatggttgatattaactaaatttgaaataataataaaatatgtagcttataactgctaattctaattagaatttctagggttctctagaggcttcaggaagaacaaagatagtgtgggtagaagttgtaagcaatttctttgcttttaatgttgcttggaggaaatacaagaaataaacataagagcttaataaaatttagcttctttaataatatatttctatagtgaaatttagctttaataataacagaaaattgaggtgttataaatatttgaaatgcatataaatgtcattttgcagtgcttgaaatattggacatagcttcaaccttatggtgtaactgagattgaagttgtgtgtatgtaaaagcactttttctttaggatcatattttaatgtgtgtttcttagtctaagaatcaactggctgcttctgaagacacccacccttgcttggttgctcaatacagtcttctatatttagtgaactaatgaaaagacaaaagagtggtaaagtgtaattcatctttgccttcataatatagaaattcttgcaattgacttgaaattaatgagatgtcagtctcagagtgcacagcccttgtaagatggtgctaacgtgtccagagagagttcgtgtcctaacaaataatttgtcatcttaatggcacaacatgcatccttctgtagtataagctttaatgtatatggtaacaaaccaggaaggcttaattctttcaggcagcaaactaaaaaccatacttaactatcttagtgtgtttgggctgctatcacaaaataccataaattgggtagcttataaacaacagaaatttatttctcacgcttctggagactaagaatccaagatcaaaatactggtatatttggtgtcttttgagggcctactttctggattatggagggtagcttctttctgtaacttcacatggtggaagtggtgagctgtctttctgaagtctttgttttaagggcactaatacaatcatgaaggctctgccctcgtgacataatcacttctcataggccccacctcctgataccatcaccttgtgtgtaggttggaacatatgaatttaagggggacataaaccttcagtccattgcaatacctgtacataatttcttttctttccctccctccctccttccctctctccctccctccctccctcccttccttccttcttttccactctgtaacccaggctggagtgcactggcatgattacaactcactgcggcctcgacctcccagggtcatgtgatcctccaacctcagcctccctggtagctgggactataagtgtgcaccacgatacctggctaattttttgtattttttgtagaaatagggtttcaccaggaggcggagcttgcagtgagccaagatcacgccgctgcactccagcctgggcgacagagcgagactccatctcaaagaaaaaaaaaaacaagaaataggatttcaccatgttgcccagggtgatctcaaacttctgggctcaagcaatccacctgcctcggcctcccaaagtgctaggaatacaggtgtaagccactgtgtccagcccataatttcatcattttaattatatctaaagttttttggatttctaaatataaataattgtttttgtatatcactttaccaaagtgttttttttttcattatggacattttaagtgtttcaacttatgatgacacacattaatttccagttgtcattttctagcattaatcacctattttatgtaaaagaaggaacaagggatgtttcagccagagatacatgacgttgtttaagtataagtcaccaattgtagagagaaagagagtatcttctgccttctaagcaaatagacttcaaaatagctccgtctttacatattgacaatatgtggtgagtgtactacttctattaatataataccatctctacaacatctagtaacagcaataatagtaataattataattaaaacaataataaatttattaaacattatatcccaagagcgattataattattttaaattcatatcataccaacctcataccaaccctaggtacttgtattgttgttttgtcggttaagaaactgagactctgggagattaagcaatattttgtttacatatctagtaagtggcaaaatggtgatttgagcccaagtttgttcttaatcttaatcacttctgtatgctgtaacaatgacttttaatggcttctatgcccttagtaatttgtgcattttgttgcactgttaactgatccctttttcatatggttaatcatatagttccacatatattgtattatcttgtgaaatatgtaatcctattatcctggcactaaagatagttcttcagagctcaaaccaaaactaggaagctgtacgttatccatggaaagaaataaggttctttctataatttagatttttttaggcattttctatgtagaatctgtcagtggtaaaacgttgccgtgacttgaagtctgtcttttctaataatgagggaaggaatgtggtcttcatgtcattaggcatttggtaatgatatattaatatagttgagatgcataaagtaatgaaatcaatttttcactttgactcttttgaaggtagcttcataacattacagacaccttgtgttattttaatatgacacttttagctatgagttaatgagactgcctttccccatttcagtgatttttgctgataaatatatagattaagcacaataacaagtgttctgttaatagcatttctaagtcatatagcttctcattcatatttggaatcattattctaagttaattagttttttttcttttttttttttaaacaaagtgttgctctgttgcccaggctggagtgcagtggcataatcttggctcagtgcaacctctgcctcccgggttcaagcagttctcctgcctcacccacccaagtagctgggattataggtgcacaccaccatgcctggctaatttttgtatttttagtagagacggcatttcgccatgttggccaggctggtctcaaattcctgacctcaggtaatccacccaccttagcctcccaaggtgctgggattacaggcgtgagccaccgcgcctggccagtagattagttttatattggcaaatagaaattatttacattgaaatccagtgggaaattgtaacattgctgtataaaactacaaagaggtgtgctttgttcttactggatattaatggcagttaaactagttccagagtatatcttgcatgatataagaagaataagagatttgtctgatttaagaaattaatttagagaggttcaaatctggtagcttttctgaagcattctatacaggtaatcttccatttagtcaattaatccttgttggtgagaaaaatttaatgcattcttttcaaaccgtatttcagtaatttgtgttcattactcagttttgcctaatttaaggatagccccatttatattattattattattatcattattacagtaatcactaatgttctttttagaacaatgcttatcatcttgtaaagtaggtgtgctgattgagcaagctaaattttgttattaggtgtctggcaaacacctaatgggagatgtcccaggaaattcaaaattataacagaaaaatatctcgtctattttaatgcatgcttctaggaatacagctgcacttgaaaacagattcacattttgtgtatgactattatgttgaaagaactttaactttttattttattgttgtgaataatattaattattaattattaataaatattaatattaattatggctgcataacccaatatccccaaatttagcaattaatagaacactcatttattttctcacagattcaggaatcttggcagatctcagctcagtcctctgtttcaaagttcctcacaaggctgcatagaagatgttgtcagggttgtggtcctgtgtgaaggcttgactggtgaatgatttgttcctaagctcattcatatgattggcaggattcagttcctccagagtgattggactgagggccttcattcttggatgtttgttgtccagaacccacccttggttccttgatcatggacctctcagtagggcagctcataaaagtccatttgcttcatcagagtgaaagccaaggagtgaagacaaagaatgaaagcaagtcattcataaggaagtcacagtcttttatagcctaatttcgtcattaataacatgtaactaggttcaacccttacacactgataggggaattactcaagggcatgactaccaggatgcaggaaacatttgggagtcatttaagaagctgcatactcacatggatatatacaatttgattttaacaaatgttatgatatctctttctttgatgacttcaacagaatcctaattggtctttctgccttctctcctgttttgtgataatcatggcattcccatgtttggaacatttcactgactacctcttcaggaggagattgaaactccttgtcatgtgtttcaaggttatttaccttttcactcccactaaaatgtacttagactgaactcctttgttcctggaacagagacacttaaaagacttggagacttctccctgaacacagtttaatttaaccaattcttcatttggcttgtatttagatgacacttccatcagaatgcagccttcacaatttactatcgtcttgactcattcacctccctcattagacactgagcttgcaggaaggaggaagcatttctgtttactattgttttctcgcatgtaccacagcttctggcaaatataagtatgtaacacacaaatgagttacagttatatatacttagtttcattgcactaagacaagtacaataaggtatgagtactaacccataattatttagtcacatagtaatgaaacaggaaattttcccagactccttcactggcggaaactggaatgagggcactggagctagccagctgttttggctggctgcaattgcttggatctgctgcactccacaccttgcaggagggggagcacagctgagttggtgcaggagccagggtgagtgcttctgagtgtcagcagaagcaaaactctggtgcgggccctgcagcagcatctagaggggagtacccacaacccccgaagccccagaaggagtgttacaggcaaagcgcttatagccatctgcagatggcttaagtgtttaacagctcagtggaccctgttccttttcacgagggcagagagtcagtgtaacagtcttctgtaacctgaactcttgtctggcatccaggaaaaatcagttcacacaattgaatttaaggatagtaaatgtaggggatgttattgccaatggaagtggctcttagccggaaggaaagctgggaaagggatggagcaggaaggtatttgtcccctgaagtccagctgtttccagctggactcttttctaaagtcctgccaatcaagccgtccctctgaagtcaagctgcttctctccaacgttcagctgcttcttctcatctccctttctctgctctcagccagtggaacctagggtttttatgggtacaggatggggggcagggtgggtcagagttggttttgggaaaagcaacactcaagtgggaaaacggggatgaaaagttttcactgtgggccatggttccaggcttgaaggtggagccctcgccagggaccctgcccttttctgcctagagcttatctgtctcctatccctatcagtaggaactcaccatctttagtaattcattcagtgtgtgtgtgtatatatctatgtatatgtatagaatatgaacctgtttcttgaaaaatccttctcattactcattaaataccagagatctatataattgagtctggctgtggcagtttgctaatgttaatttgtacacttatgttcccgtgatttagtaattcactccatttgggtgtttttaaaaaaatgtgtacatcaggccaggtgcagtggttcatgcctgtaatcccagcactttgggaggccagggtgggtggatcgcatgagaccatgagttcaagaccagcctgggcaacatggtgaaaccccatctctaccaaaaaaaaaaaaaaaaaaaaaaaaattggccaggcatggtggcatgcacctgtggtcccaactacttggtagactgaggtggaaaaatcacctgaacccagggaggttgaggctgcagtgagctgtgatcatgccactgcaatgtagccttgatgacagagtgaaccctatctcgggaaaaaaaaaaattgtatacataatcacatattttctttaaagttttcaaatgtgaaacttagatttttttttgtttcaaaagtggttgtggttgatttagtcaataaagttttaaaatgtatggttggcccacttaaataaacaactttagtgggctgacatatatgtccatttcttgatttgttgtttcattctaagtaaaatttttaatttctttttgtctgtttaaaaaataactgaaatacaataataatcaatagaataactatcaaaaggttttatgagaatgaagataaatatatatcacagattcaaaacaaactgacaatttctgtaattatatgttaatatttgttgtgccttcactatatgccaggtactttgtgaagttttgacatggattattacattcaattttgttttctaccctatacagtaggtactgttattgaaatcattttgcagatgagcaaagtggagcttgaaatcaagctcaagcagggtgattccgtagcctacatgctacattactttgctgtgtttacgacataaacaaagacttggaaattgaatgtattagcacaatcctgaatccacagcttgtgcttttaaacactactggatcactctgtagtataactgtgcctatggctctactatcaaaaatctcacttcaagatccctttatctgccccacaggacaagggtaagggtattaatacatgaatttgtaacctctgaagtaccttattcttgcctacccgattctacctagtttatgtagagtattaatacatttctattaattggacccagtaaaaatgtacccacaaaagacagaactgaatgactccatttgcccactaaatggtttacaacatattgaaacatgtctctcaatataacaccaatctagaaagagtgaaaatatattgaggttactaaccaccctagattaagttttccattgtgtgcctggtctgcctttgttttatccatggccacatattaatactattctgatttccccctgcttcctggcactgtttcctcttgttctttgtcatctgttgatactggcttaaggatcattggatggctgttaattaaattaattttgtaggagtctaagcaaaatatgtgatgcattcaaatggcaagtacaactactgtgaattaacaatagttcctccgttagaatggcttactgagagctgactgtgcctggcttcatgtgataagaataaactgataacttgcttctggcaatgtgttaggaatgtgttgtttcctagcatgtaattgcttttaatagtaggtaacaaaaagtaactactctgtgacatgtgatgctattaggatatttgtaattttctttgaaaagagaagctggtgtgattaggtaccttttgttctgctaacagcagtgataaagatgctatcactcctctcataggttttacttactatttgctcttgcagaatcagatcacatccctattaattattggcattttggttctattttacatgcttttgttttctgaatgctgacaatttaagcattttaatgattgactgcattagcaaatattaatatagctgcatgatagatcagcatatggttctgaaatctttgtaatatagtgtatagacattcatttttaacattttcgtaatccatttccgggcataaactgaacacatacacagactcatcagaaatttcttagatttgaggcagggttttgggacacaagcgatttttaaatacttcagactgcggcaaaatttagctaagggattccttgttttttagcagttcctgagaagacttgcaatcagccatattttggggggagtgcgggttcacttatattctatgaaagcaatgggattttttttctttagtgttttctacttgaaggttttttggtctgctaatgttgtctattatctttatgtaatgatgatgccaccccctctaattagtagagcataatactgttttgatttttagtaataatgtttttttaactgatcatatcatccatatttgcttaatatttcctgtaactagtgacactttttttatgatgacaaggggctgggatagagtttgtggccatggtgcaaaacaaagctgactgactcagtaagcattgaattcatgaccttagtgttatcagcatagtgctctaaccaacttaaacaattggccacaggtaaataatatgtgatgacaaaaatagctaaagttttcagccattttaagctgataatatttgctttctgcagtagcagtgcctgaggcagcttcatattatagctctcttaaattgtttaataatgaagacttttgaacatgctttttaaatttagtgcctacctatatcacaatataacaatatataattgatcttatatttttttcaaaaggcaagtcaataagttgttgattttgttatttttagggacacaactaaatatattttaactaaggtttattgagagagagagagaattacttgtacaaagtcttttctgcattgtatcaatattatggtgtcatttgcattttgttccagtgatagtctccatttcctccaaccctcagagacattaaggcaattatttattgtaatcaactctttccaatttaataacgtttttgaaaataccattatcactttccttggtgggcagtttatatttgtgcctcagtgtttatatattgcataatatttccctgaaaattattaccaagaactaagtttaattaattaggatggaccctagttagaatctaataaagtagtggtcttaagagtttgttctggtttttatgaattttgcaaatggttataaatgggtaatctctttttataatttagtatttatgtggtatatgtagcttctttcagttatctgttttaatagaggggaacaaatgtacagaactttgaaggtatatgtggaagggaaaggtaattaaatgtttttatggtaatattatttttgtattttagtatctttagctcagatctatttatgttcccctagactaggagtaagaagcaaaaggagtagtgagaacaatcaacctctggtcagatatttagggattgtttagagatcttttcaaagatcatctgtaccttttggcagcaaagcaaaaaatgggctctaggcctttgggaaatttgctatgtaggtccattcttaggccgtaagtttcctctgggccatatgttaaagaaaacccagttatctcgtattgaattcctttacggtcaaaagaattactagggacttatgctattgggggtgtaattttaagttgtgaaactctttttgttgattgtctgaattcattatctccattatttgtctcttgcagcaacagtgatattgctggtcagggtccaatgtctcaggattaatatggttagaattgcaacaaatatatataaaatgaattaattcataagctgtgctagatttgttttggtctgtggtcattctgttgactggttgttgagggttctgcacgttccttagccgctgggcaatggccaaccagaaatatacatgtgagctggaaattcagctgtttatttaaacaggagcacagatagcatagacagaaaggagttgattcatatggtatttgttatatactgtacattcttctgaacattttatatatattaacccatttaattaattctcatggaagaaaacctgtacgacaatgttgttatcttcaattatataggggagataactgggtcatggggagattaagtgacttagctaaaggttacaagcgtaacagataagaaagctgagttcccactcagtgctcttaattagtatacaaactgccagcttccaaattcatttacacgatgtcagttgtataactggcagtctagattccttttatatatttatgaagtatataccatattgtagaactgtagtcttatttcactggccttatacatgccctgacgggtctaaagcttatctgagtaccaggatgggtgtgacagcagggaagagaatttgtctggatcagtgatataagctccagtagagtttctagattatccacatttctgtctctctgagttgcttctgagtctgagtagtattactcattcttggcatctaagggttctttttgtagaatcaagtcttgaagatgacatttgcaattttggaaggacatgagaaaccctaacagaagttgctgctgctgttttaacccctccaattttgtgtttgtaccaaacacaaacattttttcagtctttcctattgatacggctatataaacagatatattccttatatactgttatataaggaatgattcagaattcctttataagcaattgctatgttttgcaagtttatttcactatcatgtaaaaggccgaggattctaaaccaatattactgtctttcttttgatatgtgtattgatcattattccctaccatctacccttactgaaaggaggggccatatgggattagattgtcagtaatgtttttatatcttccttgaggcctctagttcatatgactcttagaaatgctgtaacctaagtacctaaattatattatcatgcctgttatgtaaatattaatgctttcctaatagtctttgaagtgtggggttttgagttccaaggtcattttcaaacatctcctaagaggtgactgttagcaggggcaggcatgacagcatgcttctttgactgaaaggaatcgatatgtcaacttatcaaaatatgttttttttaatgctgtttcaaacagattgcttttaaaaggtcttgaaaaaatataaaccaattaaaagttgtggaaagcttaattttataataatttttgtcaaattcgttattaaattgaaatcatactgtgtcacttttattttttgcatgaaaaacacctacttatttataagaatcattttatttaatgcctatcatactggctcactaaacgtttggtgttcataggctttcttttctaattttttgcactttccagttttgaattagagtcagggattatatgaaatattttaaatttgagtaatcaaaaaggaggttatataaaaggactttgatgcatggaaatattaacaatgtgcatgtatattaattgttgaacattatgagtaattaaacctatcaatagttacttaaaatttgtttgattttaatatttctgaacaaactttagcctgaccactgccattgaggaagttgactttaggaccaaccaactttccatgtaggaagtaacagagttaccaggacattagagtttgtgacatgactgtttatagaatgtcaatattttacttatcacattgaaattcatcactgatatctttgtagaggaaatgaaaatatgccctgctttattattcatatttacataacagaaatacaagatttaaggcataaatgtgttaataatgccttgactcttaaggacatgtaccctgaaattaataggactaaagcaacctctttcccttaccatgtagagattgacaattggggcacatgaaatattagacatctctttgccagtcaaaatacacaatactttgatgtactgataacttttaatgaaggcaccagctatgcgttaaataaaccattcaatagacttaatactaaccaatgttcagaatttgctggttgtggaaaatacatttttctagaggtatttaatgctaatctcctttactaagcagtgattaaagattttttgagaccaaattttaatcaaagataaaattttttttacaaccctttcaggtaatatcataagcctaaattcagtgtaactgaactttagaaaatagtccttttgcctatttctttcagaaatacacacctcccttctctcaccagacccagacacctgcataatcaacatagggataaatttactttgtttcacaaatcttatatcaattgatgtttgggtattaggagctacatttctgtgtataggtgttaataagaaatgatggcctacatagagactaatttgctgtagaaatgagataacagcattattctagcaattcttccaagcggccattgaggctgtcctcctcatcttatttgctcattcaacaaatatgtattgaatttctatcatatgccatacactactagtttttacagaatggttattactccattagacctatgacccatggaatgagtaactctgaattctctgtggtagaaatggattttgtttatcttgttttgccatgctagtatctctttctttctgtattttaggccctgcttgcttacttagactcaagataactatttcttcctcctcctttcaggaatctcctaggatccaaattttgttttgttgttatttagagatgcttaaactgatgtgtattaactgaatcattgtgtactatgatacacagtgttttccaaagcccttctgcttattgtcttatttctagcctgtttttatctgagtcctctcattgctttgtaaactcaaatatcaatatgatcaaaaagatccagtcaactttggggtcactgtatcttgaagtttagaaatgggaatagagaagacaacagttgagtatccaataagagaaaaaccaagatagtgataaaaagtattcagagtagtggaatatgcttgccacctcagtaggcatttggtttatagaattactaattaattttttgttggagaaaactgcttatattttcttggaaatgtattttttattttcaagaagtatgtagcaaacagtctttccagaaagtatgggttccttaataatgttcagtaaattcattattctatacattcttatatttagaaatatatatatatattgaggatctgctctgtgccagatgctagtctaggccttgggggatatagctgtgattaaggcgatgtgatcttgactgttttagaacttaaagtctaacagtaaaaatataataataaacatgtaattatattactgtgagtttcagatagtattggtgctctaaagaagataaaatacagtaatatgatgggaaagtacttaggtgggggcttaagtgtgatggttatggaaaataactttaaaagcatatgagttgggaaatttgaaaaacataccctcagaagcagaatccagcaggacttgttgacggattggatgcagtactttttttttttaaagcaaagaatcaagatctcttttagatttggggcttgagctgaacatagtactgtccaataagtatcttattgtagccactgaatcagaaaaggctgaagaggatagtgttgacagaaaaagtggtcagaggattaaaacaatgtgatcatctagaaaaaccatctgtggatgtactataccaacattttcaaaggtaagaaatacagtgaagctcgaattagtttagtgttggtacatggaaataaattgtatggctttatcattaacctttgcttcaactctagggatttgtgctttgtttgattggactgtagagacaatctttacttttctgtctatgtttaactatttagtcaaatgaatattgcacctctaagtgtttcttttgatttactgtaggctgaggtcatactgtgtactaggcgtgaattaattacaaattgaacaactttgctctagtgaagagagaattttattctcattccaactaaatctatgatccaagaaagatctttatattctttgtgtgtccgagggggactgaaagtatactcataaaaacctgttctgattttaaaaaaagaagaaatgaccttcatttcttttggatcttctactaaatggctttaaagcatcacatcacaaagtcctcttccccatagaaataatattctctatccaggaaattttaaaaggtttgcattatcttgttcttgtggttgatagtaaatttagcatttattaattattgacaaactgccaaaatggatcatacatatgttacaaaaaatcttttgtataaatttcaaagtattcttaatgtggctttattgttatttatgatagatcactaaggtctctctcacttatttcttcgtgctccattcttaagcagccatttctctaggaacttagtcctacagaatgagtggaattggtaaagtaattgtgatcgttgatgatttcctcatctttttaatccagaaaagttagcaacaaacctgaattcttagtgggttgtctgagctttgcaactttatccaggaccatggaagaatattccaactgtactattttactgtatttcagtttggcagagaggtattttagcaccattataataacctcatttatgaaagtgttggagaattgcattctataagataatgtagcttctctgtatgataatgttttcacacagtgtattagtgcatgtggaagtatattggaattgagatttgctaacctgcatctaagatagcttagtttatttgattagtgaactccaaataaattattttggagggcccctgggaagtatataagaaatttaaaaaccaactccttcagaccactagtttcccttctgtttatgatgtttatcacttcacatttttaattagtaaagtataaaatgaatcatacaattatagtagtggagttttttgtcttctagaagtgacatcgtaatagttattttaaaacatgtagagagtcatgcatatgtatgtggaagggtaatcaacattgttttaatgtcttatgctaagttgcacatacaaacacatcttttaatttatggaagttacttacatttctacataaaatctcagctgtttgtacatgtcccagactatactggattctggtttgctcagttattccttccttattctgagagtttagcaaagggaaaatgtcaacctcaccctagagaaagtagagagctaagcagtagaaaaagctatttgtgccaggcttggaagaccccagtctttccatttctgcctttcaaagaagctctttctaggggcatagtactaaagattgagccagggcttttgttctggttattcattgcacaagggtgccttgctgatggtttgattaggggctgaaatttgacacgggttctacttgtcaagctgtgtagccacaggcctatttccaactagagtgcgcatttccgattttcacaacagtatcatatagtctggagacagcccaggcaggccatagtatagacagccactgcacctggctcttattcttcatagctccctcaaagtgttttctgcaatacttcctgctctgtgctcctctaccctgttttttaaatttttttttcgaaaaagttttgtttgttttttattgatacgtaatagttacgcatattttgggggctacatctgatactttgatacctgtatacagtatatagtgatcaaataaaggtaattgggatctttctttttcttctgagccttttctttgctgagaggaagctaataccactaagggtgcttaattatttatctttgttggaataaggtaaatgttaccttgaagagttatatttgctatcattatcaatatcactggagtctggaatatatcttagtactttctctcttttctcagtaaccccttccttcaaaatgcagcatcttaaatggtagtttgtgtactttctgacttctcagtgaatgatgtaattttgttcattaaaaaaaaattcaatttaaataaacttgcaggtggaaggtggaaaataaatcatgataatggctcacacatagcatttactctgtgctaagcattgttgtaattgtcttacatgcatcaactcattttatcttctcaataatcctttgaggttacttattattagtccctctttttttttttttgagatgaagtttcgctcttgttacccaggctggagtgcaatggcacgatctcagctcactgcaacctctgcctcccaggttcaagtgattctcctgcctcagcctcccaagtagctgggattacagatgcacgccaacatgtctcgctaaatttttttgtattttttgtagagaaggggtttctctatgttggccaggctggtctcaaactcctgacctcaggtgatccacctgcctcgccctcccaaagtgctgggattacaggcatgagccaccgtgcctggcctattagtcccattttatacctgaggaaaataaggcaaagagaaattacataacttgcccaagataacacagataataaatggggacatagtgattgaaaccaaggtatcctgttttatggtgttttttttttttttttttactatgttataatttatgaatttgctaattgcttcaatattattttctctttaacttttcatcaagctttacagtaaatcattgcttatttgttttcctgctattcattgaggataaagtagcatcacatcagtagctttaagaggtttgccgtttaatctgtattgcttttagaggttagcacgttataaaagccccatttccataatggatgactggaaaaaccaggttgctgtatatatgtgaacacatatataactaacagtttgttttctctgtctctaagcttgtggggtggtataaacaaacttcagtgtactttaagtgcagttactgtgcttcaactcataagcatttctttagaaagaacatatactctgaaatatctagcatgcattgatgaagtaatcaaaatcttgatctctaatatcttttcaaagggtttccttcactgtctctttcccctggaatatattatgcatctctaggtggtcaaacacattgagacccataccctgactaaattttcataatccctggggttcacaattgttatttaaagttcatagatgtatacttcacaagtataggggaatatccttgatatgcatactgctagaccactctctagcctgaaatgttaatatgatgattatagaggagttggatccatttagaactattaggaagattattgacagtaatattttgactggttagttggcattaaacctcaatagaactgtgaaaaggtgattgggcaaagggcagtgataaaaccaagataatgaaagcacataacaaaagaagatttaccctttgtctttttaacacaagccatgttatttgtcatagtccctttaatactttagtacttgctcctaattaaaagtatttctggaaagagatctggaacagagctttcctgacaaaaatcagataatggatgatgttttgtaatactgagcatattatatctcataccaacatatttctttctcttttaagccacaggcatgatatggaatgacctgcccattctctccctgctacttccccaaatagttttcctattccttttatttaaggtattattccgatgtttgtgttagcaggcaatgtgcctttgctttgcattttgtatatccaattaatccatgtgtgatgatcacaactgattacagctcagggaataagatggggtgatgatatgactaatgcatacaggtagaattaacaagagacttttctagaaggtgttcaaagggcagaataaagagactatctttaagtggggaatcagtaaagaagtctacaaacttgcttctagctgaaaagatggtgtaagtgtcaattctgttgtgttctctctctcccaaaagacctggtgggatacaaacaagttacaatgacttcattctagagaaaacatggaatccactttgttttgttaaaaagttcttgaatcaaaaatttcaacaaagtatttacaaaaataatattctgtgtcttactttaaaactgatgatatcaatatcacaccagtgtgacaagacactctgattgtggtccactggagaatgttccatgttaatccagaggaagaattacttcttgtcataggattattggtgaagaaggccagtagaccaatatcttgactttttgggagagagttttataccttaggccctcttggcagctagagatactaagatgaataagatatggtttgcatcctcgaagaggtccttattttcaaaagagaggatgtgtattagttcgttctcacactgctataaagacatatgtgagactgtcatttataaagaaaagaggtttaatcggcttatggttctgtgggctgtacaggcttctgctttggggaaggcctcaggaaacttataatcatggcagaaggcacagtggaagcaagcatatcttgacatggctggcaggaaagagtgaagggggaagtgctacacactttcaaacaaccagatctcgtgagaactcactatcatgagaatagcaagggagaaatctgcccccatgatgcagtcacctcccaccagctccctcccccaacactggggattacaatttaaaatgagatttgggtggggactcagaacgtaactatatcaggcagatatataaagtaattgctatactacaatgtggtaacttctataaagaggcatggaggaataatattattaaagaataattaaagatgaattgagatgtttgcagagaaaaataatatttgaactgggatttcagggctatgtagatttttatttccaaaaaacagaagggtcttcagggcagaagaaactacatggacaagggtatgataaagtgtcacatcatggggagtaaggcatggaatgtttggttggagaatgtggtatgaaggacaggagggaggtacattggagacaactggtaaaggatctttttactgtaacctatgggtaaccttaaatgtatttttaatcagggttttgtgatggtatgatcaaattgcattttagaatgattgcttttggtaggaaagtttaggattgatgggagaaaattaggagttttttaaacaagtctcaattggacactgtaatgacttgaactaaagcagtagaagtgaggatgtaaagggggagctaaatatttagaaagtgaacttaacagttaattagtgacatattaaacttggggaagtgagagacaaaggggaagcagaagtctaatatgattcccacgtgtcttgctcatgcagcaagttggatgacagtgctacttactgcgatgaggatgaatgggaaaaacaaaagttaagcttcagacataatacatttgagaaataagatagttaagtggctataggctactgtcttgtaggcagtcatgtgtagaaagtttgtagctcagaagaatatatggctttgagggagaggttgggagtccatccacgtatgtatggaatttaaaaccatgagaatgtataaaattactgtattagtccattctcacattggtataaggaaatacatgagacagggtaatttataaaggaaagaggtttaattgactcacagttcagcatggctggggaggcctcaggaaacttacaatcatggcagaaggtgaaggggaagcaaggcaccttcttcacaaggcagcaggaaggagaagtgccaaaagaagcaggaagagccccttataaaactattcagatgtcatgagaactcactcactgtcatgagaacagcatgggtgaaactgcccccatgattcaattacctctacttggtctctcagttgacacgtggggattatggggattacaattcaagatgagattttggtgaggatacaaagcctaaccatatcaattacctgaagaagaactgtagaaagagaaaaataaagagggcccaggattaattgctgaatgctaacatttgaagggccaatgggaggaagagcagccagcaaagaaaatgccaacaaagaagtggcaaaatgaagaacaatatgatataataaatgccgggagaagaaactgtttcaggaagaaaggagggactagtttcgtcgtgtagattattgcttaaagtcagataaaggcagcaaatatattttaggtttggcagtatcaagaatgttattgatcttaatgcattattttctaacacttagtgtagatggaagccagattggaattctttggagtttaggaccattggaggtatctgttgatgtcagtcattgagataatacaggaggaatgtaacgtttgttaagagaaagaaagaatgaattgttaaatcctattgaatatgataagcagctggagatgttcagcaactagcaaagcatatgatctggaactcacagaccagtctgggctgaggctaaggattttgaaggtattcagtagttgaagcctcactgggtattctcagccacatttcaaaataaaattgggtccaatttattatggaaaattggcaaattttattaatatataataccttacagcagtacacacatcacagtttacaaaggagacagttgacaaatgaatgaaatgtgttagtttagccctctctaaagattaattatttgaatacactctaatattggttaaggcagttaatacctgaagagtatattttctttttttttttctcagttaagtggctgtaggctactgtcttataggcagtaatgtgtagaagattgtagctcagaagaatatatgaagagtatattttctgagtctgggatcctagttaatattaaaaaaatgtgacatcaggcattcatataaaatccaaacctaatcaaagcagatagtcctatttaaataactaggcttgaaaaaaagaaagggttaacaactcaaatcttgaatttgtttccattgtatttacaccctagatttctatgaagtgccacattacattatatgcttatttatctctactcttcacctagagataaaatacagtcagacaaatagctgagaatctgaaattcaaagcagttcttttgaaagttaattctccagtaagtttctccagtaagtttcatcctcagattgcttcattcacaatggagtataatggttggttggaaatgtggaaatgaccatttttgatttaaattacttttgtcacacagtttttgatactagcaaagaaaacattgaatatgattgacctagttaattttaatttcatacaattcataaaagttatgttagtaattttacagagtaaaacctttatccatttatgcttctgaaaaatgaccttgtaaaatgtcagaattgccatggtatgcttttgaaaaatacttaatgatttgtgcttgatgcatttaaactctttattgaaggtcaaggattctattagggcatttttgtcagtaaaatgttgacagaaatgaactaggtagttgaattctcactgacaatactgtcacaattgttaagaaattgtctaatgataaggccagattttgctcattatttttcttagtaactaccactagttcattaaatattgccttaattagagtgtgtgttaagtgtcaaaacttaatggtcacagtcacaatccttatttaatagatacttagtttgaattgctatagttatattattctcaatgactgtgtatatatgccatgcatttggatgagatggaattgtgtgggtattccaaaagcactgatgattatgttgatttcagtgtatttttgatattcgatattgagcttagatacccacagtttgatctgtgaaatcacattccaaactagtaaagccacaaaataaaagcaatgaagtaaagctgggatatattcttattttcttatttataactctttcctatcacctaatcagtgcagtatattttgcgaacagtcagatttgttgccacctaaaataagagttgcagttgtttcatggtgatagtttttctcacctctgacctcgttaaggagatggttataaacacaattgttttaaaggcctaataagacatgtgaatatagtgtaaaaaaaatcttgggattatctcttttatttatgtcagtgattacttgaatggaaaattcctaggttagtctgtacaaagatcacattcctctgtgtatttttgttatctatacttagaggtgcacatatttatgttctgttgatatagcatattgagaaatgtttttaaatgtatgcatcctagagatgctatcgttgtagtatctaggagttgtataagtatggtgaaattagccctcagaatttttttgcctcagtgtgtaagataagcttggatggtatgtacagcatcattcccccatacatcgtgctccgtggtaaaaatgaccttttaacttaggtttttgaatcacatttagcaaattgatgcatatcctatgactccttgggtttttgccaagatttttcattgtagtattcaattctgttaaactttgtatggcatacaagagtcatgcgacttctggttactaatgattatagatatgtctcagtctcaaagctctgaatacaactgttcttcatcttatgagattttgtgagtttcataggtcttatggaagaccttaagtcgtcattgccctttctctaggcaggactgtattcatacctccatctcagtaatcatcttcattttgttaagaatcttcaatgtcttgtgtactttgttggattttctcatttcatcagatgattgtgatcacgatcattttgattatattaaatgtcacacttttaatattccttatttgaaaagatatttcagtggatagcataaacattaaaggtgaggtggtgaatttagtgcaaaatgtgtaaggtaggcaaccagctatcatttgtataattcatgcttttgttacaaatgccattgtccactaatgctgactttttatcagcttaaattgtgggaggctatattcgtagttaattgacagaattttatagaggcagcaaatgctttttatttaaaggacatccttagcttctatatcctgtgatataactcgtgtattttgccagtcagtagaagtagtaatgcactgaagaaatgtatatattgtacctcaataaaaatagtaattaatatttacctttaacttctgtggcattttttaggatatattaataaactccatgtcacttatcacaaaataaggagaaaaaatacctaaaatctatttcatattttctgtcatagtttactgagcagatttttgaattggggggagaaatgacagttgtattagaacaaactcaatttaatgatccctctatttttctttctataagaaaaaaaatgataatgctcagtttatggaggacacattaatcatttttagtttgaaaaactggattcttttcatattattaaaactttttgatgttgattgaagccaaatacgttttttaattgtctttgatgatcaaaatgagggattcatgtacctgcatttctctgccaaacgtagccctttactatagaatatatattagtgaacttcacttgctttatttgttctttatgctgatctgcaggaggtcattataaaatgtgaaccaaagacccactagcaaatagcgctgggttagagaagcaggattagagatgcaggctctggagccagactcgttgggttcaaaactcacttaaaccacttcgtaactggtctgatcttgggtatgatgtcatatctcagtctcttcatctataaaatggggataataatagtatgtaccctttaggattattgacaattgagttaataattgtaaaatgtttaaaatggtacctgctgcatattacagatggtattcgttgtaatcgtttttatcactgtcaataatgtccacttattatagcagcagatatttttgaatccagggatgtagtcaattctttgtcatctgtcttcagggactgtgacctacacctttgacaattttgacagtattactacctgctcagcttccctatagtgtctgtgagctggctagcaatttagtacactgatcttatttggtagatgaggaaactgtgggccagtaataaatttacttatggttataaagctggtaattaagagtctaatttcgattggctgggcacggtggctcacacctgtaatcccagcactttgggaggccgaggtgggcatatcatgaggtcaggagatcgagaccacggtgaaaccccatctctactaaaaatacaaaaaattagcctggcgtggtggcgggcgctggtagtccagctactcgggaggctgaggcaggagaatggcgtgatcccgggaggcggagcttgcagtgagctgaatttgcaccactgcactccagcctgggtgaaagagtgagactgtctcaaaaaaaaaaaaaaaaaaaaaagagtctaatttcgaatatagctcttctgatgacttgtgtggtagtacttgtacttcatggcttaagtgtgtctatgtatttttctttcatttttgaataatgagttccttcagggtaagaaccatgaagtaaatgtacaaaatgttggtacatgtatccattgtttttggttttccagggggctaaaattaacactgaaatgcaattgatatagtttggctgtgttcccacccaaatctcatcttgaaatgtagctcccataatctccatgtgttgtgggagggacctggtgggaggtaattgaatcatagaggtggtttttttcccatgctgttctcatgatagtgaataagtctcacaagaactgacgcttttataaagagcagttcccatgcacatgcactcttgcttgctgccgtgtaagacatgcctttgctcctcttttgccttccaccatgattgtgaggcctccccagccatgtggaactgtgagtccattaaatttctttttctttataaattagccagtcttgggtatttcttcatagcagcatgaaaatggactgatacaacaatttatggaattatctttctattgatatctgttatgaaactatgtatttatacacctaaaatgtgataaaagtcacactcgagaatggaagagaatagggttaatgacaaacaaaagaaaaagacgcaggcattggctttaaccactgtgagtacaagacataggctaaaaaagaaatcagtgataggaatacattatttcccaattgtccactttcaaagtaaaggcctggcaattgtggaattgaaatttcttttatcttcagtaaacagagatggctaaaattttcacgactcatttaatcccgcagcttttagctaaatagtgttcattcatctctcttgattcttaatttagtgattcagatttccataaacatgagtttctgtaaaacatttataatatttgcccatgtgccagtagtcctagctactcaagaggttgagatgggttgatcgcttgagccctggagttcaaaaccagcctgagcaacatagcaagatgccacccccacatacaaatgaatacacacacacacacacacacacacacacacacgtatgtctactttgagttttgtaaaattatatttcctttaaatgaaaaatgtagcactagtgattatgaaaacaaaaattagtattttcccaaagattaatctgccattgttatccatcagttcaccatctaagccccattgctctcaaattcaatgttcagtgtgtttgaactgtacccttgcttcaaccaggccaatttgttttttctcacttatccacactgtcacactgtcagcccatgtgcctgtcacataccacttccccaaataaaatttctgatacatttgactcaactaatcactgaacttactcctttacagtctcctttatttcttctaattattcctgataccagctttgagaatactgaagagagttaactatgcctgagtggagcctttcattttcttaatatgcattccattaacatgagcattttgttcctaaatgcccttgagttacttttaaatgttccctttggtgtcctcaacctgtttctagctttttgaaggtaagaaacaggtcatctgtttgttttgttcccttcacaacaccagtgggtgttttgttcaagctatttcctgactaacttcctcagtggggaaatgttcagggtatgcaaatttattttcaattaacttacataatacaaaactgggtaaatacaggagttgaggtgatttatgattgctttaaaacacaaagccagtccaggtgcggtggctcacgcctgtaatcccagcactttgggaggccaaggcgggtagatcacgaggtcaggagttcaagaccagcctgaccaacatagtgaaaccctgtctctactaaaaatgcaaaaaaaattagccaggcgtggtagcaagcgcctgtaatcccagctactcgggtggctgaggcaggagaatcgattgaacctgggaggcggaggttgcagcgagcctagatcacgccactgcactccagcccgggcaacaatgtgagactccacctcaaaaacaaaacaaaacaaaacaaaacaataaaacacaaagccaagtgtatttattattagtatggagtgtatcagtgttgaattctctctgtatctttttttatttttttatttttaactctaatggaagaagatcctagaaactttaaggattgtagattatatctgtagccttgattttttttccactttgcttgacaaaggtaatcctatttagcaatgtatttaagtgcctctgcatttgaaagaatgttgatttttccaaatagggtacgatattttatgaaagttttttttcttgaaaacagaatgagcatcccaagatcagacagagaagtaatatatagatataattagcttttctgtttaaaaaaaaaggtgatggacaaatactgtcttgataattcaagtcaataatccacaaatgtatattagtctcagtggctgagagtctgtgagtctgttgtcactcagtaggtcaaatctaatccgtgtatctatagtctcttaaatactcatttgcacattggattaactgtgtgtatttaagcattacatgtttttatatagctaagcttgagtatattattaaaagttttatccctttactttgcaatgaaaagaagtgataatttgtaatgaatatatatatatatacatatatatgtttgcatcagtgtcatgtggcccatccctatatagagtggaacacgtatgatcaaactatctgagtgcaaagcctcaatttcatttactgttgtgacaactaatgtttaatgttagcaaagcaacagataaaattcacattttactaaagcaagaccatattgattcatagaagactttagttgttaattcttaggtcaagatctaagtatgtttcccttttccttattatttttacttgctgtatcagactgaccacttctcagtatattattagttatgagatagaaaaatgaattatgttctaagttttcttaacatttctaattctttttaatttttattttcgtgggtccatagtaggtataagtatttataaagtacattaaatattttgatacaggcataccatgtgtaataatgacatcagggtaaatgtgatatgcaacacctcaagtatgtattcttttctttttgttatacacaatctaattataatcttttagttattttaaagtgtaaaataaattattgttgactatactcaccctcttgtgctatcaaatactagatcttacttatttcatctaactatacttttgtacccattaactatgccttctcactagacacctacctttcctagcctctgctaaccatcgttctactatctatctccatgacttcaattgtttgaatttttggctctcatgaataagtgagaatatgtgaagtttctctttctgtgcctggcttatttcgctccacataatgatcaccagttccattcatgttgttgcaactgacaggatcacattcttttttttttttactggctgaatagtactccatcatgtatatttaccacattttctttatttattcttctgttgatggacagtttgttttgttccaaatcttagctattgtaaacagtgctgcaacaaacataggagtgcagatatctctttgatatactgatttcttttcttttgggcatatacccagcagtgagattgctggatcatatggtagctcaatttttagttttttaggaaccttcaaactgttctccatagaggttgtactaatttactttcccaccaacaacaatatacaaggcttccttttaatccacatcctctccagcatttgttattgcctgtctttcagatgaaagccattttggctggggtatgataatatctgattatagttttgattggcatttctccgatgatcaatgatattgagcaccttttcatatccctgtttgctatttgtatgtcttcttttgagaaacgtctatccagattttttgcccattgtttgattggattattagattttttcctattgaaatgtttgagttccttatatattctggttattaatctcttgtcaggtgggcatttcacagatatttcctgccatcctgtgggatgctctttactttgctgattgtttcatttgccttgcagaaggtttttaacttgatgtgatccttttcgtccatttttgccttagttgcctgtgcttttaggatattactcaagaaatctttgcctagtccagtgtcctagacagttttcccaattttttcttgtagtagtttcatagtttgaggtcttataatctattttgatttttatatatagtgagagataggggctagtttcattcttccacatatagatatccagttttccaaataccatttattgaagacattgtcctttcccccaatgtatgttcttggcatctttgtcaaaaatgagttcactgtagatgcatggatttctttccaggttctctattctgttccatttttctgtgtgcctgtttttatgccagtaccatggtgttttggttactatagatctgtagtataatttgaagtcaggtaatatgattcttccagttttgttctttttactcaggatggttttggctattctcagtcttttgtggttccataaaagttgtaggatttttttcttggtaggttgtatgtgtctatatttgtgaagaatgtcactggaattttgatagggatcacattgaatttgtagattgctttgggtagcataggcattttaacaatattgaatcttccaatccatcaacatggaatatattttaaattttttttggtgtcctcttcagtttccttcatcgatcttttagagttttcatggtagagatctttcagttcattggttaattcctagatattttattttatttgtagctgttgtaaatgggactactttcttgacttatttttcagatttttcgccattggcatatagaaatgcctctgatttttgtctgttgattttgtgtcctgcaactttactgaacttgtcagctcttatagttttttgattgagtcattaggtttttccaaatataaaattatattaactgcaaatgaggctaatttgacttcttcctttccaatttggaggtcctttatttctttctgttatttaattgctctagctagggcttccagtattatgttgaataacagtggtgaaagcgggcatcctagttgtgttacagatcttagaggagaagctcttagtttttccccattttcagtatgatgctagctgttggtctgtcatataatagctcttattgtgttgaagtatgttccttctgtctctagttttttgtgggtttttatcatgaagggatgttgaattttatcaaatgcctattcagcatcaattgaaataataaggcttttatcctttattctgttgatatgttacatcacattgatttgcacatgttgaaccatccttgcatccccaggatgaatcccacttggtcgtggtgaatgatttttctaatgtattgttgaattcggtttgctgttattttgctgaggatttttgcatcaatattcatcagacatattgcctgtagttttcttttttaatgtgtcctagtctagttttggtaatattggccttatagaatgaatttggaagtattccctcctcctctattttttttttttttgaatattttgagtatgattggtatgaattcttctttaaatgtttggtagaatttagcagtgaaaccgtctctcggatttctttactaggagacgttttattttggcttcagtctcattacttgtttattggtctgttcaggttttggatttcttcatgattcaatcttggtaggttgtatgtgtctaggaattttattttatttttttggggacggagtctcacttctgttgcccaggctggagtgcagtggcgtgatctcggctcactgcaagctccgcctcccgggttcacgccattctcctgcctcagcctcctgagtagctgggactacaggcacctgccaccttgcccggctaattttttgtatttttggtagagatggggtttcaccgtgttagcaaggatggtctcgatctcctgaccttgtgatccacctacctcagcctcccaaagtgctgggattacaggcgtgagccaccacacccaatcactgattttagtggtttgatcttgctttcctagttcattaaaatgccttgttatttatttgaagtttttcttttttttttttttttttttgatgtaggaggttatagctctaaacttctttgtagtactgcttttgttgtatcccatcagttttggtatgatgtgttttcattttcatttgtttcagcaaatttttaaattttcttcttaatctctgtattaaccaactggtcattcaggagcatattgttcaatttccatgtttttgtatagtttccaaaattccctttgttattgatttctagttttattccattatggtcaaacattcaagtttttttaacgttttaagacgtgttttgtggtatgtccttgagaatgatccatatgctgaggaagaaaatgtgtattctgtggtccttgcatgaaatgctctgtaaatatctattagatccatttggtctatggtgcagattaaatctgatgtttctttgttggttttctgtctggaagatctgtccagtgctgaaagtggagtgttgaagtctctagctattattgcatagggttctatctttgtctttagctctaataatgtctgtttcacaaatctgggtgctccagtgttggctgcatatatattttgaatcgttatatgctcttgctgaaatgactcctttaacattttataatgaccttgtctctctcttcttacagttttgaaatctattttgtctactcctgctctttttccattggcatggaatatctttttccatccctttattttctatgtgtgtctttataggtgaagcgtgtttcttgaaagcaacaatgcattttaatgaactataaaagcaagagctttttttaaaaaacatttaacccctctatgtcttttgattggagaatttagtgcacttacattcaatgttattattgataagtaaggacttactcctaccattttgttatatttttctggttgttttgtggtcttctctttcttctttcctttcttcctgtcttccttttagagaagatgattgtctctggtggtgtgttttcatttcttgttttttattgtctgtgtatcctttgtatgttgtttatttgaggttgtcatgaggcatgcaaataatatcttataactcattattttgaactgatgctaactaaacactggttgcataaacaaacaagcaaagagaaaactaataaaaactctacactttagcctcatccccttgctttttaactttttgttttttctctttatatcttattgtactatgtcttgaaaaattgttgtagttattatttttgatctgttcatcttttagtgtttctactcaagatatgagtagtttacacaccacaattacagcgttacaatatcctgtgttttttctgtgtacttactattaccggtgaattttgcaccttcaaatgatttcttcttgctcattaatgtccttttctttctgattgaagaactttctttagcatttcttgttgatgaaatcccttaacttttgtttatctgggaaagtgtttatttgtccttcatgtttgaaggatattttctctggatatactatctcggataatagttctttttcttcagcactgtatatatgtcatgccactctctcctgcctgtaaggtttccactgagaagtgtgctgcccgatttatgggagctccattgcatgttatttgtctcctttcttttgatgattttaggatctattctttatctgttacttttgggaatttggttgttaaatgtcttgaggtaatcttatttgggttaaatctatatttatattctatatttcttgtatattggtatctttctctaggtttggaaagttttctgatattatctatttgaccttttaaggctgttttctttttttctttttttttttttttttttgagatggagtcttgctctgtcacccacgctggagtgcagtggcatgatcttggcttgctgcaagctccgcctcccaggttcacgccattctcctgcctcagcctcctgagtagctgggactacaggcgcctgccaccacgcccggctaattttttgtatttttagtagagatggagtttcaccgtgttagccaggatggtctcaatttcctgacctcatgatccgcctgccttggcctcccaaagtgctgggattacagatgtgagccactgtgcctggccttaaggctgttttctatatctagtaggcatgcgtcattctattttattcttttttcttttgtctcctttgtgtatttttaaatagcctgtttttaagcttactaattgtttcttcagctttatcatttctgctcttaagagactgatgcattcttcagtatgacattgcattttctaacttcagaatttctgctcgattatttgtaattatttatgtctctttgttaaatttttctgctgggattccaaattccttctctgtgttatcttgaatttcattggatttcctcaaaacaggtattttgaattctccatctgaaaggtcacatacatattttcctctccaggtttggtccccgatgccttaattcatttattgaggatatgttttccttaatggtcttgattcttatggatattccttggtgtccgggtgttgattaattaaatatttattgtagtcttggcactcggggcttgtttgtacccatccttcttgggaagacttttcaggtatttgaagggacctgactattgtgatctaagtttttggtcactgcagtcgtatcttcactaggggcatcccaagcccactaatgctgtggcttttgcagacttgtaggggaactgccttggtggtattggataatatctggaagaattctctgtattgtcaggcagagactcttgttcttcttccttactgtctcctaaacagtctctattctgtgtgctgagctacctggagctggggaaggggtgatgtaaatgctcctgtggcgaccaccactgggactgcgctgggtcagacctgaaggcagcagaacactggttctcatacaaggcgtatggtaaacactgccaggctattgcctgtgtttgctcaaggccctagggttctacggttagcatgtgccaaagccagccagggttgtcttcttcccttcagggcagtgagtaccctttggccttgggctgatccaaagatgccatctgggacccagggcctggagttggtaaccttagaaatctgcctagtgcttttttctgagagccgagctgggtcccaagccacaagacaaagtctgtcccacacttccctccccttttcacaagcagaggaggttctccgtgtggccatcaccaccccaggcctgcagcaaatactgcttgactactttgatgttcattgaaggccgaagggctcttcaggcagcttgcggtgaatgcctcctggcctgggactcacccttcaggtgaatgtgctcccctctggcacagggcaggtccagaaatgtcatccaggagccaaggcctggaatcagggaccacaagagcctgcttggtgttctaccctgctgtagcagagctgatacctaagctatgaggaaattcacccttactcttccctctgctttcctcaagcaaaactagtgtctccctgtaggcatcaaagctgtgaatgtattgggtcacacctgaagccagcatatccctgactgtcattcaaggcccacagctagtatttcctggctaccactgctaactacttagtcagtgcccaagggctctttagtaagcaggtgatgaatcctgccaggagtctgtctttcccttcaaagcaatgtgttcccttctggaccaggatatgtctagaaatgtcatctggtagttagggtctgcagtgggggctttaggactcttcatggtgccctgtccttctgtggctgagctggtatccaagtggcaaaacaaagtcctctttactcttccctttcctctcctcaagtggaaggaaggggtctctacctaagctgtgggctgcactgcctgggtggtggtggggggctgacacaagcactcccttggctgaccctaatggtatctcactaagttatatgcccccaaccaagtccactgactccgtgcccaccacaccaggaggagttgcccaggaatggcagttcttgtggccgagactgtgttataagttgatttaggactgcagaacactttagcctgtggtggtgaggtttgcagtgaatcaggtacaaattgctggcatatgccctacctctcttggttagggcttatctaaatgttccctctgtgggcactggctgagttctaccccatattgctttctgctatgacatgtcagcattgggttacaatgcaaagtcccacaatcattgtgctctctcttcccaaagtgcatagaatctgtctccatgccatgtggccactgccaggaggtgtatgttgggggtggggagtggtgggatagggatgggggggatggtgttggtgattcaaaatggtctttcctaccttcttcactgcttcttttcagtggtatgaatttaaaaccaggtactatgatagcttacctgatttttggttctcatgaaggtgatttttgtgtggatggttgttcaatttggtgttcttgtggggaggatgatcacagtagacttctatttggccaccttgttatgcttgcctcctgtaattcctgtttcagtttattcatcctgaaattaagaagtagaagagaagaatggcagatagtggctttcctagaggaaaattttatatgacgtttcagaacattatttttattgttatgaaggaaatttagtacttgtaaaaattatcatactgaacagttttagatcaaacctaggtacaactacggtatgatctaagatgacatatagatctttcccattgtacttttccaatgcaaaccacacctctttcctgtctttatttttgtttctacattttcctttcccttttatttcccgtttccaggcttctccctatcttctctttttcctttagtctgttctacacaaatgtgtgcttagcagaaaattacaacctatactggagaaggaaacaatctaaatctttatatctttcaaaaatttaccccacataatattattcatgatcatgatgaaattttcaaatggttttgttttacttcaaaaaggaaactcaagaaaagaagcaaactcttaattaattgctgtaattcccatatttgcctacgtgtatatgttcctgttatccttttaaattaaacacatgaatatgtgaattacactcaaagtattcttctctgtaaaaattacagtagtcataactatttataaatgataacctgaagcccagttacttcatagtcctttaaattccatttgataagcatgttgtgtattgtttagtccttgctcgcttcatttgttcatcagccattcatccaaaaaaattttgaggatctgccatacgttatgttctgtttgggctgggctaagacaatgaataaaatgagattcctgaagtggaattcacagtccaattagagaaactggtgtgcagatgaaccgataagttatactgtagtgtggtaagtattacagttgaggtgcaagaaaactgccctgggaatcttaaatttgcctgttaagatcaacatttgagaatgttttacattggaagcaattttgtttttcaagaatgaagagggatttgtggcctgttgcagtggcacatgcctgtaatcccaacactttgagattccaaggcgggtggatcacttgaggtcaggagtttgagaccagcatggccaacatggtggtgaaaccccatctctactaaacacaaaaaaaattagccgggtgtgctggcacatgcctgtgataccagctacttgggaggctgaggcacgagaatcgctggaccctgggaggtggaggttgcagtgagccgagatcgcatcactgcactccagcctggttgacagagcaagacactgtctcaaaaaaaaaaaaaaaaaaaaaaaaaaaagagggatttgctagttagagaagatagtaaagggtatttccagcagagggatttatatatgcatgtaaggcactgttagagaatgatgttacaaagttgagtaagatggttcctgtttggaaggaacccttcttgccacttgggagatggacatgaaaacaattagccaccactcattttggatagtgatattgtaggttaagattctacaggaacatagggagatagtatttctcaatttgtctcaactggaaaagctttataggacatacaatcgtagtgctgaacaaaatagttcctgaggtgaatgacctcaatgatcacaagataatagccactaacatttattggaaggttactctgtgctagccactgttctaaacacattacatgcattctctgatttaatgttcacaaccatctgaagtagatactattattgaagcctagttaagggaaaaaatgttgaagctccagatggttaaataactcctctactctctcatggaaatgacagaactgggtgttgagctgggacagtttgactctagattctttgtccacatgtatatcccatgaaaatggaacttattaaatggcatattgtcattttatataaaatttgaacagttttatcctcacttccatttgtcacctctttaagtacatttctcactattcttcagtgtacattttctaatccaaactgactaaattgtacactcttttccaacgttatctttgtaaacttactacctctgtgcatttaatagtaaacaacctaaaatatcaagttcttcagtattttgaatagttaactgtacacatttctttatatgggtgtgggattatagaaaatttaacatttattgactgtctctcctagcaaaggaaccatagtgggtggttcttcatcacaacattggaaaatacatattattaaagaatgttatagctaagaacagtgcaaataaaccatttgtccaagttcacacagcagaatctacatctacagtttcttcacaccactttttatattcttttcctttgcatatcccacctctcaaactaactggaagccacaggcaatcttgctgcctctctcaacttagctaagtctctcccttgctgttgctcttgtttgcctgctgatgctggaaggttcaggcatccacactaattcagtaatttagaaatgtatttaattcagtaattaggatttctttaatgccagcacttaggcctcaactactgaggtatggcgtgttcactgacaaccacatgaagtgacagctgacagcaagggagaagacaaaatacctataaaaagcagacagaaaaactattaaatgacagcagactgggaccatgagcctttcctggtattctctctgtgcatttctctccaactgaaaactgacaagcaagagcagagcagctgtccacccccttttctccatgactattttctgctcattgaacacagaaagaaaaagtgggggagggagagttatttctccaggcctttcagtttgctctgtgtttagtccatgactgcttctttttccttataaagatggctgtacaacagaccaaggcaatgctcagctctcagcaactttgttaaccaattcaaggtggtttcccaaggaggcttccttacggcatcattctgttcttgcagactgcttttctgcagtgaactcttattcattctgccaggttcaaaggctactttttccctgttgctttccctggtcaaatgggtcttcaaaaacaaattctggagatgagatctctgactaacattaggaaatcttggtgcacttgcagggtgatgtttgagataacaaatctggcacctggacatggcactggagtgggagaagtttggggcaggggcatgagctatatgactgttttagcaaccaagaagtaagataactaaaacttagaaactattaatagctatggacatacaagggaaggaaggcggaatcagtgagcattgatgttggagtcaaaggattgactggctgataagcctaggaaagtagagaatggctctgatgatagaaaaataggaaagagcctctttgtgatgcagtgtattatttctatctttcccatgtttattttcatgacacagtgggatgtataagtagtgatgagttttaagcaacagaaatataaatatggaaagatgagctttctaagattgtcagtgaggagagaggaaccagaaatacattattgcactatggggttaatgacaaaagaaggaagaggtagaaaagaagggatggtgatcattgtttaagtaatagttcaggaagatggataatggaaaggaattcgggggaaatttacaggcaaagtgggaatatctgcgaaccaggttgttgggtcctaaggagggaatgtgatttgtttcttggctttgtttcttagattttattttcgtaaaatttgcctttttgttttggatttctggagttaatacttctgttgcgtacttttctttgcctctatttctcctcatacttgttttccactcttcctcatgaaacataatgtttttatctgtttttcctaatcccagtataaatcttggcatccacctttacaacaccttgaaccagataaattctacagcttctactgctctgagaactatagacatttgtcagaaactgcctgtgagagaccatcagcttttttcagagtgggtaggagaatctgaagctctagtgtggtgcttaatggcaatgaaaacgcgtcagtgtgcttgatttggaaacaggcactgccacttactagctaagtgaccttaggaaagttatctaacctcttacatctcaggttccttatctgttaaataggaaggacaataatattacctcatagggttttcatgatggtaaaaataaagaaaatatttagtggtctagtccatggtaaatgttatatgagtgtttggtgccattattattgttattgtgttcttgttattctgatgtatcagtatatagagttaaaacatgtgtatcgcttaggaatatatccaacttttagacctaattttattttttagtatatttgagaaagttatccttaaagcagttgcttttattttaaaaataaaatgtttaattctgtctctgtaaagaatggataatgattacatgaaaacatatttcagaaagaatggggataagtagcattgtttaaatctaaaaattatataaataacatgaaagatacatggggaaaaaattaggctacatatagtgttacagtcatcaaaatgtaccatatttagcttaaaatattctgcaatactaactgttatatgggaaccaattaaaaaggcattcttgaggatatttcatttcttatcaggtaaataaatgctctgccctccataaatctaccactatttcattttggggaaggtcttgttttgattttcattgatgcacaataaaaagtgactcaagtcaattgtttccattgtctttcctatgtgtattcatttgtcatttattctttaagtgacctgccttctgacaatccttccaagcttcttatagtagcaagtatccaatatgctgaccttacatcaaagttactttttctattgtttgatgttattatctgtgcttaaaaaatgactcgtgtaaatatgtgtcggtgtacatgttaacatggcattttctaaattgggtggctttgtaacacatcttcctcaatttaagcaaatactgcctcaaaatatcttttaaaaaagcctcatgtatggaggttgcagtgagctgacattgagccactgcactccagcctgggcgacagagcgagacgccatctgaaaaaaaaaaaaaaaaaaagcctcatctagcagtttacagcagatgatctgtgtaagacaaaattaatagctgtatctggagtactctaaatgtggatttatacactaacctatatattgatcaattcctctatgcttgctttggttttgagcaaattatatttaaataagtttgttgctaggaatgtcttaaaaagctactcaccctttttgttagaagtaagtaaaatgattatgtcaggacctgccattaacttggtatagtacgaatatatcctcagaatactgataaaatggtatgtcttgaaacaaatcacaaactgtcaatatgttggtgatgaatttcttctgttttcatttggatcagtaggtggggcagttcaccaagtgtgagatcgacatttaatgttttcatgaaatgcaaacccatcagtggctaatttgtgaaaaatagatgttgggcttttcttaaggctaaattgttcccatttgttttagagaacaactcacttagcctatgagtttatgcaatttggcagaaagtgaaaacatatttggaagtattgaaagtcactcattgttgatcttttatattggaatgccaaggttgcatcatcagagtgtcgttatgaaaaaaatcaaataaaattagaagaaagaatcagccttctttataaacagagagatactatatattttaggctactgatctttactgtgtctgtataaaacgttggtcatgttgatggagtttatgctttctctcttcaggttcattctgacatgtcaggatatggaaagtccttttttccccccttaatagtttgagactgtagccactgtttccagaatggagtgctattgatacctttgacaagttgcttgccacaaagaaaattgctcaaaaggagctgcccaattcttagctgctatgtatttaactgttgtcacggcttctgttgtttccaagctgtcccaccataatgtaatttgttttaatctcttaaagtatatcattgcttacatcattatgcccatctactttgtttatagctgcctcagctcatgctgcaagtcttcatggttgtgtgataagaaagagaatatatcagtttcacggagaaacgtggtggtggtctagtcttgctggttaatgttgaatgtgactattttttaaatccttggcacgactggcagtctgtgaggtgtgtcacgggcctccatcatggtggtgggtatgaagctgtgcactacttctgtttttaacaccttccttggagctgcctgaagaaaattgcaggaattttttaggcacatctactggaaagtgcttattttaatatttgtcaacataattaccagaaaacattaaccctgaagtgtgtctctcaatacaaacttgataatcactaaatatttttaatataggcctttgaggaaaacatcgtaaatatcattagtcttatttttctctatgaattttatttactatacattagttgtttagaattatcttttttctcctttgtttgatggtagtgagagaagaacactactttttggaagattataaatagtacattaagtgaaaggtcataaatactgtaaaacttcaataaagcactgggcaacaacatgaattcacatatgcattgaatggggaggaagagttaggaagtgaccctcaagaatttgggaccttctttgttcattttacagtcatatatgttcaatgtaagttccactgtccttgttttaatgctttcatgagatgatatagataaattgaaatatatggtttttaactaaattcaagataacacaagtctccattttatgtaatttaattttttagactccacctgtgatcttatggcgcagctcgatggcagttggaggtgcaagtgattcccaataatgaatcacctttcaaatgtttcaatgatgatgtgatagaaaagacagctgcagtagtgtgacttaaaaagaaattacctgactgcccttttttcccaattactggcacaatcttcatgaaatccaaataaacttaatagaaggaggaaaagccatgtgagtggagctgacctgccacaaattaattatacttagtactttgtgccagcatggcatggtggagagccaggactcgagagaaacacataaatatagcaggatcttagttgcctaggtgagcaaggaaattgctgcttgcaaaacatgttggaagttattagttagcataagatgttttagcatttgcatttattaatctgacttatgcatttaaaatatgtttctgtattttacaagaccagatctggaggaggctaaatgccccaagtttcctttcacaccaacatcatatgctcatatatattcagttgattaattattttaaataaagtgcagctgtcttgtcatgttaacaggcctctaattttatttgcctattcatatgtgaaacaggagaggctagcatcttaaaaattcagtgtaaaagtttatatgtacatgtttattttataacattttggggtgatttttaaaaattatttttcagacattgtcaaataaggtagtaaaacaagattcaggtattattggttcttcatttttatttttatgagaagtactgcatttgctttgctgctattgcgacagcattgccagtagaccaacatataccacatatacttttgcttttaaatcctgcttaagatacattgattttaatagaggaaattagtgatatattaaaaacccatgagcttaattagccattcacgaatgactagtgctatattctatttgttattgttttaattaacagactactttttaaagagcattttaggtttactggaaaattgcatggaaagtcctatgtatatgctcatctcctccctgctctccagtttcccctattattatcttgtattagtgtggtacattttttacacaataatcaatattggtacattactaaagtccatagttcagagtttactctctgtgttatatagttctatgtgttttgacacatcatgtatctaccattttagtatcttacagatgggtttcactgccctaaaaatcttccgtgccctacctattcatgccttcattcctccctccaaacccctgacaaccactggtcatttttctgtcttcatggttttgcctaaatctttccggattctttcactgagcttctgcttctttcactgagcatttaaggttgttccatgtcttccaatggcttgaaatctcatttcttttatcgttgaataacattccaccgtgtggatgtaccagcacctaccaaaggacatcttggttgcttctaagttttagtaattatgaataaagctgccataaccgtttgtgctcaggtttttcctgtgtgtgtggatataagttttaaactcatttggataaatactaaggagtatgactgctcaatcatggtaagagtatgtttatttttatatggctggtgctactttatccctatccctccagttttattttgttttgttttttgatatcggattaatagaattgaactaatcacaatccctttgttcttaacccactcttatcattgatttgagggtgactttttatttaattagttatttatgataatatagtaagtacttctgacctcaccacccaatacaaaatctagatccttgacaatcacatatttcttaagtgtgtgtactcctttgcatattccttgcctcccctaacctgaggccagtgctattttagttttaaatttaataatgtttccatatatatattctacatatatggatggaattctaatatatatacggaatatatatattctaagagttcaatgattatttaagacatacttctctagaataatcatccaaataatttaaaacaagattttgcctctgaatatgtaataggcattaatagattttcacttggattttctaacattagtttttatccattttgatgccattcctagtattaatgataaatttttcattggcaatataaaaagaaagtcttctgctaaaaaaactaaggctgttagtgaagttataaaaatcacaaaagactaggattgtcgcatcattatgtgaaacagatccttgggggaatacatcagattgtaatgccacgactcctgtattttaaatctacctgcaccctaaagctaatggcaataatgccatttcaactgaaacatcaactggattaaaaaaaatcctaaaggacaaggaaaattcaagctcttggctatgcagtgctgcagttgacccattcacttctctgttcaggtaatctagttaacacaggcttcagtatcaattcattttaacaaaggatggttaatgtcattgtttgtaacattttctagtgagaataaacctgaagcatactatataaataagcccttgcttgcgctgactcaggaacacaattcttaatttacttagtgctctctgcagctacttgtgtatgtgtgtgcatgtgtgtgtgcatgtaggtatatcttatggaacttgcttctaattaacaatacattagtcctcgctacttctaattagcaatgcggtagccctgccttatccacagggggatataaaacccacaatgaaactgcggatagtaccgaactctgtaaatactatgtttttttcaaatacgtatgtatttacaacaaagtttaatttgtaaattagccatagtaagaaactaacagctataataataaagtagaacaataaaaacagtatgccagcatcactactcttgtgcattagggccgttataaaatagggttacttgaacactagcatgttacctctacagttgatttgataaccaagacaactactaagcgactaatggatgagtagcatacacattgtggatatgctggatgaaggaatgatttatgttccaggcgggatggagcaggacactgagagattgtatcatgttactcagagtggtacacaatttaaaacttatgaattgtttatttctggatttttccatttaatatctttggactgcagttgaccatgggtgactgaaactgtagaaaatgaaaccatggataaggagggactattatagttaacttttggacatgtggtgtttgtagtagcaaggtgattttgcagttgtactcattatcacctactgacaaatattattatatataaggaagattatttaagccatccaagaggaagttgcaagtaagatggacattactcttggtttcttcagatgttcttaactctttgagaagtaaaaagtctgtctttactccagaaggtaagatcttgctggatggggaccatctttcattcctcttagtgtccttagggacttatgcaaagaaagacttttttttttcctttttgagaggggatcacactctgtcacccaggctggggtgcagtggcacgattacagctcactgcaagccttgacctcctgggctcaggtgatcctcgcacctcagtctcccgagtagctgggactacaggtgcatgctaccacgccctgctccttttggtaatttttatagatttgggtttcaccatgtcacacaggctggtgtcgaactcctggcctcaagaaatccacccgccttggcttcccaaagtgctgagattataggcgtgagccaccagcaagaaagtcttaagtattattgctgtatgaatggatgttgagagcttcgagtaatgtgtttagacttaatattacaaaagactctcctaaagagcaaagaatataatgtgaatgacgtaaaggtgtataaatgaaattaataattaataaattaatgaaaagtataataattttgaaatataaggaatagttaataagtagaatagtaatagaaatgattagggaaaataagtcattggttattaatatgtgagtacatttgataaagaaacacgctctgaggcttggtgagtggaatgtactgtatgaatttacactatagttcccattcaggaaacagtgactaagcacttcctttgtgcggagtactttcccttgttctggggttacaaagaggaaattatatgattattgtcatcaggaatcttatagtataatagatcatcgtgcctataaagaaacagtctaataaaacagttgttataatggaagcatttgctaagtgtcaaagcaatgggaataacagggaaagaaaacctaagtctgcattactggaggtgaagctgtgaactactgatagagagtaggatctattactggactgggaatcagaagaccaatttataatcccagctctgtactttctagccctgacatcaagcaagtcaatttacttctctgaacctttttccttcaatgtaaagtaaggataataatattaggtctatctagttttaggattatattcaggataatgagtaactgtgaaaatggttagcctataaaatgctatgtgcatttgcatataagctgctttcactgttgacagtgtgtggtgttgtccaacctgaccacctttgtttggaagatggcgtggtactatttttcttctggtaggtggaatagtaaaagttcagctgtgaaggttaatttttggggaagaagacctgcattaattctccaggtagatgtctatacacaaatgtaagctttttatttacaatgtaagttatttacattgttagctttttctctgaaaatgtttcaaaactattgatgagcattttatttttagtaaagttatttcattataaaattaatacttagttgtggaaaatctggaaatatcattggcaaatttggaaaaaaaaattgtatacatcaaaaaattattgtcatctggaattctgacatcccaagataattatttttaacttttaaataatattctcaaaattcatctcatcagagagatttatgttccttaaaatgttagtatgttgctgggcatggtggttcacacctgtaattccagtgctttgggaggctgaggtaggaggattgtttcagcttaggaattcaaaaccagcctgggcaacatagggagaccccatctctacaaaaactttaaaaattagccaggtgatgcacgtctgtagtcctagctacttgggaggctgtggcgggaggattgcttgaggccagtagttcaaggcttcagtgagctatgatcacaccactgcactccagcctgggtaaaagagtgaaaccctgtttctttatgtactatagggatatgttaagtatttggcaattacaaattttattcacatctagacatttatttgataatttgggtttctaactcttattagtagtttgaaattatttattataatgttttgtcattggaaataatgcagattttattttcagactttaattactttatcttggatattagacttgctattcttattctttctttgtttctaatattttctttctgtttaacttcattcaaaatttcatggtttgggtatcattctgtacacctatgaattgatttagattattttaaagagtataccaataatacttacaaacacatatctagtgcttgctatgtaccagacactgctctaagtgtttaatgcacctggactaattctaacagtaacccaatgaaaactaatattttcctcattttataaatgagaaaatcgaagcgtaaagagcttaagtaaattaaccaaggtcacacagctagtaagtgggagagctagagttcatacccacactgtctggattcatagctcagactcaactctttcatcataatgcacctcttgacttacaggacatttcgttagtgacaagaatttccaaatgtggcatttcattttctgttctaagtattttttaggacagtatattggaagcagatttgcattcatacctatagaagtaagaatgtagtcattaagggaaaagattataccatgttgctataagagatattttagattccgtgttttctttgcaatttaccttttacctatataaatagttcaaataccttatcttagcagtgatgctacacataaaacatgttttattaaaacatagctaaagatgacaaacctgcttcaatattaccaaagaaaatcagattacatttggaataaataatcaacaggcattcaaaaatatgtaagtacatagttcagtcttgcaagttatagtctatctaaaaatatataggtaagtagtagtctgggaagaaattatagccatctgcaatacagtgagatggatactaggggttttcttacatatcaactcatgcaagaagatactgatattgtttctttagattatatgggctaatcaaagcaaattagaaaactttacacttttaatttacatttaaggtattttacctggaaaaatatttcgattttatgtgtagattttgctaaaaatatgatattgcatttaatgttatcagttaatgttaccaaactcttctaaatggagaaattctgtgagatccctggtgtctctaaaacatttggtaataccttcaaatgaacatccagcgtattcatatctacacatattccagagccagtgtctctaaaacagatagggattcagatcattcccacatcagagaaagacatgctttagtctgtgtaggttagggaggcaagagtcaccctctttgtgtgtgtcagtgatttatcactcttccacccaaaagaaggcttgtcctctttccctcaaccctgttagtgcttgggggtttgtgttcaaacataaattttgtcatagctatactatagtagcagacatgaatagattcacttatatttccatttatttctcctgagtatgatctgattagaagaggtaaagaaacaaagcaactagccaatatgaaaggcatatcattaaagccagaataaaatctgactgttcttgatttccatctcaaaataactgatgtctttcctaagttgagaatgacctgatctgttaaaaacagattaactcatcaattctgaccaaatcttcttaagaaggctaataggcttctgttgactagacaccattccctgtttcatttttctgatatcctggatgggggtcggagtgttgttattcctgagaaaatcgatatatcactgtattggaaacgtttgcttgtggtagcaacagtcttgatgtttgatcatgttaggttttatgaagtgttgatagatttagctccagacttaagagttacctacccaggctgggtgcggtggctcacgcctgtaatcccagcactttgggaggccgaggtgggcggatcacttgaggtcagaagtttgagaccagccttgccaacgtggtgaaacctgtctctactaaaaatacaaatattagctgggtatggtggcatgcacctgtagtcccagctactcctgaggttgagacaggagaatcgtttgaactcgggaggcagaggttgcagtgagccgcgattgagccactgcactccagcctgggtgacaaagcaagactctgtctcacacacaaaaaaagagttacagccgggcgtggtggctcaagcctgtaatcccagcacttcgggaggctgaggcgggcggatcacgaggtcaggaaattgagaccatcctggctaacacggtgaaaccccgtatctactaaaaatacaaaaaaaatagctgggcgtggtggcgggcccctgtagtcccagctactcgggaggctgaggcaggagaatggcgtgaacccgggaggcggagcttgcaatgggccgagatcgcgccactgcactccagcctgggcgacagagcaagactccgtctcaaaaacaaaacaaacaaacaaacaaacaaaaaaacaaaaaaaaagttacatacccagagatcaattgagaatgcaataatctctaaaataaatcattactttttagtagtctagaaatcatgtggtaatattaatttttataagtggtagaacagagtaataaacagtttcagccatctttctcctaagtctcagttaagagtttctcctccattgtgaaagctgaaaatgggaaagaacctattcttcctgtctaaatgttgatatccttggactctaggatccagtagagacttaggtatcaacaccaagtatggcattaccttacaacactccaaacagaccctgattcataatagtctgtgctcttgcctgaaaactttatatatgaacatggatatgtttatttgaaggtatgtttaatatgggccatgaggacattatggttacctaactgaggatagagataataaaagcattttagaatcattgtaatccaaacttgaaagtagaaacttcactttaaaaagcaagatagtttatattttgatagtgctcccaaaagttgaagattgttcttatggggactcatattgttgcatagttgttagtaaaataccatttataatacaagttctgttgccatttggttaggaaataaaaagtaaccaatgtagtaaatgctcaataaatatattttgattatttgttgaatgcattaacatataattgtaaaaaaagtagaaagcacaaatcttagatggaaaggatcatagaactgaaaacataatataattattttgcagtacatctgagttatattgtgatgtactttcctaaccaagtccaaattaatcaggagctctgggagaatcatccctagaaacaatgcctttaaatagagggtcagaggaattttcgtatttctggatttcaaactgcaggtggctctcttgatctttcagttctgaatttaggttaaagactgctgttctgccttcttcctgtccttgttacatccagactatcagacttcctgttgaaacactgataattgtcttattattggattgtaagcaacatcgctttttctcacatgtagaagatagagttttttttgtttgtttgtttaacaaaatatattgcttggccttcctttaaaatggctctgatttgcctttgcatgtcttgtgtgaggagttgctaagtatcaatggcattgttgataatgcttgtaaaatagcatatcagtattctagcattattttaaaagaacaaaaaacaggtgattctaatcattttccttcctctcattttctgggtagcattgctgttttatctcataatttattttgtacacatctggtactacaggaattttaggagtcccaaaatgaatatgaaaacctgttgatacaactttaggtggaaacctaagccttatctgtccttttattcattctgatggttattttaaagaaattgctggataccattgaagtatagagatacaaatatttttataaattatgtgccgaagtaaattataaatcacatggcttatagtgtggattcttaaattatcaatcatatcacttcatatttttataagctgaatatctaattcttttgcaaagtaagttacgtgcaactgctaccttttaaaataatagataaatctaaaatatggtgggtgataaagtgctaaaaagatacttcttagcaatacttaattgtgttacaactgtaagcaccaacagccaaaagattgtttgcaataaagaccttatactaagacattcatcaagtaataaaatataacctcaaatgtctaattctaagtgatatgtgccttataaatatacttgtagtagtgctacaaaaaaggcacagataccaaactgaccttaaaagtggcacatgtggcgttactgcagctgggctattgtcttggagattcacagaggaggcctcccaggaattatttgtatgttccttttgtgtaaagtttttgtctggaaagtcgctgtgcaaacagtagctgttccatagcacctgcttctgttgagggagagtgagtcttttatttagagagcatcggtagccatttcattcattactgcacaatggacttacataaagagcagcattccaatgacgccaaaagaaaccagagcttccaacacgctgaggcgcttgtaaacattgagtctccctatgtttctttctaaacttttcttgcaattacatccaggtctttattttgaggaaaaaaataattgattcagagcaataataggaaaagttataaactgcaatttttaatttaaaaagctgtattatgtaaaatgctgtggcaatgtcatatataagcttggtcatttacataattattgctttaatcttcttaaggtattagaaaattaattgcattatagaaataaggatgccaaaatatttcatagaattttttttaatggtcatggaattgttttcagtgtgcctatcttcctaacatttaaatgattttattattttcgtggccaatcatcttcaatatgatgtcaatatccagtgcatctgctactttccagccctttcattgacccctggcagtgtggtacccatgtttgttactctactgaaactactctctctattgcctctagttcctaccttctaaccttttctctcagctattatcattcttcatctttatgtttgataagaccttcctgatacatcttctcttggttttgtttttgtttttcaagaaacctgtacccattagcagtcactcctcatcttccatcctcaaacccctgcccctgtcaatcactaacctattttctgtttctatgtatttgtctattctggacatttcatataaatggaattacataatctgtgttctttttgtctggttcctttcacttagcttatgcttccaaggttcatccgtgttgtagcatatatcaatacttcattcctttttatggctgagtagtattcggttgtatgatataccacagatggtttatccgttcatcagttgatggacatctgggttgtttccaccttttggctattgcaaatagtgctgctattagtgttcctgtacaagtacttgtttgaatgtgtcttttgaattctactgggcatgtatcggtatatatctaggagtggaattgctgggtcatatagtgattctgtgtttaacattctgaggaactgtcaaacagttttccaaagtagctgtaccatttcacattcccactagcaatgtaaaagggttccagtttctccatatcctttgcaacacttggtattgtctgcttttaatgttagccatcctaatgagtatgagaatattatggttttatttgcatttccccagtggctaatgatttcgagcagcatttcatttatttattgcctatttgtatatctactttgcagaaatagctattgagatcctttacttttttctttttcttttttttttttttttagtgagacaggatcttgctctgccacccaggctggagtgcagtggcacaaccttggctcactgcaacctccacctcccaggctcaagtgatcctcccatttcagcctcctgagtagctggaactacaggcacatgtcaccacacctggctaatttttgtattttttgtagagatagggttttaccatgttgcccaggctggtctccaattcctgggctcaagctatccacctgcctcagcttccccctttactcatttttaatggggtcatcattttatcattgaattgttgcagatatctcccattctctgggttgtgttttcattttcatgttagtgtcttttgaaacacaaaagttttaacttttattaagctaaattgatctgtttttttaattgtgcttttaatgtcatatttaaaaaactgttgcctaatctaaggtcacaaaaatttatacctctgttttcctctaataatttcattgttttacctaacttcattttttttccatgtggctatccagcatccctgcaccatttgttgagtctattctatttcataattgtcacccttatccaaaattcattgactgtaagagattatttctggatttttatttttattccatcaaactgtatgtctatctttatggcagtacctcaatgtcttgattactatagctttatagtaagttttgaaattggcaggtgtgtgtcctctacttttttcttcttttgatacatactgacctacttagtcttctgctttcttatgatgatcagcttttcttcccactagtttgtgactcaggttcctttttaacattcttcaatggtttccatcacaccaagcaccgaccaccattaccttctctgatggtttcatatgatcccattttcttcacttagaaaaatattcacagagtcacaaatcctgtctaattaattcatatttattagatgaggaataagaaatggaggaaaaagtcaaaaatcttaacacagtttttaaccacccctgggttgcccacttaacatcattcaaatctgcagcaaaaccatagaggagactaaggtagtagggatggagaagagaaatttttgagaaatcctcaaaaggtataattaacgagactattattgatagagaaataattgggtactggagagaacagtaaaacaagtccattttgctatattttggcaaaaattataatcacagctattttcttttttttctactaataattggatggttatgtttaagaacagtatgacaaaatatcattttagttgaaagtgctaaaggatgatacaaatatttttgatggttttgttatacttactagtaatctaatatgacagtattatgcgtacatgtaccatgccttctcgtgggatacaagctatatttggcagcagggggaaataacaaatcacaagaataaagagctcatatttttacattcatattttcagaatgactttagtgtttccccttgtgtttcccatgtgtgtttcaaatcaccttattcaattttgctatctctgactcagatatagtgtactatacatatataatctgtcatcagtttcatttttaagtggaaaattacattaacctctggattttcagtgaaatgtttttcatggcactatgaaaacacaatagtgtaaattgtaccatgttgacatagctaattattcaaaactgggtcatggcttaaattgtagtgagtagaaacatacgcttaaaataattgtaagccaataactatactttagagactttgtgcctttacttgtcatatttttgagactcgatttgatttcctgtttagtttaacaaattattttactcagggctttacaatatctgtccagctcattagttgttacttcttttaccctttttatacttgttctggcttttcaaggctcactgattaaccaccctttgcagcatttctcagccctggtgtgttagctgaagtcatactacttagggagattttaggtattttctgtaagtgatgtccatgggtgactttaggggagccatttatgtatggaggccactggctattggagcctgacaagaggtctccataactagttttcatcagaatgcaaaatgataaaattttgaggaataaccttaggcattcattggaacctatggggcgggagggggggggacatcctaaactgtgataataaaatacagaaagttggaaaaataatggaaaaatctataattctataaactttacagcctacctcaatgcacaaaaggtgtttattatagtataatgtattcccatcttttgttcaagcatcattccatcaagggaatgcccactgtatttaatcttgttaacagtatgttaattgcaagtgctagttgtttttctgctttcttttgtcaattcacatttattaaatgcatacttattttctaggcactgtgctgaatgctaggggtacataaataagactctgtgtcctcggggaatgcaaggatagtggggaagatagataggtaatcaattattatcataacatgtgtaaatgccagaaaagagaagagtaggatattgcaggaccacagaggggagaaggccaccgaactccgatgaagggaagtaagcaagaattcccagtagatgttgatgccagatctgaatttcaaagtcagaatgggaattagccaattgaaaaaggattgcaatagcaaaaaattctagacacaatgagagtacacattgaggcatgtgttaaggtttgagaaactgtggtgttttcaagaaactctaagttgtttggtgtaagtgataggtagtgtacttttagggaaagtggtaagaaatcagggcataaagggatgaagttacctactcactaatggcctagcttgcagtatttaggagtttagattttattctaaaactaacatggaatgagaatatgttaagcagagaagtaacactctcagattaaataattataaagatcactctgattatggtctgagagatgtttgggacctggttggggatggagaaggggccatttggtcttgaggcagagactagtctggagcttcttgcaatataaattgaggcaagacattgcacatgtcataaagtagtgagaataagagctttgtacatattctatatagagaaaaagtacaaaatttggttttagaacttgataagggctattattttacattactcaaattactaaattacggttctatttcctgaatttatccttgtcattttgattggaattttgagtgttggttaggcaatttagtgccagatctttgaactgatcagtttaatgccactagatagctattaataataatagccattatctgtaggcttttttctattctaatttccctaatttttaagctcttggggggccagtgtgttacctcattcttgtctctttttacatctattactgctatgctccgcttaaaaaagcactcaagtccacaaatcttagtgtaaaggaagtatttcaaagagattatctcaattacaaaagaacttgcataagtttcctggaatatttttaagagagtatattatgaaaacttaattttatttgcaccctttgcctaaaggatgtactgctttgtttcagagagtctgacttatgtgactaactactttggctcttttaagttttcagttttcctcgaataattcagtatctctattgggatcattaactgtttacttcacacaaccatttactaaagacctggtctactcaaaggactataattctaagtaagacagtatgatgcccttaaggaacatgtgtaaaccattgtatggtatccttcccaagggttctggattctgtattttgaaagtctcaaattcactgccagccatctacaaagaggttgcttctttttctggtagaaaaacaattcctaatatgctataaaaattttgttgagaatatttgatcttcagatatagttaggtttccatagatacatctagactagatatccattccgtgtcaagaaatgaaaatgtgagatttttatgagcaagattagcaaacaattaaaaccagtttccaactttaaatatttgaaatcctcacattcacagtgtactttttttcctaagtaagataatagcgtcagagatcagaaagatgccagatctaataaactaagtcagctgcattagaatgctagtaaatgtccttttgaaaggtcatctccattagtccttttgttgctctccttatagggtttttccccctctttctctctcttcttttgaaaatggtcatagcttactttagctaaatagagaattttatgaattatttaaagtctctgtatttaaacaaaacaaagcaatagagaatgtctaaatagtataacaacataagtaaacactttctttaaagatgtttgaaagaaaagagctggaaaaccaaagttactgtcacaaggattggtaaattccctcaggataagttactttgtggtacatatcagtaatttctttttaaagagttgctggatcagtgtaaattttcaaactctaaataaaactatatatgttccatctatgtcttgatgatgataaagttatgagtagatattaattacaagcatcctcaaaagaaaatatacactggtataaagggccaacatgattttaacttgctcttttgatgatgacttctaatacttcatgtctatgttgttccagtaattagcatgaaggaactgccctgccagctgggaatgtcttaaagccatcttcttattatcttttaagttattgataatgtaacagagattttgaatttaaaatatataaattctgaaatcatttttttttgtagagcagacattgttagtgtgtgcatttttttttttactgtgacactgttttatgaattaaacttaataaaggcaagtacttgtattactgctaaaaatgaaaaccaaaaggatccagatattgccagataggatttggtcagaattatttgtttatagaaattaggattttaaaaagtcaatgaaaaatataagtgttccaacaagcattgtagtccacttttattattatgtatgtagataattaacagtttcaatcatattgtgagtagaaacgtatgtatgatatagagtgatctttaaaataatctacatggtatatacagaacagattttttttaatgttgttagcctaaggttccaaaaaataggaaagtggaaatcaatgtggaattgtcaagtctgcaaaatatctttccttgggattgtacagaactcattctaaaaaaaaaaaaagtcaaaaacttcatcctgcagcaatgttctttcatgacttaggactagaagaaagagagaaatcagactaccatcatgtaacgatttaaaaattaatccatacttgagacccctgtaccactgagttttttttaacataacctcctcttttctcgtataaaaaaactagattcagaacattacagttgaggaggaatatattaccattgtaactactgaacactctctattacttaatttttttaaaagtgtgtatgtgtggattggatacagtaatctaggaaagtctctgtgtaacagtgagcatggtatttttctagacattgttggtctcagaggtccccattaaaaagaataagagttgctacttctcaaaccttgtcagatactgggcatattacctgcatgcacaatggagggtttgaggataccagtctacctttgtgataaccttgtttatacacttacaaaacatatcggctagtgtatgcattatttctacaacactaccacagctttgcttgtaagattttgtaagaaatacacaagaggaaggaatcataggccttggattctgaaatgtctaattcagtcacagtgatgcagtgctcaaatgaactatagcagatttaatgagcaatccaggacagagacacatgtactggacacactagggaaagagattacgtgtacaggggctaattagcatgaaatatgaatacattcatataagtagtcttgatctatgggacgccttcattattgggaatgatttttgcatgaagttaatgaagagaaattcaggagttatgctgtataaagaattttaaaatagtattttaactttttgattctgcaaagtctcaatttctggagcaaaaaagaaattgcatatcatgaaatagtatgagcaaatgaatgtggatctattttctacagtgtctaaaatataacaaggtggggaacagtagctatccttcatttaactgattaatcaacaaatagacttcaatctcttgaattagatatgtacaagatattgagtgtcagtttgatattttaaataagggaatgtggtcatagtgtattccagaatatatacctctagccagatagttgaaaggcttggattcagtttgttgggtattctaagcatctttaccaaagaaatcagtcttgaagcaggatttagagaaagaatggatttcgactggacatggtgcctcatgcctgtaatcccagcactttgggaggctgagatgggcggattgcttgagcccaggagtttgaggccagcctgggttacatggtgagaccctgtctctacaagaaataaaaaaattagctgagcatggtggcatgcgcctgttgtcccagctacttgagaggtagaggtgggaggatcccctgagaccctgtctccaaaaaaaaaaaaagatttcatttgttttaagtttggttaaggcttataggaaaaggagccagagaagtgagaagaataatatttgaaaatagaccaggattgtaatattaatttgaatatcagatactttattccatttaaacaacagttttattctaatttgaggtttgaaatttaacatatgaaaacttggaatttaaaagaatttttgataaatgttaaatattggaagtttgagaaattaagctgatttttgccactgcccttcaaaaaagttcaacattgtattgcttaaatatgtggctatatttatgtaaaatacacaattaatattaatattttattatttcgtatctgacttcaatacatttttatgtgcttcctgtttgtggatatcttagaaactgctacagaagtcaatattcttagaaaattcagtaattcagagatgtgaaattagaacaataacagcttaagtggtttataaacaaagattatttgcaagaaatagaatatttctgtgtaagttcattgggttatgtgccatctagcagaaaaataggctgtgtatggtgtttatgttcagtgttctcatggttgcccatggtactgaactcacacctttatatgtgcaaaatgtgtgtaagtgaagcaaggagttagtggagctggtaatcagaatagaataggaatgggaataaatttagaagtgaccatcattctctctgtcccagctttgaacaagtcaaaatgcacatgattttgtacatttcattatcagggcaccttttgagagagagagtcgattgacaaaagatgggtcgtaaatcagactaattctttgtgtgactgctctttgctttatgggaacatgtttgactttagggacataaacttcagggaggtgcaataggtagatgacaatcattaaaatagcagaagacacttgctgagtgttgagcatttaaattgtgctaaataatgtgctggatgagtttacctaagtctcctcatttaatgctagcagattccttgtaagatataggtactatttttttttaatctcagatttatagttgaagaaacaaaggtttaaggagataagtattttgcttgaagttacacaacttttaagtggtagatccagtattcaaatctgaatcattcatacaattgaatgtatacctcatttaatttagtaatatattattcttaaacattgagagtaacaaaagttccttttgaatccgtttttctatttagctaggcaataagatggcctcatttcatcttttgtgtactttactgtagtacagctgtgagaaaatcatactaggctttctgctggttagatctcagacatatatgtatatttatctcctgctgcctgtcgaagcactttttgctcttgcaaatgcctgtaatctggcctgtatgtcctctgtcactgtaggttccacaaaatagggtctctttccttcctgcaagcattgccttgggggatattttcatgtttccttttgtgttcattcatggcatgtatgttcattttataccatttaggaagcatgagagattttaaaaaggtctcttgaatttatatgacgcaattgcaatttagaagtaaccatcattctctctgtcccagctttgaacaagtcaaaatgcaccttaacgttttattcattttgctattctttcagtgatggtttccctatgtctgcggtttttcgttttttactgtgtgtgtatccttatatttttataagtactttattctggtatgtagtatatactataacctgctttttgaatctaatatttattcttggaacataaactaatattctgcaaatacatgattttattggctctataaaactcccttgtaagaatatactatgatttattatcattattttttaaatttcaatagctttagggtaaaattggttttggattacacggatgaattacatagtagtaaagcctgggctgttagtatatacatcacacagatagtgtatattgtacacaatagatactttttcagccctcatccttctcccaacctacccccttctgagtctccagtgtcgattatcccaatctgcatgcccctgtgtacccatagcttagctcctacttataagtgacaacatgcagtatttggttttcctttcctgaattacttcacttaggatagtggcctccggttccatccaaattgctacaagaaatgttatcttgttcttctttgtggctgagtcgtattccatatacacacacacacacaccacattttctttatctgctcatcagttgatgggcacttaggttggttacatatctttgcaattgtgaattgtgctgtgataatcatacaagtgcaggtatcttttcgatatgacttattttcctttgagtagatatccagtagtaggattgttggatcaaatcatagatcttttagttctttatgaaatctccatactgttttccatagtcattttactaatttacattcccatcagcagtgtaaaagtattccctttgtaccacatccatgccagcatctattgttttttgactttttttttttttttttcttgagacggagtctctctcagtcacccaggctggagtgcagtggcgtgatctcgtctcactgcaacgtctgtgttttttgactttttaataatggccattctgactgggataaggtggttatctcattgtcgctttaattttcattttcctaatgattagtgatgctgagcatttcttcatgtttgttggccatttgtgtatcttattttaaaaaatgcctgttcatgtgatttgcccacttttcaataggttcattcatttttttcttgctgatttatttactaagatttatttatttccctgttgttcaatatttagattgtttcaaattatttgatattattatgccacatagaatagtcttgtatataaatccttttgtaaatttcttattgaaattactggtggaaggatatgagttgttttgaactcttgttatgtattgcaaatttgtttctgaaaggctttcaaatttagattcctaccagccatatgtgagtagcaatcatttagaacactcacaaatactgagtgtcatgattttaaaaaatattatatttgttaaattgatgggtgaaaaactgtatcttattgtttttatttatatttatttgcttactcatgatgtttaaatagctttattacatattgaccattcgttttcgtctaatttttgttcatatagttttactcatttttgttttacaagtatagtatgtttcttatttctttaattatatttatatgtttatattaacccattatcaccatttttgcagtttgcaattttttcctgaagttttcatttgcattttaattttgttttaaagtattttaagataacctgtagtttttttgtggttgtggttgttgttaaaattagtgggaccgttgaaactagaatttcccttttagataaaaattttgcattagttacttcagggaaacagaagagtataataattgtgatagggactcaagagaaattatacaagtggtgctattcattatcattggcttccattcaaatggagctggatttgttattttcctatttctcttcctgagtctccatttgtgacagtctcttggcaggatttcagtctacttctaacttttatacttgtggttggagcccagccagcttctcctgctttctgggaggagctcactctcatcgtacatctattgacttgcatgtcttgtaatggtaaagcaatacgtggaaggtattcaagtttcctgagactaaagtgggtcatatctctgtcccaaaactgaatcatttgaaatctgaaagtgactttaaagatcatcgtttaaaaatctcaccatgtagatgagtcaaatccagagacactgcttttgcttgctttctcaggcacacagacttcactgaagagtagtaagcttgattgattctctgacagctacattatattgtagagaactttgttgttattgatctcatttacacatttaattcctactctgtatgtgggaatataatattttactgatttaataaaccaggcatgatttcttattgtgtgatttattgtgtggttcttttttgtcacaaactttgtaggttgagacttggcaagtaacctacccttgagggtttttttttttttttctcccagatgatggtatgtgtggtagtctctctaaggcattattatgaagacatttattaaatctcggtctatttgagtgccacctaacgtctagatctctcaacagttttgcctagccatcatttctcagcttgggatggtgtagagaaacatattattcccacctgagcttatagaactgtagctaacatcatcagatatcagggctttgagcaagcctgcttgtgggtggtttatcttttccagtgatttgagacttgtgttgcattgaatatactttgaatttcacgtgtatctctgctctattagtctgtatttgggttgttttgaaggatttttattttaatatgtagactgatacatttttgtatatgttgctggaggcgcttttgcactgctatgttttagaaatcaaaataataaataatgcatatggtgttcattgtttttctcctctgtcttttgatgactattaagtttcattggaagtgttagtaacatttctttatttttatttttactattttaaaaataatagtaataataataataaacgtttagctttttagccaggtgtagcatttcctaatttgaaaatgtgctattcattttttaaatagactattttgtagagcagttttaggcttacagaaaaaattatgcagaaatctcagagttcccatataattttcctctccttcagaatttctcacattattaatatcttgcattagggtagtacattttttactgttgatgaaacaatattaataaattattatccttaaagtccatagtttatatcatgattcagcctttgtgttatacagttttatgggttttaacaaatgtcttgtctactatatactgatatttgacttatcctttgatgacagtgtaatcattccttacatggttcattcattcatttcctcatttcatatattttttcctgtaactatttattgagtacttcttgtggtaggcattctgacagatgctaaaggaaattgccaacctacgcacacccgatgatgatgttgaggtcatttgtgagaaaaggctttaaaagggaataacctttgctgacagaatggtatgataatcagaatggtactgattactggcttaaaatttctacttgtgaagtgtttcaattaaaataggagtagcatgttccaattatgcttcagacatttatttgcagagaagtgcagtgtgggagctatgttaactggtggctgtactgggtatttctttatctcttccctattttttgtttgtgatgaatatttctttatatcttccctgttagaagctgtcagcggtattcaaaaaaagcagtatttttccttggaactaactattctgggacagtgtaagccaatgggaaattttgacttaatgaatttcccattgtaaactttcggcattaaatctgttgataggtgcaaaaaaattgtaatatttacatatctttgatggggaaaacagggttgatttctttttacctaaaccaagcattccaaataaataaataccagtagaaatgaagagtataaatagaaaacaataggaagacttaataagacttaattgagttaattcatctttctttctggttctgtcattccttttctctttagttgtaagattatacattgactagctagcagtgatgccttcaggctagacattagtatacgtttttggtaggttcttatataatctgccaactattactcttgcagaggttatttattattattttttgtaacagtttaattgagagtatattatttgaagctagactatcggagtttaaatcctggctgccatgccaccaggggcaggtgtcttaacctctctaaatctcagtttcatctgtcattataataatacttttttaacatggatgttagtatgattaaattgatgtacatgcaaaccagttccattaatcactgcttagaatttgttgtgatgattatattgtaagagaccaagttgaagttcttcttgatctataaatgtatttctaatgtttcttagatgaatttgttgaacattaaagagatttcctttcatggctaatggctgtgctttgaaaattttcatattaaatgtagaactataatcctctttctgtgtagattgtgaagctagtactttattttctttctctcaggcttctgatttatgttttcattgagtgaatatcagaccattgctaatgtcataaaataaaatccagaaaatagatgagtcactcattgaaaataaaatctgatcagaaatcctttgactgtgttacattttaagataatgaatgcttggtttttgagttttactatcataccaacttttcccatgtgtgcatgtgtgtatacatgtgtatgcatatcagaaaaactgaaatactatttctgctcaattctattttgtgaagtcaatccaacttttatagtcccataaatatcaaataaatgaaataattattgtcactaaagtggagaaactattgcttcttcttatcttgtttattttgtttgctacttaaattgacattgaggcaaattttaagtgagtttatgttgtgaaaccctgctaaaatttagaactcactgtagtttgttaaaatatgtaaaaatccattttaagtaagtatgaaatccattgaagatacttttattttttaagcaaccttggagtgtagattttaaagaatacttgtctggcaatatccatagcttaaaatatgtagacatgaataccgatagttgaaaattaacttatttaaccatttgaaaatgagatttattttgttttatccagtgaaaaatacaaaaccaagtagacattgttttttggttaaaaaggtcacaaatttatgactgtatatgttactgggattagaagtgttttccctattggtagtttatcaagtgagtgaatacctttctgtgaatgtgaacaagcttcaccaattttagcagttcaattttagagaagctgtgatgagttattttgcacaaaaggctttatctttcaaactgctttgctatctttgcttgacagagagaggatttgatgactttttcaaaactcccctttactgcttcacctgagtaatgttttagttgccgtgtaataaaaatggagctgagaattgaaaggccaaagcagagggagttttatagcttgggatcttttaagtttcatggatttattttgtatttatatcctgggggggatgtacattctgatattgctcagtttttgtctgttggggaagtcagttgtccaaaatagcactgtattttctaatataaaaagagtaatgatttgccttttgtgagggataattttaatggtacattgcagagatttagttggggagaaattataggcattattttaatatttataaagtattttgagggccatgcaagaaggctgcatgtaagtacactaccaataaagtaacaccactaatacaattgagatactaaaaaaagaaaaaatatatacttaccatctagtgagcagagactttctttccctaatttgcatttagaaagctctaaattaaaatgctaaaaggaagacaaacaatttcagcacatgctgctggttttgtaaatacaacttgctgacttgatataattttaaatgaatactcttgacattaagacatcatgctttctgatcatgtattggtaagccacagaacaacagaaataagcttgaaatgggcatagtttttaccatagtgtaactttaattgcatgcttttatatcttcaaattaatttttgacatcgctatacagaaatagacttgtacaaagaaaaatgaataacttgcttatctacaagagtgtcattttacttgtgaaccattgtaacaggttttttgtttgagcatacaacaaacaaaatatgtaatgttgttttatcttccaaaaatacattgctgtataataagaaattgtcattttgcaataaaagaaaaatccaccaaactggtatatatgtgatttattttttttttggtcaaaccctgtaagtgacaaatttgacatttaatgctatattgtaaactatcaggtatctttttttcttgcttgttaacatagctatttctcacgttttctcttcttcaacttctttcatgcctcacctctaaatccccaaagtacacaccacacaaacacttagagaaacataaacatgcacatgtttgatgacctacctcataattcattaacaaatctagaagcactccatcaagagccccttcatattcccttgcaaaatctatcaaattgtcctgtatctttattgatattatttcctgttaccatggacagaaagagtccctgtacctatggaagagcaatctgtccacttgtgccctggttcccattcctcagtgatttagctcctttctccatgccatatttattttctccttctcaactggggatcattttcagcagcatactaacatgctctagtgtctcttctcttgatagaaagaaccactctcgacctcatagctcactccaactattccctatctctctgcttctcagagagcaaagccccttgaaaaatttctctattattctattagtcactgtcttacattgtcatctcactctcagtcccttccgattgaactttcatgttcatcattccacagagtctactcttcttaagaactccagtgaccttccatgtttgtggctcaattattattttaacctctcagcagcattttatatatttgaccattccctctttcttaaaggaaactatgatattggttctcatgacttcatactctcctgggtttcctccctcactagcccactctttctcaatttgctttgttcactgctttaattggttttcacatatgttttggagatggaaccaataatacttgctgatgaattggatttgtgcgataaaagacaaaaaggaagcaagaaagactcctaattatttggcctaagcaactagttgatggtaccatttattgagaaaggaaaaacttgggtggtgtcagggtcaggggtcaagaatagagagttatgccttggccatcttacatttgagattttttttctagactgaaatcatgttggaaatgttgtttggtaagtagtaactagttagagttggagtctagaattccagggattagttatagctagaggtatcaatttgagatcattagcacatcgatggtattcacataatacatcgggttgaaattactttgtgaaagagtatacatggagaagagaaaaaattacaggatagaagccctgatgcattctatcatttacaggcctaagaaaggaggaagatccagcaaagcaaattgaggaaagtatgaccaaagaaagtagaacactgtgagtcatagaaccaaaataagaaaatgttctcagaaggagagtacgatcaaatgaatcaaatgctactaagagtttgaactagatgccatgttggtgtgagttgaagaatacagttggaggtgagagagtataagcagtttggctagacaattcttgaaaagcttggctctggaggagcatggagaaggtggtatgtgggaagggtatggtattagggtattttaggatttttttttttttttttttttttgagacagagtctctataggccaggctggatggagtgcagtggtgcaatcttggcttactgcaacctccacctcccgggttcaagcgattctcgtgcctcagcctcctaagtagctgggactactacaggtgcacacccccattcctggctaaattttgtattttttggaagagacagggttttgtcatgttagccaagcggtctcgaactcctgacctcagttgatctgcctgcctcggcctcccaaagtattgggattacaggcatgagccaccgtgcccagcctattttatgtggttttttttttttaatgggaaatatggaagcatctttgaatgctaatgagaataatagtgttggaaagaaaaagttgaagttgtaggagagagagaaaataaaaagtgaaagaaataaaagggaggagtcctagatctacaagtggaagaacttacctttgataggaggatccttttctcctttgtaatgggaaagatgaagatggtgtaaatgcaagtttatttgctggtggcatgattatgggtggggaggtgccatttgatagtttctattttctcattagttaggcagcagtgtcatcacctaacagtttagcaacagtgtagtatggattgatgtgaagtgaatcatttgaaaaaatgtgaagtaattatcggtatagtgttgctgtcattgctggataatagaaagtgttcccttgaaattgattattattactttagagtgatattactcttcccaattatgctattttctaagaatgccatacaaatgcaggcctgcaaaaacatatagaagcattaaggggaaagtgcattagataatgattactaatgtcaaggaatacatcttggaccatggaatttaaactagacagggaggcaagtgaggacaggagaggaatgatggatggtgggtcaaagagctggtggcttcattgacatttaataattggttcagcagggttacttgatcaactaaactggacctatagaaaaaaagatcatcagttatggtgattgaattgagatttgggaggttgtgttactttcggtggtcggggtgtgatgatcacaggattgaatggcagaggctgaattcaggaaaagatggagaagttaaactgagagactagaataggtctgatgcagatgatgaagtcactgaaaacaacagaagttagagtgaacaaaaagactgagtcagttgctacagtctttagtaaatgacaggggagtgactaggagatctgaagattaaatggaaaagatggagtagctgaattatgctacctaatacttatttctgtcaacaggatcatatgaaaatgaaatattggcaaaccaattactttatagaacgatgactgaatgaaaatcacttcatgcattgttagagatagcccaatgaaaatggattccgttgtgtttatctagttcagatagtacatttaatgagaacagtttaagtggaatgacatttatggtggttagccatgattataatgaatttttgaagcgtagtcagttaggcatatatagtaccctttatctataaattcatgttttaaaataaatatatatatatataattataatctgtgttaaacacttcagatatacaagttaaaacagcttaagggataaaataggctttttttttttttttttttttttttttgctgtgttcatagtaacactatataaaggatttacttgaaacatttcagtttgctcaagttagccaagtatatactttggcaggtgacaaggctcaataggagtccttgtgttttaagtcttggttctctgtgaccgtgtgacctcagttccataaaccaaaaaatcaaatggttgtattaggtacttttaagggatcctctgactttgttctatgattctaacaaaaagaaatttgaaatatttgtgtggaaattgtatcttagcttttatcattgacatcataatattatgtggtatatatctctgtaccccctttatataagattctaagctattggtgatggtgtgatttaatacttccggttttccttttattctgtaatataatttaaataggtattaaataggtattcaaatgatttcctttcaagcaagaccaggaaaacagcataatatagtacactgagaaacaccaagaaagaccagttatacattaccttgtatttgtaaatcatttcaaacctacagaaattgcaagattaagaatactacaaagaacacttgtatatatcctttaccctactcaactactgttaagctcctttttctccttctctctttccctcttccttaaccctcttccctctcttttcctgccttctttccttccaatctccatctccatctctatttcttcttcagcctcatttaatgtggaacatttccacagccattctttgtcttttatgacatcaacaatttgagaaatataaatctcctttttagaaacatagcattccttatgattagattcaggatatatgttcttagccagaattcagcataggtgatactatatgaggtatacacctggaggtactcactatctgtccacctctcattggagaagtcagttttcgattaaggtattatgtaatttctctagtgtctaattaactctttttttccttggaattaataagcagtctgtaggaagacactttaagaccatgcacatatcttgctcctcatcaaaatgttcccctaggttatctaacatttatcataatggttgtaaaatgatacgtggccaattacagtactccttccacaaatagcggttggcactcagcattctactgtaagcaagacctctcctttctcatctattatttttacttattgatagatttattattagtatgaacttataaattcccatttttcaatggtttatagttcgttactgcaatgcattacttggtgctaaatttttgccagatttagccagtgagagctccctcaagctgttcctgtgaaatgcctacattttttttttttagcactaccttactttttgacatacaaagacattttagtttcatcttgtagctactctcgcacaatcttcttttttagtgggaaattgtacctggatgctaggtgtgtgctcattgctactggaatgcaaggaaaggcaagttacttttaagttaacagacaacaaacattaaaaatgtaattagggcatgactttttagccatatcataggattgtacttttatatatgtctcatcggtttgatgcaggtgagaggtaattttgagcccatatatagtagcctaattataattaataattttaattttttaaagtaataatgtgtgaggtgaaggagtagcaaatacttactttccctaacataagaaaaataccattaattgatctaacggccatatattcatactctagttgagttgcctcagtgactcacttaataaaataagaaattaaaatgtcaaatagaattcgacaagagattttaaggagaaaacagagtctgtttctacctcagaaagttagttaaacagtagcttcaatcatctgctatggagtactacaggtgaagaaaacaattcttgatatttgtttatattttcaactttaaaaatcagattatggggtttcatagagtttactcaaggtgtggtagttctttgatgtttttaaaaatatatctttattgtagttgggacataatattgaagaaactaatttctacatgttcaatgaattgaataattcaaaattcaattcagaactcatacactcagtgttctcctttattttgatatcactcatgtttattttaaatccttttctcttcctaagcatctaattttttcccttcattcttgtattactttataagtgatcttattacaaataagcatacactgagtcattgcaacagaaaagtgcttcatatactgagttgctttctgttgcacttgatatattaattgtgcacttactatatatgcaagcactgtgcaggcagctctatttctttaaaagttacttaaattactggtgcttccaatgaagctggtggtagggtctgttccctatctccaaactattagaccagcttgtcagatgtattactcattaggttgctaaggcgtaaagtcagaatttcagatttataacatggtgacatttgatgtttttcttttgtttattatcagtgctgtatctgatggtggaaacaactatacttttaaatcttctgtctcaaaatgtattcttcctaaaatttcatatttttaaccattaaattttctctaaaatatatcttagaattgatggtatacctttcccccctttatcatgacagtgatgatcaaatccttgctttgtgaaatattttcttgacatatttgaactgggtagtttttttaaataagtgctgttttttgagtcatcttttccttttgttgccttttgctttatgaataatcatgtattctcacttggttcattaagtagtagtagcataatgatgagagtatattaaaagaatttattttagattgacccaatctatgtgagacatcaacaacacacaaataatagaaccacgtttttttgtttttttttttttttcctcttctggaaagaaactactcttactactaacattgaaactagagtcatccttggactttattcaaatgtgtcagttttggaaaccatacaaagatgttcgctttagcttaagggaacagaagaactttgttatgctctttgagtgttacattaaactagatcattgcctgaggagcctatttaatatgtccatctgatttatgattttttttgtagtcctttttcctttgatttgtcttatctttggaaaagttggcatttatttctcttttattttttacatgctctcaatgaatatctatacattcattactttcagaaatattgcttgctgaacttaaattatttggaatattgtgttttgagtttgcaatcacggagtgaaggtggtaacattgtttctaggtttacagaatgattttgttaaaagtatcactttctgtaaataccttagataccatatagaatttagcttttggtcttatataatagttagaacactataaatgtaagtaagtttttattctcattgttattattgattcaaagagactttaaatttctacagcaaatcacattttatccctttctggacatctactatcattaaggtgatatcaaagactgaataaaatatttaagtcattaagattttaattcttaattatgcaatctcccttgccagggctattaacttttataatacagggagggtagaaattcagcagagacattcatttattttcttttatgaacaaggctgtatagtttgcattttttccaggtggtttggggaatatttaaatagatcacacagctgctggcttggtgggtttggggggtgtgtttagcagatgcttccagaatctggaatttgaagtattcttaattttatctagagatgcagatatctattctctggtttaatttgtcaggggatgactacttctttgatgtcttagtgatatataactgtcttgctttgtttttttttctttttttttttaattggccactcacctcaagcaattttaacagctcagaggatatatttactatagcctttaataattagatggctattcctattaaatagctgaatgtatttttaaggataatgtggggttctttaattagcttgatagtttacctataagaaggaaaatgaaaactgcagccagctgcatttccacagctcatttctgtgtaagaagcacgtatctgggctaaagaagtatcactttcttcatttaatctgagatgagacaacatgtgaagaacttggagcaatctgattttttgaaaatcttttctctcattagctgttttgctcaaaaataaaagctgtcaaacagcaggaatttgagatgctcatgattgtgtttataggccttcaatatagtatttactgaatataagtgcttgttaaagccaatttatctgttaattcaaacaatttattgaacacctattatacaaaagatactttgctaagtatttttgaggactatagatgactaagctagacttggacccttacatgtaggagcttaatgttcaagaataagacgtgttcaactataccaaacatgaaagtcctaaaagtgaaatagagatgaagtgatactgatttacaaggaatgagagcagggaagacaaggagagacatgggcgtcatcatggaagcagaggtaattgagctgtgcctttacagctgagtagatttagacatttaatactatgtttgagggtgggggaaagatattttcagcagaataaattgtatattgaaaaccctggtgcttctaatgtcatattcccaggcaatagtaggtatataacatgtgggtagactacaaggttcgtgttggagatgggggaagcaggggtacctttaggggaaatggcagaaaatggtgttaaaaaggcaagattgagctggattatgaggtcccttaaatgctagtctaagaaattcagactttaattgttaagaaatttggaagcattgagggatcttagaagccagacaggagcagagctgtatttaaggaagtcaaatggaagagtataagatgagagggcctgagagtctgaataggcataatgcctttgggaatgaagatgagaagaataagagcacaaatgctgagttagaatctctaggagtagggaatttattattgttgtgcaatagggtatagggaagagttaaatatgattttatattaaacatgcttattatttcttgtacatttatctgtgggactattttagggcctagcatgagggttgatatccttcagaggagatttatgtttgcttttgctgggttgcaaaaccaacctaggctgatgttaatatttttggcttaaggttttcttttttttaaagactcttgaggagctatgaattcaggctgcatgaaggctggctttggactaggaaattatcagagaagatttttactttctccatccagcaccaaggtttgttatgggcaattttcttttcaggccccatgagagatgagcaagtttatttctaatttactgttaaactgaggtgtgatcctctggggtttgtaggaccattacctattactctttccactttgattaggccctaggcttggtttctattgccccatacttgaggccttgaaaactgatgctcaagttcatctgggttcagaatattcactcaaggtcaaagctgactccactgatatttatctctctaagtttatctttcacttagtttttggcctccaggtattccttactttcttgccaggttatctgtacgttttaaattatttttttaaatattcatcatgttcagttctcttcacaggtagttgatatcagggtacatattctatcatactttcaggaacagaaattaaggtgaccccttcttacatggacatgtgacatctcagaatgactttattcttgttatagtttcctaaacatgagatattggtactagaatacagaaattatggtacctggccttttctgatgtaacttagttttttattaatactcatttttagaatagggaaacacgctattataactacctattgaagaatcagagtgattcaggaggtgatttcatgggcaagaactatgttctgtcgatagttcaagtttccagtccctctttcacacaattcttcccttctccattcacaaaagaaataccttaaaagagaaaagtctaagaaaaaaatcaatacagtctacacagatcattatcttattaatggacctttagtaatgaatgtacatgtgctttgtgtggatatatgtgatttttgatttttcagttcaggactagagggcattgaatgaaagctgcctgcatgcagtcacttcaggctctaggatcacccacagtggctctgcttatcatatagagtgacttgacattgtaggattttgccataggaaaatctgtcttagttttatctgccaccagtaatgggttttaccagggaaacacatatgtcagctgttaagtttcatagtagtgatggaaattgaaaacataatcatagattagccatttttaagtgtaatatgcaccaatgaatgactgtgacatcttaaatgcattttgtttatagatatagaggttgaaggtcaataactggaaaggctggcctttaatttgttagattaggatacaatttagtttctaacatgtataatttaagaatttttacagtttggcaatatagttctttcactgaattcaataagctttattttcattgtctactatgtgtcaaattggtactactttctagtgatataacgatgatcaagatattgctgatggctttgagtgactcacacttaatggaggagccagatatctaaactaatgatagtgcagtatattaagtgctacatccaagatagggagaaaactctgtagaggcccagaggagggaataattaattctgcttggaagagttcaggaaggcatctcaaaggagatggcattttagcctagccaaatgtgttcaggttgagaaggaatggaatataaaaaacattcaacaaaggtattccgcaaaggtatacagccttgggatgtcctgattttgtctaatagtgagtaatctggtttgggtagagcattgggacaccagggtgctattaagttaatttggagccagattttaaaaggtactaaattccctacttattacttaagctttatcatctacatagggagaaaaaataaggataagtaataatatcttaacattttaaaaagataaccccagtaatgaatgtgtagaagaaattggagtaaaggggaggaaaaaaatgcaaaacaaaacaaaaatcggagtgactactgtaatttcatagctcttctatacaccctaatacattgttatagctgttcatttgtccatctgaaagcaaagactgtgctttaatcttttctttctttttaattttatttatttatttatttatttatttgtttattttagcgacagggtcttattccgtcacccaggccgccatacctggctagtttaatttttttttttttcacttttgtaaacatgaggtcttattctgttgtctgggctcaaaggatcctcccgcctcggcctcccaaagcgctgggattacaggtgtgagccaccacacctggcatttaatcatttttgcatttacattgcttgtatatgatcatgcgtgttataactgtagaataagtgaattaatgaatgaaagatctaagcaataattattgagggctctaaacagggcagtagaaatttaggcagaattttgcaggtagagggcaggcttagggagagaagattcaaaaatggcttgaacatttcttatttctatgctatatattttgttatgatgcctttcactggagtagggaacagacacaacacttctcaggtaactgagaatgagttcatgttggagcatatttatttggaggtcctgtggaagagataagagttggatttatgggtctgcaacccagagggaaaaacctgggctgaagatacagatgcaagaaacataagcacatagattaatgattgaagtcagggtagtggattgcacagggcaaaaaatataaagtaaaaaggctagagcatggggactttggggtcactaatatataaggagtaggtagaagtagagaatacaatatggaaaacagactagtcagaagcataggattgtttatcagagaagtctggtctttgaagtcattgagaagaaagtttcaagaaaaaaactattagtaatttaataaattcagtagcttcctatatcgatgtatatacatataggtaaatatgtaacatacttatattaatacagagttgaatgatagcaaggtcactcctatctgttgttatcaaatttcagatcttaaaccagtaggacaatttctaggaagaacacttcatgattcatttctcaactaagagaatagtgctcttatttttctagtgatcagcttgaagtagtttttttcattatgtgtgtttatgccttgcagtttcattgattacatactttaaaaggttttaatgtggccaagtattgaggatgtagctgtaaaagcctttatgtggtggtaaactccagcatttaataactgctagaaatgcaacatcttctctcttattgtatttgacagtttttttgttattattttgatactctttattttgccaagagttaactcattcctaaaggtattttatgccagggaaatttcattccactttgtatagtaggctaggttttatattaacctttgagtgtgcatttttactgtggattatacattactggaattacttaagcaaaattcatactgagattctttattttaaaactgataatgaccatacgtattaaagggctagctcagaaaactgccagcaaataatcatctttgcctttgggaaataatgaagtcattgcatcgtgcttgaattaccatagactatatcagcagatacactcattgattcatttctgttctttttgttaaaccaaatttttctttcatcgtttttagtaatgtaattttctatgtctggtatgcttacctgtaatttgacagaaccccatttctttgtatatctcactctattagactacatgtagtgcagtgtttgtagagggggccattaactaggaattgatatttacaaaggtgcctattaagtgccagtcactctgctttgttttaaacatagttcacttaatgaaatgataggcaaatatactaagggagggaatttgttgtagtggaatgaatatgcattgaaagcataggtttgatctaggtttgaatcccagatctaatagtcatttggtggacgaagtcacttcacgggtctgagccgaagcttttgtatggtaaaaatgggatcctatcttgaagagttattatgataattaaattgttgagagatacaatctaagatattcattaaatagaagatatataataacatcattgataattactattagaaaggaaattagacgtttgctttgctttgagtgctattactaaatgatgagtcgtatgtggcaaaaggagatgtggaacgtacaggcaatcgccttttaaataaaacctgaaacaaaaattatttgaaatgttagtttggcagttatgttggattatatacgtttcttaaggctagtgacttgtttcctggaattctttcacttcatagggtaacaccttgccccctactaggaacttaactatttctttaattttattacattgaagctgcttgaggaagcatgcttttttcactaaaaggacccagcaaatttcattctttcattggaatattttctcttaatatgactgcaaatgcagttagtaagttgaaaaagccacctgttgtcgtattggcaggccacctaactggtctgtctgtacttggtgtgcagggaagcttgaataactaccattaggcctgcacagtgtcagatttcacatactcatgacaccgtaggtaattgggtgacagccagtttatttcaatcagctaatgttatagataaatacttcatattttaggttagccctgatatcacagaatggaataatgttctaatcctcattagcagtttgttatgcagcaactttttgtatgccaataaaaatggcataggctgctgcttcggtggcatttccccttgaacatgccattttattcatttgttgactcagatagatggagttgtcatgtttctttgttggaaatgttgacagaaccttgtgggctgtgcttgtataaacgtttggttctctaaacaataattttcagtttagctctgttgctactgctacatgctatttttctctttctgtcacattgggaaattctattttgttgtcagtaaaaaaaaaaaaggtgtggtacttgcttactgtctatgtagactttattttgctagttgatttcattaaagagtgattccaggaagctttgggtcattgtatcaccttgtctcattccattatatgtattgatgcaacatggatcgttgaacagtataatctcttttgcacagttcctattgattttatccagtaaatcattgtctgctgggtttgttctgaaatcattttgtgcataaaaactattcgtgaatttgacaatcaggtgccttcttgtaatagataaacttacacaaaactggaatccagtcactttttgtctccttcacactatatagttatctttcctactaaactgatcaagtgagtgatctctattcagcaaatgtttctattccctttctcatttcttgtaatatggcttctcttatcattgctcttttgaaattgctctgtatgatctgaaatggcctattttcttctggtctttttttttttttttttaagtatttagactatgcttgaccttcctgctacttttgacactgttgattactttctcttattgaaacattttcctttctcacttctgggacaatgaactcccctgtttctcatacctttttattgttctttttgtcctcttaattggctgttctgtcttctctgggctcaacacttcaggcatcctcactacttaggctttagttacaccttgaagacagaagatcatcactttcacatttatattcctgtaccctcatttttccactctaaaatttcacatattttattctcataatatttcctgagcatcattttctacataccatgagaggagggattgatgtgggagataaagttgtaccgtgaatgttctcttccctacaagtttataacttagataagtcaataagatgcatacatgaaaattaattaagtagggcagcatgtggaaaataccttttcagtgctaaaggtagatgaagaatgtagtggtaattagagaagatttcatagagaaagtgacatttgacttcggtcttaatggatagataaaggtttgacagcaaaaatgtgaagggagatgaactgaaaatattttacagtcattcaggagtcctgtcatacttttgctatcttagctactcttgtcctagtagactataggcaaaaatcacttaaaattagaaactgtaatctctccatctatattaggcacacagaataacagtgtacacaatagctcatgtcatatccataagatgttaaaaatgtgtatattttggaggcgggacttcaaggatgatgctacctagaagtaactattttattttctgtactcacttatacctattacatcttatgtgcttcagttttctttaaatagtgcacctggtatcagatataatctctgcctttttgagtgtcttatcagattcagttccacgaaatctaagtggaaagctagatatatagttgacccttgagtaacatggagattggggtgccgaccgcccgccatgcagttgaaaactcgagaataacttttgactcccaaaaaactttactaatagtctactattgaccaaaagtcttacaggtaacataaacagtggattaacacgtttttgtactttatattgtattttacatgtgttacatactgtattcttacaataaagtaggacagagatgaaaacgttgtgaagaaaattttaagacagagaaaatatatttactgttcattaagtggaagtggatcaccataaaagtcttcattcttgtcatcttcatgttgagtaggctgagaaggaaggggaagaggagagattggtcttgctgtctagggtggcagaagaggaagaaaatttgtataagtggacccttggctgttcaaacctatgatgttcaagggtcagctgtattctgccctttttcattcttcttcatggattgtcacagccaactctggaatctatgttttttaactgatattttagtaaaattttccattaagaaacaggaatttattgtatcttataagccagtttgaatttttaatttgattttattacaacacttttgttccaaattttacgtatttacttcctgctctgtctctgtagttataaccagttcttaagttcagattcaaagcattctgcgctaaaagcagaggcacactttggtggcagccatgagggaagcaacaatgatcccccacagtgataggactgaagtggctggggtgaagtaaaggccagcctaatggcgagcacagcaggtttgaaatagtttgctaggaaaaagagtcagcaggttgctgtcctgatccagtcaaatacatatgctgtctgcgactattagcagttgcttcttacctggctattatcttcaataagtttctagtaaaaccttcaatttgtaggatttctgattttttttttttaacataaggcagatttcattctattctttatgagatgttttttattttgtatggtaatagctctatccgcagtctacagatttcagaaaactagtaagaatcttaggggccatatattgaggatccaccgtacatttgagttttgctttgccttcagatttagtgtttaatcttaaacattgcattcatcttatatatgcctttataaacagtataggaccctctattatctaactcttggctacaaaattaataagaggtgcacagtgggcaattacccattattttactataaatgactagtcttatgtttttgttctatattgtttgcagtaatgttatgaatgctctacagcactgaatatagtattaaacggtagttctcacagaagacggagtttgtcatagctgagctgttatccaacaattttttttttaagttcttaaaagcttacagtccaaactgtttctggcatttagttgaataaatacctcatggaaattcactgttaaactgaaactacctaagtataatatatttcatgatacacaaacgcacacgtgcgcatgcacacacacacacacgcaacagttgtgattgtcaatattaaaagtaaactcaatattaaactgagtttactttttggataggtttcataacaagttgactccatttactttgataaataggttacatgttaaaatcaggtttattttcatagatagtatcaacatgctacttgctaactgaaacggaccttgacgtaaagcagagtattagactcaggaatgtgcactttcagtagaatatggtttctgagatctgttgctctaaggcccacaagctttaaaatgactacatggtgtccaaaagcaatgaaactaagctatgatgtgcttgcttaacattttgtctagctcagttctggacttttattagattgaattttctctcttttgaagactccagtttttaattgaataaaaatttttttcacttcctattttgcatattccaagtctttgcctgccttgattgttttcagtgacctggcagaataggtgtgtgtgtatagcaagcaagaatacactcatttttgggctggacacagtggcttacgcctgtaatcccagcactttgggaggctgaggcaggtggatcacgaggccaggagttcgagaccagcttgaccaacatggtgaaaccccatctctactaaaaaaaaaaaatacaaaaattagctgggcatggtggagcacgcctgtaatcccagctactcaggaggctgacacaagagaattgcttgaacccaggaggcagaggttgcagtaggccgagatcgcaccactgcactccagcctgggcaacagattgagactccgtctcaaaaaaaaaaaaaaaaaaaaaacgctcatttttaactgcttttgatttccttttcaacagcagattattattattttttcttttcccgtcttctctacccctgtgacacctgtacctataaaaggggagagaggcagtggtatcttatattcattttagtatttattatttacataaatagttttaattaatgcattttatgcattcttattctaacttattctaagaacttatatatccctagcacagtgatagattttacaaatatgtgcaagatccttgccctcaatgatatatctagtttgtaattgatttaaaaattaacggagtgtaccttgaggatcctttgttctttcataaaatctcattatttgtcattcctatgagaccaatggttgaccaagtattgccttcagtgttagattccaagatttggaagatattataaagagggctttcatgggttactgttaacaatatttgcacttttctatttgggaagtatttattgagctattatagagtgttgtgttatgtactacagagcagattttctaaaccttgctaatatttggaattacctgaggagctcttaagaggtacaggtcctgaggccctacctgcagagatttcagcatgctaattcagtaggtatgagtgtgttagaattcagatcacaagtaaatgagagaataggagggaaggacagggagatggtgtcaggcattcttctgagatgcttggtagtataacaggataatagattgaggaggaagagggtagtgagtctgttcaggaaacaagagaacttaaagcttatttgaattttattctcgtatgtctttttacatttccaaaatggtctcaaatattacttttctgctttcaaatagaatgtcaccaacagactaaacttgacttaaaaaaagaaacaaggagccaggtgtggtggctcatgcctgtaatcccagcactttgggaggctgaggtgggtggattacttgaggtcaggagttcgagaccagcctggccaacatggtgaaacccagtctctaccaaaaatgaaaaaaaatagccaggcatggtggcaggcgcctgtaatcccagctactcgggaggctgaggcaggagaatggcttgaacctgggaggcaggggttgcagtgagctgagatcatgccactcctctccagcctgagcaatagagggaaactctgtctcaaaaaaaaaaaaaaaaaaagaaggaaatgaaatcttcaggtcctccctatcttactcttctcagaattattctaatgttttgatcacctgcaacagtatacactgatgtggtttctgaactaaagaaaattactgctgaaagataaaattgaaaccagttggaatccaaatggggaaaacagggacagtctaacttgatgtttcccattgagctcagccagcaacaaacaaattgagagactcagtaatatttttatgtgcatagaataagaactgtattatatgaaatacaaaagtctgatttatgtgtgtgtgtttgtttttacagaacttgctcttcattttattataaaccagtatgtcccaagtgaaacattaccgaacactgtagctgcttatgagctctcattcaaccccaataaggatgggatggtagaaactaattttttaattttattaaagttgagctgcgttttcagtcattttacatgaaaacgtatgtgagactatatggggaataaaataaaggacagttacagtttttgatgagataattgatccctgtaggaatgacacattcaaaaaccatgaggagtataaatgtgtttgattatgtgtatcctacttgaaaaacagaatgtcaacaattatagcaaggagcttctagatcctaatttgcaggggtagtgttgaacattttctcatatttgcaaaagtggaagcaagtataaattgacctcagttgcagaaggaaggggataaggaatcagacatttattgaacatcttgttatgtcaggggtttggaaactatggtctgcaggccaaatctagctgaccaactatttttgtaaacaagatgttattggaacacttccatccttatttgtttacttagtgtttctggctgccttcacaatacaatagcagagttgagttgttgcaacaaacatggtataacttgcaaagcctgaaatattcactatctagccttatagaaaaagttcgctgaccttctttatgttactggagcttttacatgtatgtgccatttctttctcacaacattcctatgaagcaggtgtcatcagcacatggtataaataatctaaatttcctatacttcaaacctgacgaatacatttttaatacccacattttcaaagtcctgaatccctacttacatgatatctaaaatttgtctcaactgcttttcaaagactctcctggttgattctgggagtctttgggaatggaggtgatcagaaactaatcagctaatgttctttggctttggattcttcctcttgcctatgccttctgtgagcatatagctccactctacacaaccattttttttcatctggcaactcctctgagcccttggattcctgacataatctccaaccctctcactccagttctttgtacataagttatatggctggactagataagtatggaacacataccccacccccctcaacaccattgttccatctctcgtctctagtctttatcttcccctgcaaccataaaaaattaataacacccagcacctcctgcagcaatcaccaaccatcaaattcagaattatatttcaggcaaataaggataccaagccatgtataatgagaagaaaccacagctttgagttaatattcaggaaggcacagcaaaacactttgattagggccacaaggaagaactctatgaggaatattaaagtgcggggttatgctcagcatctccacggaagttttttatctcaaattatttagtaataatatgtaggaggcaactgtgagtctcctagtctgaaaagtcctacattgtcaatttgagattatggctacaaatatttcagggtgttactttgttgagtcttactcagcaaggttaatgtacgtagcattaaactgaattgtgtgtaggatctgcaccaagctgagatggaccatatcaaatcagaaaagcctgtgtgtgatgaatgcccagactgtattctcaacaagaattgtcctattggcctagtgatactggtttttgtagcatcgcaattcctacagatatgcctttcttagtactttgtttgatgcacttagctcttggagttgattgctggactcactgattcgtgacaggaattctgacatttaaaataacaggaagttctctgaataaatgggatagccagaaaaatgtcagttcgtacttagaaagccagagacaaccagtgggtaaagtgactgacttgagcttgaataaggtaattcatataggttaaaggttaacaggaaaccaccttgacaacctcatttgtcaaatatagtcatgtaccacaaaacgatgttttggtcaacaatggaccgcttatatgatgatgattccataagattataatggagctgaaaaatcccaactgcctagtgacatgtagccattgtaacattctagtgcaatgcattactcacatgtttgtggtgatgttgttgcaaacatactgtgctgccagtaatatataagtatagcacgtacaattgtgtacagtacataatacttggtaataataaacaaccatgttactggtttatgtatttaccgtatttttcattgttattttagagtgtactcttgttaaaaaaaaaaaaagttaacagtaaaacagcctcaggcaggtctttcacatggtattccaaaagaagtcattgttatcataggaggtgacagctccatgtgtgttattgccccttgaagaccttccagtgggacaagatgtagaggtggacgacagtgatattgatgatcttgaccctgtacaggcctaggctaatgtgtgtgtttgtgtcttagtttttaacagaaaggtttaaaaagtaaaaattttaaaaaagttgaaacaggaaaacgcttacagaataaggatatagagaaaatatttttgtacagctttgcaatgtgtttgtattttaagtgtgattacaagagtcaaaagtttaaaaaaaacaaaaagtttataattactataagctaagtttaagttattattgaagaaagaacatttctgtgaatttggtgtagcctatgtgtacagcctatgtctatagtggtgtacagtaatgtcttaggccttcacattcattcaccacttactcactgactcacccagagtactgtccagttttgtaagctaccttcatgctaagtgctgtatgcagctaaaccattttttatcttttatatcataattttactgtaccatttctatgtttaaatatgtttagatatacaaataccattttgttacaattgcctacaatattcagtacagtaacatgctgtacaggtttgtagcctaggagcaataggctactaacctgtgaagtaggctataccatgtaggtttgtgtaagtgaaccgtataatgttcgcataatgacaaaatcatctaaagaagaacttctcagaatgtatccacatcattaaacaagatgtaagtgtactactttgaggtaaagaccatacttcagttttggtatttaagttaccacttcaaacaagggaaattcttccctaaaacctctaagacaactttatttgtccttcctaaaatatgcattacctgctgagttattgaggcccatttgaaaatacacaacattagctatgcacgctgttaaacataatgttctggtgacatttagcagtgttcagtaattggcttaatgaacaggtgtgcaagtatattagttatgcagatgttaatttgcagtaacatgtgcttcctgatttggggtgttcttgtataaactacaaccagtaagatttgttccttaattaggaaatcactacaaagtatgtctgtgttatccctaccattacaaccattagtcttgtttaatgtgctctgaacttcagaaacattcttagtaatgccattcctattgcttcaggtactatgcaggtgtcagaatgaaatctacctttctgtgggatgccttggttagtgtgcagctgtaggcaacatggagaggggaagcttcgcagctgtaatatgtagcatgtgcaaggagacagaaatggaatctcttcctgcctattgcatcagctttccctcctaaggtttggtgaacacatgtgttattcctcacaaaacagactcgataacaattgaacacaaaatagtggttccttacaaacagattcatctttaccagcatttttaattattcttttccatattgtttgtaattcctgtctacacttggcccttgggatttccaaggttaacagtttgtaaactataaaaatggataggaatgtttgtgagatttattcatatgatttttatttttatgtcaaaaaataggaaattacaaaggctaatttagcaaacgcccatctaccagccacccaaaatgaacacatgttaacatttagtcatatttactccaggtctttgcttttaaggaaataaaacattaaagttaaaatggaagtttccaaggttctacctattccagcattagattcctcctcttaggcaaccactgtcattaactggtgaatatctagtctatgtttttataattttgctacatatatactcatccatcaacaatacgcaagattagtctccgttttatttttaatttagatgaaaattatactgcatgtaccattttccatagctttaatttttccactcagcattgtatttggcatcaatccttgttgaaatatatagctgtaatacaatcactgtaaatgctgtgtgatattacattgtattaatatgccacaatttatccatttcataacccctgggcacatgggctgtttataacttttctactgttataaacactgttgaagtgaacatttttgtctccttgaccacttgacctacaagcagaaatgttgggctatgtttatgacaagcataccttcaaatatattagatgttgatgcatgcgttttttaagtcattgctgaatatttactgtcaaccattggcataatcaaattcttcttcgtatcttcatcaatacttggtattgtgagacttaaaaaatttttcaatttgatgactgttaatggtatttcttcagttattttcatttgcatttccctgatcactagtgaagttgagcatgttttcattactagctatatgaccttgggcatatgatcaagtttgtccttgatttcctcatttgtaaaatgacagtggttaatacctatcatataaagtggtataaaaattaatgccagatacagagcagatatgtaataaaaatttgatttttgtggtgcttgtgaagattgtattggtggttaccagtagtaaaactactactactgctgttatttttgttttttaatactctcatctgttgtgtattgcatatgtatttatctattgatctaatcttctttgccctttttttccatcaggttcatgtgatatttccagaaatgcatagataaaggtgattcagaatacagtagaaaataacaaaaaaaatcattaaacctgtcacatgcaaaaaccagagtagatttcccgtacctttcattgccattcttgcactcattttaatattatcaagtcattaattgaaattaaaatattgtatatttcaaccaatatgttaaaaaattatttccatgtagctggaatcacctctggaattgtatccacatggataaaatatgtatttaagtatatatggatcacaattcttatatttgtatgttatatgtaaaagaacaattggcatttacttgttaaatatacaaatatgtatgcgtgaagttacataaatatacaaatatgtatgcatgaagttacataaattttcagtgtgtttgttgacactactattattagctttatttaccctggctttgtatatagtgtacttttttgttagtttgttttcctgagacggagtttctctcttgttgtccaggctggaatgcagtggcgcaatcttggcacactgcaacctccgcctcccgggttcaagtgattctcctgcctcagcctcctgagtagctgggattacaggcgcccaccaccacgcccggctaattttgtattttttagtagagacaggatttcaccatattggccaggctggtctcgaactcctgacgtcaggtgatctgcccgcctcagcctcccaaagtgttgagattacacccagcctgtatgtagtgtacttaataggaagggacatccttttaattctcctcatatttcttataatatgatgcaacacataatgtgatgctgattcaaaggtatgatgttccctatatagaactatgcttgcactaagaaaatgagaatttactgagtggtatacatgtattcatctaagctatattttgtggatattttatggtacctaagctatatattttatggattctttataacatttataaagaaaattataaatgttaggtaccttttggggatacttccataattagtggtttacatatgaccatgcagtatgagtagatatttatgtgttgtgtaccattgtatgctcatgctaagctaattcatagtaggtgctcaagaaatatttggtagattaatgaatgtgattctggccatagaaatcagtctttctcactgaaattttaagataaagtagttatacaaattttactgtgattcatggttagttatcactatgtaaatcatgcaatgttgcctatttaaaatatcttaatacttgctacaaattataataacttgtcacatgttctgtgtatccactgggatatcagaaattaataggagattcctgaacattgcctatattaaattggggaaagaatataaccatgtttactttatttatgctgatgagcatttctcagttgtaaaggaatacatttatagtacaattgcttgtaaaaatccatgtattaaaggaaatataagaatactcagtgggcattttatcttagataatgagtatcttgatgttaacatatctttaataataatataaatgtcttcattattaggattatcttcctacagacagtattttataatgtttcattattattctattagcagtgccaatttacacactcaaattaattcaatatattggattcaaacccatttgcaatatgttttttcatttgtacggggaaggtctcgtttgactgtgggcctcattatgaacctgaggaccatagggcaattgatgataaaatcaattcatgaagtttttgtatcaaaacttaaaaaaactttttagtttcatccaagtaacttcaaataattatagaattgctatttatttaatgttttgtaaccattagaaacatacagaataaaagtatcctaggataagtgacattttgaggtcactatgaaagcaggcaatttttaacatatgatgtgttgaacactatagggatatttgatgtctcattgctgttctttgaattctctatttatctaagcctgtggtcatgatccctaaggaatgcttttaaaacaagaaggccaaaggcaataatagccactggtctgtaattatttatcatggcaaaaatatgattagttctgaaagcctgtctagttagagaactgttctaaacttgtttttctctagtgattctcagaaaagcagtgcccactcatggaactcttatcacttttcgaacccaggatttaagccaagttatataacacaaggaaaatatgttgagattcaagaaagaaaactatgaactatagatatttagggcatctaatcttaattttaaacaatttgttcacttgaaaaggggagaggctagaccatattttaattaaaaaatgcaaaaatataaagtcattaaatgagcattatctattcctgggttagtcaggatcctgttagtttgcagaaccatctttataggtccttcatggcacaacatgtttttcttatatgtacttggctaattagtctcccatagtgaattttaaggcatattgagatattaggaaaattttcttgactatttccttgactgggttcaaattagtgaatgattctagaagtaatttcaatatgattcagatatttcacattttatagacaaagggaatgactattggactgtcattttcttgtatacaattgtcttaagctggaactggcttgacaattagaataaattaaaatgttgattattgcatatgaaagactctatgctcttagaaagatcctttgaagaatatttgagatatgttttaatgtattttaaaacatatttggaaatatatacagataaatatcaacataaaatatattcttttaatatattttaagagaaatacattaaaagtcacttttcttccagtagtagcagtgactattatgttgaatccacatggcaaactgcttgccatgtctcataagatcataatttctaagtataattatccattctccttagactgcacataactttagattggccagtctggtaaaatttagcactgttaggagtttagttatccaggtaatttattttattaatatctggtatttctgtagcatgctcatttaatttttctgtattttgtaccattaaaacaaaggaagtcttaacggacttccagtattttgatgaattctgtagaatgttgcttccaagatggtaacatctatgaacatattgcctaagtaaaagtgtactgtggttttatgttgctttttctctaaaaaagaaaatcaataatgcatttgtggtctttttaacaaagattaggtgaattaaaataatatcattattgcctcaaaatgaagttatctttttaacattgataaagcagcagcatgattatggtcatatatgaaccagtgatgtaatttagcagcatgaatttgggggcaaggacctaacactctacttgactgaaaaagtactagctttacttttcttatattttctgatggccccattacttacaaccctgtttttatattggaaaaggtaaactgccaacacttgagtacaatggtagctgtaaaatttctataccggaggggtttggggatttaacttaatgctttattttcatagcagacagccacattgttttttgggccggcctacttggggagttggctgatggaggttatggaaggctaaagccactccttggcactgctactccttaccctttcagtcctttaaactgtttttaattatactgttaccttctaaagaaagcaaagtaaatcttctgttctaaggaagcaaatagtatttttcaaatagcgagggatacaaagctaaattactcaaaagaacacattgctgagtctgtttaattacatgtatgcaaatggtgctactgttgtacaaattgcaaatggttcataactattcttcaaaacagtctcagcaggaatttgtatatggcaacctgtttagcagttaaacttaccttaggtgctttaaagcaatttcactgaattgtttaaattttagcatattttgagagaaatgcatgtcttccttttccctcaattagttcagattagtgaggttgtactatatatttaattccagtactgctgtaggtacctggtaaaggagtaattaatgttgcgtattaggtaagaaggagcaattgatttttggttcatttggcttatcttttctgcttaagtgctgatatttaatttgtagtgaaaactctaaacaactctgtatttttatgtttatcctcttccttgagctaatgaaatcaacacatttattgatttcagaatgagctttattaatgtagttaatatgccttactaatgttattccgtgtacttggattagtacccttattgtttatgaatcaacattttttctttcagttcaaaagaacgcagaagcattagaagaaaagaagactgggcctacaaagaagaaagtgaaagaactgagaattttggatcccaaaacagctcagaatctgtgtatgtaatattttcttcgtaggattggtataggtaacggtgagaggggtgggagctgtttaatgtatttaatgaaagttgtaacctttttaaacaggcatatttagcatcttctagaaacaaaatcctgtgtaaacatgatttggttgcctttttgtcacttagccagtaaggagaaaattctaattcaacctctgtcaggccagatgaaacttgggaatagtaaagatttggaaagtaatgataataaaacactgttggaggacatagtgaaacataaggcagaattgacaaaaagtgatttttttttccttctctctagacctgggattgatagttttagagtattcactagttacattggaaaaatccttctactgctattcctttatgtctgaagtaattgcgatgtgagctacttaaattgttaaccttaactgcatttaaaaactggttagtgaatcttgaagcctttaacaaaccagtcagccattaagtataccttttctaaagcagatggacagttaaacccatcttcatttatgtaagcctttaagttttaacatactcttccctctgtcttgaaatcagaatttttggtctgtcactacagtagactgtgtttagattttgctgatacaaaaacactatgcatcagagatttccacacatcaagcatgtctaattgcacaaagtaataccatgggagcttattttgttaaggaatgtggtatagggaatcattacaataaacaaaacatcattctcatgtcagtagaaatgttgctttcagagaagcagtttatcagtagctgttgtgaatgtgtacattgcttatttgatagtacattttcaaagttgacgttcagtacttttctttaaaacacagtaggatctcaattgctggttgatttctgtcaacattattcttttagattgtggagatctcatttggtcttatgtataaggtaatcatttgtctatagagtgaggattttgttttcttttggtatggctgaaggcatatagaccttttcatgaaaaaaagaaaacaaaattcttagaagtgttcaagttctgcgtgccgggcgcggtggctcacgcctataatctcagcactttgggaggccgaggcaggtggatcacctgaggtcaggaattcaagaccagcctggacaacatggtgaaaccccgcctctactaaaaatacaaaattagccgggcgtgatggctcatgcctgtaatcccagctacttgggaggctgaggcacgagaatttcttgaacccgggaggcaaagtttgcagtgagccgagatcgcaccattgcactacagactgggcaacaagaacgaaactgtctcaaaaaaagaaaaaaaagaaaaaagaaatgttcaagttctggtgataagaacacatctgtgttctttaaaaaatatgtttaatggaacatgttgttgcaagtaccttctgaataattgttagctattctaggtttaatttgctgaattattccaatatgatatcatagatttccatttaagaaaaagttggcaggggaaattgtgagtcaatatataaagtaagtaatagtgtaccacaggaatataagcaggaatgcagagcacactgatgatttaggcactttaatttttttcttatgtgggagaattgcagagtagatggatatgattttttatttggttattttattgtctttcctgagaaatactgtgttgggtgcatctgacaatctccacactaagttcttcattgaataaaaaggtcaacttgaaataaaatctcttaagttttcatgggtcattttgtgttatcatcctaatctaaaaggcataagcatgtagtcatgaatgctattagtaggaattttattttgtgtgtaaatatgcactagctataaacattacagcccgagaaaatatgccattttgtctagatggatagagtgagtagtccatcaaatggaacaacttttgtttgttcataattctgtatattagtgacaaatttcatattttgagtctatgaaatgaaaatcagacgtttattaggactttaacatgttgatgctgttatacttttaataaaatcaaattttattttagccatctttctgggatcatatcgcatgccatatgaagacataagaaacgttattctggaggttaatgaagacatgctgagtgaggctttaattcaggtaacttggatattttccttttgaaattcattttcacagatttttttggactattctcttctcaatggagttgtaagaaaattctcttctataattagatttttaaaaagacattgaatagtttaataaaatcaggaatatctagctgtgttgatagtaaggggactcagtatagaaaatctaggttctaattctgtttctgccacttataagctatatatccgtttcagtataagcatatgcatatatagacatatcattgtccattattcactgtacatacaattacatgtacttcatcaccaaaatggctgcattaagtgtatattgttcttaccattttatgggtgaaaaacctgaggggtcaagaggttaaatagcttgctgaaaattagtgggtatttaacatacccattgttaagttgagtatctaacttttacccaactctgtttgggtacataacatgtattgctgattatggctagcactttctgtattttttatttcattgaatcctacagtaatcctatgagataagcactattattctcattttacaaataaggaaactgaggtttagagagattgcccaatttcacaaagcttgtaagtggtgtaagttgcaaagtaccagaactaggattcaaaacaatgtctgtcttgactctaaagctgttatattattctgctttccatgaacaaactgtttaatctttctaaacctctattttctcatttgaaattacagggtcattgtgaggttttaaccaaataaagtgctttgtatgataaaggactatacagagctgacacattatttgaattcttggtatgtctggccctgtctggtttaatttttgaaaggaataactgtaaagatttctgtggaagggtatagtcattgtagttttttctgtttttctttattttgttgttttttgtttttgagccatgagttggttttgagttttagaaaacatcaaatagggccaggcatggtgactcacgcctgtaatcccaacactgtgggaggctgaggcaggcagatcacgaggtcaggagatcgaggccatcctggccaacatggtgaaaccccgtctctactcaaaatacagaaaaattagctgagtgtggtggtgcgcatctgtaatcccagctactcaggaggctgaggcaggagaatcacttgaacctgggaggtggagaatgcactcagccgagcccatgccactgcactctagcctggagacagagcgagactctgtctcaaaaaaaaatgaaacaaaacaaaacaaaacaaaaacatcaaatagttaaatagcttatgctataactttaacaattttgccatattccctgcaaactctaaatctcagagaacctgcatatataatttgagcaagtgatgtctctgtggaagctcttctattttggattgtaggcttacattaaagtttacctcatatatatgtcttaaatctaggcgtgatttttaaaaataggactcaggtgtaataagatgacctatgtcatctcttccttgtttttagacctccattcccttttctaagcctttatctctttatctttttcatgtatctgtatattttacccatatcctgctttacccaccaattttgtgccttctgtttgctgaggacttttttaaagccaacttgctttccttctcagtaccagatactctgaagtttcttctcaatccttaccctgtttgatcaaaacccattttcttagttttgcttgtgggaagaaaacagtttaacatgtagtataatgtacataattggaattgtgctacttgggtacgggtgtagggcctaagtggcgagtaacttacctgagttattaaggttagtattgcttttatctagacaaatcaaatgtctgagtatcttctggtaaggaggatggatgctcctgggtagaaataattacatgattttctagtccccaagagagatgacttccctctgtcaggagaaaagactataatcactagcacctttttctacccccaattccagaacatttgtttcagtgatggaaaagtaacatcaatttgccattcatttgagctgtttaccatttatgtctaattaccatgtagcacatcgataatgcatggcattaaatgtgtatcatcagattaactttgttgtaagttctatttgattacagtgctaaactccatccatgcataattattgttttttgctcatgtagcatggttgtctcctcatagcaacaaaaacaacaaacaacaattaaggatacatcacttcccagaacttgaattaacagtagtagtattttctcttccagtatgggtcaataggctcttgctgggcagacaactgatagaatttagttagttggcaggataattgtcttacttaaaaaacaaaaaacaaaaaacagaaaaacttttatttaatcagcaagatccagctctaagttgaagcttattaataaatatcaattttcattttatttcaaaatatctaaatttaagctagaaaatgagttctctatgtgggaaaaattgaaatggcctaaaatacttgcagtagcacgtagaaacatttaaaagtacaccatatcctgaggttgttgaggagtttttaatacatgtaattatgagttactgtcaaataatgtgtactaaattttggtgacttttagaatcattattctagccttcaaaatttgtttcagtataattgaatttgatctattgagagaaaaatctaagaccaatcagtcagtgctttttaggatatcagtggtaaaacagaaatatgtatagacacacatatagagcattgacagagtaatgaaacgagcggtttgaaaaaagtgatgcatgtgtgaagggaaaaataaaagtatgttctatttgagatccttagtgcatgcaaatgattctaggtagggagtttatacttatattcttaaggaatatgtgaaaaaaagatgatcaacataaaagatagtgtattattactgcagaataatttgtaaagatatgataaagcataggttggtaacctggagttcaaagccctctttggggacccatggagagaattcagggggtcctgaacttgtatgcgaagaatattacatctttattttcattatcttctaattaatatttagcatattatttaagagtataggcaacagaccaaagtagtattaacagtacctctaagtttttcactaatagaaataataaatattttcatatcacattatagttgtggcagagatcttaaaatactgttacagtcattaatgcttcaaaattacagtacttattagagctgcgactagaaattatttttaatgctttaatcaagcacttctatcattatatcactattttggtaaatatgttgataactatttaaatgtaattggtattttatataatcctatttattttattttatcctgatatagaggttcacagaaggtgaactgtagggtagggtgggctgtggttaaggtagtcttcctggaagaagtgttctagactttgaaacactagtaggattcagttagagagggctaggataggagaatggtggccaaaggcttgaggtatataaaggatactgtctttatttttctggtatagataagccgtcatatagggtagcaatgagaaagagcgcataaaagattagtagcttggtggtggtcatattttaggggcacacagatagcaaattggtgactcacaggcattcacgctctctacctctcactttctctccctcacttctgttttatttggcctttctagtgcctaatcagtgaaattttaatgtcacacactctccggtttgccacaggtgccaccactccctattgcattttacttactctgactcattcctaacccctatatacaccagaagttttgatccctggtagacaacatgaatgctgagctattgagtttggtcatggtcaaattgtgtgcttaggaaaggtactcttagctgcagtacatcagatggcttgatgtaaagagacttgacatagggagatcattgcagtttcaagcataaggtgtaataaagccctgaatatttcagaagtaggagaaaagggaatttgggtaaataaggaatttttaaaaaaattattaattgaaaaatcctggtggtagagacagtggttgtagccctgacacaaacaggcaaatcgggtaggggagaaaatactttcagggcaagggagaaaaattttacaaaaaacattacattggaaaatgtattggaggtcagaatagaggctgagactgaaaataaggatttttggagtcatttacaaagaagtgattgttagaatatcaggaccaatggagttcttaagtttcctcatgaaaaaagtaacaaatggaaagttaaggactgcatatctggggactatacatgtcaaggggatgggagctattagagaaatcagagcaaaaggagtcagcatatcagagagatggccaggatgctatagtgtatcatcaaagccaacacaagaggcttttaaggagtgatgaataagagaatgagattgggagaagagatatttccttcgatatgtcagattataatgacttatttagtttaaatagttatttttctatagttttttcttgaaacaatctacactatataccagacacctgtattccttaagcaactgttctgtttattcatggtattttggtctctgtctcccttataagggacatctgcattcctactgggcatgcaactgtctggtgtcctatctattgttcttcttccacttgtattgttttttgtttgtttgtttgttttgtttttgacatttccttccttcctttcttccttctctccctccctccttctttcctctcttcctgctactttctcttacattcttttcattcccttcctccctcattcccttcttccttccctcccttcctcctctcctccctcccttcttttcttccttccttcctaagtaaattctttctttgatgaaagaccttaattttccttaataatacctaaggtgaaatacagctcctggatgcctccatacctggaaactacagaaatacctccatagatgtttctctacgatgcatacatgggactatgccagcttgcttctatcccccacaatccccctcccccgccccaccaataatttctacatatattggctgttttacttttctgaagcccatttgagtaaccagcactgtactcaatgtgtggtatttataggttgctacacgattatgttttctcaaatgtgatttttatctcaaaacagattatatgatctatataacttattattggataccgacagaataatcagaatgacacgaagatcatctagtccattcccctgattccaggcaatgctacacctaagtcatcaaagatagatgggtatctattgattctgcagggaaaaaagattcttcaacttccctcaattaaccagttctagagtataattattcttatagtcaggaagctcatgcatgtgtaatagtagagctcgtttttgtctcctcaatccatctttgtaatcattgatctatttacgtggctatcgaccatctgtattttatgcaggcttgtgagtctgcatgtgtgcgtgcactttacgagggttgatgactttagaagactacaagtatgtcaattaaggctataatggcattagtattgtagaatttgaaaacatttttctcttaaataacaacttgtattcaccatgttcattttcataattctttagggaaaatgaaacagtagcaatgacagtaacaatcataaaacatttctttcttatttctcatcatggtggaataattatggcatgcttttgcagtctgaaaattcttttatctataagctgctcttctttcacatctttggctcttaaataggtgattaaaaatttttttttgtttttttcttttattgacgtttcctttgacccttgtttgctactttcagtctattattataattacacatattccaagcaaatgttatcgctgcttatttttattctctctatgtctattattgattaatgccagtattttcatttgtcaccatcaccagctgtgttgttgttcacagagaaagaaaaggtagctttaaacaattaattttttcttgtactaattggattgtgcaaaatgtttttaaaatataaaaaattgagcctatggccgggcatggtggctcacgcctgtaatcccagcactttgggaggctgaagcgggtggatcacatgaggtcaaggagtttgagaccagcctgccaacatggtgaaaccccgtctctactaataatacaaaaattagccgggtgtggtggtgcacgcctgtaatcccagctactcaggaggctgaggcgggagaatcacttgaacccaggaggcagaggttgcagtgagccgagatcgtgccattacactccagcctgggcaacaagagggaaactccatctccaaaaaaagaaaaaaaaaattggccgggcgtggtggctcatgcctgtaatcccagcacttttggaggctgaggcgggcggatcacgaagtcaggagattgagaccatcctggctaacacggtgaaaccctgtctctactaaaaatacaaaaaatcagccgggcacctgtagtcccagctactcgggagggtgaggcaggagaatggcttaaacccgggaggcggagcttgcagtgagccgagatcgcgccactgcactccagcctgggtgacagagactgtctcaaaaaaaaaaaaaaaaaaattgagcctatttacatttttagcaaaacgtaagtctcactaacagttcagtaagatgcgatctcagaaatcatattttatgctgccttggacactttaaaccatggtagaacttcattagaattttgattctttcatactatatccattgggtctattgaaattagacgatggtcagggtagaacaggaatttcctcataagtgtaaaactaggggccaggtgcagtggctcatgcttgtaatcccagcacgttgggaggccgaggagggaatatcacttgaggtcaggagtttgaaaccagcctgaccaacgtaatgaaaccccgactctactaaaaaaaaaaaaaaaaatacaaaaattagtcaggtgtgggggcgcacgcctatagtaccagctactcgggaggctgaggcaggagaatcgcttgaacctgggaggtggaggttgcagtgagccaaaatcacaccactgcactccagcctgggcgacagagcgagactccatctcaaaaacaaacaaacaaacaaacaaacaaaaacaagtgtaaaacttggtaagtggcctctttttccttatataaacttccaaaatctgaactgggaaatgaaaagcaaggttataccataacccctcctctaagtactagctgtgaggctacttccagacaaaaagcattagacacttagcctaagagattcagggtacaggagtcaaggctataatgtccttgatggaattatcagagagatagagaacaatcatgatttcctcccccagctagctccctattcattttttgtagcatacaaatttgttttaaatccaaagcttattggctagtcatatatttaacaaattatacacttttgtaattgatcatatctataaaaccactttctcttatgtactaaagaggtaatcaaaacctttccttctatacataaggaataaatctttacattctttttgcaaggttctattataattctagatatcctcctatgtaaaatagaaatgtacctagttattaaatcttttaaagacttgtgatagttatagtataatctaacataatataaaatttaacatgctatggcacactttaacatagtataataacgggtataacgtaatggtattttaactaatctctttaaaatattttaggaaggcaggaaggaatacacaagggaaatttaagtcttttaatttcttaaactcagtggtagacacgtagattcattgtctttgtatccatcttcgtgtcttaaatattacacaatgaataaatttaaaagtatttagcaagtgctgaaagcgtatgcttaaatcaggtttcctctactttggcactactgatgttttgggcccatttttctctctctctcttcttttatttttgactactgtcctgtacattataggatgtttagcagtatctgtggctctacccactggataccagtagcagctccaccaccagttgtgacaacccaaattgcctctagactttgaaaaatctctggggtgcaaaattttccctggctgagaaccattgtcttaagaattacttttatttctgaagtatatgtagtaaagtttcagaatttaatacgttcccaatcatttgcttttattttccgtgtttattataaacttcgtgacaggttttggacatttaattagtataggtccaaacaaaatgataccatacatttacaaattctatatcccaggaatggaaagtactcatgttaagctctgattctgacagaatgcattcctgttacgttgcaaataccactagtcaagcattgcttaaagtacaggtcataattgttttccacctgtgaatacaggcaatcatatcagtgtgaataggcttttttttttcctttaccacatagtatttacatttatagtttaatagtgctgagcaattcactttacaccatttttaaaagcttatttgtttttgttttgttttttttaaatatgtcatttagataaatcaaataatatcatggtaacgacttcttctctgaagtgaagagagctgggtctgaatcccagctctgccactcaccagccatatgaatgggagaaagttacctaacctctctgagtccattttcttttatcttttaaatagctagtaagtttattgaacggatcaaattaaataacacatgaaaaagtcccctagcacattgctggttacatgataggcgcacaaagaatgtcttttccagtgagtaggaacagtacagttacaattggtattttgaaatattttccttcaaaacttacaattgaatagtcagccctcagttttctatgttaatggaaagaattatcagcagggtgataattctcctggggcttcttcctttctctgtactgtctgaatcccagaaatagagatatcaaatagggacaaaggaagtatccaggagtagtgtactatttttgaggggactattcagaaacctcactttaacccctttgatctttatttttcatgctttatgttgtattttagttcatttgcatgctgacaagagaaacgtagtcttcagagtagacaaatataattgaatgacaataaactagtaaggggcctctagataaagaaatcaaaggaatgtgaaagcaagagctgctttggggggactgcagtaggtgagaatgaggactccagaatgccatcaaaaccttttaatatttatacatattctatagatttttaaatattccacttaaataaatgaaacaaaagtttatccatcaattgtttccaacagctttaatgtgttgttggatttatattactgtaaattattcatgtctttggtgttgtaaaatttagctttcaatgcttgtattattattaaaaactgagatgaggctatcataatttgaggtccttaaggcaagtgatctgaaaatgttttaggaacctggtgtttttgtagttgcatattttttgtttagattttgttttattttagtatactgagtgatattagaatcatatattctatatttagaatcatttagaatatatgagaatatttgaaatcatagctatataaaattatcaatatctaatatgaatgaaattgtgtttgtttagtttgagtattgctagaaaacattttgtagaaaacgaagtacctaaaaagtaacaacatgaccttttctgaagttttggcagtagaagaatatagaaatcaaagtacctaaaagtagaaacatgaccttttccaaaggtttggcagtagaataatttttgtttgtttgtttgtttgtttttttgagatggagcctcgtttagttgcccaggctggagtgcagcagcacagtcttagctcactgcaacctctgccttctgggctcaagtgattctccttcctcagcctcctgagtagctgggactacagaccaccgcccggctaatttttgtatttttagtagagatggggtttcgccatgttagccaggctggtctcaaactcctgacctcaggtgatccgcctgcctcggcctcccaaagtgctaggattacaggcctgagccaccgcggccggccaagaatttgtcatattaaataattaatcaggaatggtgtgacccattcagaataactagttaggatttaatatcaactttgagtatttgttctaataaagaattgcaaaatatactaaatacttggggactaacaaagctagatggcagtgctaaaatgtggcttcaagagtgttttcagttgatcagaagtaggagaatgggattagtatatgacagcaggcaaaggggagagttgttagatgggagtaacctatagaggtatcactttacaggaaagaccgtaagcaggattccctcctaggaatgtctagaaagcatatgggtgaaagccaatatgatagggagaattctacctgatggaatgcttaaaatatctttttttttcttctcttcaaattgtggaacctttcatctatgaagtacttactaaggtgtgaccattcccttcagccttatacacattgtgctcaaattcatagtatgtacatgttggaacactattcaccctttaaaaagaaggaaatctttgaacctgcaggacattgtgctaagtgacataaggcagacatggaaagacatatactgtgtgatctcatttatacagtatatagaacctaaaaaagtcaaactcatagaagcacagagtagagtggtggttaccagggactagaggtgggagtggggattgggagatattgatcaaagaatatgaaatttcagataggaggaatagttcaggaaatttattttagaacatggtgatgatagctaataacagtgtattgcagctttgaaaattgctaaggtctattttaaatgttctcatcacaaaaaattaagttcgtgaaataatggatatgttaattagcttgatttagtcattccacagtgtatacatatatcaaaacatcattttgtacaccataaatatatcctttttgtcaattaaaaattatttgcctttgtatctctgtcagaatcagaggccaccaaaattaaaactaaagtaagctttataaattattcatttcccttatttcgcgggaggagaaaccaaggctcagagaggtttacatcacatagtcaatctgggatcacaacttggttcataagatgctcaatttattgatttttttaaagcccattgtttgacctgtttttccttgctgtggtatgcaggtgggcgagcgggttggggagtttactgctggacagcaataaaaagtagtaacagaaagtttactaattaaaaacacttagtgcaatctctgtcattggaagtcagagtagaaattaaattatcccttgaaacatcttcttccagtattagatgacattataaatgtcttcattgacattcattattgtttgtgttgtgaaatatataattaggtgccaaaaaatacttaattttacttaatgcagtataaggggcattggattccgtttctgcattaataagcagcattttagtaaaatgaaagggtagctcaattactaataagaccatcatttattttatcccatatgaaggattcagagtgacagaaccatttaatgaagtctttcagctttgtgagaaaaataagagtacatattttggccttcatttcataatttttcttcagtgtatatagctgaatagtgttgaaaaattagttgcttcttgggaaaagcaaagaaggtgtctgcttttcttccttgagtgctatgactaattgctacattgtctctttggagtttctactcttcggcggtttatacttaaaataccactctcagtgtagtggaaaaaaaattcttttgggtttcagtcctgtattctgtatatgaccttgggcaagtcacttttcttcttttagccatatagtttttgcctttagaaggggggaaatgtatacttataaaaattggttattatacaaattaaatatgagcatatgttaaaaacccttgcaaactataaaatactacacaaattgaacacacatagagattagtatcttagacatttatttagctgtaacctgtcactctttctggccatttatctaaagagaattaacacttaaacattcaactattacttgaaagagtatcccaaaaagaactcatagtcttcatccttcccccaaatgaaggcctatatctcctggaatttttttcatcccctctctcttctttgatcccagctcatcatgcattcttactgattgaagattttctcacctcccatgcccataggactagactactattgttttctagttggtctttgtctctagacttcctccagtctagcacatcacattacttgattcgactaggcattctttttcctccatcaattcattttcattcttaagaagtgattgcaatgattgccacctgttttcttctgtttttaaatgctgtaatggatctctagaaattggagagtttctcagagtcttgattttgaataatctgtgcattacgttacttacatttgctcttctccatgcctttgcacctgtccttccatcctttaggtgtcttttttatcttttaaaatatgacttaaaacctactttctcttggaaatactccctattctgtaaactagactgaacattctctccattcttcatctgctcatttctactgtgttattcttaatcttttgaagtgatttttgaaaaagatgtttgcatgtgatgcagacattctgagctgtatcataagcattctttgtattggtcattctttttacttgttttcgaatcagatgcatgatacagagttttctttatatgataatgttatatcatgtgatttggtgatattttcaattagatattttgagcctgttaggctagtcccctctacaaggctatattgaatgggtgagcactctatattaaactgactttcagatttacagatttccctttcttgaatatttagggctgctttatctctcaaagatttctgagaattataagaaccacccaatgtcctttattgaataaaaggtcttcatgaaagtaaacataaaaattccatacaatatcaaataaatatttacataaggttttgattaacgcttcgttctaaatatttctgtcatagatgactttgaaatttcttgtgcattgagagatgaaacctatcctcatctacacagtttcccgggtttcatctgcctattttgggggctttggttcacccaagagaatactgatggtcttcattagcctaagtgcatgcagtcagtgtgttcggtacactagatccaaacagaacagccacttggttctgtttatgtaggttccatgttgtatataattttaaaaatgaaagcgtgactacttccagatgaagagattttccgtcagtgatgagtagcatcgtaaatagggaagctttgtttttggctgccctaaatccatgaggaagatttgaagtattacaaagacaacagatgctaaaacagtatgcttctcatgtgaagttgtgcttcccctttggaccggaggtgtcacaggtctagagaagagttgagcttccctaaaggagagcttgggaatgttaggcatcctccttagatcctgaaagcatgggcttatctgatcttagggccaagtctcctcagaagagccaacaggttaaatgtcatcaagagggtggactttcagaggatgagtaactagttggtggcacagtaagcagtcatatagaagtgactgcttagagtgggactacatctgaataaagccaggataaactctgctcaaccaacataaagccagtcattggaaaacaaatgtattgggtcaccatatattgtcatatatgctacttaatcattttatttttatggaatgtggcatatgttctagatcatctttacatatgatctatctcattgcatttcatttgatggtagagtggtggtagagtttgcctgatgaatgtttataaataaacacgaacacatattgctagttgggaaaataatcaattattttattttattttttttttggagacagagtcttgctctgttgcccaggctggagtgcagtggtgccatctcggctcagtgcaagctctgcctcctgggttcacgccattctcctgcctcagcctcccgagtagctgggactacaggtgcccgccaccatgcccggctaatttttttgtatttttagtagagatggagtttcaccgtgttcggcaagatggtctcgaactcctgaccttgtgatctgcccgcttcagcctcccaaagtgctgggattacaggcgtgagccaccgggcccagcccgaaaataatcaattcttaagcattggagtgaagactgttatttgctttatatctgttagaaacagtgtcccaggccaaatacacttatataggttatatgtatagataatttgaatactgcttcaaggggaaaatatttcaaacaaaactagatttgtaattgttgtaggatttctttgatttctacttgactagctcccctcagttcatggtacaaatgaatgactaagagtaagaattgttcgtgatcctctgattgtctctgatcccttttttttttttttttttttttttttttttttttttgagaaagagctctggggcagtgggctagaaaggggtgctcccctaggaaacccccaggccaccgctgcccgccacgcccgggcctaatgcccaggtgccccagggctcaccgcctctccagtccctgtccccctgatctcattctttctacactcagttgatgattctctttgtgaaaatgtatgggatgtttggaaagggtccccaaaaagccaaagcaaacccaggagtgtgtctatacattacaaaagtgaagggtcagtatctagatgatggtgaccagctgaaaaatgtccctgaatggctcatcaaaagaaatccatattgaattggatcagattaaaggaaggctaagtcccaaattgtaaaattttaaggcaacaatgtaaactctcccagagtaatcaaagactatctgagaacagaaggttgaattaagattaagaaaagggtcatttgagatacgtctctaatatttaggctgtgtgtgtacagttcaaagcatagtattaataaaatgtaaccatgggtgtgcacgttaccattactgtgaagccattgtttacccttctccccagaagaaaccactattctgaatctgaggctcatcaaccccatgcctttcttttgccatatatggatgtgccccaaaatatatgttatttagttttttcctttgtttttgttttgagacaggatattcgctctgttgcccaggctggagtgcagtggcacaatcttggctcactgcagccttgacctcccaggctcaagcgattctcctatctcagcaaccccacaactccctgctttccacctcctgttccccacttagatttactcacatatttaacttttttgtatacctttcttcttatatgacaaaacttccttctaggatcattttacttctccccaaaacaagtctgtttattttatttattttaatttattataattatttttagagacagggtctcactcagttgcctagcctggagtgcagtggtccaatcctacgtcgctgcagcatcagtcttctgagatcttctcaccttggcttcccgagcagctgggaatacaagcttactaccatgaccagcaaatttttaaaagctattttagcgatgggggtcttgctgtgttgcccaggcttgtctcaatctcctggactcaagcagtcccctatctcagactccctaatagctggaaccgaaacaagtctttttgaaagacttttagtgagattctggtcatagcaaacactgcttttgtttctctaattattttttttcacccttgttctgaaaatatattttcactgggtatataattctagcttgtcaattattttttctcagcactatgaagagattatttcaccatattctgggttcagttgttaactgagctgtagtctaaattgacattccctgggaggtaatctttctattctacctaggagtactaccaaagaataatcactttaaatataaattatcagcatatatttttacaactaggtagtttaaattctaacccaaaacttgcatggtggagggcgggggtgttgccttgtgtttagaagtttccagcagagaagccccttatctccaatcccagagtcaaggcaaaaccagacacaattctttactgttttcttctctaggcgggctttgttttttctccaaaataaccccttttctggaggtattaccttttggggttctgtaaaagctctagaccagtagagtttggtagatgttcctacgatagtcttggacttcagtgtctggttatgtgtctggattagtgctttctttttattttttttcccattggggagtttggggggcaagtaatgagaactttttaaaaatgtcttgccaagttagcttttcatctgaagatatttttaaagaagtctattcagcattttaggtgttctgtaaattgacagttcctctgggtaactaatcagctatattgctggaagcagaagtctattctaaagtatctctatgactctgttattgggaagttgagagaaacattagatattgataatctgccaccatgttcaggttagtgtatttaaagttctgcagatgacaagcgttgtttctgcttaaagaaaaaagtgttagcttgccagatgtgtcaaaatgtccagggtattatggatgctccattttgactttgtatttctttagtctaatggataacttatactttgttttcgatacaggcacctttaactagtacttaaatgaaaacagagaactaaataatgatagccgatcatcatgtatggcagtttctattataaatattttgaactaattgaagtgatttatttggtgctgtaatgataggggtcttgaatatgaggatagaattcagctttggaagcatctgcatgtactattttataataatgaatcctagcattggtttgtggcagtttgtcatggccgtgataggatgatatctaatgaaagcagaatatagcgttaacagggtatcatatatctgtcaacctattttgtctgttaaaaatctattctaggccaggcacagtggcttacacctataatcccagtgccttgggaggtggaggcaggagaattgcttgagcccaggagttcgagaccagcctgggcaacatagtgacaccctgtcactataaagagttttttaaaaatcagccaggcctggtggcataagcctgtagtcccaactgctcgggaggctgagttgggaggattgtttgagcccaggagattgagactgctgtaggtagtgattgtgctactgcactccagcctgggcaacagagtgagactgtgaaaaaaagaaaaagaaagaacgaaagagagagagagagggagggagggagggggggaaaaagaaaaccagtaaaccagttaggaaagggtaggtatatgtaaaataggtgaaggatggatatcaatcagaggaaagcacgccaaacagaaagacaagttctcaatcctgcccaaggatttaatttgcagcttggctttcaagctataaactgtcttcggcctggagttggggaattggggtttcaccaggtacccacccgcgtctgcctaagcatttggctgcctcctgttgctatcattacatttagacatgggcatacatactttggatgctgctattcaatactcatagtcattaatttattctatatgtcctactttttaatgcttaatatcactttttatgtttaatatggtttataatttttattttagagtacaaaataggacataaacaaaataaaaggtaaatagcatcaaaggagtacttttcataattatcctttatactgtaaatcataaattatgtagaaagcaatacatgtattttgcaaataggatcatgacattagtgggagtagaattttttacatataatcactattttttctattatagtagtaaatatatctgtgatcttcactgatctacttagtacagggctagaaccccttgaatagtttaattgaatttaaaataggaaatgtttagctaccgtgtaatttccctagcccagatttttggctgtggaatggaaaggaagggttgaacctgaaagagattttttttaggaaaaattgtcagaagtgtgactgaaaggtaattgccagtttgaaagcttagaagatgaaaaggatgccagttctgttggcagaatgaagccattaggagacgctgataaggtgtagggatgggtcagagtgaggatgagttctcctttagatttgttcagtttgagttaatgatgggacatctgggtgggaatgtcagttagaaacatggagcttgaggatgcctaagagtagtcagggctggagacgttcatttggcattatcagcagtgaggtgatattgatcatgggaaagtcaatgcgccttctagggaactgagtataatctgaatgttaaatgtcagagtttcaaatcatttctttaggatatgtttctctgcctgggctagattaaagattagataggaaacctttaaatccccgattatttctaagacacacttgttacttcaaggtcaggaattttctcatcgattttcaatgcttgtgtgttattttattaactaatgtgtttttgaaaatagtgactgcatgttgagggattgaaatgctccacccccaaatactttagtggtaatcagcattttaacatacttcagtatgtatgtcgattcttggagtcaaatgcaagagttttggaaatgttaggaattttatatcaaaaggagaagattgtaccatcaccacctgacagaaaatgtattttggatcaaatggaaggcaaattactcagtcatatgttgattgtgttccattgtgtaaacaagaacatacacagcccttttggccctgtcatctttatgagggcagaatctccagaggttaatgtggtggtagtcacgtggtagacatccagtatatattggcagaatggatgaataaaacagaaaataagtatagaaccaagtactggcatgaaactgtcatttcatttgaagaaaagtaaaggaacacatgatttaagaacagtaaacacatacacagtgatttaagccatataccataaaaaagttctgaaaaacatgggtaaggaattgtgttttctgaccaagcaaaatggggaaaagatgtgttatgatgatagagatttagccaagggacttttagggaaatgtttctttttcttttttttttttttttttttttttttttttttttttgagatggagtctcgctctttcacccaggctggagtgcagtggcgctatcttggctcactgcaagctctgcctcccgggttcacgccattctcctgcctcagcctcccgattagctgggactacaggtgcccgccaccgtgcctggctaattttttgtatttttagtagagacggggtttcaccgtgttagccaggatggtctcgatctcctgacctcgtgatccacctgcctcggcctcccaaagtgctgggattacaggcgtgagccaccgcgcccggccaaggagaacgtttcttatctagatttttaaaaatacacaattgtcaacataagttaaagtaagacattacatatatatataatatatatataaatacattttttataaagaaatattagccccaatccgtttatgtggaaaatgatagtcttaatcaaaatgaacctaacgcagttcttctactagtaaagtgacttaatgagatagaagacaaaaaagaaaggttatgttttggcaagaaggaaagggcattatggttcaatacctttacttaactaacctttaagtgttcaattaacatttaaaggaaataaagttttggaagtattacagaataattgcagaaatgtaaaaagtagttaaaagcgtgtggtctattcgtagaaattccttcacttaacactgacaatcatcagaatgtaaatttgtgatgcgtaaaagatgaagaaaactctgctcaatcaatgacatagttgctgctttctcttttgctgttttctttgtgaacttcagttcattgacattttctaggataaaaccttcatacttatccagaattgatcttttaaacacaaatcctgaaatatttgaaaaaaaaatatgcacagtagtaagcagcagcaggtggggttgggggacggcggagaaattgaagggcttgtgccttgaaactttccaggatatttgcctatcaactcacagtttgtaagaatctgttgtacttaaaaatttatcacttctagcctttactactatgaacagtttttcacttatagcgagcatagagggtagtcttcgactattaactcacctttgcagtttatttagagaacagaagcaattgtagtatcaaggaagcattaaattcaaaagctattttaattttttttaagtacagagttttggggcaatatgaatctaacaattttattgcctagcctgatctgtgtcacttcacctgtatttttcttgctcttgctcatagctgctgttgcaggaccctgattcttatcaaaagtctcaacattagatgtttctagaggtctcaggaaatagcttacacattctctgaattaattttgccagcttccatgtggcaactgtgggttcttgttttgatcctctcccctggggacaactgtgtgtgggaagaggggaggagtttcccacggggcacagctggtggtgtattgaagccttctaggtgccaagggtgtggggtgttctctggcaaagtatgggaacatgtattttttccctgctttcctttttaaatgtacttgattagaggagtaccaaagcagtgctcttcacacagttctcctctccacagtactcagacatctgaccacgttggggatgaatagtctgggcctggaatcacatccaaaaaacaactacagtgcactcagaatcaccctaactctttccaaattgcaggttttctcactggactaatcttgtctgcttgctgcttgacttctctccctttacaaaatgtctttcctgggagcccccttagtccactacacaaacagacttcaggctgattccgaggactctgtatatcagtgtcaagctgtgccttgaacccctgccttttttccatattctctgttggtatgcttttgatgagtaggtgaagtggaggtaaatgagtaccattacatctctctctcctctgtattatcttccttcctcttttatttaggaatttatgggaatgaaaaaatactcctatccaaccttatactacatctttgtctacaacgtttagtatgtacatatataaaaaatcagatatgtttaggcattgactacaaggaccacttgcaacatgagatcctacaggtaggtgactcataagagcaatatgtactattgtagtagtctgcatctgccgcacatttgagagtgagttttattctaattcgcaagtacaacttactaaacagtggcagttacataagcttaaaactcataagatgatattcagagtcagaatacatccaaggccactaaatgtgttaaatatttcatacagctgaatagagaaaagatatgtcacctcccactgtggcgccttcattctgaaaataacaggttacctatagctaggagaaaaataaaataacaaaagtttcacattccaagctaaaattatattttaggcttgattcattccacaatacttattttcccagttacagcttaaaattgaggtggagatttttaaatatgcagaattgattttaaataattttgattatcttaatctttctaatttagtttcactgtggtgaaaattattcaagttaccaaactgagtctttgtttttcttaataacatacatacttcacacaaaaaaaaatcaatagaaacagtttttaaaaacaattgagtaatttccatgcatcaaaaatatttgaaaaaatggaaataataccttggtatttacttaccttcttattctataaaagaaaataatactaatggagcaaaatagtggattctcttgatttcatttcagtattcatatatgtggttatatccatatttatattttagtcaaagggtgcgatattttaaaacttgggtctcattaattagatgataggtgccattgcaggcccagagtttaatggaaaggcaaaattgagtgggaggagggaagagacaaatggggagaacaaaagggtacttatagtaggggtatagtacagttgttttccatgagacttatgttctgtgtaccctaccctagttatcttttcattgtggaaaaataggtaacataaaactaaccattttaccctttttacgtgtataataaagaagcattcattacatttatgttgttgtacaaccattaccactatttccagaactttgtcatcatcccaaacagaaactctaaacctattaagcaataactccccatacccttctacccccagcttccggtaacctcaattctactttttgtctctaaaaatttgcctgttgttgatacttcatatcagtggaatcatacaatatttgttcttttgtatctattttgttttactaagtgaaatatttacacatattgttatctatgttatgacatgtcaaaacttcattcctttatgactagtagctgggattacaggcatgtgccaccacgcccggctaatttttgtatttttagtagagatggggtttctccatgttggtcaggctggtctcgaactcctgacctcaggtgatccacctgcctcggcctcccaaagtgctgggattacaggcatgaaccactgcacccggccactggcctcttcttaagagggaactaatcatattcgtgagggctccactcttatgacctaattgcccctcaaaggcgctgcctttaaggataatcacgttgaggattagatttcagcataaggattttggagggacacaaacattcaattcataagaatcatcaaatttgagcatgcatcagacttcatcacttttgcttgattctccattaaaaataggattgtattgtgtacttaaatatagacattgtagataatgggagatgttgtacaagccaggtgtaatttataagattgaagattattccaggttttgaaaaattatgaatggtagagttgatactttcttttttagtattattgtacctaagcaaattctacatagtatttttctgtttttagtttagattgactaattattgtgactggaaataaagcttaaaaattattctaaacacggtgaaaccccgtctctactaaaaatacaaaaaattagcccggcatggtggcgggcgcctgttatcccagctactcgtgaggctgaggcaggagaatggcatgaacctgggaggcggagcttgcagtgagccgagatcgcgccactgcactccagccagggcgacagagcgagactcgtctccaaaaaaaaaagaaaattattctatatgtttaagtcccagaattttactcggttttggaatacgatttattcttatgtgatcttttattcaatatgtatatactatattgtacaaaaaccaaacaagtttatacgttttattcacaatttattgtagttcatttttaggtcaaattttggaggggcggggaagggcggatactctggtaccataacagaaccacagtcagaaatgtactgtcctagttaatcactttcataattgttaatgcatgtttaaaaattctaatactaaaacactaaacttttatacttttatttctttttagaaccttgtgaaacatcttcctgagcagaagatactcaacgaattagcagagcttaagaatgaatatgatgacctctgtgagcctgaacaatttggagttgtggtatgtatccaacatgagggaccacaaactcagctgggaggttaacacttgccagaaacagtgaaaagacaaacatttcagttgtcaattattttttcattactgtattgctacataatttaatataatattggctgtcagaaaaaaatacttttttacctattattatttgtcatggcattgaaaaataataaaatattcgcattcataaaatacttcaaaatatctcaggggatcttttgaataacagtgccaatttttaattctattaatatatgcaaacagtatacattattattatatgggctatttttctttccatttagatcttaatgttagaatttggcctccaaaaagtaggttaaaataaaaggataattactagataattagcaaagtactagagactctttttctagggtatatgtcgtgtcagaaaaagcaaaaggattttcagatttcatatagagtgtcattaattgatttaaagcttaaaatgtgctgttttagctgggaagaaaatcttatacatcatgtctttaaatcatcatgtagttaaattattattggaatgaattattttttcttattccacccttcatattaaggggtacaaaggatgaataagtataaattttgaattcaagattatagttatattttaagtattccccaaactgactattcaaatagttgacaaaaaacaaaaacaaaaaaatggcaggaaagagggcattatgatttatttaatttcttggagaaaaagctattttttacttaggtggtcagtgcaagtttgtttgctgtatgaataaatagttccattatggtcaccaactttaccctggctccctgaacattttccatttgcatactaaaattttaaaattaccattgaacctaatagtcaaacattttcagcgttatccaaaatattctataagcttttaaatagtataatatgttagaactgatccaatttgataccttgcagtttaaaaatcctgtttaaagtcaaactgtgctagatgggactgagcatgttccttttgaacatgtgcaataaatgctcacccatatttagagtttattaattttgagacatggcattgactgcacttatatagaaggattctgtcaaattcttgcaaagaaaatcaggaatgtatgtttgggatcagatagagcatataatggtatctgagaaaggtatttctcttatttttgaacaaggtgaattaatcaactaaattcgatagatatcatttgttaactaaaagcaatttagcacaacattgagtaatacagttatttagatcaaagtccacacttgaagcctaagctgcttggattcatattataattgaagcaagggtatataccctctgagaattcagctgtgtcatgatggttatgagttttacagtaggtatactacacaatttctctgaagccatttttttttttctgaatgcagtttatcttggaagatgtattagtttgccaagcaagtcctttcaagaggcatatccttggtaccacactgaggaaatgaagtttggggacgtaaaaagcaatataccttctgaactaaaagcaaaatagaaaatggaagagatttcttgtttatgcacataaccataaataattctgaggctgtgcatacatgaagtaacctagtccccgtatttactttcaccattcttagctacatgtctgggggtggggggcggaaagtcaaggacattacaaactagtttacactatgtaaattacctaagatagtatcaatcaggatttgcccaataaagtttagctgcattcacatcaaggaaatattttttaaacaatgatatactttagtttgttaaacgtgtactttgcagtgtttagaacaatatcatgtattaaatagacagtaaataaatgtttatggaattgaattacaggacaattattaagcctaagtccgagcctgaaattagaaagtagtatgatttaaatctgtaacaatagaaattttgctaaaacatatttctctaggtgtatgctgaaattcaattcacttctgtgtgtatacatccaaacactttttaacccttaaacatatatcaacagcctaatgtgaggacagttttggaaattgtttaatagaatcatctgcagtaatgagagaggctccaaactggaaaggctcattgcctctgctcacttctcttgttaacattattagtgtatttatcacatgatttctatatggaaaacctccggtgtctccctgaatttacagaatgaagctccttcgcattctcactgtatctctgactgtcttgctttcttcctttctgctccctttggtgaagtgagtcaattggtatctttttgacattttagcctttatttcaatcagactctcactgccgttttaacagctatttcactcgctccctattctgcgtcctttcatttttccatagtggccataccatacctttccttctctcctcaagtcttctgtctcctccccattcttttaacttaccacgaacatcctaacctgttacttgccagagaaaaaagaaagcagtttgacttcaaaacctccaatatttcttctacctacaaagttttctctagctatataccttttacttattctctgtcaagcctcagaaaaagaggagctccattatcattaacattattgttgttgctattagtatggatagaaacaaaataaatattgaggacttaatttgtcagattctatgagaagcatgtttacttccaccaacttatgtattcctcatgacaaaccctacgagtttggcactattaatggctccatattaaggatgaggatgccgggcgcgttggctcatgcctgtaatcccagcactttgggaagccgaggcgggaggatcacctgaggtcaggagttccagaccagcctggccaacatggtgaaactccatctctactaaaaatacaaaaattagctgggcatggtggcgcacgcctgtagtcccagctacacaggaggctgaggcaggagaatcgcttgaacctgggaggtggaggctgcagtgagctgacatcaggccactgcactccagcctgggccacagagcaagactccgcctcaaaaaaaaagaaggatgaggaaactgggcccaaggaagactagtttacttgtccaaggttacatagtaactagtagtcacagaattcaaatgttagcagtctgaatttgtagccagtgctttaaccactgtgctcctgggttgtgggtatgtgggtgtgtatgtgatgctctaccacatgctaatcttctcacttcagttttgggcattgttatgcactgcctactttaggtggtagtatctcttgcctgctttccttctgttagttattttattacttcctcaatttgtcagtttccactctgccctgctcttcagaaaaaaagaaaatcttcagtcatttgctgcctggaaaggagtggatagatgggtggatggatgaataaaaatccttcctgactgaggtttctgcttgctactgccttctctccatttcctagcatcagtttttttcaaagatcagtctcctttttctctctgcttccttaactctcattcactgttcaaccaatggtgatcagaattctgccttaaataatgcattgaaattgaaataagaaaggcccttaaatcctgttcacatccaaaatacacatcaaatatactcacttctctgtctccatcaccaccaccttagcccaagccagaatcatcgtttcaattaaccattacaatatacatttatcttgtttttcccgctaccacttttgcccttctccaaatccgtctcggcacaacccttagtaggatgtttctagagtgtatctgtattgcatcataatttttatctgcttaaaataccagtgctgttctatagcactaaagctacagcattaacttcttaccatgacctagaagatactatctggtctggcacctgcccacctctcctactttcatcacctgctatttggcctcttgctcattatgcctcagccacattttatttttgaacttaccatgttctttcctgcttaggaccattgcacatgctgctcctttactcctgcttgctgcctccctctcttgtttatacttcaagtcatagcttaatttttgctttcccagtggtaccttcatttgcctttcagtcagaaatagatcttcctactaaactctcccagattaccttttttcttttcctttctagaaatcatcctggattttaattaaatgtttatatatgaggttacttcttgactgtctataatcccaactatattgcaagttctataaatggatgaactatgttgattttattcacgtgtgcttaacaaatatttcttgaatgcatttgcatgaatggaaaatcaagtggactctttcagtcccatcttattctgtatctatatggcatttgataacataaaagaatttaagctcctttttgaaacctttcctctccttcttaaataataaatagtatttcctgattttttttttttaagagctgcctcttaaagctcttaaagaaagttctctctgtgtcccccagggtggagtgcagtggcgagatcatacctcactgcagcctcgaactcctaggctctagtgatcctcccacctcaacctcctgagtagcaagttccaccatgcccggctaatttttttaaaaatttttctgtacacatggagtcccactgttttgcccaggttggtgttgaactcctggcctctagcaatcctcctgcttcagcctcccaaaatactgggattataggtgtgtgccaccatacctggccttatttcctgattttaatactctaaccctgtgtagtgccctatagagtttccttgattatataacttcttagatgataaaaacaaaatctcatcagttaggggtgtaaatatgccagaaattagattactcttgcagtattcattaaaataatgataatgaataattaacaaattggctggtcatggtggctcacgtctgaatcccagcactttgggaggccaatgcaggcagatcgcttgagcccaggaattcgagacctgcctggccaacatggcaaaaccccgtctctacaaaaaatacaaaaattagccaagcatggtgctgtgcttgtccagctacttgggaggctgaggtgggagaatagcttgagctcgggaggcagaggttacagtgagccgagattgcaccactgcactccagcctgggcaacagaaccagaacctgtctcaggaacaaaaccaacaacaaaaaaacacaataaaattgacaaaactgggggaaattgtgaaagaaagaaacttatctaaggcagtgactgggacactaagctttctctaaccttttgggtttttttagcagccacatcattaggtttgcttataatcatgtgcaaccagttggaaaaaagagaaaaaaaaagaaatagaaaaacccagagacttttcctctgtctagagacagatcctggtaagggggacatgctcgctcccacatattgtatgatcaataatcttgtttagggggtagattggctgcatagcttcccactgacttgtcctccaacctacctcccacagaattgaatttggtacatcattgtaattatgtgctgtacctttactagggaaaaaagcacagatttttgaaagctctggcagttagaaccctcagcaggagcttttagactcttctgagtgtctttgcagctcagctgttctcaaacctcagagcaatggaagttcccacttgtcttgcacaggggatggagacccatactgtgtgtatctattaaactaacacatcttctgaggaaaagaaggcaataattaattctcttagtaatcgtactttgtttttctgacttcaaaattatccatatttttcaattaaaaacatcctaaagctataatctaacaaaaaatgttgaaattggcttgggcgtagaaatcttcataataggaagcacagatgatgtgatattgcggacagcacatttaaattttttttacacaaatatatgaagttgggaggagaggatttatgcatatagttggaagtacaactataaatttactgtgctttttaatttttttaaagcctcataagagcttatgagctataaagatagcttaaccaggtgaaaagaaaattcttaaaagctttttttttccttccacatatcatcaaaggcaattagtttggatagaaaattgtaagtcctctgttccattaatatcaaatcatttttcacttttgcatattcagtgtgaaaattgcatttttctttattttatatgcctgcatttggagtattaagtgttttgatttgtaatgccctgattgtttctattttcattacttttgtaaatattagtgctagttcttacttctagatatatattcattttatctgaggaaaaagctggtttaataattttgagatcaggtaaaagaaaactcaccatgactcattctcaaatacatgtatttatattcttatccctcttactaacttcttataatcatttttttgtgacagaatttcttatttccatcagcttttgcaataaaacaaggtaaaataaaaccacctgaaaattgaatattcaaattaggtcagtaggtgtcaattaattttgctattgattggttttcattaaattttttaaaaatcaaaagttaaccctttcatttttcccctccacatatcactaattcctaacaccaccatagaaatttttatggctgtgtccaggcatggtggctcatgcctgtaatcccaacactttgagaggctgaggcgggtggatcacgagatcaggagttcgagaccagccttaccaacatggtgaagccccgtctctactaaaaatacaaaaattagccaggcatggtggcgggtgcctgtaattccagttactcaggaggctgaggcaggagaatcgtttgaacgtgagaggcggagggtgcagtgagccaagattgtgccactgcactccaacctggatgacagagcaagactccatctcaaaaaaaaagaaatgttgatggctgttcttggcctcaaacatgttttcagaaaggtgttttaaaattcttgcctaactttttagtgtgattcttctgagtttatagtgccttttgggacacacaatgttattgtattctgttctagactaaagacaagtgaatggttgttgatgggtagtttccacatatttttatctttggggaaatattctctaccagtacatcattatttttcttttttctttttctttttcttttttttctgagatggagtcttgctctgtctcggcctcccaaagtgctgggattacaggcgtgagccactgcacccagcctacatcattatttttctgatgtagaatcagttttcaacactcaattttttcaaggcttcaattcacagattaagtatggcccttttctctcatgacatctaatgtacgaacatttggcattgactccatatagttggtacacttgtattgattattttttccaggcctggtactggatttgctacagaaagtattagaatgagtataagtaggagaggttctgccctggaggaggttgttgtctcaaagaagataacagtctttactttataaggtgtcataaatgcccctgccttatttccacaactccaggcagaaatctggtcagtattgactcaatctcatttctgtaggcagttctgccttctattaaacttaagtccattctcctttaatgtggtttcatgatcattctttttgttatagtcacagatacaaaaggattctgtatattcaatgggcaatggatcaaaagagtaactatttggaaaaaataccttgtagcaaatatatatttgttacaaatttttctgttaattctaatgaattcttaacattatattttgaagagacggggggatcagtttttctcccatatgttaggccttaatggaatatgtcttagaagtgaaaaggaaagatgatagaaataaccctaaaggccacacctgaccataggagtgccatgtggccatctccttttccgtcacatatgatttttacatttgtgctcttttcctttctcggtggattcgtaggttagttgggtagtagatcaatattcatgagctgcgtaggtactgaagtgtgtaaaattcaaattatataaacaaaactgtgtctaactctttggggaaataacccacttgtagttgctctcactaaagctgtcaatgcacttcttttatttttttttaatatagtgaagatcagctaaagaaatgagagccacttgatgtgatttgatagacaagtacatcgtaacacaaataaatcccctacataatacaataccctggtcagcatcccacagcacttcaaggaatgaattataaaacaaaggatgccagtcaactaaaatgctgcaagggaccacaactaaatacaaacacaaatttcagcagagtttttattttatttacttatatcacttaggtgcactcaagtgcctttatgagacatgagccttttaataattgtatctgtggctggggatgttgctcagtgcttcctactatttctaagcttagttatctaggacatttccttccatatccaaatcctctgatggagttgcaactgtttctatcagtgtacactggtctgatcgtaaaaattcacacttatggttgcaaaaattctgtggttatgatcaatatgtactggtttgtggcttttgttaagagatgcacatgtatagcttgcctcctacatcatctcttgattttgtaataatacaattttaataatgacatttctaatagtagatgtatattatgaattaaaaatagctaaataaagcatgatatttacagtggataatgagagctgttcttcactgagccctggaaatatatttcttaattttgaatgagagaaattttacgttgggtttgggggaaaagataaggaccccggtttcttcatactgacaatttctgaagatgaataaagaatgtaataacaacaagaactattgttttagggtgtttacatcatgtcagttactatgacaggagtgatacacatagtatcacatttaagttctaatgcatcgtgtatagatgatttaatgaatacattttcatgatgaggaagtaacttagaaactccaggtaacttgcagtaggtcatacaactagaaagtgaggcccagtgaggtcacttacatctgaaatcccagcactttggaaggcccaggtgggcagatcgcttgagccccaggagttcaagaccagcctgggcaacatggcacaaccccatctctgcaaaaaaatacaaaacttagccaggcatggtgacatgtgcctgtagtcctggctactcgggaggctgaggtgggaagatcgcctgagccccgggaagtcaaggttgcagtgagctgtgatcaccctacagcactccagcttgggcaacagagtgagaccctgtctctaaaaagtaaagtgacagaagtgtggctcaaacctatgtctgtgtaactacagtgtcgctgtttctcctactgcagcttacagtatgggtctggagaatgcagataattgtttccccctctttcctgggtttagagaaaaaaattctcctaaatcctattctttaagaaaaagctgtatggggctctgaatttgggctaagattgggccttggcggtattgttggggtgacctacctggaagctaatgaatgaccttacatgtacttcctctttccccacatcagcctgctgttatacctcttgaaactatatgtcctcttcttgacccagcattttactgaatattatgtttcctatttatatgaatgaagccattcattcattttacgatggtttattttcaaaatcacttttcatctttatcatctgccatgtatcaaaccttgttgtaggagatgaatcaatgaagaatttttgccagatcaaagggcaactttgaaccccttacagtatacaacttcttctgaaaagcaggctgactcatgatagattaatatctagtaatactggttcaacaaagttaattccctaacatttctggtttgacattataactgaagacattattttgtagaagtaaaatattactgtcagctattaattttgttgaatagacaattgtcctacttgggaaaagatctggaaaatagtcagctaaggagtgctttaaaaatcaatcagcacatattgatatactcaagactctgtgctaggtgctccacaagatgcagcttttgactcctttctccttttttttctctatgcagtctctgtatcaatgaccttacctcccatagcatctattcagataactcccaaatctgccaactccaatacttctaacccctagaactatagtttcaaatcctagcagatatcataataataacaaaaactcaacatgtcaataaagcaattttattatttccctatcatggaggtatcattttattattttttagaggatttgagagggatcaaggagaacatttagtctatgttagtaatccaagcttgaagtacataaaattatgagtttctatatggtgagcatggaaaataagggacgactctcagaaattctgcaggttaaaatattggtaaggattggtattattataaataacattgtgtttactgtgacttgaatatcacttcaagatttggggtcttgaatgggaaaataagagcatcattgttagaagtaagatgccctatttgccgggtgcagtggctcatgcctgtaatcccagcactttgggaggctgaggcgggtggatcacaaggtcaggagatcgagaccatcttggctaacacggtgaaaccccgtctctactaaaaatataaaaaattagccgggcatggtggcggctgcctgtagtcccagctactcgggaggctgaggcaggaaaatggcgtgaagccaggagacagaggttgcagtgagccaggattgtgccactgcactgtagcctgggcgacagaacgagactccgtctcaaaaaaaacaaacaaaaaaaaaaagatgccctatttgatgtctgagaagatggtcagctgaatttacttaaatgctaatacaaatttttcgtagcagccaagcaatacttttcctttatggaactagtgctttttactctaccttcccacagctgtagaggcagagcctaaaaaagaagaaagtaaacgtatggatcatttattttgactcccttcttttcatcaaaacaagaccgctttacaggaatttctcccactttacgatggggaaactaagaccagaaaattaggcagactgttttcacacagtcagctcacatgacagtttctaaattcagtctcatttgacttagttgctgctaagctacacctacctgcccctgctgccttagtccctgattggcttactggaatttaagtagcagcaggtcagggaaagcaaatccatctactctcattctctgaaacaagcaaacaaccaggtgacaaactgtaccaaattagcacatccttctaccttcattattgccggcagacttcaaactttggagccatctttgactttctcctgctataactggtcggttactaagtcccatttattcttccttaattctatcttttatatccattgttttctttatcttcctactgtcaacatgctacctcattacctgtttcttacaccattttgctaacttcctgatggtctccctgccattaatctctccttcaaccaatcatacttactgctcctaataagactcaagaggcagtgtggggtagcggttgagagtctggggtctgtagcccaaaggcctgcattcaaatcttcaggtttccaacataaaatttgattttgtgcaagttacttactatttgtttcacttttctcatctttggaatgaaaataacgataaccgtttcctaggattgttttgagaatcaaatcagttaatatataaagcaaatgttgaaaaatgtctggcacaaagtacttaataagtgttaattgctgttagcattgttaccatcattatcaaagcatactttggttatgtaatttcaattggagctgatatttttataaaaatatcaaatccatgttctctgagtttgtaggccaaacattgtaggttaatacaaaacatggaaaggataagaatatgattgcaggcacatgatattgggaccaaagaagactaaaagcccacatatgcctaagggttttgttccttgtccatctgggaccaagggcaccctggtgaacatggcccctataagctctgcaaagtatggccaggagagcaagtgcatggtcactagtagctgctcaaagtagctctatagcttttttagtcatcagggagactaaaaaactactccctaaacgtaaaatgatagaaaacctgcttcagtgctagtgatggccagttaccagtaaaaggaaaggaaaaataaagtggggagggatttggagacagaggtagaggcagaaatgaaggcagaaaaatatatagagaaactcagagtgattcccacacaaacatacacaaagagacctgcaaattcacggagacatagactttgatgcgattagcttccacttctgcggcctttacctggactctttagatacattgtttccaattctacccctaggtatgtatgtcatatatacctagcctataaaccttttctcacaccattctctctctctttacttttctcacaccattctctctctttactccctccttccttccttctttccctttctttcttttttttttttttttttttttttttttttgagacagggtctcactctgtcgcccaggctggagtgcagtggcacaatctcggctcactgcaacctccgcctaccaggctcaagcgattctcctgcctcagcctcctgggtagctgggattacaggcactgtgccaccaccaccatgctaatttttgtatttttagtagagacagggtttcgccacgttggccaggctggtctcaaactcctgacctcaagtgatcctcctgcctctgcctcccaaagtgctaggtttacaggcctcagccaccgcgcccggccactttttccttttagtgtcagttctatgtgtgcttaaatttacacatgcatgcacacacctatacatatattttttcatgtgtatttcctctactgtgaagccttcattaatcactgtaatcataagagtttaaagttttttcttcttccagtgaacacctccagaacttaatttctttttacctatctaaaatcatgtgctggctttttcaccagcaatagttttcaaggttctatgttgagtttcagactatattgtaagctttttgtgaataggtggcgtgttttatagttgccatgtgagtactgaagaaatagcagtacaatttgtataataataccctgaccagataaaaaaaagtgagtcataagtgatgagacctacaaaaatacagtaacaggtagatatttcatcatacttttgtatatctgcctgtgaaaagcatgaaagcatataggaggattagtagaaggcagaggttcatatttggagaggcagatgttcatggttaatgggcaaattcgaagaagaaaaataatgggctatgtcttgattctgtattagagtagatatggtctgcccaacagctcatctgctgcttttgaaaggtactttgtggtttaaaaacttttgtttatgtcgtcaaattctcttcatgttatctgcagatatgttggtgtctaatctgtacttggcatttgtatttaaggaagtaggctatatatacaaaaccaaatataattaggaatgttaataatttattttcactgtgtgcatgtgtctgtgtgcgttcatgtgtgtctacctctccccgacctccctcccagaattcattttgtgaaggaaaactagttgagtaacttggagctataggaaattaaaaactaaaacaattattatcatagtaactataccaagtggaatatttaatgtgcaccagtgctatgaaacaagtaattaaaaccaaagttgaactgtattgaagaaaaccaatgtagaattcttgcataatgtacttgaaagtaagttcatgtgattttactatcatctaattacttaacagcagcatctgtcaagtaggtgaaattctttagaaattctttagagtatatataaatagtatattttatgaatagaaatcataagtttaaaaattattaaatgctcaatcagagctagtcttctgatttcaaacagcatagtaataggtaatttcttaggaaatgttccagttatattttctgtcatcatgtacatcttttatctgcggcccaactattcactcaactcaatttcatgtttataaattttcctagttcacctcagggacagattttggcagtttgaatgctattgatggctaatgattatgcaattaacatatagcaactgttcagcttctataatattttattaatgccataaggatgatttatttttttaaaaacctgtatagccaactgctttttaaactttgataaactatttctttggaatgtttaaaacaaaaaagatttttaaaatcccagagcaaactgactttatgcagaaatgttacagtgttgtctatgaaattatccccactaaagagataaaataagaggcattaaatgtatattctcatagggtatttcttatcttacagatgagctctgtgaaaatgttacagcctcgtctcagtagtatcctgttcaagctcacatttgaagaacacataaacaacatcaaaccaagcatcatagcagtaactcttgcctgtgaagaactgaagaaaagtgaaagctttaacagacttttagagttagttcttcttgttggaaactacatgaactcaggctcaagaaatgcccagtctttgggatttaagatcaacttcctttgtaaggtaagatgacattttataatgctaatttacaacaataatcttcttgtctatgaaaggtgatactgcaaatagcaatcgtacataaaccacaaaattgtatgcttaaaaagggtgaattttctgggatgcgaattatatctcaattcaaacaaataattttttaaaattttagtaaaatctaaaagacttgaatattcttttggaatacagtacttaacatttgctgattacattttactgaagtttatagacaaaaaaatcccacttttataaactagatgcagtattggccaggcgcggtggctcacacctgtaatcccagcactttgagaggctgaggcgggtggataacctgaggtcaggagttcgagaacagcctggccagcatggtgaaaccccgtctctactaaaattacaaaaattagtggggcgcggtgacgggtacctgtaatcccagctactctggaggctgaggcaggagagtcgcttgaacacgggaggcgggggttggagtgagccgagatcatgccactgtactccagcctaagcaacagagcaagactctgtctcaaaaaataaaatataaaataaaatagatgcagtattatatttcctttacattattacttatatcgttctaaaaagtatctgacaagctaaatttaatgagataaatagccagaaatttatttttgaatatagtttgcttattctactctaagataataatactcttcaatgtcaagtagtgttgtacactggtatctggtgcattaactaagaggtaaaaaagaaaattgaataacaatcatcttgttttgattggatcatttaataatatttttgagacttatgaaaagcaaacaaagaaacagagaagcccaaaagtgcttgtatatgtccatttttaggctagagcaaaccaccttattcaaagaaaagatctgtctgttatagaagcctgaaaacactctgaggtgaaggcctgtaagaaagctagagacgaaaataaatctgaaaacaagcaatctgtctttgacaactcaccattctttcactcttttttttctctcacatctgaaaatattgcagaactttggttagttcttgaagtatattataatgagaatcccaaatctagcaatggatatgaatttcttttctatacatgcattaaattgatgttcattacatatacatggactagcactttgatatgtatcaaaaatgatttgatcttggtagttctaacccaaatagacataaagaataacacttatagataataataggatgtacaatagaattgtgaacatctgtttactcctgatatatttttgagggctgtaaggaaagagaacaaggaaaatacagaagattatctggaaatgctggattttgtgaagaaaacatttttacccccatcttcttgtgatatttggggacatgtaaaatcatttcataatgccagagggaataaggcagtgcttgtaataaactgtactaaatcatgccagatttataggatgaaataaagtatttaggacttcagcattgtattgcataccatatccccaatgttaatagagtcatctctaccatggtgctacttgcctagagtatatgctatatgcacactgagtgaatctaaaagtgttcttgcttgacaattataaagagattataagttaaaatatcatcagaaatttgtattagatacctattttgcatttaattcatataaaaatatttaaaaccattctaatttgaagaaatatgtaccttataagtgtcttaatttcacactattcaaattaattacatgaactgatttctttgaagcaagaatgaataagtcatttatacataggaacaaaaggttacgttaatctcaccgaaggattttacagttacatcttatattttggagagaggcttctttctgtcatctacctgtcaaataaaagttcttctacacaacgctgatctgacatctatcactagaggtatgctcaaaggattcagcacaaagatttttgccaacttcaaataaaataaaaaataatcttgcgggaaatactatcatgtagcaataggtgttccaaaagtgaaagaagtgaaggttttaaaatctgtcccccaactcaccccccacttttcagtaagatttttatcttctgggaaattttctaggaaaacagttgtcatttagaaagagaaatatcatacacatgcatgatattcccataatgtataggattcgaaggatgttcctggaatacaaaggattgtgagtaaatgtaaatgtctaaaatgacagaaattttctgaagcacgtagaaatagttagcttagttctgtattatgtttgaaatagaattaactagctactgatgtatgattagctagaattgctgtttaatttcagttgtattatgaaagattacttcattgatttttcttagtgattgccttcttaaagaaaatagcagggggaatttccctcatagaacactgattatggttttaaaatgataccatttactctcctaaatttttctaatgataatttcttttctcagtgattttaaaactaatccagtgcttttaacaagaagctatagagtatgttaaaatattcacctaggtaaaaaggaggcatgtggttaaacttatcagatgtatcttgtagtaaggtaatataaaaatttcagatggtcacagttggctgttatggtatttgggaagaaaaggaaaacagatggattaaccaaaatgtcaacactaaagggtatcattattgtaattactaccttcaccacaaaatgctttgttaatttgcagcagtgaattatcactttgtgagtcaccaaaccagtgtgctgaactgtaataaaaatcatttcaatgaagatgagctcccaatgttagcttagcctgttggttattaaaattctaaccaatagaaatgctacacttcaaggccatttgtttgttgttttttttttcagtacgaaatagcatatataatctgcataaggacaaaacattttaaaatacttagcattccctatatactaagctttgtgggtttatcaaataaggatctttgtttgtaagtatcagaacgtgactctgcctgattcaagcaaaaagtgaaacttgctggaaggatatgaagtaactaagccagaaactgaggaaagactaaagaacttgccctttaaaagaacagcaactgtgacagctttgagaattcaggtagcaggaatgaatgaaaagtctttttaggatgttgcctttgggatatatcagctccaaccattttccttctcctttccctatgtttgattcaaattcaaattatgaagagagcctaatgagcccggtgtggattataagaacaccccttgttcaagggagagcaaaaaaccctgattgacagtgctaccaaaactacctgccatggaagattggttatgccctaaagggtgctgttaccaaagatagggctaccaaaggttaggagcaggtaaagggatatcaggcagctctaaacaaatacaaaataaaacagatgatctattcatcagaggcctaccaacaatagagaagatacacagaaacctcaagaagcttgtggtacagttgagcagccaggaaatatacatacacaatattatgtaatgtcacaaggtacactgtcaatgagggcaaaaataaatggccactgagattagcagtagttcaggggaggaaggaatctttggtgattgggcagtgctggtaaattgaaaaagaagaatcttgaaggataggtaggattaagaatctataactttacaaaaggggagaacattgtggcttggaacctacgttttaacttacacttttgtcaattactagccaaattttcctgactaagtcacttaccttctctaaatctcaatttgagattgaatatttcttgaatatttctcccttcacttcttgtatctttttttggatttccttgcattgggcttcacctttctctggtgcctccctgattagcgtaataaccaacatcctgaattctttttcaggtaaatcagggattttttttcttggtttggatctcttgctggtgagctagtgtgatttttgggggggtgttaaggaaccttgtttggtcctattaccagagttggttttctggttccttctcatttgggtaggctctgtcagagggaaaatctagggctgaaggctgttgttcagattcttttgtcccatggggtattctcttgatgtagtactctcctccttttcctatggatgtggcttcctgagagccgagctgcaggagctgcagtgattgttgtctctcttctggggtctaggcacctggctctgggctggtactgggggttatctgcacaaaggcctgtgatgtgaaccatctatgggcctctcagctgtagataccagcacctgttctggtggaggtggcaggggggtgaaatggactctgtaagggttcttagctttggtggtttaatgttctatttttgtgctggttggcctcctgccgggaggtggtgatttccatagagcatcagctgtggtagtatggagaggaaccggcggtgggcagggccctagaactcccaagagtatgtcccctttgtcttcagctaccagcatgggtagggaagggccatcaggtggggcaggtctaggcatgtctgacctcagactctccttgggtgggtcttgttgcggctgctgagcgtgagattcccagctcaatggagttgtgtacctaccgtggattatggttgcctctgctgagtcatgcaggttgtcaggaaagtgggggaaagccggcagtcacaggcctcacccagctcccacgcaatccaaagggctggccccactcccaccatgcccccactaacagcaacgagtctgtttccaggcagtgggcaaacagggctgagaacttgccccaggctacccacctccgagctgtgaaagaaaagggctttagttcttcccctgcctgtagagtctacacagcggattcacgccctccactgagttctggccaggaggcttcttgaccacttcaagttgttacaaagatcagctggagactttcttctccttgtggcttttccccttgtgcctctggctgccctccggaaggatccctatggtgccaggcaggaatagcctgcttggggacccagcgaactcccagggcctttcctgctgcttcctctacccctgtattttgcttggctctctaaattgactcagctccaggtaaggttggaaacttctccctcaaactagaccttcggtttccccagtaggggtgtgtgttcggtggtggaggatctccctttcccacttcgcaatttgggcactcacagtatttgggtcctgcagcagcagtccccttccttcagagggtctgtgggtcctctcgggattcctggtttatccctgcagtcgttttggagctaaaattcacaacgcaagcctccgcacgcttctctgtccatccgagttggagctgcaatctagtcctgcttcccgtctgccatgatcctcccacaaattcataaactttcttaaaacattatgagagttttttgtgggtttttttttttttttttttttttagctcatcagctatcattagtgatagtatatactatatatagcccaagacaattctccttcttctaatgtggcccagggaagccaaaagattggacacccatgatctagaatatctataacatgtaaagcctcatctagaggccattacatggtattagtgacaaagtatcataccaactatacaaaggaaacatccatctccatccatttcccccatagaagttgttagaaggaaagtaaaataggttcagctttattgtgaaatagaaaattactgcagaaaatatgctttgtaaagaaaagtgactgctgtctatggtagtaaaatttggaaatctgtaatccacacacacaaaagaatctacaaaagaccttagaaaaaagtcatatgtaagtacacgcaaagttttgcagtgtctaatcatttctagctaaaataatgtggactatgtccatataaactcagaatgtcagcatatgaatacatccagtctaacctcttcagtccacaagtgagaaaactgatgcttgtagaagcaaaatactttagtcagtgtattgttcagcttggactgacataacagaaaccaaaggctgagtggcttaaagaggagaaatttattttttcacagttataggactgaaagcctaagatcaagatgccagcagggttggtttctggtgaggtctctctccttgggttaccatatggccaccttttcaccgtgtctttacttgacatttaatttactgttttcttcccctttgtccttcacaagactcagaactcgtcaaatttggatgtatattttattctgcattatatctccagtgtctattatatgtgaagctctcaatatattactacagattgaaagtcagacaatttgattaaatagaggatttgttattaatactcagcatgtgttaacttgttttttaagttagaacattttgttcctcacagatacaaagggcatatttttgccagcaaaactgttgaatatgtaactgtaagattttttatgctttatttgtaaagacgcaaaaatgtgttgtttgctgtaaatctaaatcagcaactcattattaaatatgggttattaaataaattaacatgagactattaatttaaaaccaaagatattttagaaaataatcactataggatgtactgaaagggaacctagcaacgatcaataaatcctggtcaacagtccatgcatttgtttgcctgtgtttttatagtttataaagtgttttccttgtgattcagggaggttaagtattattgaccccattttgcaaattagaaaactaaagcccagtgaggttatataatttgtccaagattcaaaaactagtaaaggtacaagttggggcttacatacaggttttctgtttacaaaattgtgtagcaccctgcctcttattgcattgtaacaatgtttggttatacttggctcatttcaaggaagcattatagaaccaactctggcacttacagtattctgaaaatggggaaaacctcatgtgaattttcttggctctctggcatgaaacttggaatccatcttttttattttaattcagcttggtgtaactgtaggcctatcaataggaagtttctcatcttgtaatagattttaatgtatccaagcagcagagcctatatatttgtaataaaatagcatctaataatttgaataattgtggagctatcccttggtgttgtatagactgtcagagtattttagttttgtgtaggcaaggttgactgctgttttcaatattttacaaatgaggatctgctctccagagagatgatctttacccaagatcacttagtgatgaaggcagagttaggatccagcttttcctgggactcaaacaaatgatttcagtggatcatgctattttcagaattttcattgactcttttgcttcactgaaatatactttttcctatcagacaatatttagcattaattgaatttgagggagatgtggttgataatttgctgagaagaaaatgactttgtgggttataatttgtcttgaaaaaaattatgtgaaagggaagattagactctcgatcatttatggagggggatgaaatgttaagccctatttccaaacttttatttttctccttgggggtcctttaaactttcctttctgtggagctatttgtgggaaagagttttcatttggtgatctctcctagtcactggttgctaatcagtgatgcaagattctatgctacaccaaatgcaaaggaacatattcatggtatttgcatttaaaaatgtcatcatataatatagtgacatgctgtaccatttgttcataattcattaccagtggatacaaacatttcaatttaagggtctgtctgtgcctcattatattacgttgaagcaagaatattcgctatagtttagacctctgaaataactaagcaccatggaatgacacaagaacaggatatcattcttaattttaaatagtttcctttgttcagcttatgtgatggttgacctttatttaagtccattgtgtttcattgtactgtgcttactgagctctcatcattgagaaccactgaatagtttcttgagcttaaagatgaatgttacactgttgtgatactatgtcagtggtgacattctggattcagtttttatagttgtgtcatgggtttttgtttcctacactttttcatgtaaatcaatacaccaaaatatgtaatttttcaaaggcaaccattaatactacttaagttagtaaatctagaagtatttaaatgtatagaacactaaattttttaaaggaaagaattctccataaggtcttttaattgctgtatgttattcattgtgtattctaatgcacatgccgttgatctgtgcatatggacttgtgcacgtaggcaaatggtaatagtagaagattgcttcagtcatctgatttctccactaaatcaagatacttggataccagctcagaaatccaatccaaagtcctcacctctaatgcccttcattgccatttaaaatctgaaccaaacacaggccacttcttttgagtttatcttctttaaaatgcagccctctaagagttggaaacagactatcatggctccttgattttgtaatcctatgaatacgctactgtgtgctttgaagattgtccttcaattagcaagtcagtgctttatcccacttctaagatgtcagctacctggtctccttgtgtgtctatatagtatagtggtgcacatacagattgactacttaagtagaaagaaaacttgatgaaggtaatatgtgtctctgtcttatgaggtgccatcttctaaaatgatagcctcaatttttccaaatggtcatacatcttctagatttatattaatgtggagatgcatgatatctttcttgttctctgtagcctacattaagaaattgaaatgagacaaaacactaactttgtggtaagctaattacagcagagggaaaaatatatgatcatgtcaggcataggaattaacaaagtttatagatgtattttaaaaattgctatagttctaaaagcttatgtgtctcaaaatatctttttgaaaacttgagctctgagtgaaagaaactaactcacacctttattctcctccttgcctcttaaaatatagaggtcccgtgagcttatttaaagatctttttctctaagttgaaatattcattaatttacattcattgctgcaaattagctagtactttaagtgtaacacttgtttgttttctcagaatttgattacatctgtttagacaaaatcatcacatttacaatactataggttgtgtgaaaacttgattatactccaaaattttcagtttgttaaattctctagagaacaatagtttgtaaatgtaatttgtctgatgcagacttgattagtattccttgtcaatactgactgctttggagactcatgggatttttttctattattcttatgtatgttaaaattttctgttgcctattacacacacacacacctccctttacctgtgattattaatatcgtgaagcctatgctgctatctctgattttaacttatatgttacagttatgtctgcctcctagatatctagataacttgctgtgaggtgtatatatgtatatacatgggacatacttgccttgagtactagtaatgcctcgttattatacacccctctgcaaacacatgacctttttgttatggaagagttttcaacttttgaaagttttgtattaggggaaggaccaaggaaaataaaataagagccagatgaagccaaaaagggtgtgtgtgcatatgggtgttgagtaagagagacagggagatagacagagacagagagattgagacacagaatgagagaaagataatgaaagagtgagaagggttggggtgattttcacaattggataatcagagagaaacaggattgagttaaatgttcctttgtatacatcaattgactcataaagagcattgaaaaatgcaaactggccgggcgcggtggctcacgcctgtaatcccagcactttgggaggccgaggcgggtggatcacgaggtcaggagttcaagaccagcctggccaagatggtgaaatcccgtctttactaaaaatacaaaaattagccgggcgtggtggcgggcacctgtaatcccagctacttggcaggctgaggcagagaattgcttgaacccgggaggcagaggttgcagtgagccaagatcatgccactgcactccagcctgggtgacagagagtgactccgtctcaaaaaaaaaaaaaaaaaaaaaaaaaaaagaatgcaaactaagaattaccaaattatattccttatcttctaccaataataagcattaaaaagtcaaccatatatatttgtgtatagaactgtaatgaagggtataatttgttttctgtagagaactcacctgtggcttagtttttgactcattaaatacagatacattttcaggaaataagaaaattaatgcatctgtattttctttcattttaaaaaaattatccttatagagtaatacaaaaaaagtaatcaaattaatgctgtgtcacagctatacttgttgaagtcgttgtgactaaacaataatagatacagttaatggttgaatagtataactggcagagatgaatactcctctagttaacaaaaatacattttttttgttcttgatgaataccccatatatcaggagcagcaataagcattttcagcgctagagcagacaaaaaatgatgatttatggaactagctgtaggtcttacttagttcgccatgaagactgttttcatagaggatttaaatgaacccagctggcttcgtattctgtgaattgctatagtcgttttctgagtataatcttatgactgattttgtaattctcacagtaggggaaagttgacaacatgaatggcatttagtgaatataattagtaagtctgaaaacaaaggcttttttattctataaaagctctgttcgaaggagattttgaccctgtatgagactgttccaaaaacatagctaccatgactaagtttgaccagtcatcttacaagctgattttcctgttaaatgaagccttcctagtgaaggcattgcacaaccttaacaaggagagctcatgtccatggaaggaagtttataaagtagcagttgatactaaaataaagctctgtgataattttagagaatctaaggattatttatatacatttaacgactttttagtgagtacttgtgcagcaagttggccacatttattgagcctttaccctctgtggaaccttgtgctagatgctttgtggggataaagagaagtaaaacatacatctccagtccttgaggagcttatgagctagatgccagatatagaacattgtaatgctaaagcaagagacagggagaagtgtgtgtggggacaggcaaatggattttatataatagcacacatgaaaaataaattatgttgctcataaacactggctaactaaccacaagacaagaaagcgcatactctgttagatgatatctatactgtaaagctgctccacttctttggaaaggaaggaaaaaacaattccagccccatttccaagatgtacttttcttctcttccccaaacaatgtcttcagttttgcttttcctgccttccgtcatggggacaagcacaaagccttgccattcattattttcttatcttttagtcttttttgaattttaaatctgaattatcagaatgctctcttcccttttatgctacaataaaagtatctttaaaactgcttctcaagttcctaacatctttctacatatagttaaatattagtattttaaattttttggataaaatcaatacctgttcaaaaacaatagtataatggtactacttataactattgtatgtctgtacccctcccaattcactaattagtcacaaaagtcaaataatttccttttgccagaggatatcatgagattgtctagataaataagaatgaagaaacttgttatttaatgttcagtatgagggatcactccaggatgcaagtaacctactatgaggaaatataagcttttcagaggctatttagggaaaggatctcaatatttcagatttaagcaactagctagatacacatattaaaacagaatcctctacttagaaacctgtgctgagggaagtggaaaagtattgtaagttatattcaaagacttggggacagatgaacatgcttgattccaaggatatttcatcaatcacagcctggcccattcagatcactttatgcttccaaatttcagctttcaaaaagtgtacgagaaaggctagggttactcgttgatttcttaaagcatcttcttaggactttgtttgttgtattgttattttgttagaagtaaaatgtattcatggccaagagagacttgaacctaacctataatttcttgtagtaactttactgaggtttttaactgacatactataaaatttactcattttaggccaggtgcggtggctcacgccaataatcccagaactttgggaggctaagtcaggcagatcacttgagctcaggagttcgagactggcctaggcaacatggcgaaaccccatctctaccaaaaatagaaaagattagctgagtggggtggtgcgtgcttgtggtcccagctacttgggaggctgaggtgggaggattgcttgagcttgggaggtggaggttgcagtgagccaagatcgcgccactacactccgcctcagagacagagtgagactgttacaagaaaggggtcctgatccagaccccaagagagggttcttggatctcgcacaagaaagaattcagggtgagtctgcagtgcaaagtgaaagaaagtttattaagaaagtaaaagaataaaaaatggctactccatagacagaacagccctgagggctgctggttgcccatttttatggttatttcccgatgatatgctgaacaaggggtggattattcatgcatcccctttttagaccgtataggataacttcctgacattgccatgacatttgtaaattgtcatggcgctggtgggagtgtagcagtgaggacaaccaaaagtcactctcatcgccattttggttttggtgggttttggccggctcctttactgcaacctgctttatcagcaaggtccttatgacctgtattttgtgctcacctcctatctcacctgtgatttcgaatgccttaaccatctgggaatgcaacccagtaggtttcagcctaattttacccagctcctatttaagatggagttgctctggttcacatgcctctgacaagaccccatcttaacaaaaaatttactcactttaggcatacagttagatgaactttgttgtttgtatacagctttggaacctccactgcaatcaaccagtgtggtttcctcatgcccctgtgcagtggatccccactcctagctcgagacaactgctgatttgttttaaatcaccatggtttcgccttcttctagaatttcatatgaatggaatcatacagtaatagagcctttgtgttactttgtgttgttagtgacttttttcacttagtgtaaagttgtggcatgtattggtagttcatttttattttgaggtagtattccattgtatggctgtgccacattttgttcatctgttcatcagctgatggacagttgggttgtttctaaattttctattatacttgttgctatcatcatttatgtataagacataaattcatttatcttgggtaaatacctaggagtgggaatcctgggtcatatggaaagtatagttttaattttaagagagactgtttttcaaagtgtctataccatcttttcttttcttttcttttcttttcttttcttttcttttcttttcttttcttttctttcttttcttttcttttctttcttttcttttctttcctctttcttgtcttgctctgtcacccaggctagagtgtagtggtgcaatctgagctcactgcatcctctgcctcctgggttcaagcaattatcctgcctcagcctcccgagtagctgagactacaggtgcacaccaccgtgcccagctaatttttgtatttttagtagagatgaggtttcaccatatagggcagggtggtctcgaactcctgaccgcgtgatccacccacctcggcctcccagagtgctgggattacaggcatgagccgctgtgcctggccatctaccatttttcattcatacttatgattaaattaaaccacaatgatggatttcatatttggaatatatgaatatatatgaaaagatatctcatattcatgagactggcaaaaaatgttaaattctgttaatataaagtagaggtaagaataaggggcaaagagaactaatggtgagagtataacttgctaaattcattttggaaaacaatttggtactatcaagaaatgttaaaccatgcacagaaatgccccttctagtgtatacactagataaactcttaggtaaggaccctggagacatatacaagaatgatcacataatcaaataacactatcaacagagtgaaaaaaaggcaacccacagaatgggagaatgtattcgtaaataatatatttgataagtgattgatatccgtaatatataaagaactcccacaactcaaccacaacaaaacaactcagttcaaaaatgggtaaacaaattgaataaatatttctccagagaagataaacagatggccaataaacacaggaaaagatacttaacaccactaatcattaggaaattgcaaatcaaaaccacaatgaaataccacttcaaacatactataatggctactatcaagaaaacagaaagcaacaagtgttggcaaggatgtggagaaatttgaacccttatgcattgctggtgggaatgtaaaatggtgcagccaatgtaggaaatagcatggcagttactacaaaaattaaatggaattaccatatgatccagcaattccacttctgggcatatacataaaagaatcggaagcagggactacagatgattgcataccaaattcatagcagcattattcatagtagccaaaacatggaaacaacccaaatgtccattgagtgatgaatggataaacaaagtgtggcatatatacaatggaatactgttcagcctttaaaaggaatgaaactctggtatatgttatattataatatgaatgaatctccgtgatgttatgctacatgaaataagccatatgaagaaggacaaatactatatattccacttatatgaggtacctagaatagtcaaatttgtagagacaaaaagtctttgtttaccaagggttgggggataaggcagatggggagttaatgtttaatgggtaacagtttcagtataggatgattaaaacgtcctggagatggatagtggtgatggttgcacaacagtgtgaatgcacttaacctcactgaactgtgtgcttaaacatggttaaaggcaagcatggtagcccacacctataatcccagggctttaggagactgaggcaggattgcttgaagccaggagtttgatagcagcccagataatatagcctgtaatctcagcactttgagaggccgaggtgggcgaatcacttgagcccaggattttgagaccagcctgagcaacatggcaaaaccccatctctacagaaaaatacaaaaattagcacggtatggtcgtgggtgcctgtagtcacagctactcgggaggctgaggtacaaggattacctgagcctgggaggttgaggctgcagtgagctgtgatcatgccactgcactccagcctaggttacagtaaaatcctctctcaaaaaaataaataaataaataaaaaagtgttcacagcagcattatctgtaattatatccaaaacagtgattccctcacaaaaaaaaatggaaaccagatattgaaaatgttcgatgagataatatgcctaaaatttataatatttatatggtcaactaatatacagcatggatgaatatagctagaaacatcaacatggttaaatacctcactcttaaacagctgctcttcagtgctgaattctaattacgcttttgtaatattctgtgtcttagaccttcaaagtttttcataaatagctaaaatcactaatgttaagtgccatttaatgccatttattaaaggttaaaacctttaaatgcgatttattatttatctacagtgtatagacagagcgaatgagtcctatggactcttttggtgctagtgacaatctgaagctatgtacataaaaaaaaatattccatctactctcaaacctcatacatataaaacaatttaagtaaaatgctcatgacaataaaagttaaaagttttagttacgtgcttaacccatgtctgagaagaaaccatctaacaccaacaaacattcatacttgtaaactatttctataccaatttaaataatttgatttttattaaaactattctcagaagaatttttatttggtaagccaactatagacaggatgattaaaagcatatgaaagtaccagaacagcttttctttgcatagatatatttcattaattcattctggcctttcctaaaaccagtgagtacaaatgatggttaatttgccactggtcctggcaatgcaggctaatgcacatgcaggtcattctccttggataagtggggctagaagggaaaatgctgagaaggggagcaggaaggacaggaaacagaatttgtcttgtctaagaaacttagcagcacaaatgccctgctggtccggaaggtggcaattgagatgaatccttattccatttaatgttgttacggtttcaagtttcagctctcctttcacagattgctaccataaattaggctaacaagtgtgaaacttttaatttgcttgactatacaattgatattatctgtttccttttggttggaaatatcattataataccaaactaaagggtgtaaaaaagggactatcaggcctacataaaggatgaagacctctttccaccgtaaattacatttggctgaattagtgtcagccctagtcatgtagtgcccagaaaagcatttttggtgacagatttagaaataaagctgggaaaacatgtattaaacctgtccggtcatagctacagaactaatgtctttatggtaattgcaatctttaaaaatacattatctttttcaatgttactgcagtgtgtggtggtattaaagaaagcaataatttgtaaacaacccttggcagagggcacagaacttaattttgtttaaataaaggagactaacattagaattcttgtgctgtatcaagactgacaagcagtagtagctgttttgatatgtgcactggagcattcatgattgcttaaatattaactgttccatgaatatacaaatataatagggaaaaaggaagccatgattaatgaaaattttcactaaaagaaataaagttgaattatatgactgtactggtggtttagatggttttattccattgactcaaccagatctcttcactgagtttcagtatttcttttcaaggacaattatatatgtgtattgtgtgatgttgctatgtgttaggaatgtttccttgacacagaaggattaggcaatttttttttttcctgagtacagcacctgttgataagtttgctgaagttcatgtggccattcatgtaaatccaaaaggaaaggggggagatccaaaagggcttccttcagatactctagagatttgaacttttatctcacatttaagttttaatatgctttaaagatagtcttccgttaatgtgtgcagaaacatttcctttagtgatatccacgctgctttactacttcatttcttatactctttatgcaaaaatcagtttttgtctcagagcagtttacactctacagcaattcatgcaagaaaaccaggtgctcctcccacacattcttgcatgtttccagaagagaactaactgttttgttttttcttttttcttttttttttctttgagacggagtttcgctcttgttgcccaggctggagtgcagtggcaggatcttggctcactgcaacctccacctcccgggttcaagtgattctcctgcctcggcctcccaagttgccaggattacaggcatgtgccaccacgcctagctaattttgtatttttagcggagatggggtttcaccaagttggtcaggctggtctcaaactcctgacctcaagtgatccacccaacttggcctcccaaactgctgagattataggcgtgagccactacgtccggccaagagaactgttttctgtgccactctgcaactgaggtcaggattgctttgggacagggagccaaggtccgctgctttgttcctatataatgtatggtaacatatgaacctagccccattctcactcttggtcttcaacccgaaatgagtatgatgacaaatgaaatgcagtatcagcatatgccagggccatggagcaggaatgaagcttccttccttgattgtcttctttacatacacccaccatagtctgatttcatacatgtaaactgtttggcatagaggtcaagcaaggcattaggttatttagatacaagaacttttatggcaagcactgaaacccgatgtctgcaacttacaatttcagaatctgattcaaactttctgagtaaatatctaagcaacaatgcagatttgcttgagcaggagttggaaggcatgaataatctgctaggttatctagtccatcactctgatgatacgtagtagacaagacatactatagcagcatttaagtattttttcaatacagttttaggtgaaggatgaaggacagtttagaacactgaagagcaatgtatctggaatcttcacagcatggagcatactgtttgtctcatctacttttggataggtagctgataggttatgataccaatcagtcttatttttatgtgaattaatcaagaacacttagagcaattctgtccttcagatgccacaaattgctagataatttctctcttattttaaattgacactaagcattgaaaacacgttgacacttcaactttttatatgtaaaagcagttgtgagaggacctaggcaagctgtagacaattgccaagcatcttctcccctggaaatttatttgaaagtagcctagtgtctccctagtggcatgcatcagaatcacctagaggtgatatcagaagttttcccctagtatattcaaactcaaattgctggaccaaaccctcagagtttctgatttagttgatttggggttgggcccccaaatttgcatttctaacaagttcccaggtgatactgatattgctggtccagggaccagggattgagaaccaataaagtagcaaatgctcatgaattcttgatttttcattcttatttcttccgttgcctgatcccttcaagcctaattatgctgaacttattcgggacaataattagaataatttttgtcactaacctcaccattttccagctgccagctctgctacctcctgtattatctggttattatccacagtcaatatttggaataaattattcgttcacattacctcttttttctgactacccattccttttaattttgaatcctttgcactgtattctaacagtgcttgaaggtcaccaaagattaacatcaagtcagccctaattatttttggcctgtctaaagaatttattcattcaacatttactgaataaaattgatatagtcctcatttttaagcagttcacaatctggtgggtgagactagttgtgtacacaaaattatatattgtggaataagtgctataactagagtatatagaaaccgctataggagaacaaagacagaatttagtagttttgctttgttttgttttgttttgttttgagacagagtcttgctctgtcacccaggctggagtgcagtggcgcaatctcggctcactgcaacctccacctcctgggttcaagcaattctcctgccccagcctcctgagtagctgggattacaggcatgtgccaccatgcccggctaatttttgttttgttttgtttttttgtagagatgggatatcaccatgttggccaggctggtctcaaactcctgacctcaggtgatccgccccaactccttgacctcccaaagtgctgggattagaggcgtgaaccaccacacttggcctagaatttattaattctattcagggaagttgagaaaggcttattactagtaactacgactctcctccctttccacacgcataccatcttcatcacccatgacagttcaatccagtaagtatatcttaaattccaagtgtgcataaattgccgtgctttgttctggcaccaacacctattgagtgtgggaactagatcaaacaacttatgagctctatcttatctataaaagtggcatattcgtaactaactcactgaattgattttaggatttaaaaaaaagcacttatgaaagtgcctgagttataggcacatgatagataggcaacaaatgttggttctcctaccccttaaaagaggaataggatattatcacctgatgaaggaagaacagtatgccgaggtcaggaggaacataagtaaatgggtagaaatcttcacccatttgtgcagtcaggaggaacataagtaaatgggtagaaatcttcacccatttgtgcagtcaacaaatacagatagagtgcctattgtatgctacccacttttctagatgctgagtatataaaagtgaacaaagaagacaagaaaactctgtacttgtgtccagcatagctgaagtgagtgtgggaacttgagagaggataatagctagagataagatcacaacagagtaggagccagagggatttttagtttatagtgatgggaagctaaggtaggctctcaacacttcttatctggatgatgatggtacccatgataacatgctatcttattcaattctgcaaacatgtctgtgaacataggtgcttatctaatgctcattttatagataacaaacctgagacatggagtattcatgtaacttgcccaaggtcatacaagtagtaaatggtagggtcaaggttcggacctggttctgtctgaatccaaaatctatgcttaataattattctgattagaaatttgaattttattacatgagttgtaaagaaccatttactttttttaaggaagggagtgacatgatcatatatatgtttaagaaccataattaggctaaatcatataggataaaatgaagcaaagagaatggaatggttatgaccatcttttcatagtgtattttcacatagctaacacttctgtttaaaatttgagctgccatccttttcctaatgccagttcactctagagttatttccctcattctggacatgatacaacattcttttaatcatcgggacttaaagcttttggagtctttgatttttccctttccctcatcttaatattcactgactaaatcctgtttttccttacaatctctcttgaatttgccctttttttgtcttttctacacataccctagttatcattttaagtatatcagtctttgacatttgccaccaaattattctcctatgtcgtttcttttctatatcattttgtattttctactaaattctaagcttaaggccttaaaagtaccatgcatcatttatctcttatccctggtgttcagcatagtcctcaactcacggtggattaaagaatgtacttctccattcatatttgctttgctcctaacctgcctcccctaaaaaaatgtacagtgctacatttcctgagtgacaaattataactttattctggcattcacttgcacctaactctagcaaatgtgtgttctggaaaagtttggcctttgtagtcaacctctgtgtgtgtggtggggtcatatataaacgcagttatacatatatatatatatatatatatatatatatatgtatagaattaaatttaggagtattgctctatagcccagaaaagttggagtttagagaagaatctgcattcggaaacatttattgactatctagtattttctaacatcctcctaggcaccatggattcaaaaatattaccaaagcaaagtctctagccatgtaagagctcatattgagtgtgagagactactatgttgaaatgtttacagtgaatgaagatggccaaaaaaagttattaattgcttctaagatagagaagtcttcagaaatgacatgggagttgagtagtctgaaatgtgagtaggtattttcttggcggataaaaaggaacaaaaaggaagggcgtccacacagagagagctgttggtgcaaaagcacagtggcatgaaactgcatggtatgtttaagcagttgtaatcaggcagacagcagcaggaggcaggttagaaaggtagacaagggtcagctcaagggagtgtcttgtatgcaaaatcaagaacttttcttttccagcagatgacaggagcctttgcaatggatcttttgaatggactctaattaccattgagaaattaaacatttgaagaataacatctatgcggttaggttaaattaactgcagttgtttatttggagaacaggacgggaatgagaagggaactttcactctgtgagaggttgttacgtacagcatagtgaccagttattttcagttcccactgaggacaaagcaagaagaaataggcttacatctcatcagaagggaaaattacctacagaaggggtccttcacagaaagattgaatgtgactgacgtaggtcattaaaatgttgtctgaggctctctggctgtgtgctggtttctgtgtactcaaacagcccaatttcaaagacatggcaagactgaaggttttgaagcttgaatgaggatatttggaataaagaaatttcttatgtgtcaattagttattgagaaattttgctatatacctaactaaattttggagatgtacttgaacatataaaatatatgtagtatctttcataatataacgtttgtgtgtactaggaaaaagaaatgatcaaaatcagctgtagaaacacgtgtcctattaaaggtattttgtattcatgtaccattttagaaagttattaaagattaggtagatagaattcaattaaattcagttattaatctttatgtgtaacatttattggtcagatgattaaattaaaattgctgtatatggtttattaactgatgattgcacctgatcagttaatacagtgactcactcttgtcttattttcattatcatccagtgataactgcgcttattaaaataatataaaacttattttagctttttcaaatatttcccatttctagaactgctgtttgtgttattgtttgaagatatataaaagaagattgtagagtgaccattttgttcatccttttgcatcttataaaaataagtcatatatgtctctccctacctgtcatggctggagagaggaaaaacacatacagggatgcaaaaaggcactttgcttctggctagagcaaaccttgaaatgcatacaatataaccaccactaagacttaggcaatctaggcaactattaattggatatttcatgttaatgtaaaattttaatatgatttcatattaaacagctatcaaatggaaatcaattctatttcttaataaactaactcaaacattttggaaatgacttgtacataatcagattagattactcttgttctaccccaagagatgtgtatatccaactagtacacttagaaaagcaaattattggataaatgtctttaaccagtagaactgatgttcttagttgccttctgtgctgacattgaacaacacgatagggcctgagagagatacaatggctaatgtgtgaatggcatagacttggtaagagagactgaaggcatgatataaagtaattaagcttcaataagtaaaaaatattttccattatattttaatattatatatatatatattttaaataattggtctaaggcctctcacacatagagaaaggtttaaaagaccacccatttgtcgtgatttcctgccagtttgaaccattaaaatggtctctgtgtgtttttttttttaaaaaaaaacaacaaatattgcaatacattaagcagcttgtctcccagaccaactaagatacttctcaacttgacaagacaaacatttggccatgtttgcccatgctttgaagggaatattatgattctaaaagaaatacatgcatagtctgtctaaaagtcttttatcatttcatcaaagatactaatacatttaactgatgttgtgctttatttatctttttaaaatgtaaccattaactcttctaaattttgtaacaaattaaattgttagtggaccagatactgaataaatatttattaataaatacaatttttgaaaattaagcacttataagtatgcatgccaaaaactgaaatgttttttaatacaaaacaatctaacacatgtgacaaagaaaaaaaatcacccataaaattgacatatgagcacagtgctatttttctgtttttatatttcctttccagtgttagccatgtgcgttttattgtaaactataatgtacttgtacaatttgatgtcctaaaaaactaggtgggtttttgttgttttgaattgtgttcttttttaaaaaaaaaaattgtttttgtctccatttatgttatgactccaaagagtccataaaatacataggaatttcctttcctttgggaagatgtacctgcaattttttctaagcacttaatgtttccagaattttaggatttaggtagttagtgaacttctaaggaaaaagaaaatgttaatttcctttttatttggaatatccggcatactcttaaaaacgatgcactttgtaaacacatcacacagtaatcccaggtaaagacctctctttaggaatgtgagcttcccattgattcctctacagctgctatccttacttaaggaaaattgcccttgaggtttgtgttgctttttgttctttcagcttgtccttgagttgtgtcatttctaccttaaagtacttaaaagtgtttagtggatcagcatgataatgtaaaattttaaatatttttcctatgtgggataaagtaatccccgaaattttgaaagaaatcattgtgacctcttgaactatcaacattatgcctcctgtggctgtttggttgtttggaaccttgagactaatatttcttctaagttgtttacatcacattgagatgcaaatggttgttaaaaacctgtagaacaaaacagatccagtgtgggcctgatttattaaatgctatgtttttctttcttagtcactcaaacaataaggattaatttactctgttacctaaatatcctgtacagccttttcataaacctgtttgtgaaaaatactcatttattctaaacagagtaatccttaaagctaaaaattccaaatcagtatgaacatcagtggacaaacccatcatctaaggattatagaattataacatccaatagaatgagaaaacttgatactttatgctgtatttatgctttgtttctaagtaaatccttgattttatttgcagcttagtctagtatgagaattatattgcagcactagattttctttttttgtgtgtcctatgctttaaagatttttaccattctaactgtggcatctcttttgttgtgtgtctgaaaaggaaatacaatatgtaagcaaataaaatttttcatattatcaggattgtatggtgagattttttttaataactcagtataagcacaaccttgagaattattttctgatggtccatgcaagtagaggaggataaaatgtgcttgctcctttacattaatttacatcaacaatggctagaaataaatataatctcacaaatgaatctaacttttaagaacatatttttgtaataaagcaaagaacagaatgatgataaaataagcacacagtaacttgggctattatcaatacttaaatggatgttcttctctcatgaaaagaatagttcattttgccacaataatttagacatttttgaaaatacagattaaggtttaatttggcacttttactggtcatcttacttgcttttaaaatatggagctccttttaaaatctagagcaccgctactagaccacattaagaacctaccccaaagttttaaaaacattttaaatgggttataataaattcattcatttcacttgtttaaaaaagtatttactaaaaaattactaaaaaatgtgttgttgttttctcccagatcagagatactaaatcagcggatcaaaaaacaacccttttgcattttattgccgacatttgtgaggaaaaatatcgagatatcctaaaatttcctgaagaactggaacacgtagaaagtgcaagcaaaggtaattgatttataactactttgagattatctcttgcctatatggtttaaatggaacaattaaagaatctgtaaacattattcataaaagtattttttgtttgtttactgataaaagaaaagcaggaaaatagtttccattagcttatatttgacagcatactacattttaataacctattttgtcttacatcattttttttaccactgctacgttattaaagctttcatttctctgatcagataatatgtttgtactttcatttgataaacatttaagtggatattgtttgcaaaggaaccatactatagggctcttggttatatgacaatgattgtgagagtttttgattgagtgtggttaaaatatagtaaatgagaaaaatgtgtgtatatatacatacacacaaatgtgttataaaataaggatgcatgtgagaaatgctgcaggaaaagataatgtcctatagttgagatgaggaggaaagtactcttgaatgggtgggtaagagaaggcttcatggaagaggtcaaaggtgaaatatgaggttagggttttacagacatggaaaagaggtttgctttccagagagaaaacaacatgagcaaggcaaagtggcagaatgttttaggacaagtgaagggaatggttgactctgaggctggagcagtaaggtaggtatctctgagacttcagtgtcaggctaaggagtctagtcttgatgtggtaagcagtacagcatcattgaagggatagaatagacaagccatggctcctgtgaggaacaggatgtttgaaacaaaaatgtctctgagattttaattcagggtaattagctttgtcagtaagtattatctacttttgcaagaggttgaaaagtgaaagaaaagaagattaaggaaacatttgctgaaggtgagattatgtgcgagaagaagtgcattttccctcttagataagagaagtacaccataaatcttatacttgaaattacgctgaagtaatttcattctgtaactctgaggacttttggtaaggacttcatatatgtttctcaagtttattacaaaccatataaacctgttagtttccttttaagttaaaaatagtgaatctataaaacccagaatattctttgaataacattgtgcagtggtcatctcagccagttgggtattgtcaatcaaatcctcaacatatttctttaattttaccgagtttgtatcgttttgtggtccaaggagcaaactaacacaaaaagacaaactatgattgtattgtattatttattttctttcgttgttttcaaaaaattgtgaaatatgatggaaaattacacaaattacaactataatggcaactttctggtaatagctcttctaaagaatttatctttggatttaaaaatacagctttctgactagaagcatatttactaacatgtggctaatgtgaaataataacattttaaacatttgtgttgtaatttgaaatgtatatatatatatagcacaaaaaagaccagttattaaattagctcattttgttgctattaatactttttgattgccttctaccagaatttttttctaagttttctttgttcaacatgtataatcaatttttacaacattttggaaagaagtatgtcaataatatatctatatatacacacacagtgccacacatgaaaatatatatatttatatgtaatatatttactatacataaataaatatgtaccacacacttatatcaatcaacaggtatttatataaacctcaatcaacagttatatatatgttatatataaccataggtatttacatgtgatccagcagttccactactaggtatttatccaaagaaaaagaaatcagcatatcaaagggatacctgtaccccatgtttattgcaacactgttcacaataggtaagatatgaaatcagcctagatgtctatcaatggattaatggataaagaaaatgtggtgtatatacacaatggaatactattcatctgtaaaaaagaaataaatcctctcatttgaagtaacatggatggaactggaggtaattaagtgaaataagccaggcacagatagacagatattgcatgtttttactcatatgcaggagctaagaaggttggtctcatagagatagagcgtagattgatgcttaccacaggctgggaaaggtgaagggtagggggatgaagagtggttggttaatgtgtacgaacatacagttaggtggaagaaataagttctggcctggtgcaatggctcacacctgtaatttcagctagttgggaggctgaggtgggaggaacacttgaggccaggagtttgagaccagcctgggcagcatagtgagaccacccccatcagaaaattttaaaaattagccagtttcatgctacttgcaggggctgaggcaagagcattcctcgagcccaggaggctacagtgagctatgatcacaccattgcactctagcctgggcgacagagcaagaccctgtctcttaaaaaaaattaaagaaagaaataatacgtcctaatgtttgatagcagaatagattgactgtgggtaggaatgatatattgcatatttcaaaatagctagaagagaagatttgaaatattcccaacacaaagaaatgataaatgttcaaggtggtagatacgctaaacaccccaatttagtcattacacattctatgcatgtagcaatatatcatatgtaccccataagtatacaaatattatgtatcaataaaaaacttaagaatatatagatatttatatatgtgtatatagcgtgtatatatatatatatattttatatagttatgtagtgagacattcaataatcttgtacactttagccactactgctactgacaaaagtagattgtagagcccagccttttgggttagacactataaatttctttctttctttctttctttctttcttttttgagacgaagtcttgctctttcgcccaggctggagtgcagtggcacaatcttagctcactgcaacatctgcctcccgcgctcaagcaattctcctacctcagcctcccaagtagctgggattacaggcgcacgccaccatgcccagctaatttttgtacttttttagtacagatggggtttcaccatgttggccaggctgttctcaaactcctgaccttgtgatccacccgccttggcctcccaaagtgctgggattacaggcgtgagccaccgcaccaggcctgacactataactttctaatcctagctctactacctattagttctataatttgagctaataatttaaacttctaagattttgtttactcatctgtaaaatgagaataataacagtgagattaaattagttaacataggcattgcatccagtaaaatggtatagtttatagtatatgcttgacacatagtaagtatgcggctgttgctgaactactaccagtagtagtagtagtagtagtagtagtagtagtagtagtagtggtagtagtagtagtattgatataccactaaggatattatagttctttcttttgtcttattagaagggaacaatcataaaatatcttatagttcctccagtctcagtaagtatgtattatattcaattctatttgtttgtttcctattcctgggcttttggtaaatccttttatatatttttttctttattttatttttcctttttaattttttgtatatcaccaacttcctttttccaatccatttcaagagcgaaatctctctgctctattttgatcattcctgattttgtgcattcttcctgccagtgtattcaaaagactgttgccaaaaatcctcttcttatatcactgtttgggccatatcaatccctactctcaaattattttgactagttatttttctttccctatgaaattcagactgagaattctcaactcaaaaagatcttacgcacattctgcctgcttgcatccctctttcatttcctcctagttctcatttcagtatacccagacatatagtctcctgagccatttttattcctttataataatcctgtctctgtgtacgatttcatgctgcatcctctggctggaaatttcacctgccctgtactctaagacaactgactgtcatttgccaaatctctgttcagaatctatttcctttttcttcttccttttttttttttttttttttttttttactaaagccttaggagaaaatactttttgtattagtctgcaggaagaaacaaagcattgtaaaaggtcaagccaattacctcttatttatatttaaatacttttccttggtatttgagtctaacttgtcttgtttacttaatgtacatttcagccctgtttgaatcacactttatcacattcaggactgtgtataacatagcaaaaaacaaaaataggtcaacactatataattcattttatttgatgatggactatctctttgtaaaatgatcccgttctcttcaaaaacaaaaacaaaagattgtctttttttttttaaactggagtgatatagataagaaaaaactaattcagttaatgaattatatagctaatattgaaagaacaacttgattactaccaatatcttttttcatatttttgtgttattagaacgcacatacctactttgatagagtaagatcttttctgtgtggtatagcaaataccaaatttattttagttcagtactaaaattccaggcatcaacattactggcaaaggggaaaaaaatcaccttgaagtgaaaggcaaacaaaaagaaagaagtatgtgggttccatggaaaaaatcatcataattacatttattccttgtaaagctaagctgctaaaattgtgtgcttcttggaaaatgcaaaactatggtataaacttggcatatttttctagacctctgtagctcaaagatagtggggaaaaacacatcatttttacattaaaacagatatgtattatggagtagaattcaaaatccacattaattttaaaaataaaacagatgacttcaaagaaatttcccacttgtagcagatccctacaggattattttcagtcttctcttccattaggggtactttggtgggaaaagtttatgaagcattgcctgaagaattagagagcagttttgttttgggttaagtttacgtatttatttatttagtttgttattcagttagttagtgactattgcagggaaaagggaggaaagtaggcaaggtgagggaagagagagtatatcacttccttttaaacattgtcataggccgtatgaagttcagaagcaaattgtataatgtaactttattaccagtaaagttaataaaataacattgctcttgtcattttattcttggttaaattataaatctgtgggtcatttcattcaagattggcataccaattagtctttagagaaagaaaatggttgttacagagactttgatgcctttaaaacattgaattttttttttcttttggtgaaccacaattatttttttccccaatgattaattttaaagtttatatatatgtatgtatatgtacatatgtaaacttatatctaatagatatatattgtataaaacattgctggtttactagacatatttgatgtctttttttccccctgtggctatcactttaattttcagctttaaggattttttactgtttgatttaaaaccactcctgttttataggttgactccaggttttaaaccaaatggttagtaaagtttaattaaagctattttattcaaaagggggaaattatattaatgtatttgaaggtattatttatcctgaggtttgcataaatccaaaatgggtttcacttcagttaaattggtgccatcctacaagataaaagctagttaagtttcttctgaacagtgctaacttttttatgaattaaataaattattataattttaacaatcaactataccttttgatatctgccatgtttccatgtcatgttagttaccgattagctgtttatccactctgactttttcacgggattaataacaatggaagttctgattaaaggcaatgttataggggaaaatctatggattcattccatagtagtatttcttttttatataaaagaaaaaagtaaaataatagcaaagttaaaaagtttggggggaagaagaaagatgaaacaattccagaaactccacagctggttgaagctttagagattatctagtccctgctaaaagggacccaagatgacatttcatccaaacttattttatagttgaagaaactgagatgcagaatgataaaggacttgcccacgatcacatagctgggcagtagagtccatgtacatttggagaccttgtttagagttattacatatatttcatccacatttttacctcctttgtggtcgaaaatatgcaacaaagactcatgctcacatactggaaaacatatagaaagtagatgctgaccaaataaaaaacttactggaagtataaatgctactttctctgtagttgtccataatctttctagctccattttgacagaattaaccattcctttctctgtgtcacagcagccctttagcgttattggtaatagagcacataccacatttgcactttttatttaattatttgcttctatctgtacctcctcttgagtttcttagtaacaaagactgtattctttttgtccttacaatctcggtgctatcatagcacctcagtcggaggggctcaatctatggccataccaacctgaatgcacctgatattggaagctaaacagggtcctgcctggtcagttcttggaagggaggtagaagtgcttaataaatgcttattaaattaattgcatatcattttagtacagcagtcatatttcaaaataagacattgtgggaagttgacaaatagagagtaacagtctgaaaattactgttcactgtaaatttgagaggagaaacaaggtaaattagaataaggaggacaccggtatttaacaatatttcccagtccacactttgcttcttcaagggaaatggtgaaattggaaacaatttgttaataatggagaggacctaaacttatggacgccaccaaaccacaaaggtttatggtgaacagtaaggaccaagtcataggacctaatgggagtgactgtctcaatgtgaaatgtaactaactgctgaaacatctatgtttaatacctgaaaaaaaaaattgcatattgtctgctattagtttcattgaaaaatctttgagttttttagtaatctattaaagaaaaatctgtggaacaaaatcctgtttttagagtgtttaacttttacttatagtgacttataggacctaagatgcaagaaagtattaaactaaggtttcctaacagatttaaactttgagttataatctaactttttagaagcacagaatgataatataccaatgtgacaaaatgttagtagaattgaccttacttaaatcttagcagcctgagtaaaactgagtatacatattactacattattttaataaaaatgttaacttgtttgttcagcttggtttggatttttttcatatataggatttcaggccgggcgcggtggctcacgcctgtaatcccagcactttgggaggccgagatgggcggatcacgaggtcaggagatcgagaccatcctggctaacacggtgaaaccccatctctactaaaaatacaaaaaagtagccaggcgtggtcgcgggcacctgtagtcccagctactcaggaggctgaggcaggagaatggcgtgaacccaggaggtagaggctgcagtgagccgagatcgcgccaccgcactccagcctgggccacaaagcaagactccatctcaaaaaaaaaaaaaaaaaaaaggacttcaagtaacttaaacaatttttgctgaacgaattgtactctatcaatagcaacaccataaatatgttataaaatttaggggaacgttgttaaatgttagggaatcaaatacatatttatctacataaattttccagtctgtaagacttctttcttcctcactctcaccaagtcagtcctaatttttctaaacaaatgactgtctttaaaataagagaaaaaataagaggtctaaaacagtcacagaatttttttttattattatttttatttttggtaagaacacttaacatgagatctaccctcttaaatttttaagtgtgtaatacattattattgactataattacagtgttgtacagcagatctctagagcttattcatcagttaaggaagataagctcaggaaaatgtatttttaatgtgaaatgtcaaaaggacttaggaaagaaagtcatgttttcttcttgctgttcagtaatctagtcattaccaaacaatgttatcaatgcataacatataaacatttcataattcattttcatttctagaggaaactagtgagtaaaaacaatatcttcaggtagcagtgaaaggaagcagagatcatggccgtttggatttgagtgaattctttcaacacaaatcaatgattttatagacatatataggtttttgtcagggttccttagcttttgcatctcaaaatctatttttgctagggaactgtataatagctcatctgtcttaccctccttgtctcagagcccaggcttctgtgccttttccaatctgaaaagcctcctccttgtctctgtccttttgagcctcatgtatctttttaaaggcccactttaaattccaccactctataaaaagcttctccaactattctacctttcaatggcttctcagtttcctccataatactttgaaccttttagctgatcctgtactctcttgcactacagtgtaaaggtttctgtatttatggctgcatactggcatgatgctttctcagttatgtatgatatcattagtctgctttttcaggacaaaatctgtgtcacagtgttacagacaaaatctataacacagtgtcggcataataaattcagctcagtgaatgcttattaaacattaacgtaatccttgttgctttctttattcaaccctacagtgaaattttctgggtgcttggagtaactaaaatatatttgcagatatttaatttcaacttcttacacattaaacaagtagaaaaccatgtcttcaaaaacatattctttaaaagtgattgcttagggcaaaagtagtctatgattttagaattcattataatagttattcttagggtgggttcatgattggaatggaatatgtaggggcttctggggtgttggtcatgttctgtttcttaatcttgatgctagttacatgggtgtgtttagtttctgcagattgattcaggtggccacttatatgcacttttcttaatgtatgttttacttcaaccaagcggtttttaaaagccagtcattcagatttttaatatgtgtaatatgaatagtgaggatggtactacattttaattcagaaggtcctcttgcttttacccatgcttagttatagtgatcacatgcattgtataagtgtaaataggcagctgctgtcagagttaatctgatgttattctaaataattattgttaggaagttgtatgtctcctaaagattttatccaaacaccttttttttttagtctaagagtggataggtgtactttattttaaaaaaagaaagaaaaagagccaccaaccacattatgtaccacgtgaagatcatggtaatctatatcatacttgtcaatattatgctgtcttatatgtcattgaatccttggcacttactgacctaaaatattcaccaataacctgtcgctgctgtcatttttattattttatctttgcttcaatgtcagtaaaaagaatatataggaatattagtcagctttagctcattgtggatttaagcttgttagttaaaaagtgaatattcgtatatcaaatgttctaatttgattgactcctgaagtaaaacacagggacatacttgatacaagaggttgaagtactgatactgagtagtattgtcaaggggggagatgtgagagtaagggaagaaggaagaaagacaaatgaagaaagaactagctttctgctgccacagcagaatcataagaaaagctggatcatgccctgaatggagactcccttgtactactatggaaataggtggaatccaggaatcaacttggttaccattattgtagttttcatcaccaccagtccctctgatatattcatcaataaggatgagcctgcttaagagatgtagggcttagggattggggaggttaccaaacagtatcagagctacctgagcaacaccccacattttccactttttacacgttttgagtgtagcttgaacacaaccaagtcatgggcagtaccattgctgttgtgatttcttgaaattaactggcatcttttgctggaatttggattctacaagttgatgagacaaatttagcaaatataacatttccttgtgccaaagttatatgactcaaactccttaacagtattttcatgtaaaacgatcagaggggaggtggcagttgtagccagttttgcattgccataataaaataccacagattaggtaatttctaaagaaaaaaatttatttcttacagttctggaggctgggaagtccaatatcaaggtgctagtacctagcaagtgccttcttgctctgtcatcccatggcggaagggtggaggggtagaagggtcaatgagcatggatgagagagaaacaagagagagtacaactcgcttttataacaaatctaatcctgtgataacaaatccactcctgtgataaccatattaatccatttttgagggcagagccctcatgacataatcacctcttaaaggccctatttctcaacacctccatggtagggattaattttccaactcatgaactttgggggacacattcaaacaacagcactggcattttaagtttaagattcattgaagtagtgaggagaaaaccctgacttctactggaaactagtagctctgtggcaaaagattctggtatagtcataatctgaaagatgtattcactggaaataatatgtccagggatgagaatcaggacacacacatttgagttccagctttgttaccagctacttttttggacatagtttggccatataacctctcagtgcctatttcctcatttgtacaaaaattttcttaatttgaaaaatagcaatggtaatatctaggctacttatccctcaaggtggttatgcaagtaaaattagatatgcaatatgaaaatgccatatgaaaaaggtgttacatataaaaaattattattcaagctagtatgaggatattaattccagttgattttgattagattttgtttattcagtccagtttaaaaaatgaaggtcagaccaggcgctgtggctcacacctgtaatcccagcactttgggaggccgaggcgggtggattccctgaggtcaggagttcaagacgagcctggccaacatggtgaaacctcgtctctactaaaaatacaaaaaaattagccgggcgaggtggcaggcgcctgtaatcccagctacttgggaggttgaggcaggagaatcacttgaacccgggaggtggaggttgcaatgagccgagattacaccactgcactccagcctgggcaacaagaacgaaactctgtctcaaaaaaacaaaacaaacaaacaaaaaaatgaaggttagaattcacaagttaaaatataaagctttctgaaatgatgtatgattttattaattttagtttttctacatattcttttactcttttccattttggacacttttaaaaataagactaaaaacataatcatgaaggctcatgttattttaaatgacatctctaagctttcatggaagaatcattgtcccccatttaaaggttgatcataaaatttccaatatcctattttgttaggatatctttttccttagcatgtataaacatggaagaaaagataaagcatatagtattaactgaatagcctaagtaattgatagtaaaagtttaggggcaaataaaaaaggtatgaatataaaagattattataataactaataaagatgataaataagtagaaagccaggtcttcaaaaaaattttcttttatgtgcattttaaaggagtagattctgcttgaatttgtagcagaaaacctgaagctaatgtttatgctcggcactgtttcttaattatgcatttgctgatacctaatagtgattatagtaaccactatcatttataaagggctaagtgccaggaattatattaagcatggttttatagaaaaggagactgaggctcagaaacgtgaagtaaagtgcacaagatcacacaatgaataagagcgaatattttttctacttccgtgtctcttgttctttccactataacatggacaataatatcaaaaacataattcaaaaggatataaaatatgaaaattttagttataaatttaatataaactgataaagcagtataaaccttggtaatgtccatattttaatgggaaggtcaattattataattagaaatatctaatcacatcatataaatactgctttgttctaaaacttcagtaaactcttaaatatataaaagtgctatctttagaatttagggttttactcaattgatttttccttctacgtgtccacagagaatagtaacatacattatgatgaggagaaagaataatcatctctgttgcacaccctttttgaggggtgtggtcctcaactaaccacatctttatttaacgctattcgtatgaggaactgcggctgctaaattgttcatttgtatcccttggtttaaatgtgtcagttttcttcagttatctattctctggaagtaagtgtatgctttaaattaatctgtgcacttattcatgtatcttttaccattagaaaacacactgaatagatattcttcggaggaaaatgaattgttgatatctcagcttactcagaaattcagtagaaatgattcttaactcttaaatgggaaaatggcacatggatagaacattttcgtaggaaaaacattccaaacgtatttagcctcaccagtaatggaagaagtgcacatgaaacaataaaatataagtttcagctatcaatttggtaaaggttaaaaaaatcaaactatatcgtattctcagcagtagtacaggtggtataggtgagatgcttatgtattaattatttgcttctctatataaattattgattatcacaaaatcccatacataactatttggagattaacatgtgaaataggccgggcttggtggctcacgcctgtaatccagcactttgggagggtgaggcgggtggatcacgaggtcaggagttcaagaccagcctgaccaacatggtaaaaccccgtctctacgaaaaatacaaaaattagccgggtgtggtggcacccacctgtaatcccagctactcaggaggctgaggcaggagaatcacttgaacccgggaggcagaggttgcagtgagccgagattgcaccactgcactccagtctgggtgacagagaaagactctgtctcaaaaaagaaaaaaaaaaaaaatgtggaatattatacagtgttccaggatttagaggacctggaagtatgcaaagatttatcaccttgaaatttatgtgtttttgaatgtatgttattatttttattatttaccttgtgaatctttgctacaataacttgtagtcagaagtctgagaatattggcatccttatgaaaaatgcactgaggaaaacagacaccatttttgcagctttgagactctgctatgtgcgtctcaccatacttcttggtaataaaagtctctttaaaacacactcaaaatacctacttgtaactagcagcttttttttaaagaaggaagactgatgtatatggctgtatttttattatatttgcatgcactgaaatataattattctgaagggaattaaaacaggcaagtgatttcaggaagtggatagagtttaaacatgggacagatcaaatgtataggaaacaagtggtttgtggtaatgattggtgttacatctttcaaggcctgataccattgacatgtggcggtgagcagcatatctctgacacttttgcacagttagcaatgatgttagacagcagttcttcctgaaataagtgagccaaatgccagtgcagctaattggtttacttgggaaatgctattcaccaatataaagcctagaaaagtgaaatttcagtatgcaccttataaactccatcggcatgtagataaccaactaattttgagttacagttggtccagtaccagaagtattgtatggtttatctgaagggactatacagaattcatcactgatatttaaatttttctctatgattgttttatgaaagcagcaaggcaggttatagaattctccgtattgacagatctttaataaataaactttaataaatgaatcaataattggcatagaattaacctccagaaagacacatattgcttagccttaaaagacatttttgaaaaaatgatttacggatacaattttaactctttcattgtactgtcaaaccttattttataattaaaatcctccatgatctggaatctcccttttattaacagtggctaaggagccatagcagtgagactagaaaggagagaaaagattctggaaaatgtgggacttaaatatgtgtgcattgtgacataagtagtggatgagggaaccaccgatggggagaaaaattgcaaaaacaagagtaatatttgtatgcagatatccacctatacaatatatgtgataatttgaaattacctatatctttttttttaaccacacatgattccctgagtagatttcatttctagtatcagcagtgtcatactatgaacgctcaaaagtaaaagttttagaataagctgtaatttcagatccaataatctcagttaaatttggaagaaagtgtcagaggtatttgaaccagagcaactccattttgaatgagggctaggaaaatgaggctgagacttgctgggctgcatggttaagggaacaaattaataatgtttactggccgggcgcggtggctcacgcctgtaatcccagcactttgggagaccgaggtgggcagatcacttgaggttgagacttcaagaccagcctgtccaacatggagaaaccccatctctactaaaaatacaaaattagctgggcatggtgacgcatgcctgtaatcccagctactcgggaggttgaggcaggagaactgcttgaacctagaaggcagaggttgcggtgagccaagatcgtgccattgcactccagcctgggcaacaagagcgaaactccatctcaaaataataataataataatataataataataataataatgattataataatatttactaaacagacccagacttgggagtgtccagatgtcctgatatctggagaacaaaggcattcctaattttgctttaaagataataatatcaattcttgcaaaatatagtaattaagaaagttaatcctgtatcacaaacccttgtagcaaagcacatctccccatatatataagcgttgtacctacggtagatgcattcctcctcttttgggaatgtcctactctgtctatggagtagctgttctttcaccactttactttcttgataaacttgctttaactttggactgcggactcaccttgaattctttcttgcgcaagatccaagaaccctcttttggggtctgcatcgggacccctttcctggaacagaagtacatagaaaggaaatgtttattctgtcagtccagatttcaaaacaaagtgtctagcagaatcaaaccattatcatatttgtattttgtgttctgtctatatttctgttctcaaaactaattatggcatttgatatagttagcgcagaaaagtatacgccgagccttactctgatgttaaatgcttgtggagttcaaatattttgtaaaatactatttacctttctacagatattaatcaaggtagaattacctctctctaaatacagtcttgtctgaagtaaaatcccagtcagtttattatatatcaaaagaagtaaacagcttttttgcttgcttctctaagaaccataatcagttagtcatcttcattctattgccttagtctggtcttccatgatcttaaaaaatgggaaatgactgtgattaatgaagctatttggacgatgatatttaagatgataattgcatttaaatgttatattgtttaaattatatgcaaatatctgagatcaaaggaaacataaagagctctattgtcccataagtagtttccaaattctgctagaaacagttaatatgtttgatcggttctattgtcttgtccagattcttgaattctgtttgtgcaaactggacttgaggggagtatctacagacagagcagcatttctatcactcctcggcagtgttctcttcaacagtgcttattgccagctatcgaaatgtgcagtgtgtgtatgactaagagtggatgagtactgtaacaccttaattacaaaataaatagtgactgtcactgttgctttttatagagctttctgactcaagtgcttggtttcctctgattttttaattatttgcatgaaagaaaaaagaaatcactcctttgacattcgatggagggaaaaggaagagctaattaaactgttgtggaacattattatcctctttagttttacactgacaattctaatgcagagtcactttaaatggctttgcaaatcggaatttgctgggccctttattatttctccaaattcactgaacaagtccattcacagggatattgaaaatgcaaagtaagtccagactgaaatatcatttatttcatgaaacattcattagcactttcagtagctgaagataaaggaaaaaatgtttcacagggagtcatgagagattaatatatacagatttttaaaaacaaaacacagaagtttgaaaaaccatcaggtattgctttgaaaggaatatagagttatatggattttgaatgtgttgaaaaatggcttaaatgtactgagctattcacagcccttggcttttactttttatgtgagttatatctgaacaaaaattttattatagtcagtgttgttcatgctgctatagttaaggttgtcagcatttccattacaaacccactatttcagttggggttcataactcagctttagaagtcaccctgggctaaaggttggcaaatgccttttcaacctgtggtggtaatgatgggtatgagtgtggttaaatatgtagtaaacatttaaattaacatatattacttcttatgttatgaaatattttaattgaataatatattatggttctctgattatagaaactgtctgaggaatgttagctttgtcagtataattgattcagggttaaagaaaactttttttcaatctaattagtccttgtagccaagaaactctgaacatatcttggagccattagccaaacacttcctgctaccaatgagcgatggcttgtaaaaggcactcagtaatatactaacattactgccaaacaactggttaattctgtccaaagattagtgtgtgccacgaggattgaaaagttaaactgacaagtttgagattttgcatacaaccatagccacatacgcaggtaggtaacagattttttaaaatgaaaatcggtttcttttgaattaatctcatttttctggttataaaattaattatttttcctagttatgaaaattaaaatattttagattacttagtaaaaacggaaaaattaaaacagagtaaagaataaaataaattacctataatttctcaaaccagtaataacgactggtaacatgttgatgaatgtccttctgatctttatattatacataaacacagatatgctacaggactgccagcttcatatgcccactgtgcagcagcagaccaatacactgactgcagggttgcagcagaggagtttaatcacaaggcgccaagcaaggaaatgggaggaattctcaagccttgaatttgtttccttgagggattctgggcaagggtgtttaaggggattcataaaagacgggggcggggcggggtgggggctggaaaatttggtgttgtgatcagtgggggcagggaggatgaaatcataaggatgtgtaactgcttttctccaagagtcagcttcttactgggtccaccagaccagcttgattccctagttttgttgatatgcagaacctcctaaagaagcatctcagacaaaaggcttatcttctcacaatgtctgagattttatctatagaaccggaagagaacagagaatcttgtgacaaaggctatgttatcctggggtggtaagtagaaaccagttacaaggaagtgggccaaagggcaagctggcttaatgattgctgctgcaaacctagttggattttattttattttatcttattattttattttatttttcttaaacaatttcattaaattatcttgggaacagtgtcagatatatatatattgctaaggcatactttctctggctgcccagtatcccactgtatgaaatgtttaacttatcacctactgtcgtggatttcgaaatctggttaatgatttatcttagttaatcttagttactttggaataaaaatctgatgaaacctttcagcagctagagtttgctcaggatcttggtcttaagtctggttttagccatttttaggtatgctagttactgtatcctccaaatgttaataatttataattttgattccaaaaatagattaaacacatagaatttattatatattgatcacagagagataccatataccaaacacttaaattccattggcatggttacatattgaagcttttagtgtaaatggagcagactttaaaaattaataaatttggaacatatggaatgatcatttcctttgaattcttcttattttaacttgaagagcaagggaaaaactttcttgcaaaccacatttttccctttaaggtttttgttttttgtttttttgttttttttttttttttcctccctagggaggatatagtggcgggatgcagccggggactctctgtaggaacagaatattatttaatacagaattccatgatccgaaagacctggatttcaatctcaactctgctttctagttatgtatgtgattttagggaaggtacatgacttatgtgagccttacttttctcttccttatgatgtagataatacttgggtcaatggtgttataaatattagatggattatatataaaaatttacttatttgttgattggcatatagctggttccaattaggtaaaaatgatgaaactatgttatactggacttcaaaagttttttgtgggttttttgtttttttttcttgagaagtctcactctgtcacccaggctggagtgcaatggcacgatattggctcactgcaaccttcacctcctgggctcaagcaatactcctacctcaccctcccaagtagctggacccacaggtacatgatgccacacctggctaatttttttgtatttttggtggagaagggggtttcgccacccagactgggaaaagttaaattgagtttagattcatgcgttaaggctgggaagccattgcctactcctgagcaggagagtgatttaatgaaagtgctattctaggaaaattattccagcactgatatcaaaatatctttaaaaggcaagcagtagctgggggtacattgcttttgtctttctctaaaattcatgattatcaataaaagaagactgtctcattacctctgttttagttaagaagctgccagggttttaccattatgttgcagtttttaatctttaggactcatgttattctttacttctgtaacattatagtctcttcatctgtaatttttataagagatatttggaaccttctcattctgtcctccgaagtttaacttttccttcttgtatgcatctcttagtatctctttattattgctttttatatgacttcttaatagctcttcttagtatttcttcttaatatctcttaatattaccttaatattatcaatttcttgagaattatcttccaatgcactaattctctttttttctccccactaattctctctttacctgtatctagcaatcttttcgaatcatctattaagaagcagtatagtgtggtggttaaaagcaaagacttcgaagccagacttcctagattcaagtcatttctctgccacttactagctgggtaatgctggtctagtttcttaacctctctgtgccacaatttcttcattgtcaaaatggatataagagtagcatctgcctcataggtttattttagtattaaatgagtgatgaatgagtttagaatagtacctgtcatatagtaaattttgaatttttctgtttttattgaggttttattattgtagtatctatatttttcctctcatcccctccccctctcttcttctcacagaatctccctctgttacccaggctggagtgcagtggtgcagtcactgctcattgcagccttgacctcccaggctcaagtgatcctccctgctttcgcctactgagtagctgagactacaggcgtgtgccaccacacccagctaatttttgttttttgtttgtttttggtagagacaggatttcgccatgttgcccaaactggtctcaaactcctgggctcaggtgatccacccgcctcagcctcccaaagtgatggtattacagacatgagccaccgtgttccttttattgatctattcattcttttttttccccgtctatttcttgctttatggtgcccctttctttcttcatttcttagatccttatgaacatatttaaaatattgttgttctgatatttattgtttctaaggtatgaatttcaccctttgttatttctgctgactttgtatcatagtggtttttaatgttcatctgattcgcaatttcttcactgagagctcacctttagcagaagttttctttggaagtttcagatgctctgggttgtagaggtaccatatgggatggtttcaatttttctgtctttcctaaattttaccagtttttacattaatttttatctttctattcttttcctttcttttctttttctttgagacagggtctcgctctgccacccaggctggagtacattggtgcaatcatggctcactgcagcctcgaacccccctggtctcaagagatcctctacccttcagcaactgcccccacccctacctcgccatagtgggggctacaagcacatggcaccacgcctggctgatttttgtatttttttcagagctggggttttgccatcttgcccaggctagtctcgaacttctgggatcaagcaaactgcccaccttgtcctcccaaagtgctaggattataggtgtgagccaccaggcctggcctaagttttcaatacatggtctccacacaggttggtaaggcattgaagtttcacctttatacccatagactgatgtggctaactttttccctgctatctttcaggaagtgactgaagcttttctagacttagttttccagatgagaccacccttccaggctcttagctttgtgcagggatctcagttccagctcctcatgtacaagaagcttgtgacataaattctcttccctatgcagatattaaaactctagtctctatgcttatatttagttccttattcctcttagcctgttgcctttagctccctaacagagctttgactttgaattgctactttctgtctggcccctaggaatttgccattcttaattttgagcttggcttttttctttaagttttatacagaacaatttgactagtagtagcttttcacattaacttattcaccattgtgtttggtagaatattgtcaggaataacaatgtaaatttaccagagatatttctttaatgagtaaattggctcaatgtatgcattaattgattcataagtctttgaggatctctgatatcaaacaaataagcaagagtcactaaaatcaagaatttattgagaacctactttaacccatttttaaggtcactactgtgtcagttccatttcaaagctagtctcaacctttaaaatacttatactctagttagaggcaaggaataaatacatgaagtacaatgaaaagagctaagtgacaatgcaaaacaaccaatccataaaactgtagatcagagtcatctgggctgaagtaccttgttctgacaggtcatacaactgtacttatccctataaatacctaaggcaaaaatacctatttcttacttcctgcaaagaaattatataaaattatctttcccccaatctttactgtctgtcggcaaaagtgaggcagacttatggttctgagtgagcactaccatttaaaagaaaaaaagaaaagaaaaaaagagtgtgaattgccttaggtaaactgaaattgtcaactctgagccaaaacaatgcatcaaatttagaaatgtatgtcttcttatacattgactttactattttcacatgtgtgacttttaacttttcagataatgtatacctattatcagctttctcagtaaattgtttacatcactgaccattaattcttagaagtccttattgctactttttttggtgttcagaaataaattaaaattctcttctttgttcttttacctagtagtgttttacaactttttgaaacatgaacgatgggttaggattttatacaatgaatgatatgaaagttggcttgaatatatacaccacaaggtttgccgtatggtcctctgtcaaatatctgttctcaagatgccccaaggcatcataaaaacaaaatggaaaactgcaacagaagaccaagaaagaaatattttcaggtaaatggtaaagcagggagatgacacatttcgtgcattgtatttcactctttcaacaactatggattgaatgctgaatttgtgccaggtattttataaactgggcacttgtcatacagtggtgatcaaagtggatgtgatcactaccccttgtcacagtctcataggagagacagacaattaattatatagctctagacttaatatgctaggaaagaaacagagtggatacaataatgggtaataatactatatggtgggtgcagggagagggctccttctgatagtgtgttcagagatagcttctctgaagagtggccatttaggtggggacctaaaggctgagtaagaggttgaagtattttctgttggcagggttagagtttcttgggagacataaaatagtttcaaaagaagcattaccaaaataagagtttttataccttcacctgtgaattatacgcttttgtttgtttgtaaacattttattttacaactctacatactctgatgcaattctgtattttggagttttgtttgtttgtttgtttgtttttgagacagagtctcgctctgtcacctaggctggagtgcagtggcgccatctcggctcactgcaacctctgtcccccgggctcaagggattctcctgcctcagcctcccaagtagctgggactacaggcacgtgccaccatgcccagcaatttttttttttttttgtattgttagtagagacgcattttcattatgttggccaggctggtctcaaactcctgacctcaagtgatcctcccgcctcggcctgagattacaggcatgagccaccatgctcagccctctgatgcaatttgagaataaacaagtatagcaagtataagcaaaaggcacaaggtattctgcatagttaaaagtgcagctgcttaaaaaccatcccgtcttctctactctctctctctctctgtcctcctcctcctctttttttctttctctcatattcgtcttacagaatattaaatctgtttccatattgcttggtcccttccttcatcttaagagagatgttaatactgtgcgttcattgagaataaccaaatggatgttagcattgttctttatttaatcttaagtaaaatattgtttttttcttaaaaaaaatacatttatcaaaatttatcttacccttatcaatctcaatacagttgtctttacattaacttctattagttggctattgtcctatgttttatatattcagtaattatataatatggaacaaaagtaagatatcattgctgaatgctgttttatggaaaaagaaaagcctttggcattaatgtaatatatactcctgttgattaatactttgaatgtctttctgtgagatatatacaataatgcccataaaatgatcaattttgataccattctgatgcattaaagatggtgaaataaatgttttaaaaagactgggagatgcgaatacctattttttgaaagcaggttagaatgtaatgcataaatgggcaaatgaaaataaaagcataaacacatagaactaccagggctgttgaatagtacctgactcaggtctcttccctccagaaagactataaaaaaacttctaggcaaaacagttgtgtttcatattttttaagtgctggttagtaaagactttaaaaaactcattacaaagtatttcatgattacagaagaacatgtaatagatagtatgtaaggtataaagaatagtgataatttaaaatcccacgaacttagcacccagctaaagaaatacaactttatcagtgctctttaatgccctgtctgttctgagatcctgtattcctccccctgctccaaacggaactactatcctgaactctgtgtctgttgtccctttgtttttctttatagttttactgtatattatgtatacataaataatctattgtctacttttcctcagttttgaatctttacataaacagaattgtaaaatatgccttattctgcaattagtttttatttttcactaaatcttgtgtttctgagattaactaatattggtgcatgtatctgaatccaattcctctgccacatagcgtttcattggatgactataccacaatttacttagccattctcctgtcaatgtacttgtggtcgccccctccaccaagtcttttgttaatataaacaaagctgacgagaacaatgttttattttgcttcctgatgcaaatatgcaagagtttcctctagggcgctattctgaaacttttttttttatcttagaacctctttactcacctaagaattgaggataccaggaacttttgtttacatctgttaaatgtatcagtatttattcaattagaaatcaaaacagatcatgttaaagcatcagaatatataagcacacattccattaaccatcaaagcagcggtgggcacttgaaacatgagtggcattggaaagttttgagatagagactctggaaactactgtacactctttcaagaatgagagtacaaaaggcagatttcttagtactattatgaatgtagttttgacctcatggacctgctgaagggacctcagagacctgtagctttcatagaccacacattgagaactattgttccaatacaaatctaaggttagaatcattaggtcattatgtctcttcaattactagataacatcaaatatttttctaaagcagttgtactgtaccaatttataatatcaatagcagaatatataagtacttcctttggtacacattctagccaacatttggtcctgtcaaacttttccatttttgacaatctagtggtttaagatggtgtctcactgtggtttcatgttacatttctgtgatcactaatgagcctcaaaatttgtattggccattaaaaagactgttaggtctttttctgatctttcttttgggttgtttatcctctttaaagaaaattctttcaattagttattgaaatattacagatacaaaccccttgtcacttatatgtcctgcagatatttagaaacagttgtggctagtagtagtattacttttaaaaatgtgccttttaatgaacaaatgaacagaattttaaaattagacagtctttttttttttttttgatggaatctcactctgtcactcatgttggagtgtagtggcatgatcttggctcactgcaacctctgcttcctggtttcaagcgattctcctacctcagcctcccgctgtagctgggattacaggcgggtgccaccactcccagctaatttttttgtatttttagtagtgacggggttttaccatgttggccaggctggtctcgaactcctgacctcaaatgatccgcccgcctcaacctcccaaagcgctggattacaggtgtaagccaccacgcccagcctatatagtcatttttatcagtcatttcctttagcacttagactttttgtattttaagtaaccctttctaccttcagttcatgaagatatttttctgtattttcttttattcattaaaacaacactttttgattacctactactatcagacacagttctaggtagtgtggatatggcagtgaaaaaaatacatttaaaaaaaaaccctagactcttagagcttacattctcgaagtggggaggaaaacaataaacacatatgcaagtatctcttagtctcttcagactactgttacagaatactatagactgggtggcttaaacaacagaaatttatttctcagagatctggaagttgggaagctgcagatcagggtgccagcatggtctggttttggagaaggccctcttcctgttttatgcatggccgcttcttactgtgtcttcacatgtcagagagagcagacaggaagcaagtgctttcatgtctttttataaaaggcttgcatcaggtggttggcaataatgaaaaatgtccagattcttaacgtgaagttaaaaattcacaaattgattagaatccacccttatgatctaattatttcccaaaggccctatccccaaataccatcacactagggactagggtttcaacattggaattttgacaggacattcagtccatagcagcatgattttgtatgaaggatagtgataaatattatgtagaataataacgtcagtgagagtgccaagtggtcagaggtggggttctgtaggacagaacagcaaagcacaaacttcccaaggcaattaatgtacttggagagtttgaggaaaaggatgaagtccagataactagaatggagttagcaagaggaagcgtattaggagatctggttgataacagaaacccagatcacctagggcctcctaggccattttaaaggcttgagcttttactttgagatggtaaggcgatggaaagttttgagaaaagaaatggcaggtttttaaaagatcactctgtctcctggtttgagatagtctatatgcaagcaagggacaaaactaggggaacatgtaggaggttgtttcagtaattgaggcagaaatgatggtggcttgcatcaggtggtggcagtagtgaaaaaatgaccaaattcttgatatattttgaagcttttatttgcaattggccagtcacagtggctcccacctgtaatcccagcactttgagagccaaggtaggcaaattgcttgagctcaggagtttgagactaggctgagcaacatggtgagacctcctctttacaaataattttttaagaaacgaacagggagtggtggcacatgcctgtggtcccagccacttgggaggttgaagtgggaggatcacctgagcctgggaggtcgaggcagcaatgagccgtgatcgtgccactgcatttcagcctgagtgacagaatgagactctgtctcaaaaaaaataagacaaaagtacccaaaacaaacaaacaaagatttgcaaattgattaaatatggtttgtgagaaaaacagagtcaaaaatgagtaattcctttttttgttgttttttgttattttttgacatgagtaactagaaagacaaagttgtcatttagagagatgaggaagattgtaggtggaacaagtttaggtacaagagtaagaagttatttttgaacatggtaattttcttatgtccatgttcaccacatagggacaccaagaaagcagttagatatatgagtctggacttatggggagaagtccaacctggacatgtaaatctgtgaggcattagtgcacatagtctttgaagccattagactggatgagattaccaaaggattgattatagatagaaaagggaaggggcctggtgtgtgatccatgacatactataatgtttagagttctagaagatgaaaaggaaccaacagaggggactaagcaatgaccggagaaataaaatggtatttaaatcatatcctgcaagccatctgataaaagtcttttgtaaagagagtgatgaaatttcttaaataaaatgaagtcaagtgaaatgaagacagataattaaacatgaggtctgacaacatgagcctgacaagtcctgtttggatatagtgttggggcaaagaacaagattggaggagattgaagagagaagggaggaattggtaataagaagtattttcttctaaagctcttaaattttcaacatgttctttaaatacattgctttttacctgttacaaaagtaatagtgttcattgtagataatttaggaaaaacttaagaaaatattttatatggtccaaaaaactaactataaccactgtagatattttggtttatagcattggagtccatttttttctgtgcatttttataaattcattttctaaacaaaaaatacattatagacatatttacatgattttcttttttaaaaaattatttatttatttatttatttttttgagatggagtctcgctctgttatttaagctggagtgcagtggtgcgatcttagctcactgcaacctctgcctccccggttcaagcaattctcctgcctcagccccacgagtagctggaattacaggcacgcaccaccacacccggctaattgtattttcagcagagcccgggtttcaccatattggccaagctggtcttgaactgctgacctcaggcaatccacccgcctcggcctcccaaagtgctgggattacaggcgtaagccaccgtacctggcctatttacatgattttctcacgtaagaatgtaccatgtttgtctttccttagtatttttaatggtagtgtagcgttatattatgtattacggtttatatgtagccaatatcctattattaggcacttttcaacattttcttttagaaacattgcagtgagcatttcaatatgtaattatagtctttcattagcatattcttaaagattttgacaattagcccactgggatatgtccagaagagaaatactctgataatggtcggtctgcaaaccttatcatacatacagagggcttaggaatagttgtccacgttgcaaaaattgtaagggttcagtggaagaggaaagctgcccagcagcagaaggtagtccttatagggaagggcagttctctgacagaagaggccttgtccatagaaaagatatgggtagaattgcagcagttgtttgtatgtgcagcagttttttaaataagaaactttccgggctgggcgcggtggctcacacctgtaatcccagcactttgggaggccgcgacgggcggatcacaaggtcaggagatcgagaccatcctggctaacacagtgaaaccccgtctctactaaaaatacaaaaaatcagccaggcgttggggcgggcgcctgtagtcccagctactcgggaggctgaggcaggagaatggcgtgaacccgggaggcggagcttgcagtgagccgagatcgcgccactgcactccagcccgggcaacagagcaagactccgtctcaaaaaaaaaaaaagagtaactttccatattttattgaattgtaggtcatgtaacgaaggttttccatatatctcataggcacaaatataaacattgtatgcattctaaaatcaaataaacacaatctcatttatatatgtctatgcatgtctgtgttgtagttgaggaactttagtttatatgttatactaatagtttactgaatataagtttgaaatatttttctagaattaaggagtatttttaaatcaacttagaattctattttctgcaataggaatatgacaaacattttctcttttttgaccataaactacttgaaccctgtagttttccatttagcttactattttaaggaatgtgataaatcaattgcgaacctttttgttttctttttcttgaggcttctgttgtgatttccagcaaaaaggtcgatgtagacggcattttacctgatgttgatgttgcttgggatcagaattgacaatcaggagtagtctctcagtttagatttacaaaaggccagataacttggatatcactactgcttatagaaacatctctatctctcttcttccttttcaaatattatactcactagatcattaataagtaagataaaatgttctttacactttcacatagcctctgaatttttcccatttaaaatgcactgcttgaaaaatcaaggggaaaacaaaggtttaaattttctttacattttagataatgaaaagagggctcaaatgaagagtttaacagaggcacctgatgggactctttttattgcatataaatagaactattcgtgctgctatttaacaatcaaaatctaaatacttcagactgaagatcaagtcccctactttcaaactatctcccaaaacttcccattaaggactgtatactctaggtgaactgaattaccttccgttcactatgcccagaatacagttttctagaaactctctgtctctgtgatattcacgtcatgtaggtttcctatgtccacgactttgaaattctaaatctaatccataatttaaggttcagttaagttgccaccctcttcaaataggcttcctggaataccacaactaaaagtaaaatctctgccattgaactttattttcatataccaagattctactacagtgctaaaacataattatgactatgggctagtcacaggggcttatgcctataatcccagccctttgggaggccaaggtgggcggatcatttgagttcaagagtttgagaccagcctgggcaacacgacaaaaccccatcttgacaaaaaattagccagctgtggtggcgtgggccggtagtcccagctacttgggaactcagaaggttgagatgggaggattgcttgagcccaggaggcagaggttacagtgagctgaaatggtaccactgccctgtagcctagatgacacagagagacccagtctcaaaataataataataatatttatgattatgtttaattttgatttgttctgttgcactcttatgatgcatgacatatataacaaacaattcctaaatatgagtgttcctcatgaaaatcactagcatatgtggatgcatacttatatgtatttttggccttttgattgagtattcacaaatcataagtgttccgcttaggagtacttttaaaaagtgaaaaaagggctggacctggtggctcagacctgtaatctcagtactctgggaggccaaggtaggcaaattacttcagcccaggagtttgagagcagcctaggcaacatggcgaaatgccatatctacagaaaaaatacaaaaattagctgagtgtggtggcatgctcctacagtcccagctactcaggaggctgaggtgtgaggatcacttgaccctgggagaagctgaggctgcagtgagtcatgattgctactgcactccagcctgagtgacagaatgagaccctatctcaaaaaaaaaaaacagtgaaaaaaggagttaaatagaatagtatctaatggtatctaaagtagcagttaagcagtagagtaacagttgcatttattaaggatttagtatataataatttttattatataaaattattatataataaaaatatataataattatattatataattataatatataaaattgttatataataaaatatataataattgcatatgcgcatgataatttttatatgcactcatctcctctgtacttcacataaatcctgataggtaaggtactattattattcttactttacaaatgaagaagctggaacttggggaaattatgtaacttgcctaagttctcatatatagtcaaagacccccaagccttttaaccactttactatgctgaaaaaagtcagaagacgtagcaagaatgtaaagttttgaaattaagtcttaggacacagaaattatgttagaaattatacttgggtttcaggattacattctcgtgtgttggcaaggaggacgctactagctgagtaagaaatgatgtgtgtgctttatgactttattatgtgaaagggtactaaccatagtagagggttacattaatgtatctttagttgttgtagatattaatgggagaaaaggatttataagagctttcataaaacaatttgattcctttatgcctctaaagctgttttcccaggaaacattaaaattgtaaataatgatttatcctactgtggggttcttcggaaacttaactcttggggttagatttctactggtgtgtgtgtgtttaaaagagctattaataaaactgcatatacattattccattgtggtgttttaattatttttgattgatcctgctttctaagctccaaattagaacaacccctttaaacatttattaggaagaaatatctgaaccagtctgacctgacatttgtagacatcatcttagggctgttctccccttagaggatagtaacttaggactatatcagttacgtctggtaacgatatgccatgtctgtgatactagcatgcatttctataaggaaggaagagatggagggagagaggaatttgttttgaatactctgaaaatgtctagccagtggattataattaccataatcacagtttttggccatttggatgaaagaatgttgttcatgcccatactgctagctaagacagtcatgtgcatactgcattatgaacctatttccaatagattaggaaaatagttacaacaggtttgaggcttctgttttgcaaaaaccttttatagcgttatggtctcagaaggaaccattgaagaaaataatcattaacattttctcgaacactaaatcctccgttctgctcctccaatatctcataggctgtcatctgatatcagcacttatgtaatgtcacgataggtggtgccatagttctatactgccttacattataggaaaatataaagtgttatttgaccaattgaataaaaagaagaaaaaatgtaaaaagttttctgaaccctggttttaagaaatttatgaacaactaaaaatttctcaaaggactgcatttttccattctctgttagtaaaatatctcagctgccttttgattctgctagctgcgagaatggcagaatggggcctgaatggcaaactatattatttgtaacattaatgccagcctgtttggagattaattactatctttgtattaaagtactggttgtgttggaattgctgcctttttaaacttccccccaacccttggtcatttctactgatgatttgcagtaaaatagctgacaactgcctatgattagtttagccagatgctacttgctctggtaaattcattttaagcatttgacaagactgcaaagattagtgccagctgagcttaaaatatttttacagacgaatgatacgtgaaaagtcagttacttttcaggtatatgatgactatgtaaattaactgacaacatatcttctttggtgtttatttgtgaatcatttatctactttatagaacaattggtagagttatccttcacaggtatattcagaagatgtcaccaaatggagtgctttcaagtttttgtatgttattatgttgtcctatgaattgcctgtgctccaagacttatagaattgcagggtaaagttgggaatctctggattagagaatgaaaataaaagtgagaagtcttttctttagctacttctaccattcaacatcaagaaagaggctcttactctcaaaacattgttcttaggaatggccatcaaataaatgccttagttacagataacattgaacaatgatgagtagtttattggtttttcacctttcttcattctttgccctcttttattattatatctttactctttctcttatgccctttttaaaaagcatgtattatactatagaaatgtttcctattagtgattaatgtgataaatttgattagttgaataaaagcaaactttgattctagattttatctatttcttggtatccggcactgtcaaatacagttgtccctcagtatccatgaaggattggtgtttttttgtttgttttgttttgttttgttttgttttgttttgttttttgagacggagtcttgctttgtcgcccaggctggagtgcagtggcgagatctcggctccctgcaagctccgcctcctgggttcacgccattgtcctgcctcagcctcccgagtagctgggactacaggcacctgccaccatgcccggctaattttttgtatttttagtagagtcagggtttcaccgtgttggccaggatggtcttgatctcctgacctcgtgatccgcctgcctcggcctcccaaagtgctgggattacaggcgtgagccaccgcgcctggccgaagtattggttttaagacctctgcagattccgaaattcgtggatgctcaagttctttatttaaaatggtatagtatttgcatataacctatgcacatcctcccatatactttaaatcatctctaaaccacttataatacctaatacaatgtcaatactatgtaaagagttgttgtactttattgtttagggaataatgacaagaaaaatagcctgtacatgttcagtacagacacaaccatccaatttttttcccaatatttttgattcgtggttggttgaatttatagatgtagaacccatggatatggagggtggagggcctactgtatagttatctctataggttttgggtagtttcctgtccttcacccagctgagtgtgaccttgtctattagaatcatatatactgttctggaataagcttgagatgttatcttttctaatctcattttaccaatgaggaaactgaggtcctacaatttcaataattagtcaaatagcacatggcaaaaaaagtggtttatataggattggaccctagttttcttcaccttccagtgttctgtccactttttggacttcgtacatttgaatttctttatactttgctgatttcactcaccaaacttactgacttacctgacttctgaattatactcagaacaaaacacctgtatgaaagtcttcagtggcaccccattttcttttccagttttccttcccttctttcatctctccctcccataaggtcttcctttttccttcattactgcattttttaattcatgtagaatctacaattttcacttgtagttttatttcaaaatttgttaattttttctacgtctcttttttgttatagctctgaaaagcctacttaaaaaaaaaaaaaaaaacaaaaaccctgctaattggcttttcttcctggtctattgaataaagcactagatagggaataagaaaaccttgatgcattttcttaccttgaccagtgacatgcacactctgtgctctagttttctattaatatcaataaagcggtatttatctgtactgcagagttatcaacctgatttaattaaaaaatctagatatgggccaggcacggtggtttgcccctgtaatcccagcactttgggagaccaaggagagcggatcacttgatcccaggagttcaagatgagcctgggcaacatgacaaaacagtgtttctacaaaaatacaaaaaaagttagccagttgtggtggtgtgtgcctttaatctctataatcccagctgctggggatggggggccttggggggaatgctgatgcaggaggatctcttgagccctggaggtcaaggctgcagtgagctgtgatcacaccactgcgctccagcctggctgatagaacaagaccctgtctccaaaaaaatctagatacatttggggctttctcagagaatggtgcacagaaaatagaaaacggtattagcgttttaagatatggaaaaaaagataattgttttgatattgatggttattattactaatttttaaagactagtatactcctagcttttcaagacaatgatgaagcaatcctgtacctgtgacaggcctatatttctctttttttttttttttttttttttttttgagacagagtctcgctctgttgcccaggctggagtgcagtggcacaatctcagctcactgcaagctccacctcccgagttcaagcaattctcctgcctcagcctccagagtagctaggattacaggcgcccaccatcacgcctggctaatttttgtatttttagtagagacgaggtttcaccatgttggacgggttggacaggtctatatttctttccgtgcttattttacaactggtatggtctgaatgttctccaaaattcatgtgttgaaatgtaatcgtcaatgtgatagtattaagaggtgaggcctttaggaggcgattaggtcctgagggcagagccgttaaggatgggattaggactcataaaatggtttgagggagtgggttcattttcttccactcttctgccatgtgaggacacagatttcattccttccctagcatacaacaataagccaccatttcttggaagcagagtagccctcactagatgtacaatctgctggtgccttgatctttgacatcccagcctccaaaagtgtgagaaatgattttctgttgtttacaaattacgcagtctgtggtatactgtattagcagcacaaaaatactaagacaaccatcctatgctttagattaaccagtatttaccatataacttgtaaatcggtgttagtggtggtaatgggattactaatgtgcatgtgttaacatgttcattggttcaatgcgaggctgtgatcctgtactctgagtgtgccttttttttttttttttttaattactttaagttccgggatatatgtgcagaacatgcaggtttgttacataggtatacatgtgccatggtggtttgctgcacctattaacccatcatctaggttccctcccctcacctccccaacaagcccgtgtgtgatgttcccctccctgtgtccatgagttctcattgttcagctcccacttatgagtgagaacatgtggtgtttggttttctgttcctgtgttagtttgctgaggatggtggcttccagcttcatccatgtccctgcaaaggacatgacctcatttctttttacggctgcatagtattccatgatgtatatgtaccacattttctttatccattctctcatcgatgggcatttggtttggttccttgtctttgctattgtaaatagtgctgcagtaaacatatgtgtgcatgtgtctttatggtagaatgatttatattcctttggatatatgcctagtgtattagtacattttcatgctgctgatgaagacatacccaagactgggaagaaaaagaggtttatttgaacttagagttccacatggctggggaggcctcagaatcatcacaggcactttctgcatggcagcagcaagagaaaatgagaaagatacaaaagtggaaaacccctgataaaaccaacagatcttgtgagacttattcactaccatgagaacagtatgggggaaaccacccccatgattcaaattatctcccaccaggtccctcccataatacatgggaattatgggactagaattcaagatgagatttaggtggggacacagagccaaaccatatcacccagtattgggattgctgggtcaaatggtatttctggttctagatccttgaggaatcagcacactgtctttcacaacggttgaactaatttacattcccaccaacagtgtaaaagcattcctatttctccatagccttgccaacatctgttgttttgatttgcatttctctaattatcagtggtgttgagctttttttcacatgtttgttggccgcataaatgtcttctattaagaactgtctgttcatatcctttgcccagtttttgatggggttgtttgtttttttcttgtaaattccttgaagtttcttgtagattctggatatcagacctttgtcacatgggtagattgcaaaaattttctcccgttctgtaggttacatgtttactctgatgctagtttcttttgctgtgcagaagctctttagtttaattagatcccctttgttcattttggcttttgttgccattgcttttggtggttttgtcatgaaatctttgcccatgcctatgtcctgaatggtattgcctaggttttcttctagggtttttatggttttgggtttcacacttaagtctttaatccatcttgagttaatttttgtataaggtgtaaggaaggggtccaattttagttttctgcatatggctagccaggtttcccagcaccatttattaaatagggaatcatttccccattgcttgtttttgtcaggtttgtcgaagatcatatcgttgtaaatgtgtgttgttatttttgaggtctgtgttctgttccattggtgtatatgtctgctttggtaccagtaccatgctgttttggttactgtagccttatagtatagtttgaagtcaggtaccatgatgcttccagctttgttctttttgcttaggattgtcttagctatatgggctcttttttggttccatatgaaatttaaagtagttttttctaattctatgaagaatgtcaatggcagttttgttgttgttgttgttgttgttgttgtttttgatgggttcttgctctgttgctcagactggagtgcagtggtgtgatctcggctcaccacgtcctctgcctcctgggttcaagtgattctcttgtttcagcctcccgagtggggattacaggcatgtgccaccatgcctgggtaatttttgtatttttagtagagatggatttttgacatgttggccaggctagttagtctcgaactcctgacctcaagtgatctgctggcctcggcctcccaacatactgtgattacaggcatgaaccactgtgctaaatatgtatctaaggtggcatgagtatatgtgttgttgttgttgttgttgttttgtttctttgagacggagttttgctcttgttgcccaggctggagtgcaatggtacaatcttggctcaccgcaacctccgtctcccaggttcaagccattctcctgcctcagcctccggagtagctgggattacaggcatgcgccaccaccccagctaattttgtatttttagtagagatggggttttgccatgttggtcaggctggtcttgaactcccgacctcaggtgatccacccgcctcggcctcccaaagtgctgggattacaggcgtgagccaccacgcccggcctagagtgtgtgtttttaacaaaggccttccttgccacatcctcattccagtcctagtttagttaatgtgacaatagtagtcttttgcaagataaagattataagtaggtaaccattttagcatttgatgcactttacagattgcaagcaataatatgctataaatttagtttttataataagatcatggtgtgttaatagatcatattctgtaggatagttatagaaagtttttaagtactcttttaaggccaagattcatcaaccatttgcttatcctctcactatttgctgtaatttgtcagtatccttcacaataaaaatagattatgacataccttgggggttcagtgaaggttaggacaagttagggatccaggtaaagcttcagagaggtgatgtaatccccttgatgagattccagtagattaagatcttagtatggcttgtgggggctaggcatgataggaggaagagaagaggttggaattctaggtagaaaaaaacaattaaactgagatataaggtaaagaaagtacagagtaaagtacagagtaaatttgaggagcaataagtagtccatcttggctgaagcataggatatgtgtatagtactgagagaaatcctgtggtggaagaagtttgagactatatcataatggcctcgaatgccatgttaaggattttcaattttatttagaaggctgaggggagaggattgaagaattttgagtagcagaggaattttatcaagaggttgttttgtgatgattgataggaatcatcatcatcatgatatgaataaaatggatagagtaaaaattgaaggtggaccccacttattattaggttactgcagtagtccatgaaagaagaacctaaaccagagtagatgcaactgacattaggaagaaagactcaacagtaatttatatttttatgtggccaggatatgatcaaagacaattctgagcctgaataacttgctgaatagggatgcattttttgccttttttaaaaagaggagagcagtagattcagagaaaggttcctggcttggggagaaattatttttgaacttctctggtttgaagtatacattgagtatatagctagagttgcttaatagggagatgaacatatggtactagaattagaagaagggtgggtatcagtaattacctatttttgcaactgtatctacaaagataataattaaaatgatgagattaaaagagatcactagggcagagagtataagaaaggaagaaagataaggaaagaactttggtgaatacctcatttaaatatagaaataagagttatcagagaagctgggtggggtatttatgccgaagcagtgtttagaaaacttatggaagagaaaatttcaggaaagaaagggttaatcagcaatctaagtttttaaaaacttttgcgaatttgtttttattggggtataagacatgggttggaaaatgtcagtttggggtatgcacttgtctccaggaaatatctatcctcatcttcccgggatgatttttggaactttttctctttaatggagctgctcttgctgccagcacaagttcactgctggctggctcctccttggaagataattttctcctttgttttggagacacttaacaagtggattaaggatttaaaagtaggttatttgatttgttggcctaggttatattgctgatgctgcaagaataattttaataaagtggaaaggacaaagttcatattgtaaggggttaagtagttcctaggtgataattaaatgtagtcaaatttgtatagattgcagtcttttcaaaagtttaacattgcttatttttgtcttcataatattaaaccaggtctatctaaaattttaatatcacatgcaagaagcattatcattttgtagcagatttttaaagctgttatttcagattttgaactgatcagcatgagacagattttctttagaaccatttttgttctggacaaaattcaagctggatattactgattactctgaaatgcaaatagtgctattttgttttacagctatcatttaaaaagccatgtactcattaagataaatatgtgcagcatgaacaacaaaaaaatgagaaagaaaatggacattatttgtattttgtaggctctctgatatggaactgaatgcactaatcttcaaatactaatgagcagcaaaaagcaatttgccagtgcacaattaacttctgactggcttctgttgatatgtagtgctataaccccacaccaggtgaacttcccattttttgagattttatttgaccagtatttataattgtggccaaataatgagatgattattatgaaataatgttatgttggagtaaatcatacttacatggagctcttattatagtttctctatttaattgtctgccaccagggccttgagcttttattttcctctttccccttctgctcttcttgccttttcccatcattgaagaaacaagggcctccctctcaattctcaatttggaaacctgctagtggcatgtcttagttacaaacactgtgttttatatcatgtggttatgttcgtcacttatctcttctttctgttaacttttattctattactgtgtcatgtcatttatatgtatgtacgtgtagatacatatacatgcatatatatttacattcagatatatatgcatcccccatgcatgcatacatatcatacagtagtggagaggaggttgtaaagcataaagtttacctgttttgctcatggtttattgaggcagattttgtcccttagctcagatgagaaaatccctactccacagtcataagctgaaattctcaatccagccagatattttgcaaatgtgcctctggtgcctggggagattgagttaaagcatatatggctcagtgagaccaatcattgtgattggcaaatgaactcaaaacactatcttagtaatgttaaggcagttgggaattttatttccacaacatgcaaactaatactctgaatgagtagcagattggaatatggtaggaaactttgaaattgtgattctcaaataatttagcctaatgcttgtttcatagaattatgaaatcttgtttattgtaaggaaccttagaggatcatctaatttaatcactttttctaatgcagcggcacgttgtataatacccctgagaggtaaatgtccaatgacatggaattccttactttgtctgggctcctgctgcattgaaaatatattctttgtacttggctggatgcggtggctcacgcatgtaatcccagcactttgggaggccgaggcaggtggatcatttgaggtcagaaatttgagaccagcctgaccaacatggtgaaaccctgtctctactaaaaatatttaaaaaaacaaaaaaaaagaaaaaatgacccaggattataggcacccgtcaccaatcccagctactcatgaggctgaggcacgagaatcgcctgaacccaagagacagagattgcagtgagccaaaattgcaccactgcactctgggagacagagtgagaccctgtctcaaaaaaaaaaaaatatatatatatatatatgtgtatatatatatatgtatatatatatgtgtgtatatatatatgtatatatatatgtatatatatatgtgtatatatatatatatgtatatatatatgtatatatatatgtgtatatatatatgtgtgtgtatatatatatatatacacatatatatatatatatatatatatatatatatatatatatatatatctcacttcttcatactgaattgagatctgtcctcctgtcagctctcactcagttccaccatgggggcaatacagaatctgagatttatctcttcctcatgacagttatttaaatatttgaagcactttccattttgtttacttttctaaagtacttttctatggtacctatgcatactttgttaaccatttcttgattgctgactcctccagaatgttggttattctctcttacttattataatttgtcaatgccccttctaaaatgtcatatgttatttaacctaatgcttcaaataaagttttacctttgcatgatacaattgaacaatgccttatacattgtaggttcaaaggtcaaatctttgaagtataggttcccatcctaaattattgatgacagttttttagcttttatagtaattgcatcttgctgtgaatgcatgttgactctgtggtcaacgaaaaacctcattcctttttttcttttatttttataaacacaaactgcagtcaagttagattatcccaaatcccggacctatataaatgatttaaaaaaaactaattgtaagattttcatttatccctgataaatttaatttttgtttggtttcagttcagcactgctacccattacaaaattttgaatcctgactctatcatctagcatattcgcagtccctttgggttttgtgtcatttgtaaatttaacaagtataccttcaaacagcttcttttaagtcactgatttttttgaaaaaggaacaagaaatgcctgcaactaactaccataaacctcctactggttgacaccaatctaattattaatagccttttaatttaatttttaaaccaaattaaaatctacccacctgtactaatatccagttcttatgcgtgttcctttcccacaatggtatccacagagaatttacccaaaataaaaatatgttatgcatttactttccagttgattttctctaagaaacagttgccagtagtttggcatcagttattttacataatccatgctacttcttgatttttagcatgatgatttataaatttatgaagactttgggcatacccaagcatgaggcagagttgggagtgcttcattttctttaacacaattgagaaaagttgatatttttatcaagacatttgttaaggaagaaacagggaaggtataagaaatctaaataaactggcttgcatactacaggattctaatctccctctagctaatgcagcctacagggcctagcccattccacatagagacctatggaaagtgaggggctttgccttgactcctcatttccactattttggtctgcttccatgttttgagtgtcatttgatacacatcatccaagataatcagtctggattttatgactgttgaatatagtacaagaaaagttatgtccttttgcctgtttacgtaaggaccactctcttaattcctgtttctagaatgaaagaaatgccttttctcaagttgattgttaccaggaatgacttcatattgtttgcgagattccactctatccatatgcttgtggccttttcccatacagagtcaatagtatagtaacttaatacaacctactatcatggaattcatttagtaggaattatcagtttgtaataacagggaatatgggcacaaattgccacttattctggagaaagtgatgagaatgtattagaggaaggagtagggatttagggattgaagactaattaagtagcctttttttttttttttttttttttgcaactgtctctctctgttgcccaggctggagtgcagtggtgctcactgcaacctctgtctcccgggttcaagtgattctccaacctcaacctccctagtagctgagacaacaggagtacaccaccatgcccagctaatttttgtatttttagtagagacaaggtttcaccatgtttgtcagactggtcttgaactcctggcctcaagtgatctgcctgcctcggcctcccaaagtgctgggattacaggcgtgagccaccatgcctggcctaagtacctatattatcttccatatgaaatgtgatgagtaccttaactagtttgtagcaatgtgattgaattatagacagttcgctggtaaaaataggcaaatgataaaatataagagactggggaatataataatcaatataagtaaggagtttttggaaatcaaaaattaagagaactaaagtgtttgtgttacacttgggatcatataaacagaatgctaatgaatgaattgtaggtttttaagggttattttccaaacttagcaaggtaattaacatatcatgctaatacaaatattaatagaaatatagatatactttgagcagcctgcagcctacacctactttcctagagctattgaggttggagagcaaggtgaaaatgatgggtttagatttagttctggattactctgggtgaagattttaagcatgtagttagaagttttacctggagagatatttggaagttgccaaaaagataataggtaaattcaaagaaaagtctttggagtagaagacgaagattgcagataaaatcttagagaataatgcctacctttaggatggaggttgaaaagaacttgccaagaaagagttacaaaagaaaaggaggataaccaaaatctgtgctttatctcaggagccaagagaagaaagcatttttagaatactagggagtaaaacaacaccatcagtgtccacagagaaattgagaagaataagctgctatcaggcctttaagtttggtggtgacatagttatggagatatttcatagaagaggttgaggagactgggaaaggtagattggaagggctcacttaatagaagcagtagtggaggaagcagaagcaatggaccgtccaatacgaatagtcatgaaggtaaggaaagagctttactgtttcttcttcccatttaactgatagctcagtagataaaaaaggagaacaagataaacttatttgttgaaaaattactagaagtttgttatattgtttaaattgatttcaacttcagactgtttaataataagtacatagtttaaccaccataggaatgaatttgagttctttgctctgtataactttaataacagacagatgttagtctttcagcaaagaaacaaaggttgttccctaaattactttagatttacaatgcaatagagcattttaattacattcatatgtgcagacttttaaaaaataatttttaaatggtttattatggtaatagaagcacatttatgccacatcatgcaacacggaaagcatattctctctgttgagtggtgtaaaatgtttgtggcttttgcatctcacatttcttgctttagaagtgctactgtcatttacattctctagtaatccaattgtgaattttatggatatatatgagcatgtgaggacagggtgccagtggaaagctaagaaaaggagaaaggtaaataacagccagagaagttggcaagattactttttcttcaccgtgccaagacagctattttagctgaaaatgaggaggatgggaggtgcacaggaatttagttagatatagaaagagaaaagctgggcaaataattcaggtatgtaagcaagttcaagagatgaatgaagacattattctgatgtctgaagagcggaggttaaaggaaaggttgactaaccaaaaagccttatgtgaacccagggtaatcaataactgcgcttgattagaggtcttgtagcagtggtatatagaagaacagaagaaagatgtggcccccaaggtcgtatttaccagagagaacagtctgagaaacaagccacaaaagaattggtctatgaagcttttctcagaatcagtcgtccccccccctccctccctcccaccctccctcttcccttgctaagtaatggctggacactacagaagtactgtatattcctgggtttatcttaggatatggatagtgaattacaaatgatattttaacccatctattgccattgatatgtaaaaccattttctttattaaaaattgccaatccctatgtccaatattataaaattaatgtctctactaaatgaagaaaaaggttaaaaaataagaagcaatttttaaaaaatccctctttttgcctagccaaaaagaaaaagaaaacaaaaagtgagtaggatttattgtgagaaaatgtaacctttaaagctggcatgctgtttgagttacctgcctctgaagggcaaggccctagagagatgcttaactaggcaggtatgatgattgcagtgcccttagggcaagagcaaaggcagagattgtcaacacataggcaataaaggctgcctactcaaactctgggcactcttacttggcttgttaagttgtatcctacgtgcatgagtgttttggctcaggagaaaaactctagtgctattagaaaatgtctctttcacatagacagtatcaaaacggctttattagtcttaaataatgaaaaagtagcagaaacagatttagaatttaatctcttggtttctaggtttctcgtcacttgcttcaccactgatgatctgctctgtttttcaaccaaattctttgtgaattcatggcattggtagccccattctttgtgtttgtacaatgcactagtctccagagtgtgcattccttgaatgatagaggtttttagttatagtggcatgggccatcactagggtagatgaacagatttgtgattctaggatattacgccagtccagattgggaaaagttttcaaaggtttaaaggtttttctgcgggctgcctttgtttcagcagagtggagagaatttaaaaacatgtacccttaataggaccaatagagtttaaactatatattgtgtaacttttagaaacttttcaaagtacatatcttagcaacttcagaaggatgacataagggtcagcctcactggggatgctgtcccatgttgctccttagttagcaagacattgtaaatcggccaggcatggtggctcacgcctgtaatcccggcactttgggaggctgaggtgggtggatcacgagttcaggagttcaagaccagcctggccaacatggtgaaaccccatctctactgaaaatacaaaaattagccaggtatggtgtcaggcgcctgtaatccctgctgaggcagagaatttcttgaacccgggaggcggaggttgcagtgagctgagatcatgccactgtactctagcctgggtgacagagtgagactccatttcaaaaaaaaaaaaaaaaaaaaattcataggtactggactctagaaggtgaatcactgccagtccttcccccagttcattatctgaagtcacaaggcaaagttctttctcctaatcccataaagtcctcgtcctttccccacctaattctgtgtgcagtagccccctctttcaaatgctaagtggacctgactctcatacagagaaataaaaacgggctgggcgcagtggttcacgcctgtaatcccagcactttgagaggcccaggcaggcggatcacctgaggtcaggagttcaagaccattctgaccaacctggtgaaaccctgtcgttactaaaaatacaaaattagctgggcttggtggctcatgactgtaatcccagctacttgggaggctgaggcaggagaatcgcttgaacctgggaggcagaggttgccgtgagccaagatcatgccattgcactccagcctgggcaacaagagggaaactctctcaaaaaaaaaaagaaaaaaaaaagaaaaatgtattgcttcttggccttttggctaagatcaagtgtagaaataaaaaattacacatttgttggatttgttccttcagagttcttccttttaaaatctctagtgggatagatactgagaaagcattttgtatcttccctgggaagcaggcttaaggagagtagtctcactcttctctcagctctaggaaagtaggtgtaggctgcaggctgctcaaagtatatctatatttctattaatatttgtattagcatgatatgttaattaccttgctaagtttggaaaataacccttaaaaacctacaatgcattcattagcattctgtttatatgatccaaagtataacacaaacaagatactttttatactttagttcgcttaatttttgatttccataatatcgtcagtttatacttaaatcttagggagacaaggtagaagaaagaaaagtgactggatagcagcatgagctttgctgccctccaaataagtgctgaaaagatgagtatgagtctactctaatcatctcaaaaggaagcagtgaaaaactgaacattagcatgttcatgaacctaatagtaaaatggccacactgaaacaagaatttatcccagacaagactctttgccttaccacaatgaaaaataagtacttttgctgagtgcagtggctcacacctgtaatcccagcactttgggaggccaaggtgggcagatcacgaggtcaggagtttgagactagcctggccaacatagtgaaaccccttctctactaaaaatacaaaaattacctgggcatggtggctcgcacctgtaggtgctcgcagctacttgggaggctgaggcaggagaatcacttgaacccgtgaggcagaggttttggtgagccaagattgtgccactgcactccagcctgggcaagagagtgagactccgtctcaaaaaaaaaaaaaaaaaaaaagaaaagaaaagaaaagtactttttcaaaagtagaagttctctttatctctacccctaatgcccagtaatacccttaacactaatacctgctttttaaatccgtgcatatacctattttgtaaagcaagagagtatctaaataggagttgagccatagaatgtaagagctagatgcgcccttagattccatttgctaaaacactgttctgtgaaccagtgttaacctgtgaagttttcatcagcctgtaaatgataatttaaaacacacagaaatttaagctcaatgtattcagtataaagaactactcctttattctgagattatttcttttacatattttttcatgataaaatatcctacttttatgagatgacggtgatgatagatggtaggaattttcctcttaaaataatagcctaatttggcagtataaaaagtgcctcccgattttttgcagtttctgaaaccctaacacctgagaacaactggtctagtttgatctccttatttcatatttgagaaaagtaaggcctaggagaagttaagagagttacttaagactcactactaagaaatcatggaattaaaactagaacctacacattcatattcctagtccacagctctgaataaagcaacaaattccctctctttttcctaaataatacattatttctttctttttctttttcttttcttttttttttttttttttgagacagggtctctctctgtcgcccaggctggagtgcagtggtgccatcttggcccactgcagcctcgacctcctgggctcaagcgattctcccacctcagcctccttagtagctgggaccacaggtgctcgccaccatgcctggctaattttttgcattttttgtagagattgggtttcaccatgttggccaggctggcctcaaactcctgagctcaagcaatcctcccgcctcagtctcccagtatattgggattacaggcataagccaccgtgcccagcccacatttctattcttaaattaacttgaactttgtcaattttatttttcttcttttaccagatttatacttcctatattttgatgtgccagtacttcattgggttaccttcattatgcagttaatttagtttctcaagcacattttaattattgatttctcttattttattaaagtgaattaaaggtacatttgtcttgccaaaaatttaaggccttttattgtccttgtactaagactaagttatctcccagttggtatcatttaataaagacattgattgcattctacttggttgcattctactggtgctggaaaagcgatttcattttctggtgaagtttatgctgacaagttgaatggaaaatatacttgtataatacttttaattacatgttatatgcatttatttattttgctctttagcaggattttagcatcctcacaaaatattatatgactcaaggaactacctactcactttgctttctctgctggaagtaggcaatcaagccaattggaaaatttaaatccgtggattatgggttctaatttctggcctataaataagttagttttgtcataatattatatatttgtataatactttatataataaacacttctttatttctttttggtattcagtgtatcttttacatacattgtcaggctttgttttttctgaaaacactgtgaggacatatttgctcactctcattttgtggatgacagactgaagctcagatgccttaagtaatgtgcccaaaacagcagaactagctaataagtcgcagagtcagatttagaacctcaggtcatatgactacaagtcttgcatttgctccatatctctgctctacggtaatgtttctctttgcatattagtattaaaaatggcttctcccttccctaccagataatggtatgattcttagtaaaacatcccatttccattttaatatcctagaaatttttttttttttttttgacggagtcttgctctgttgcccaggctggagtgcagtggcgtgatcttggctcactgcacgctccgcctcccgggttcaagccattctcctgcctcagcctcccgagtagctgggactacaggcacccgccaccaagcccggctaatttctttttgtatttttagtagagacggggtttcactgtgttagccaggatggtctcgatctcccgacctcgtgatccgcccaccttggcctcccaaagtgctgggattacaggcgtgaaccactgcacccggcccctagaaatattttcaaattgttgaatttgttttagtgatttcacctgtccagataacctaccttaaacatcatgatgagaggggaggggagaaaataaatagtattgttatagagtttaagctagaattaagtataaaatcataaacaattaaatgtgattaaatgaaccattttatagcttaacagtatacaggcacatattatttatgtcagcaagagaaagagcccacattattaggaaagcctattttttagatcattcaaaattgtttcctaaactgtataactaccttcctcaaggatggatttacttaatcaacagttctgtaataattggttaaaccatttggttggggagtatggtcccaaccttaccatattctaaaataaattttgtaatgattaaaaaagcaaaagctaataaaatgaatcaataaaggacaacaaaacctaggtggctattgtttagtcttaggatagggctgggcttactgagcatgaaagtttaggagaaaacctcatgtaaattttgatagatatgtgtcacttgatcaattccgtaatttaaaaaaagttataaacaaaattaaaaagtaaatgatatcttctaggagatagctgaaatatatataacatcaaaatatattgtataatcatacatttggggcatcataatgaatttttaattaaatattaaagtgtaacttcagcattgtcccttgaagtataattggaaattgccattgactagtctcactggtaaaatgagaaatgattaaaagtggatagattaggccaggcgcagtggctcatgcctgtaatcccagcactttgggaggctgaagcgggtagatcacttgaggtcaggagttcaagaccagcctggccaacatggtgaaaccccgtctctactaaaaatacaaaaattagctgggcatggtagtgcacacctgtaatctcagctactcaggaggctgagacaggagaatcgcttgaacctggggggtggaggttgcagtgagctgagatctcgccactgcactccagcctgggcgatagagcaagactccgtctcaaaaaaaaaaaaaaaaaaagtggatagattgctaataaatggaaagtaatacaaaaagtctaagcccgcactggcctaccatgttacaaatttttaatgttgaaatattctgttcgacatattaaaaaaataaaagggaagcaaataacattatgttgttaaaaaaaaaaaaagaagagtaagcatccatggggcagtagtaaacgtgattgttcatagagcagaaaagcttatcagtagctgggtagttaacttagaagcaaataaataaaaatgtgtgtgtaaagagaacacaagttaattatttgacatgatgccattgtttttcaaaataaaagcattctttgcaagatttaattgcaataaatgactaaaatcataactgtattttcaaatatgagaaaaatatgaaagaatatgacaatgatatcttcagaagctactaattattggaaacacatggggacaattacacaggctagcaaagctcggtagcttatcactggatccagaactcagaatcagagttgtagtgatacacatacacacacacatacatacacacacacacacacacacacacatgcacatacgtgtgtatagttttgttgtattgcagtatatagagaaagaacaataaaaagggatttttggtattatatcttacctttgctcattcagttccatgttactgccttcttatctgctctgaagccaagcaggatataacagaagattgtaggcattaggacatcatcagatgctaacagaaatttgttgatagaaaatatggttctagtggtataaaatccacaaaactaataacgggatttgtcatcaaatgttagtaaacacagaaatggtagagataccaggaaagaaataacatgaaatgcttcaattatgagctagtactggaagtttgttaaagaaaaaaagggaaaatgttcactctgacctttaccaacaatttctttctagattgaaatataggaaatgagccaggtatcactgtatagttattttaaacgcaatttctatattgagagtgtatatttgcagctggtacatatctgattttcgtttggaaaatgtaaatgaaaaagggtttttatttcttttttttcggttttttttttttttgagatggagttttgcttttgttgcccaggctggagtgcagtggtgtgattttggctcactgcaacctccgcctgccgggttcaagcgattttcctgcctcagcctcccaaatagctgagattacagacatgtgccaccacgcctgactaattttgtatttttagtggaaatggggtttcaccatgttggtcagactggtcttgaattcctgacctcaagtgatccacccgcctcagcctcccaaaatgctgggattacaggtgttaggaagttttgaggaaatacataaaaaacaataatgtgtaactggtaaaagaaaattaaatgaaaggtaaatacaagtgaaggccagttcttgttctgccattgcctggctgctgtactcactatactcatatactatctctattccctctcatgtgccaaaagaaaaatggtaacttaattcataaatttatagtgaggactaattgtgttccccatgagatgtgttctgagtcacatggaaggttatctgtacattcatgtacataagtatatacacatatagacacaaatcataaacagaacttcctaatactaaagaaattatgtgcttacattttctatatatgcctcattttaagaatagtgcaaattcgaatatcttaggaccataagaaggagaaacactgtgtgattcttcatctcatataaggtagagtgtaagttattcttataaacttccttcagacatctaacaatcgatcacatatgtaagaaatttagttagcctattttactggaagataattctatagtagttcctgagctatatctgcattttaaagtatatttactgtgccttgcttactatagatgacatttgtttcagttctcttgtttaccaggggcatggtagggtgatatttatatatttgatttgcagaattagtagcttcagcttaacaaatggctgctcttcagccttttcccaaggttaagtttgaagtgttcaggtcattttatgattttccttgaccacaaccacgttggctgtcaagggctaagattttactaatttgaccaggttgttctttaaaaaccagttattttaattcttttctctatttccccagccttgtgtatttccagttgagtaaaaataaatagaaaatgctattcagtattctaaagcaagccagttatgtttgcatcacttagacagctttataggactcagaaagagagactgtcagattcatgagagtcagctgaaaactatttgtttctttcaaaagacaaggggaatgaatgattctggtgcatgtctcatgaatgttgagaagctcatcttatggttaaaaagaaaaactcattagacgactctagagagatatataagaaacctaaggattctgttttatttacctaaaacgttcctggtcaaatcagtgaggtatactaacaacaacaacaaaatacacacacacacacacacacacacacacacacacacacatatgtgtatatacatatatatatacacgcatatgtgtgtatatatatattaatataaggaccatcagattttaatataccctttaagctaaacttgtccattgttacacgtggtcacagaagtttttctatgaaaacttacgaagtggatgaaactaggacttatttaatttgaatatgcatattatacatatataggcacaaatgtattttaatttgtacttaatgtatttgcaattataataaataaaagttcattcctatgtaaaatattatgaatttacagaattaccaacaatgccttaagtatattatttcttctgatcttttattccattaaaattataacatctttaagctaatgatccatgccagctactgcattttttatcagttagcacagtgctgactatagacaagtaagtacctgatgggtttaatcacatatattgaacttcaactacatagtttaagtagtgtggtcttctgttatcgtaaagtcacagtgattttccagcacattcatttgatattttcatccctgtcagctcacaaatcccctcatactttgacagcattatactttgttaagaaaggaaagcaggagatatcctttatatttcaaatatattaggttgacatgtgagccatggccaaacttgattaaaggtgaggggaagtgaatgtagaaagaagaattcacaagcagagaagtaagtgctttgggagggtggggtcagggcaggcagtggatgggaggaaaagcacctagccataagctaaggcatgtttcagaggaaggcagtgctgagtttttctcttaccctattttttataatctccccttataatagttagccaccctcaatctaagtaatcttcccataaggtggtttttttgaggattatattaacatatgtatatgtgtgtgtgtgtgtgtacgtgtgtgtatctgaacataaaaactgataatacatttcttataaaataacttgctttatcatgttgtatagcttaaattgcttttattccatatatgtgtatggaatatgtgtatacatgcatatgtacatgtacacatgtatatgtatatgtgtgtatctgtatctttttattaatatttgccaatggcataattctacactccagtctctcaagcaagcatttatgtaaagcttgatccagggatatttctttctttacatcatgttccttgcttctttgttgaagcaatttctatttttccttcttttctgatctcccgcaatgttctagttcttgtgaaatattagttttctcagcactgaagttgaaaactttccatataccaactgctgttttcagttctgatttcaaccagggcttggtggaggagtagggtagggaaacttcctgaaaccttgttgatattaatagcaacttaatcctttggcttctactcagatttcgatggactgtacattcatgctcttatctttgaatcatctgacactttttcagccatgaagaaatcagaatatttggtctgttgtatttcctttctaagtactttttaaaggttacctacttttaaaagagctagaccaagtatagtaaaagtatacaccttttcattttggggatggaggagccaagatggccaaatagaaacagctccagtctgcagctcccaacgagacaaatgcagaagggaggtacctagttgatctcattgggactgattagacagtgggtgcaacccaaagagagtgagcacaagcaggatggggcgtcgcttctcccaggaaggccaaggagccagggacctccctcccccagccaagggaagcagtgaggggctgtgctacccgccccagatactacgcttttcccacgaatttttgcaatctgcagatcaggagattccctcgtatgcctgcactaccagggccctgggtctcaagcacaaaactgggcagctgtttgggcaggcacccagctagctgcgggagttgtttttgtaccccggcggtgcctggaacaccagcgaaacaggagaaccatctactcccctggaaatgtggctgaagccagggagccaagtggtctcgctcagcaggtcccattcccacggagctcagcaagctaagaaccatctggagtcgagctgggatgatcaagcttggtgatagggagggtcatccgccattactgaggttttagtaggtggttttcccctgacagtgctgagactgacaggtttggactgggcggaattcatcacagcgtggcaaagcggctgtggccagaatgcttctctagattcctactcaggggcggggcctctctgaaggaaatgccacagccccagtcaggggcttacagataaaactctcatcttcctgggacagagcacctgtggggaggggcagctgcaggcgcagcttcagtggacttaatctttcctgcctgccggcttcgaaggcagcagctgatcctgataagggggattcttccagcacagcgcaccagctctggtaaggctcagtctgcctcctcaggtgggtccatgacccccatgcctcctgactgggagagacctcccaacagggcttgacaaatatctcatacaggagagctccagctggcatcaggccggtgcccctctgggatgaaaattccagaggaaggagcagataacagtctttgctgttctgcagcctccactggtgatacccaggtgaacagggtctggagtggatctccagcaaactccagcagaactgcagaagagaggcctgttagaagaaaaactaacagaaagcaacaacagcatcaacaagaaagaccccccccccaaaaaaaaccccatccaaaggtcatcagcctcaaagatcaaaggtagataaatccatgaagatgaggaaaaaccagcgcaaaaactctgaaaattccaaacaccagaatgcctcttctcctccaaatgaacgcaacacctctccagccagggcacaaaactggacggaggatgagactgacgaattgacagaagtagactgcagaaggtgggcaataacaaacttctctgagctaaaggatcatgttctaacccaatgcaaggaagctaagaaccttgataaaaggttagaggaactgctaactagaataaccagtttagagatggacataaatgacctgatggagctgaaaaacacagcacaaaatctttatgaagcatacacaaggatcaatagctgaatcgatcaagcagaagaaaggatatcagagattgaagaccaccttgctgaaattaggtgtgcagacaagattggagaacatagaatgaaaaggaatgaacaaaccctccaagaaatgtggcattatgtgaaaagaccaactatgattgtttggtatacctgaaagtgatggggagaatggaaccaagttggaaaacacacttcaggatattatccaggagaacgtccccaacctagcaagacaggccaacattcaaattcaggaaatacagagaacaccactaagatactccatgagaaggtcaaccccaagacaaataatcatcagattctccaaggttgaaatgaaagaaaaactgttaagggcagccagagagaaaggttaggtcacctacaaagggaagcccatcagactaacagcagatctctctacaggaaccctacaagccagaaaagagtgggagccaatattcaacattcttaaagaattttcatcccagaatttcatatccagccaaactaagcttcataagcgaagtggaaataaaatcctttccagacaagcaaatgctgaggcattttgtcaccatcaggcctgcttttcaagagctcctgaaggaagcactaaatatagaaagggaaaactggtaccagccactacaaaaacgtaccaaaatataaagaccaatgacactatgaagaaactgcatcaactaatgtgcaaaataaccagctagcatcatgatgacaggatcaaattcacacaaaacagtattaaccttaaatgtaaatgggctaaatgccgcaattaaaagacacagacgggcaaattggataaagagtgaagacacatcagtgtgctgtattcaggagacccatctcacatgcaaagacacacataggctcaaaataaagggatggaggagtatttaccaagtaaatggaaagcaaaaaaataaaaaataaaaaataaatagcagggattgcaatcctagtctctgataaaacagacttttaaaccaacaaaggttaaaaaaggtaaaggagggtactacctaatggtatagagatcaatgcaacaagaagagctaactgtcctaaatacatatgcactcaatacaggagcaaccggactcatcaaacaagttctcagagacctataaagaaacttagactcacacacaatgatagtgggagactttaacaccccactgtcaatgtttgacagattaacaagacagaaaattaacaaggatattcaggactcaaactcagctctggatcaagtggacctaatagacatctacagaactcttgacaccaaatcaacagaatatacattcttctcagcacttattctaaaatggaccacataattggaagtaaaacactcctcagcaaatgcaaaacaatggaaatcataacaagtctctcagaccacagtgcaatcaaattagaactcaggattaagaaactcactcaaagtcacacgactacgtggaaatcgtacaacctcctcctgaatgacccctgggtatataacaaaatgaaggcagaaatcaagaagttctttgaaaccaatgagaacaaggagacagtgtaccagaatctctgggacacagctaaagcagtgttaatagggaactttatagcactaagtgcccacatcagaaagatgggaagatcccaaatcaaaaccctaacatcacaattaaaagaactagagaagcaagagcaaacaaattgaaaagctagcagaagacaagaaataactaagatgagagcagaaatgaaggagatagagacacgaaaaacccttcaaaaaaatcaatgaatccaggagctgattttttgaaaagattaacaaaatagatggactgctagccagactaataaagaagaaaagagagaagaatcaaatagacacaataaaaaaagataaaggcgatatcaccactggtcccacagaaatacaaactaccatcagagaatactgtaaacacctctacacaaataaactagaaaatctagaagaaatagataagttcctggacacatacaccctcccaagactaaaccaggaagaagtcgaatccctgaatagaccaataccaagttctgaaattgaggcagtaattaatagcataccaaccaaaaaagccccaaaccagatggattcacagctgaattctaccagaggtacaaagaggagccggtaccattccttctgaaactattccagacaactgaaaaagagggactcctccctaactcatattatgaggccagcacgatcctgataccaaaatgtggcagagacacaacaaaaaaaaggaaacttcaggccaatatccctaatgaacatcaatgcagaaatcctcaataacatattggtaaactgaatccagcagcacatgaaaaagcttatctaccacgatcaagttggcttcatccctgggatgcaaggctggttcaatatatgcaaatcaataaacataatccatcacaaaaatagaaccaatgacaaaagccacatgatcatctcaatagatgcagaaaaggccttcaataaaattcaacgtcatttcatgttaaaaactctcaataaactaggcattgattgaacatatcacaaaatagtaagagctaattatgacaaacccatagccaatatcatactgaatgggcaatagctggaagcattctttttgaaaacctgcacaagacaaggatggcctctctcaccactcctattcgacatagtattggaagttctggccagggcaatcaggcaggagaaagaaataaagggtattcacataggaagagaggaagtcaaattgtctttgtttgcagatgacatgattctatttagaaaaccccatcgtctcagccccaaaactccttaagctgataaacaacttcagcaaagtctcaggatacaaaatcaatgtgcaaaaatcacaagcatttctatacagcaataatagacacacagagagccaaatcatgaatgaactcatattcacaattgctacaaagataataaaatacccaggaatacaacttacaaggaatgtgaaagacgtcttcaaggagaactacaaaccactgctcaaggaaatgagagaagacacaaacaaatgggaaaacagcccatgctcatggataggaagaatcaatattgtcaaaatggccatactgcccaaagtaatgtatggattcagtgctattcccatcaagctaccattgactttcttcacagagttggaaaaaaactactttaaatttcatatggaaccaaaaaagatcctgtatagccaagacaatcctgagcaaaaagaacaaagctggaggcatcacactacctgactttaaactatactacaaggctgtagtaaccaaaacagcatggtacttgtaccaaaacagacatatagaccaatggagcagaacagagacctcacagtgtaaccccacacatctaaaaccatctgatcttcaacaaaactgacaaaaaaaaagcaatggggaaatgattccctatttaataaatgatgcttggaaaactggctagccatatgcagaaaacagaaactggaccccttccttacaccttatacaaaaattaactcaagatgtattaaagacttaaatgtaaatcccaaaaccataaaaactgtagaagaaaacctaagcaataccattcaggacataggcatgggcaaagacttcctgactaaactgccaaaagcgatggcaacaaaagccaaaattgacaaatgggatctaattaaacaaagagcttctgcacagcaaaagaaactagcatcagagtgaataggcaacctacagaatggaagaatatttttgcattctacccatctgacaaaggtctaatatccagaatctacaaggaacttaagcatatttacaagaaaaaaaaaatcaaaaagtaggcaaaggatatgaacagacctttctcaaaagaaatgtggccaacagatacatgaaataaagctcatcataactggtcattagagaaatgcaaaaccacaatgagataccatctcatgccagtcagaatgatgattatttaaaagtcagcaaacaatagatgctggtgaggctgtggagaaataggaattattttacactattggtgggagtgtaaattagttcaaccattgtggaagacagtgtggcgattcctcaaggatccagaaccagaaataccatttgacccagcaatctcattactgggtatacacccaaaggattataaatcattctattataaagacacatgcacaggtatgtttattgcagcactatttacaatagcaaagacctggaaccaacccaaatgcccatcaatgatagaatggataaagaaaatgtgacacatttccaccacagaatactatacagccataaaaaagaatgagatcatgtcctttgcagggacatgaatgaagctgtaagccatcattctcagcaaactaacacaggaacagaaaaccaaacaccacatgttctcactcataagtgagagttgaacaatgagaacacatggatacagggaggggaccaacacacactaggacctgtcatggggtcggagtcaaggggagggagagcattaggacaaatacctaatgcatgcagggcataaaacctagatgatgggttgatgagtgcagcaaaccaccatggcacatgtatacctatgtgacaaacctgcacattctgcacatgtatcctggaacttaaagtaaaaacaaaaataaaaaaaattaaaaatgaaagtatacacctttttatcagcattctttaactctgtctcttccaagctacttctaaaaatgacatgttgtaaaaagaccaatttatttaaatattggaatgattgtgaatatagttatcatgaggtcctaaaatgctgtttcattttgattgtggaggttagtagggaaaatggatacttatgtcataggatcttttacgttgaaagacttggatcatacatgaaaacatatatagaggcatacataatgcatataatcagatgatcaatttataatatccttatatcttagccatatctattgtaatgctgaatgataattaaacattcatttagcatttgacacatcttacgctctgctgaggttatgctaaaagaaattttttttaaattgatgaagatagtatgtttgacagaaaaaaatcaatatgagtgtacctatcaaggggcaggcaatgcttttaaaatgctgtgggtcaggaacactcaggcgtatatacttgtgacatattaaaagcatcctttccagtaataatatcgtttggcagaattattttaatggcctgtgatcctgattctataattctattaccaattaccttgactctgctttcaaaagatgctttaagttttagattctggtattctgatctcagtatctcgtagtgacctcctgttatctactcacttgctactgccagtgtcatggaccatgaattgaacctactgttatcttatggaattttggcactctttctaatcaatcctttgtcatgctaacagtatctttattgttgtttttggctaaattaatagctaaactaggtatttgcatgttttgtctaatcgcttatgaagaaagtactttaccaatattgtgaaaaatgttaccagtcgtatagctttaatgccatgtaacaatgtttacagcgttcaattgaagcactttaatattttaaacccaagttagattgaaagtactcattcagcaagcattttagggattttatggacatcttttaagatcgtctgtgggacgtttgtaacaacagtaatcgcaagaatggcgatgatgatgatgatgatggcagctcacatttattaagctcatagtatatgtcagactctattctaaggactttatatgaattaattcatttaatctttaccagaaccttatgaggtaagaaccatccaattttagagatgtaaatactgaggtactaagcagttaagtgacacgcccaaagttagaaaactaggaagtgtcagagccaaaattggacccccactttttttcatgcctctgattgagatagtaagattttgtcttaccttctgcccagtatttgattaataaaccttatggagcttcacaaaagtaatattttcattaagtgttgcttgtcagtcatgatccatatatgcagaggactaaagagtgtgcaatgatgattgatttttgtactgaaattctttcttttattttgtcaaatgaagaaatttgtcacaagagtgaaccggggccaggtgcagcagctcgcgcctataatcccagcactttggaatgccatggtgggtggatcacgaggtcaggagttcgagaccagcctggccaacatggtgaaaccctgtctctactaaaaatagaaaaatttcccaggcatggtggagcacatctcaggaggctgaggcaagagagtcacttgaacctgggaggcagaggttgcagtgagctgagatcatgccattgcactccagcttcagtgacatagtgagactctgtctcccccctgcaagaaagaaaagtgaatcagcatggaaatgaaaacgttctagtgtcttttcttgtaattattttttatatccatccatccatctggaattcactgtgtgtccaatactgtaataagtgataagaatataatagtaaacaagacatggtccctttttcaaaaaacataattgaactcaggaagagaatagaaacccatttatccttgttgattatatattcacctacctgaaggcagattaactctgaaggagtcaaccagttctgcaatttagattgtaagaataaattttgcttcaaaatagaatttaatttgcttaatttgtttcagtctgttttcagattaacttggatctaattaatgcattagctactattagataaggagtgcttttctgtgttcgctacttttgccaaaagggaatgactgacaaaatcctatataaatttaaggtagaaaatagtctattttctgtggcaatatatatttagaaaggaatgtatagactttctgggtgttttgagataataaaatattctaacaaatgttcttacaaaaaatatcttttgagtaggatgctcattctgttggcccagaattaagtggactattatgtaagcctttgcattatttcaatttttatcacttattttttaaacaacattaaggcaacaaaaggatgtttctgatatccctctcccagtaatgtaaggcagcggtgaggggtttttttttggtcattattttaaggttcttttccccagtctttatcaataggtaatgtttataggtcttcatttgcatttattacccttaactttttaaagtatgatactctttctatgttgctacccttactacataatcatttctaattattatgtaatcctgactcaaattgatgtaccaaaatcatcaatcagtcttctatagagcacagagacctcaaacctttcattattaaacataacttaacattttctgtcttcatgtatctttttatctcctccctttgattatttccttttagatgtaccaagatctgtaaacatttttctactcttcaattttctagaaaaattgttttccaggaagattgtatcaatgtatacaatcatcaggaataaataagcatatgagtttcatcacagcctcaaaaacagtagttttatgtattttatgttactttgacttccaaagagggatagcaagaactgctcataaaaacaagcaaatgcccaaattcaataaaatataaaagtaaaaatgagacattttaaaaaattgtgccaatacatataaagtggtaagctttttgttataacttaaattcctatgactctgaatgaaaaatattttccttttttaattaactttgtcacttcatttgtgaatcgacttcatatgtccttcgtctattgattaagatcaaattttaaccctttatgtagcttgaattctttatataacaaatatttgttgcaaatgttttcctattctgtttattttaattacagttaattataattatcaagaattataactatgacttgatatgtttgtatgttgaaatagtaaggtacttattctcacttaatttttaagtgaactaattgttttggaatcatatatattaattgagtctatcggaactgatactctatactaactgcattttattgttaggaccatttataatcctcttcttaatgattttaacggaaatcacttcttttttttatatttataagcatttagtatattaatctgaatgatgaatacaaattctttattattctgtataccttttgcacatctgaaacatagtattataaaataaaaccttagctttcaaagtcattgtctctgttaagggcttgacaatccaaatttggaggtcaacaaataagcattgacttttcactcttctttgtaattatactataataatctcaatttatgtcaaggaagtgtggatgactctaacttttggaaaaacaaattaccaggtagtataaagtgtgcaaaagaaaaacagattaatgtttcaagatattatttgacctcttttacacatcccttactactgttgacacacttgactttgatatatttcttaaatctttctttcagaagtaatcaagttatttaagaggaaacctttcgatgatagtgtttgttatctctgtgttcatctatttatcaggaaatcacttcttaattagtatagcttttagtatatcttttggacatgtcacctttattttcatttctgttataggaaaatgtcttgagttaagtacatacccgaagctagaaatgtctccatttaaaaaatgtattctctattttgttttatccagcattgtattttccctggctttgttcattctgctgtttcacaaacactgtgtgtttttatgtggttataacaatgatgagacattgacttatggaattaacatagacacatggaaaatattttatggtactgacataaaaagaaaccagttctgggccatgattgagaccgggagctactgaggttcaacagtttctattccacagagtgccattttgtcccaaatgattgatgacattctcttgccctattctccacagattataagaacactgttgcaatctagagcttctgtagatacccgcttcattaagcatgatcccaaaatgtcatttaatttatttcttagattgaatgtctcattaaactttgatgaggccaggagctactttgggctggacttgttatgaagcactcttatcttaaaattttgttctgtccctgttggcaaaggaaatggacatgacagtgaaatcaatgcacagtgcactttatctttgacaaactgaaatattgttttgctaaaataggcccatggggtagggagattaaaatcacacataaagtagatcagcataaagagtaaatatacaaacttatacagtctttggtgtaattttattttgtttaaactgactttgccccatttggacaaacataacacatctacttgattaaacaaggtactgatctccctcagcctcatttgaaaagaaacattttcttctttttagttataagaagtgaatatatataagatgaagtcagggcatgagtaatgttctatcagtttttagtaagaggtatgtctcaatagttgtgttactcaccttgtggaataggttgtgtcaaaacaagaaaaaaaaaactaatagtatttgtattttccctttggtgtccattgtagaatcaggagcatagtcatagattggtataggcgggaggtggagaaaagcaggtgattccttcagtagaccaaagtgaaaacaacattccttgcaaaaaaggaatttagacattggccagccctaggtcatgctgggcattggagtataattttttgatgcttccttaggtttggaatcaccatcttgcaactgatttttctctcatggctcctgcatcctgccatgttgccacactgcacacttagaacatgagttccacccctgtgtatgcttcccttgattccacaccagaatttgccagctcttctttgatctttcctgagtctttatacagcatattaaagagctgctctgcagtctaactctgaaaatcagtagtgtcatctagcatattttatactgttgcctaagatgtcttgggttcgaaggttctcactttgttaactgccagtttgctacctaatcaaatttgcaactttgaagattgcccttgtgtacagggttaatgtcagatttttagtattaaaaagaaacgactaagaaaatcacaaaacagatacctataataaaacaattgtcctaaaggattatcagcctacctccatgtctgataacagggcaagaaaagaaaatctgagaccatttcaatatgtattttgctaatatcttgagattccacctttccatggaatgataaattttagttctaaaatcatttagaattattaatgttatttgagacaatatggtatgctcttctttattgtgccttctattgaaaataaaatatcccttcagcatctaaaatgtcacttgaattaacactgtgcaatagcaataggagtagataaaactgtcagaaaatgactgggcaatgagacaattattgcagtttattttatcaatctttatttcagagcatgtaaaagtaagtaatgattttgagtctccattttgtgggttatttgagaaaaagatatgttagaacctttcggtttgtgtttttggtataatcataagctgcatgatttgcaatgcctgattttggttctaccttgtttaaatagcttagtttatattatattaattttaatgtagcctcaaccaagatcctattcttacctttctcactaaaaaactgtatagtattaaataatgtgaatcttagggttttttgttttttttttttttttttcaaattgtggttgctaaaagatacaagcagtgttgggtgagtcaggtcatccatgggatttagtcatagaaggacctgatttttatttcttcctctgcaagtaaccagttatgtgatattagacatgtttataacttcttgagacattagtctcctcccataaaataactgtaattgtcaaaattgttctatttagggtgttgctaaaattaaatgaggcaatctgcataaaaaccgtgctttttgcatactcaggagtatgtgatttatcacatttatgtagcttttaaaatttgtatgtaagaagtcattggttaaatagttgaagttttggatatttttatcattatacaatcattattatggtttaattttgtatatatgctttaaaggaatggatgatatgtgtagaaaatgcagtttcagtttgtggaacttagaattgtttttaaaatgtggaattcacatgaagatttgataatagatcaatgttctgttctctgtagaaattacatcattatagggaaaggaattgcacttgtttttgttgtttgagtatatgaactttaacaaggcaacctgagactaatttctaagatatgagatgaaaatgtgttaaaataatagacatatttcagactctgacttcagttgaaaacatagatcccatttttatttctccaaaccagaggaggaaagactgcttctttcctatttttttccctttctatgctattcatcatagcctcttaaaaatgcttctgttttcacttgttcccagattaagaaatgtgttttcattgaaatgttaaaatatgcagtgtgtcacattttgggttaatatcatcaagacaaacaactaagccagttctttatttcctgtcaaattgctgttagttaccaaagccaactaaatactattatatgtcatgttttagaattgtgctttgctttatcagatactaagatgcagcatactggtttgcatctcttagcaatgtttccaaaaccgtaactgtattaaatattagtaaagggctgaatgtacttaagcaatatacaaatgtactcttgatttactgtagagaataattttgttaaaatggttgtattttcatttttatagattcaatagataaacagttattaagcatctatatatcagacactttgagagtacagataattttgtgtagtacctgccattcagtatcctacacatagtaagggaaacagaaatctgaagaagtaaattaccatatagcatattcactcatattaatattaacctcagtgctatggagtacagtggacatagcaaccacctctgcctgttcaagtccaggaaatctttactgagcagctggttttaatcttgatctttgaggatgagtaggaaattgcccagtaaaaaagaaagtgtaagggcggggaattgcatgtgcagaaaattggagtaatgaaaggaccctaacatccatatactagggagtagctagttataggggcataaaatcaaatcgctgctacttgataacttgaagaccaatcttctgttctgacattccatagatcaaacttatataattgtctaatttgaaattgtacaattgtataatttgaaaacgacatgttttcagtgaaaagtaagaacaaaaactatttgttttatctgtgtgtgcatgtgtgtatagtgttaaaagttgtaatgtcaacaggtcatggtggcacgcacctctactcccacctactcaggaggctaaggcaggaagactgcctgcgcccaggagtttgaggccacagtgagctacaattgtgacactgtactctagcctggacaagagatctcatctctaaaaattaaagaaaaaaaaaaaagttgtaatgtcttcatatttaaaattttcttagaaatttcctttaaaaaaaaaatgggtcctggctgggcacggtggctcatgccctgtaatcccagcacttttggaggccgaagtgggtggatcacctgaggtcgggagttcaagaccaacctgaccaacatggagaaaccctgtctctactaaaaatacaaaattaggcgggcagggttgcgcatgcctgtaatcccagctactcaggaggctgaggcaggagaattgcttaaacccaggaagcggaggttggggtaagctgagatcgcaccattgtgctccagcctgggcaacaagagcaaaactccgtctcaaattaaaaaaaaaaaaaaaaaaaaaaaaatcctaaattttaaaatgacgattataaacttgagtattgattttctgttttccttgagttagacagagtttttttctgacaataataggtacagtttagataagaaatgcttaacttagtcaaattttagtaatttcagtaatgaaaatgatggagttggtttagtctcctataatcttgcttaagaaaaaaatcccctggtattcagtttatatatagcatgcaatctagatgaataggtttaggttttgtttggtttttaataacaacatgcataaaggaaatataatgatctcatcaaatctgtctccttctgagagacagtagcctactggtctgcctctcaggatccttctaatatagttttcttggatattaggtggttttgtttcattgaatctcagcagtttattgctttagaggctttttactgagttgggtcaacattccacattgaggagatttttctttctaatgcaagaattcaactgttattaacagtggtatgaatcattcatgtacactaagaaggaaataggttccagttgtttcaaaaactgttaatttctagttctaaccatcggtagctttgtgaagtgaatcatatcactgtctgtggaaaagagaaatgggaattaagttatttgctcaccatcagccatgtcattattgaagatgaaagctaaggagataaatcctccactcagttttctgtcatttatccaataggtcttcatatgcccctttagccatgagactgcaaggtggtgtgggaacctccgtactttatattaaagtctgttagagaaataatgggagtttggctacttgtttgtgccattaagacactgctaccctctgctgcctaagttaattacattccagtagtgggaaaaaaatgcatttgcctatatagacaccaatggaaataaacatatcgttcatacacttacagagaatgtacgtgtactgttgagagtgaggaaaaattgtagtttatagctgacatactttaaaatgctttgtttctaaagatgcaagtgcgaaattgatccaatatgttcagcagtcaaatattgagatcaaaattgctctatttcctttattcgtgtgtccgttaacaaccctttctgataatgtcagagacttattcaccggcctcaactgccgaaagaattttaaactaacagccgatgtatcagtctaaggactggtagatttacttgagaaatgttatgtatggtgtttcttagctataaaaaactatgtatcctgttatgtaaatacagatactattgaggcctttgaggcctcaattaatgaatcttctgtgggaaacatcttttaaaatgatggtgactgttgaagatatttcttatacaaaggagtgtcatatggattatacgtaaaattgttaactcatactacacattttcttcgtttttattcttcattatttttgagacagtgtctctgtctgttgcccaggctggagtacagtggtgtgatcacagctcactgtagcctcaacctcctggactcaagggatcctcccacctcaacctcctgagtagctaggaccagagatgtgcaccaccatgcctggctaatttttttttttttttgtagaaactgggtctccctatgttgcccaggctggtctcgagttcctgggctcaagtgatcttcccgccttggcctcccaaagtgttgagattacaggcatgagccacagcactgggccatattttctttaagaaagcagtatatttttgttaagagaagaagggggtatataggaaagaagaatcagcatgtaacatttgtatgatcctgacagaagaattacgtgatataggtaaaatatacccatccattaagccccttctcaaatgctggcccttcattggcaatactcctagtgggggcaacagtattttcttttgaaatgtcaaacacttttattgtaattctgctgtggcacttatcgattttccgccttgaactatttgtttgcttgccttgtctcaactactgtattagagtctaatttcaggaaggaggaatgtggagagatgtaggacagaaacttctgccatacctaacatagtatttctgtcacatagtaaacacttagtactatgtatggaattgaatttaataatattaattggtttagcatgaaaaaaattatgctatagtgtgagttaaagaagctaagaaggacagaaataaaatagaaggagaaatatatttgatgctggtcttccaagttgcaataaaaagagctgaaattatgcccatcaccattaccttccctgtgccactcttgtgtttatcagtacagagggtcaaggccacatttaaaactatgggactgttgcgtctcacttcaaattcatctggtttccttgggccgaatgggaaagattggtagtttaactcactgtcatacaaactccaacccctacttaattccgttggtcccctgctttggaagctcacctgctgcagtaagaaaggaaaaactgtgcctctgttccccagttttttgtagatacttaacctgccaccctcatgatcacattctaaagctgttctgctggcagtcctcatgttctgctctgaatctgccagcttcatcactcccattacactctcccatgtttcagaaagccactattctgtccatgccctgagggaaggagagtttttttcccatcattttattcttgtccccaaataatcaaatatttcctcacaatttcacataggtattcattcatacattttagaaatttaaaggccgggcgtgttggctcacgcctgtaatcccagaactttgggaggcagaggcaggcggatcacgaggtcaagagttcaagaccagcctgaccaatatagtgaaaccccgtctctaccaaaaatacaaaaattagctaggcatggtggcaagcgcctgtagtcccagctactcgggaggctgaggcagaagaatcgcttgaacccaggaagcagaggttgcagtgagccgagatcgtgccactgcattccagcctgggcaacagagcgatatgccatctcagaaagaaaaagaaagaaagtaacaacgcaaacttattttttgaaaaagaaatttagaatttcttaaaatttaaagccaagacatgctctaggaatacaaagaagagaactcctaatttctcctgtgaaaatttaggacatgcttttctttttttttttttgagacaagagtctcgctctgtcacccaggctggagtgcaatggagcaatctcgtctcactgcaacctccgcctcccaggttcaagctattctcctgcctcagcctcccaggtggctgggattacaggtgcctgccaccacacacagctaatatttgtatttttagtagagacagggtttcaccatgttgaccagactggtcccaaactcctgacctcaggtgatctgcctgcctcggcctcccaaagtgctgggattataggcatgagccaccgcgcccagccaggacatgcttttcatgtgagatgacatttgagctggttttggaaagtaacactataaaatgcacatgtaatgaacacatatgtaacaagttattggaatgatcttagttgttactgagaaatctcaattatatgcattttattcaactgatttttattaattttagcatcttgatctagtaggaaaaatcaaatactgcctgctaatacaagaaaaaaaaaatcaaaccaaatacagttgtccttttgtatccttggaggaactggttctataactgctggagataccaaaatttgcagatgctcaagtcctgatataaaatggcctaatatttgcatacaatctaagcatatcctcctgtatactttcgacatctgtaggttacttatgatacctaatgcaatgtaaatgccatgtaaatagttgttatattgagttttaaaaatgtgtattattttttattgttttgttatttttattgattttcaaaaatatttttgatctgcagttgtttgaatccatggatatggaacccatggatacagaggcctgaatgtagatattctaacagtaaattttcttatctgtgagatactataactcatacttaaaacaataagttatctgggcccttacaaatacagacctctggtagagagtctttagagaaattattaaaccttcatataatttgttgagtgtaccatgaatatgttttgtgtgtatgaaattagcagagtagcataggctacgttgtggatgaaaaatgttttatgtgcttagcacattcctctgaaagcaagtcatggagaaagaaatataattatttcaatagaaaaaatttaaaactctgctatattttaatattttagtgatttatatgatataagcatacatgcacttacgattttgcttttttatttcttttcacaagattgagaaaatggagcaacacttcactatttttcttatagggataatatgggcaaattaaatgtaaattgttgactctgaagtgaggggattatttttgttgctgtttcagggaaaacataaataaaagaaagtgaatagatgttatttcctactttagaaagtttgaaaagtaaagataaaaaaggaaaattgtacctatatccattaagttttataagtgctataatgttgccatttttttcagaaaatcatattttaaagccacatcttaattcttaggaattctcaggtaaaattataataaaattcattgaataaatatgattaaatacactagcttcacatgttcctttcttcaggactatcaataataaaatagatggaagtacagcgctgaagagaaactaccctggcaaaagtatatgcttacccatagttgtagctttattgttttcccaagatagacttttcatatttctgcaccttcatttttcatcttactcaccaattgcatatcttttatagatgtcagaatgattagatttagcgtctgcaaaatactcatcgttgagaattatagaccacttagaagattggcaaggacaagttaaaactgaaaataggcatctcaacaggcatgcaaaatcatagcagtgattcagtaaattctcagagatatttcccttttgtgataggaatggggggatagtttatattttgagattctttgcagaataaacactgggagcagaaaattacacctatatttattgccaagctgcatttgttatataatgcattttcctcctccctagatgtaccccaccttctgtcaaaatgttatttctttggctattctttgttgcatgtagttcagttcaggcctgactcctaggattctgcaggtttttttgtttgttttttttaacttcccacccagggaagtgaaagttctgttttaaaaattcctgaatgtgtataaatttcattctgacaagcccactttttcagtatgattttatcagtgcttacaagttttagaaaaaaaaaaaaaagaaaaagaaatctcagatgacctttaatgtcataactgaacttgggttttgaggagagcaaagagagcaacaatttgaagatgtaggtttactagtaaacacttctgttccaccatctgctcccccaccaccccatcgcagattacagtggaatgagataccagggtggggccagaggggccgtggtaaaatggggatgaggtgagagcagggaaggtgatgtgggagcagatggcagctggtgaaagaggcactccatggcactgttggcatggttacagagaagtagatgtcctaacatgctgtgccaattttggaatgtttcaaactctactttgtaacttgtggcctcaaactaaactcattggctgtgtagagcttctcctgtgacaagcagttcctataaaagcattagtttagttatattgtctaacggctgcttaaaatatattcgtgtgtgtttgtgcgtgtgttgtaattaatctatggaaatgtaaaaataaagtatttactgtccttggtctccaggtgaataataattactacatattaacaaccctgataataatatatatgtaataatgaaacagttttgctgtaccatctatttgtgtaacaggagcaaatattgttaaaaacagttcattggattttgttgttgttgttgttgctttacatcagtttataaaagtcatatgagcatttgcctgtctcatctttagatgaatttttgttttccattaaacaaaaaaaaaaccgaaatggcctaatttaagttgaactaggtcattgactaaagtcttatttttgtctaaaaatgcatccattgcaaatgttactgccatttctagtgtctacagtgtccttagaggatatgcatagtgagttgatttgaaaagtttttggccatatggcatggttgaagcaaaaacgtattgtgttaggtcaaaccatgtgtaattgctgatgccacacaatttttttaaatataaaatataaaatagcatttttttgtggttcaacctgatatatacatttttaaattccttattctgaatttgggtaaaaataaataataacttataaaacacgtgtatgtatatttggtcttgcagctaaataagattatatataattttccaaatcttcggagagtccagcttaattaaaaatactatttgcacaaatgttgcggtttgtctctgtagaagctctgagagcattcatttaatttattaacccaagtttctcttgctaatacatttactcagaagtaactctgctgtacataaaaatagttgattcaatagagaagtagctaaacaattttttgttgttgttgttaagtaaagggattaattcatgttagtcactggaatgtcttgcttaaaatttcctccaaaattttttgttcaagttttcattacacttttcccgcaatttaacaaaaatgattttgctccttctttttttttttcctgaaactgtttttagaatggaattaactgattctataaagtacacaaatgattggtattaaatgtctgtctctttagtccacaagtgtttagttttttgaacagagatgaaaattgaattgggctttgtaccaaagatttatatttagataaagttattccaatggtattcaaagtgttaattgtatttctacagcaaacttcatcgtattacaccaaagcaaataccatatttgagatgcatctctaccacatttagtcttgttccttcattttgtttatttcattatttgaagtataaagggagggtctagatgatgatgatgatgatgatgatgatgatgatgatgatgatgatgattgagatggagtttcgctcttgttgcccaggctggagtgcagtggcatgatctcagctcgctgcaacctccgcctcccaggttcaagcaattctcctgcctcagcctcccgagtagctgggtttacaggcatgtgccatcatgccaggctaattttgtatttttagtagagacggggtttcaccatggtggccaggctggcctcaaattcctgacctcaggtgatccaccctccttggcctcccaaagtgctgggattacaggcatgagccaccatgcctggcccaagtctagattattgaatagaaaaacatgatcctgaatgacaaaatgtgtctgaccaaagtagatttacccatgcacagaaatcgaagtcaatttttagtgataagaccccatattaaatatgaatcatgtcttggatttctcctaaattcgctttaacatataatgtgacataattgttaaaggaaggtctgaaagtcatataatccgtctttattcattttcatgcttaaactaacacacaatgctagtataatgtgaccctttaattctgagataattttctggagattatagtttggtttgtggtttttgttttgtgttttatttgttttggggatgggatctcacactgttaccaaggctggcatgcagtgggattatcaccactcactgcagcctcaacatgattggatcaagggatcctcctatctcagtctcctcagtagctgggaccatagacctgtgccaccatgcccttaagctaacattttatttatttatttgtagagatggagtctccctatcttgtctaggctggtctcaaactccttggctcaagcaatcctcccaacccagcctcccaaattgttggtattacaggcttgagccactgagcccagcttgttttgtcttaaagtacaaaaggatctcttgtccttaagtgttccttagatctgagtccaaagcaaattttccttttttcataatgtttattttaaatgaagaaatttgactgttatatatatggctcaaatttttactctaatttctagattgtttacctaagtatcctatcactatttgcagattcacttctaactctccctaaatttcaggccactagtagtgtttttcatgttttttcaaataggaatgattcaaatcgacttatatcagcttatggttttttgactgtttttaaccccccaccagtttttgggtagaaaatggtagatcattctataccatttaaattcaaacatttttaatttatcttagtttctgatatgttttcatttactcgattacatatttctgcaaatataattgaatataagtcaaaatatcatttttcataccttttatacttcctgtctctattttttgccttatattttctaattttctatatttctaatttctagggcaattgatatttaataaacattctctattgtgtagtaaagcttgtatttctaccgatttaaattagtaatatcctattagtttaaacaactttaaaccatatctcaacttttcatagttagttgttttggggtcaactatgaatgaatagaagaatctttgtattagcaattcaagaagcagcaattatgtatttctgagttttttgtttttgtttgagtctagttcaaagtagagaaagttattgtttactgtttttttagtttaaaattaaatgaaaaagatggatatgtcttgaatatcaagtggagtagcatgtactcagaaaaagcaaccatttcctgaccaaattagacccttattaacgatagcacatgatgctgtttaatttgtttggggtatgctcttaccccaattgttaattgtcagtttctgaaaataatcagttttcaacatttcacggtttttcaattaggctatggcaacaaatgccattgttgctaattgccagagtttagtcagtaaaattatgatatggtctttctttaactattatcaggtcacttagtatctgcttcatctttttacgctttaataaactaagcagaagattgagatcattagatatccaactgtaatttagcactgtcaagattaaggaggggattatggtcattaggagcaaaatggtttcatttatggactgagaacaatgaggcccatcaataaaccactttctgcctctaatgatcttacttctctctaattgtgtgctaatctaacaacaaactcattttcttctttcattcttgagggaaagattgctaaacagaaatgctttgcatatatgttgcttttacttccttaagttttggtgtgtgttcatgaatgcagtaaattatttctaggtgaacagatatgtctcttaagggaaatatgctatgttctcttctagtttatcaacatatttttgacagaggaatagattttctgtgattagatgtgctttattattagtaccatcttaatccttatttgagtcattcattgtagaaagagatctgtcttataaaattaccaactcaaaatatctaagtgtgctaagaatcgaaaatgatctcagtaaagtgggtcataagggatatatctcttattgggctgtctgccattctatcacctttatgatagaagttctctaaacccacctctttgtagccacattccttgagaaatcaatgcttgcacttcactgaatttaacatgttgactgaggcccaaggcactctgactgtttgcagctagtagaggatccttgagtacaccctggtacttctgctctcaacatttgagattttggcttatcatgaatcaattgtgcttattctccaaacctcccttatgtggcagttgtactttttggtgcagttatttactctaattaaatattatgtgaaccaagaaatggtgcttaaaaaaaaaaccttgccatttatgcaaaaatgatgttgactgcttgaaaaatacttgctaaagtcattttaaatttactctctaattaggtgtgcgtaaacaaacttaaatgataggaactcattccaaaagccttctctaattagatttcttcatgaatgtttaaattctagaaacttaattctagaaatcaatctagaaactggtttagagggtacccttcgtgtatgggttatatgcaaggaaggctctgcagatacccaactggagcctaactcacataggatacctcagctctacatcaaaaagggtagcaagtgaatattatttatactttttcatttaagattttaacatgtatatcatgtcttctggatacctactttaactgacctctttgattaattgaccttgcgtgattttctaattatatttattagtcatgcttagtgtattaaaaactttactgctgctcactcatatccactagaaatgttaacttcatgttctgagtccatcatttctctcctttctacaacatagaaatggacctattgggtgtttatatattgaaattttttttctcaacatgacctcaactcccataagctattgtcattttacccaattaatgtatttttaagaaaaaaacctaaataattgaaagcatctgtcttgtttctgttgtaaatattatgttatcaatagtacacagactatctgcaaaagagaatctgatgatgacctgcacataattttgttggcaatcttaattttaacatcagagataaatatggagggcttctggtggtgcctaagcatagtaggtcctatgagaaaaaatattacacagctgctctagaggaacttacatgcttattgaatagataggattaacagataagatgtacttagcaggataagagactcagatccttatggtgcagggcagactatagattttttaggcactaagagaaagaagagctaaaacgtgtcattatagtaccacctcccaaatgttacccatatctaatgagtgaatgaaagaatggcccaggaagacttggaagtctgtagttgttattaatggaatgttccttccactgtaaactggagtgtaagattgtaaaaaataaatacggcattaggaattacataatatgacttgaaacatgccaggacttgtttctgaagattgaggaatgagtatacgttttttgttttttgttttttgttttattttgttttgttttgttttgttttgtttgagatggagtctcaccttgttgcccaggctgggtgcaatggcgcgatctcggctcactgcaacctccacctcccaggttcaagtgactctcctgcctcagcctcccgagtagctgggattacaggtgtctgccaccaggcccggccaattttttgtatttctagtagagacaggatttcatcatgttggccaggctggtcttgaactcctgacctcaggtgatccacccgcctcggcctcccacagtgctgggattacaagcatgagccacctcacccagccgagtatatgttttaaagtatgtaatgtaaatactcaggcagtcagtggagtcacaggaaaattccctcaaggactttaatcagcagaaatgtttgtgtatttgtgtgtgtgtatatatatgtatatatgtgtgtatatgtgtatattccagtagttacagttaatgtatatgtcataacaatacagaaaatgttaatattaaaatttatgtcacctttattcattcacctaatataatcagaattgacaaaacatgttagctattcatggcactgaatggagtattctgagcacagtaggaaactcacaaaattggccaggtgcggttgctcatgcctgtaatcccagcagtttgggaggccgaggcaggtggattgcctgaggtcaggagtttaagaccagcctggccaacatggtgaaaccctgtctctactaaaagtatttttaaaaatgagccgggcatggtggcaggtgctggtaatcccagctactcgggaggctgaggcaggagaattgcttgagccgggaggcagaggttacagtgagccgagatcacgccactgcactccagcctgggtgacaaagcaagacttcgtctaaaaaaaaaactcacaaaatcaataaagcaatgtgggtcaacaggatatgtgaatattataaggatatttccctattctattcatttattatttagtacttcacatagtttattcttagctgattagtgattaaaccattagatagtaatatgtttgttcatttcacccaatatatatttactcctactttgtgcaacacaatatactaggcccattgagaagtacaaaatgtaccccttaccttcaaggacgtgacagaaatataacttttttgataaaatgattgcaaaagatttaatcagggtgacactaagagaatgcttttgaagacttatctcaaacaggtcttagtttattccaagtcttacaaagtcaaagttgcataagtcttacaaagtcaaagttgcataagtcttataaagtcagagttgcaaagtgaatagtgaagcaaatcaagaagatttttttagatcatataagaaaaggtaataatcaaaaagtaaaatccagttgctgaatttaggttagttaatataaggcatgattatgtaaaactgactgtaaaattgagatccagtttttaaaaatccaagttatttgtaggcaaatgttaaacaattaaaaaaattttttttcaatatttttgagacaggatcttgctctgtcacccaggttggagtgcagtggcactatatgagctcactgcagcctccacctcccaggttcaagtgatcatctcacctcagcctcccaagtagctgggaccacacgcatgtgccattatgctatgctaatttttaaatttttcatagagccgagctctcactatattggccaggctggtctcgagtttgtgggctcaagcgatccccccgcctcagcctcccaaagtgttgggattacaggcatgagccactgtttctggcccttaaactatatatataattaaatcctgcccctgattttatattagaaaattcagcaggtgcacgcagcaaatcttagggggaaaatggtagttttcctaatacttaaactttagctgcaaatacatgaggccctggatcctaaaatcattggggtcatatgctagattctgtgtgtatggtagaaaatttgaaaatactatttttgtggggagagaattcatatagaaaatgaagtctgttgacgtatggtaagtaagacaggcgaaaaaagtgttttgcaacttcgcttgttgctctgatactactcattagtgtatgctcacttttttctttctaagatcataccctttattaggcagcaatattcttctaatggagaaaagaaaatgagcagtttacaattatgtaaataagacatagttttttctatttctgaaaagtaatagaacttttttcccctaaatgaataaaatctcaaataaaattagaatccctgtacctcactactcattaaagggtgacactagtaacaatttgtaaagaggaaactgtagaaatgcaataaaagaagattatcttagcaaaattgagatttctctctgtatgtcatgctaaaaatgtagctgagagctggtctttgcaagatcaatgtgggatctatgcatgaaatgtgatttgcatatttaaagaaacagtttaaatcatagcttataacccatgccacagagagaaagaagtaatgtaatgctgttgtacccttgtccatctatgtatagctgagtccatgtgtgtgccaaaagggcacaggtgcacttttaattccccagagacaataaggctggtatgtggggtttataaaagcttttccttttcatgttcaccatggcgattgtgactattttttatatttgggatagcactgccatttcccactaatttgtattagttaaatgtgttcaattctaaaaacctcttgattcatgttcaggatgttagtcatattcattagtttctaattgcattctgtaacctatggtagctctggggacttcaaatgtaattgaaggttttaattttaactcattgaatcaagtagtgatatggtgacatcagtgtcttaagaattttttttttctggaagcattatgtgatatggattgaatgcatgtagaacagttgcagtgttccaacctttaggtgagatgcacttcctaaaagtggcaattgcaatgcacagacaaaggtggatgccaaaggcattttgaaaatgattgatgagacttggtgactggctggttatggttaatacaaaagataaagagtaaaagctaactctgtggttttaagcagtgacagctggaagagtagtaatgccactggggaaaacaggataatcagaaacagatctggtttctgggagaaggtggtctgctcaggtttggatatgatgcttatgaagacatgggacactcaattacatgtttaattttatgtgagactagaagaccattcctcaaataaaagattggggtttgggtatagagatttgggcttatatataataacaatataagatttcagcttatatataataagatataatatattgttattatatataataacaatattacatcttattatatataacatattatatattatatataataagatgtaatattgttattatatatgataacaatatataagatttcagcttatatataatagcaaaagccttgatgtaagagcaatgcattaagacagggtttatagagaaaaaaacgcgtttatagagatcttggggaatgcttccatctgaatggtgggaaggagaatagaatgcagcaaatgaaacaaaggaagagctgtcatcttgctctataaaagtatttagcatgaaagagatctctatttggagttaaagcagtattatggtattggcctcaaacaatttttccatgtgtcaagtagtaatttcttttcaaatattgataagaaatcttcacagatattacaataaatgtattcagaattcttatatactgtgggtctgaaatcaaccataattatttttatgagttgacaaaattataataaatgcaaatatcctttgctgtagattagaggcatttttggaaagtttcctatgaaaaatattttccatttactggggttttctttctaaatattccctttatatgtagaaacttaaaaggaaagagccagagatctcttttggctccatcctcctgccaagcacaattttcttattgcagcatttataataccatcaactaaagatttttatattaaaaacattttacaaagagtcacagacccatttgtatgttttgttttgtttttaaacggagtttggctcttgttgcctaggctggagtgcaatggtgcagtctcagctaactgcaacctctgcttcccgggttctagagattctcagcctcccaagtagctgggatgacaggcgcgtgcctccactcctggataattttttgtatttagtagagaaagggtttcaccatgttgatcaggctggtctcaaactcctgacctcaggcgatccacccgccttggcctcccaacgtgctgggattacaggtgtgagccaccaagcctggccagtttgtatctttataatgaccccaccagatcagagaggcaggtgatattattcctgttctacaggtatgaaaactgagactcaaagtggtttaggtgtcttgcccaaaggcatatgtaaaggaagcgggaattgggtcttctgactccaagaccagctttctttttgctgttactgtgctgtctcacatttgttatacattccctgaagactcctgtgagggaaactttagaatttcatcaaagcaaatcctaaaggtacatgataaatttgttgtctgttttattgagtaaaaatctgtctagtcagcagtccatacgttaggtcagaggtctaaagtaattgtttactgggcttttttggatacattctgaggcatattaattctttcaggctttttttttttttttttgagtaaattactcttgaaagggttcttattggtaccctctagaggttcagaagagttaattggcttacaaaacatatgtggatcgaacttggggaatagttcagtcatctcttaacatctggatgtactgttttattattttaccattatgtatttgtatctgaaaactgcagccatttaaaaataaatatggtaagtaaacagtatgtatataattaagaataattcactgtagctcttcaagtttacagcactgttaaaaataacctggtgtatccatgtaacttatgaattcaatgaaatttaaataactgaaaaacaatttttacagtaacatgccattcacattttgaaaatattaccaattattttaatattatctactttgaaaatatgggaaacaaaattgttcatgatgtttgtgtgcacatcattcaaagaaccaaaacaaaatttttatcaatctgcattccctcagagagataaaatattgctctgtgaaaatctgattttcaccatatgctaatcataccctcttccacagacctcttctcttacttcctcctgaacataaccttccatcaaaacaagaaacaacacaaaaacatcctccaagaaaaaaagaaattacaaaatacaaaagcaattcacaaagccagaaataaatgtttatttagttaaaaaaaataaaaagatgaatgttgatgacttcaccattgaaaatgatgcctcaatatacaacttggcttcaaagatccttagccttgatttggtcatcacgagttattctctccatttcagcttcccccatagcatgtaaacatcagactttgtcatcacatatgacagtgtagctaccaccaagatctcaagctctgaatgtgtccttgtacccacaaccatcctcacatagcccttgcctctggcgcctgtttttctgttgccctcattatgaccttacccttacccttcctcatcttatttatttattgttaagacagagtctcgctctgtcacccaggctggagtgtagtggcgtgatctcagctcactgcagcctccttctcccgggttcaagcgattctcctgtctcagcctcgcaagtagctgggattacaggcgtgtgccgtcacacctggctaatttttgtatttttagtagcgacgggatttcaccatgttggccaggctggtctcgaactcaggtgatctgcctgccttggcttcccaaagtactgagattacaggtgtgagccatcgcacccggcccctctttcttttctcccaaactatttgctcccctcaagctgcatttgccatataacctacacactgtctagcactgtagaatcctcatacttgcttcaagctcccctcctttagccttctgccgtccacaccctgatattcctgttgctctgatccaatcccaactcccgcatacatgacagaagtcacacagtctacctgatgggatccgttgttccatcatttctaaccttagcctcctaatggagttggggtagcttttcatttaactctaattctgtctttttccccacaacagcaattccaaactaggtttgttctcctcaaatccctgagtctagctaccatattcccagataaacatctcttctcattcttgactgaagatgaaaaaatattcttttcatttactgccacatatctcaaagaagacattacatctcctcctgtttacaaattattttcttcctactaactcttcagtgtgttatcatctgactgatactcccatcaatttatacgtctttgtatttggttgtcttaacctccctacaataaagctccatgggggcaaagacagtggtttgttcccctcacttccttgtttgctattgcagtgctatgccattagcagaactatgtgttaactttcagggcctaaaagaacttcagataccaggttcaccttgtacttcccatacttggaaatactgctgaactaaatcttgccttattctcagcaggcagtagagcatgttggttaagaacacacatgagacttcataacttcaaatattgtctctgccacttactagttacatgactttgaagaaattatttaatctctctttgtctcaggtttttcatatgtaaaactggcataataacaagatacgttttataggatgaaatgagtatgtgcatgtgtgtgtgtttgtgtgtctgtttatacaacactgggatttgtaacttggcaacttcctggaatgtactggagtatcattttaaagcccatggtaatgacaaagagatcagttatttaggatgcgttttggtcaattctaaaaggaagctataagatgggataatggagaatttcatttggactcctccgtgttattttcagaagtgataatttggccattgagattgaatttcatgttgctttatagtggctgatttttccttttatactgactgggatacaggacctggctttgagtttctgcatgtgtctgttgcttttatattttatttatttaatttggggatttacaaaataaattttgccagcctgctttgatcatagctgtctgtggcattgtgctaactcaattaaaaagtttttttttctgtcctgttaaattaacattctattgatacattcaacagaataaacttatataatcaattccacattatagaattcacaatatacattttaccctcagaaggatgcaaagaattgttgtaaggagactcagttgcattatggttatagaggcatcaagaaatccagaggcacagtggctcacgcctgtaatcccagcacttagggaggctgaggccggtagatcacatgagatcgggagttcgagaccagcctgaccaacatggagaaaccccgtctctactaaaaatacaaaaaaaaaaaattagccagacatggtggtgcatgcctgtaatcccagctactcgggaggctgaggcaggagaatcgtttgaacctgggaggcggaggttgtgttgagccgagatctcgccattgcactccagcctaggcaacaagagcgaaactccatctcaaaaaaaaaaaaaaaaagaaaaaaagaaatccagaggcctggtggtgtatacctaggcaatccacttttgttttctctctgtttccatatcctcatgagagatctggactaggaaattgctgatatccctccccaagggggcatttttgttaatctagaacatggatcaacaaactttttctgcagagagcaagatattaaatattttagggcttacggaccacacacagtccctgtcacaaggactcaggactgcctttatagtccaaaagcagccataggcaatatgtaaacgatggacctggctgtttttcaataaaactttatttatggacactgaaatttaaatttcatatacttttcatgtgtcacaaaatgctatccttcttttgatttttttttcagccacttaaaaatgtaaaaagcattcttagttcacaggccatacgaaaacaggcagccagctagatatggcctgcagacagtagttcaccaatcccttatctagtctagccaagcaatgtatacatatgtctatttgaggaacttctatattgaagacattatctcatagtacttgtattagtgaacattttcactttcctttcccttgtttcataaatgatcactaggcatttgaatatttcagagcctttagccagattgcatgtgtatttgtgcttgtatatatttttgccagaacacttgaaagtctctgggccttttattcatctttgctttgccaaatattttcccacctgtatagatgaattaaaattttcaacagcctttctttgaacatgacttttgagaccagttgctatttaaattacacaaaagtatatttagcccttctttgtgttttattccctttttgccagggtggaaggacttttcaggaacatatttgaatagatggagaattctgaaaaacataacccagatatttatttgggtctcagagaagaagacgttttgaaaacaacctttgtggctgggcacagtggctcatgcctgtaatcccaacactttgggaggccacggtgggtggatcatgaggtcaggagatggagaccatcctggccaacatggtgaaaccccatctctactcaaaatacaaaaattagccaggcgtggtggcacatgcctgtaatcccagctactcaggaggctgaggcaggagaatggcttgaacctgggaggcagaggttgtggtgagccaagatcgcaccaatgcactccagcctgtgggatagggcgagactacgtcaaaaaaaaaaaaaaaaaaaaaagaaagaaattttatcaatttatcctgcttgaagtctttcagcgctttctcactacacttaaggtgaaacccaaattccttacggtgtcctacaagaccctacctacctctcaaacttcatctcaaatttttttttaaaatccattattttgttagtagacaaaactacataaagtataataaatttatgacatgataatgcccagataactaatcaagacttgctttatttagggactgctttcagtagtgaggaacttaaaaacatagtacaattatattatctaattgctttagtttgtattgccaatttcttatttcagggcatatagtaatcctattaatatccacagttaatgaataaggaaaatacaaccataggcttactatatcctttgaagcatcttttgtctgacctataaccctattacccaggagaaatattgctaatccaggcaacactaatgtggaatggactctaatggcttcaggactatgacctcagcactgatctcaacaacctgcattcagtttgggtgaaaattcgtggctttgtatatgttacatacctgtggacttcatgcattaaacttgttcctcaaaaactctgtgaagtgcaagaatctgcatatagtcctattaatttccctgaagagttcaggaataaagttaatgaaaaatttacccatgatcacaaaaattacactcaacaaggctaacattattttaatacagcattatagctttatggaaacactatttatgtgtacttaattcttgccaaatagtaatgtggaagacagtatctattcaaatggttcatcaatctgtatgatcttttcacaacttattgaagataccatttaccagaagtaagggtatatattagtaaagttttctttttcctttttttttcattttcatttttttttttttttttgagatggagtctcgctctatcgcccaggctggagtgcagtggcacaatctcggctccctgcaagctccacctcccgggttcacgccattctcctgcctcagcctcccgagtagctgggactacaggtgcccgcaaccacgcccggctaattttttgtatttttagtagagatggggtttcaccatgttagccaggatggtctcgatctcctgacctcgtgatccacccgcctcggcctcccaaagtgctgggattacaggcgtgaaccaccgcgcccggcgtgtaaagttttcattaagtgattgctcagataaaagcatttgtgaatgcttattcaagaagcaggtagtcgtcttgttgtgaaacagtgttcatttatcgcatctagtttgtcaaaacattgtttgacagtattgaatataaattgttttctacctgtttgttcttcgtgacctttttgcagtactatttactcaattattgtagttcacaactaaacacacctataaacatatactcaaaattccaaattttacagactagtaatttcagatttcttaaactaggattttcttctttctagttttagtcaacacgtctacattcttcatagcccttgcttttccatgattttactaatttattttaagcctttctattgttatattaagtagcctcctttgacaacctacacttttatcattagtgttctagttccaaggttaaagaagaatgcattacatagattggacaagtgaagacattagtatgggattgtcataaaggatttatcagcatttgaagctcctgacaagcttttttttttttaatttagaagaatgccattccagccatttaaataaaatctccaggagaagactattcaggttagaccaatatcaagtcgaaaagacttgacctattaaaattattccagtttgagttttaggtgggtggggcatcttttattacaaaacaaccaaatgagtttttaaaaagatttttctttttcttttttctatttttttttttgagacaagagtctctctcgctctgtcgcccaggctggactgcagtggcgccatcttggctcactgcaagctccacctcccgggttcgcgccattctcttgcctcagcctccccagtagctggtaccacaggcgcctgccaccgcgcctggctaattttttgtatttttagtagagacggagtttcaccttgttagccaggatggtctccatctcctgacctcgtgatccacccgcctcggcctcccaaagtgctgggattacaggcgtgagccaccgcgcccggcccgcaaaaaaagatttttcttgacgagaacaaaccattccaccaagactttatccagcattgctttattacttcctagtcctggccttgagctaagactgtcaagaaaggtaggagatttcagtttgttttttagcctttgatttaaaaaatcacgcatagtatttgctgcaggcagaataacacttgcagaagagacagcaggggaagggactgggattcttcaaggggcagcttgactgtctgtccactactgttggtttggtgctcaggcttcagaattttcttattgcaaattattacttagacagtttcaaactttcccttcctccttgttttctttttgttagaagtctctctttattttttcaaacatgcagtcagactgaggttttcaggctgagaacttgtgcaaatgtatgaactcagacattgaagtgtacttagcgaagttttaagagttaaatcatagaatgcagctttcatgttttcttactggatttcctctgctatcagcatcagttcagaccacattatgaatccagttgagaaaaactgcactttcttcccaagggcacatgttagaggagtaaatgatggtacttaagaacacatatttagaatgcacatttttaagttttatggaataagaattctagttgtgttttctgtgaaggtgactttttaacaggttttttttttttttccccctaagaatgagtcattttctcacatttttcttcattatagggattttttatttgggtaccatttaccgtttattttctttaaaggccaaagaagctcacagtgatgagcttttgctattgttactgtataaacacatttgcttcatttccaggtacagcgttcatgtaaaatgaaactaccttataaatgcacttgagaaagaatgcaacagtgtctattgttcaggatgcttgtaatgttccttttcttttttacatatgctttccggatgagtcactttaatggtatgccgttccgctgatagtaattcttcaactaaatatattcagttaaggaaaattacagggtacttatataatcatgtttgggcctattcacatatagacttgcaagagtaaattcttacttggtctttcttagagcaaagatgtaagaagtgctccgttaatttgtcaatggttacaatgaatagaaacatttaattcagaaaaaaatccacaaattcctggaaatgcttttatatttacatagaattacacattcttaatatggtctagacagtgtcactggaatactgtgattttttttcttgcatgcatatctgttctcttatatactgtgtaattgaagagtccttccgttcaaactcttgcttaaaatatgtatcttatactttaccttaggattatgtattagagaaagtctgtcatttaaaatgttttgaatgaggatcaggccactatcatatatttgcttgaagccagggaaaaagtatatgtatatttttcaactgaagcaagtagataaataagatatgtgaggaaagtttctcctacatataactcaagagagtacactaagcttaaaaggttatttatggagtacaaggaagaaagctataataaagaacccgatagctataatttaattttttagtgttataattcagattcagtaattcagtagcagatttaaaaaatgaaatgagagaaaaaaaattaaagtgctaccagactgactaatcagtcattgaaaatgcctgtagtgggaatttactcagatagaaaatgtttgcactgtcattaaagaccccctagtttatattagtgaactaatataatgacaggcacaaaaatataccctgaggctgaggctgtgcaaaggcaagcatttctaacccactctggtacttaaatattcttggcactacaggtaccatcatcaccctgcaacctctagtaaaaatctctctctctctctctctctctctttctctctctctctttctcacacacacacacgcacacgcacatgcaccccctacctgagaaatattagaagtagtgtaggcaaagacctagttaaatatttaaataatcataatattaattgattgccaactcttaagattgaggcaaatgtgttcaaggcaattaatgaggcaggtaaacacatattaattcttttctaatactttttttttgtctgttaccttttagacaagtctagaaagccaaagtgatgaacttttaaatgccaaggaaatacagactattgcatgggttttaatttccagaaatattatttaaatttggaacttgctaataagtctgataaattggctgttagttagtgtaattgtcactagttcccaaacctaaaattccatgtaccctgtaaaatctaaacacagaaaacacaatctaaatttagttctctttattaaaaaaagaccagctgggcgctgtggctcgcgcctgtaatcccagcactttgggaggccgaggagggtggatcacgaggtcaggagatcgagaccatcctggctaacacagtgaaaccccgtctctactaaaaatacaaaaagttagccgggcgtggtggcgggcgcctgtagtcccagctactcaggaggctgaggcaggagaatggcgtgaacctgggaagcagagcttgtagtgagccgagattgtaccactgcattccagcctgggcaacagagcaagactgcatctcaaaaaaaaaaaaaaagaccaatattacgttaaattaggccatagtagggatagcaggttggaaatgtctgcatttttttcccgtagattacatctaaatagttgtttaattcgtggtagcatgtatacagtgggaatgtgtatgttggaaggtagggtgtaggaaagaggatagtgaaatataaaatgaatatttatgtactaggtataataataagtactttatcaaatcatttaacctaaatgactaccctttaaggaagatattatcatcatcattttgcaaatcaggaaatgaaggcctagagaagctaagtcattggcttaagataacctaactagtaatatgtatggctgagattagaacctaggtctgtctgattcctaaaaccattcctaccccatccaattctgccacagcagcatatataagtaacatgaccttgtgccaatgaatgataaagagtacaggttttatttcatgatgctggccttccaggctccagaaatactgctttacatttacaatttcctgagatgacatcacttatacccctccttaagagtagtgcataccttatagaatttttgtattagataagttaatacataaaactacttagaataatgtctagcacatagtaagtactcagtaaatgttggttattacttaagaacttaagtaatgactaattctttttttttttttcccgagacggagtctcgctctgtcgccatgctggagtgcagtggtgcgatcttagctcactgccacctccgcctcttgggttcaagcaattctcctgcctcagcctcccgagtagctgggactacaggtgcctgccaccgcgccctgctaatttttttgtatttttagtagagatggggtttcaccatgttggccaggatggtctcgatctcctgacctcgtgatccgaccgcctcagcctcccaaagtgctgggattacaggcatgagccaccacgcctggccagtaatggctaattcttacaccacagaaggactagttgaaggaactgggtatgtataggctgggtagattaagaagattcaactgatacatttcttgtaaaataggtagtagacttgatcagtgctactatgaggcaaaattaggagtaatagataagagtttaagtaggctgatttttttttttttttttttttttgagacggagtctcactcttttgccaggctagagtgcagtggcgcgatctaggctcactgcaacctttgcctcccggattccagcgattctcctgcctcagcctcctgagtagctgggattacaggcgcccaccaccacgcctggctaatttttgtatttttagtagagacggggtttcaccaagttggccaggatggtctcgatctcttgaccttgtgatccgcccgcctcggcctcccaaagtgctgagataacaggcgtgagccgccacacctggctaagtaggctgatttttcttatgagtaaataaaaaaattctagtgatatcaactgtcaacaattgaataaggcacttaggatgtagggagtactctgttttagatctaatatatgcaacaccccagatttactgggcactcctttgccatctcccacctccaaacccaggctactcatttcccagccatagtgggaagttaacattgctagaaacaatttcaccaatgaaggaacaggagatgctaaggagtaagcaggtaaatgaattgctcattgtctcctctaagcagctcttttttttttttcttgagacagagtttcactctgtcgcccaggctggagtgcagtggcacgatctcggctcactgcaacctctgtctcccaagttcaagtgattttcctgtctcagtctcccgagtatctgggattacaggcgggcaccaccatgcccagctaatttttttgtatttttagtggagacggggtttcaccatgttggccatgctggtctcaaactcctgacctcaaacgatccacccgcctcagcctcccaaagtgctgggattacaggcatgagccatggcacctggcctctaacctacttttctaagttacatttgttttatctggagaccaggactgactagataatttttgggtccgggtgcagaatgaaatgtggcaccccactgcaaatttttattttattttatttatttatttatttttttgaggtggagtcttgttctgttgcccaggctggagtgcagtggtgggatctcagctcactacaagctccgcctcccaggttcatgccattctcctgcctcagcctcccgagtagctgggactacaggcgcccgcccccacgcctggctaattttttgtatttttagtagagatggggtttcactgtgttagccaggatggtctcgatctcctgacctcgtgatctgcccacctcagcctcccaaagtgctgggattacaggcttgagccaccgcacctggccaaaaagttattaagaatttcaaaatgacaacaaagtattaaacaaaatgcagggccctttgcagcatgggatcttgtacaactgcacaggttgcatatccatgaagtcagccctgacggagacaacctgagacactaaacaaccagcatttttttttttttttttgtaaagctatgacaagttctggaacttaccctcttgtatttgctgtctttccctcatgcctgcttctctgggattatatcccgctcaccccaacaaggccttaagaagtaagctctaacttaggctatgttttgcagggactcagactgtgatactctgtaacctgagtttttcaaatttaagaggctggtccaaatctcctttaatgtcacttttacctcaaaggtaacataattcccccatgcaaagataaacactttacataatggcattgtttaatgcagccataaatttctgtataagctagaattctcagattattacatctccaatattttattctcttttgttcaggcataatataaataatccattagaggggaagaatggaggagcctaagaaagaaaggtgccctttacttttttttactttatccgctttcctcacattcccatttgtctaagcatctcccgaaccacgtctatatattgttaggcagatttcaagtccctgctctctttctctacttatataataattggtatggtaacttcaaatcattatgattatatctaacctctccctgtactttcagttgtggaagtagacataaatttaaatgtgaaccaaaacttcttgaaatgtacatattcatcaataaatatttattgagtgataaatactgagcacagtgataagtactgagggaaaagcaaaaaatcaaatatagatcttaccattaggcagcttggagttttataaaggaaactgttgtttatgtatatgagataaaagacaattattattcaaagcagaaggtgataggtcgaagatcacttaaacaaacaaaaagtacatatgaaatggtagagaatttggagtagagctctggagagatttatagaggactaaagattatacatgtgaaattcgggaggacagatgttcagaaaaatattgatttattcagaatgcaactttagagtaaaagtaatttccctgggttaaaaatattctcacttattacttgacatatgtagactgctgtgtgcatagcaatttgattaggctagttttgtattgaatgattggaagatgaagtcattatcatcatcatcccctttttactagtgccattactattgtgacctaaacctggccttttagcacattttatttattacagaaagttagggaggaaaaataacttttccttttccccattttaggttcattggccacggtctctataccaaaaggcagattagcaaaagaaaataatgcagatttatttaggttttacataacttgagaggggagcattcataaggaaatgaagatccaaagaaacagttaaacctgaggttttctatagtatgtttgatgaaaaatggagaggtgtggaaaaatatgatagggagaaggaaaagtatgtgctaagtataataaactgggagaaatttaacaagacctatttgttcagatttctatgtccctttattttcagagataaggatgttggtttcctcagggtgcatatagcaaagttagctctcaggccggacatggtggctcatgcctgtaatcccaacactttgggaggccgaggcgggtggatcacaaggtcaggagatcgagaccatcctgaccaacatggtgaaaccccgtctctactaaaaatataaaaattagctgggcgtggtggcacatgcctgtagtcccagctacttgggatgctgaggcaggagaatcacttgaaccagggaatcggaggttgcagtgagccgagatatcatgccactacactccagcctggcgacagagtgagactccgtctaaaaaaaaaaaaaagccacatgagtttttgtttgtttgtttgcttttgttttttgtttttttctttaagagaaaggatcaatctgtgttgccctgtctggagaagagtggcatgatcatgactcactgtggcctcgagctcccaggctcaagcgatcctcctaactcagcctcttgagtagctgggactaggcacataaccaccgcacccagcttgcttatttatttatttatttatttatttaaggcagggtctcactctgtcacctaggcaggaatacagtgatgccatcataactcattgcagcctcaactttctgtgctcaagcaatcctcccatctcattttcttttttttaaattttttgtagagacgaggtctagctatgttgcttaggctgctctcgaactcctgggcccacgtgatcctcctgcctcagcctcctaaagagctgggattacaggtgtgagccaccacacccagcagagcttatttttgtattttttgtagagatggggttttgccatattgtccaggctggccttgagctcctgagtccaagcaatccatccactttggcctccacaagtgctcggattacaggcatgagcccccatgtggggcctacatgagggtcttaagacctgtgcccaggaaagatcagatagtccttcctgcaggtgtcatttctaaaagttcttcagcttaaaatactcaatatgccaaggcaccatatttttgggtaatgtgccctgaacttcaccatgtccgtgtaacctaaataacataagtgactggtcaatgttttgtcttcacttttttttttttttttgagacggaatttcattcttgttgcccaggctagagtgcagtggcgggatcttggctcactgcaacctccacctcctgggtttgagtgattctcctgccttagcctcccgagtagctgggattacaggcacccaccaccaggcctggctaatttttgtattttttttttttttttggtagagacagggtttcaccatgttggccaggctggcctcaaactcataacctcaggtaatccgcccacctcagcctcccaaagtgctgggattacaggtgtgagccaccgcgctcggcctgtcttcactttttcaatcaaccaagtggggaaggagaaaccttttgaataattggaatacagcagagaaacctaagtgaaaaaattcaattttaaaatcagagagaattatttcttccatagcaaactcatcctttaaataaagcaagcaatgattggtgaaccattagcaaatttttggcaaaactttcttctgcaataaagaataatttccaagcttgtcagatctaaacaaatggaactaaattggacagagctatttaaactgacagattaatagaaaaaaaatagtctttagtgttagtgtttgatttttagtctcttgaacttccatgtatatttaaggtgatttctcctcattgagttataaagatgtgcccatcaacatgatgaatttgtatctgaacagtttggctgaaatttgccaaggggttgattttggcagtctcttaaatttttcattgtaatgctgatatgtctctgcataagactaactttgcttaaaaataagaaagaatcatagtatttttctatttgtgtttcatggtcctttaatgaaaataacagtatttcagaggcctggatttaaaaaccaatgtcacaggctgtccatcaaattataacacttacctcatctttgcaactagaatcttgccaaatgctgttgatattgatagaagtgttttcatacataattggcagttatgcagcaatagagtatctataaaatagttgaaagttaaaaaaaaattacctggtaaaaagaaggtctcctgacagatctgaaaaatgtgcatgtatttaggagcagtttgaatacaatacataaaattattagttgtcaatgagagcaaaaggaaggtgcagagaatgttaggggtaattacagcaactaatgatagtgtttgagggcaggctgaatctttgtgggtatgtacgttcatttgtgtttgctggggtttgctctaaattatctttctgtatcaacagttatttttcacatctctttgaaaaatactagagatgggaacttttaccatagatattggtttataaaaatcaggatattccaacaaaagaaaaatatttgatccttttacataatttaaccttaaatcatttatagagctactaacgtgcattaataacatctctttgaaccttagtttttctttaatcttcaaattagattttaaagaatgaaatgttaggaattccgtcaataaatttaaattgaaatggattcatttgaactaatggctgagtaaaatggtgacattcccatattaaacatgataatttggtatactgtattacacattttcatttatttcatggagagtagaatttttataagcagtaattcagaaaaatgtgagttgacttcatggaactatttcccacatttaaaaaaaaagactttaactgataatgtctccttttagatgttttgtggaacacttggtaaaatattctaaatcctttgcacactgttctttagtttcagctcaaattctcaagagcaaccttgcatcaatggaacaacaaattgttcatctggaacgtgacatcaagaaattcccccaagcagaaaatcaacacgataagtttgtggaaaagatgaccatatcctttatttatttaagcattttgtctagtttttagtctctatgtctgtctgtttactaactgtgtggttagttctagatttactagtcttttcacaccatctggatgaatttgtgtatatgctgtttttctattagtagcataaattttgtttcatgatgttttcaaccagtaggcaagggaacaattagattttttttgaaggctatttctcaaagaagaattccatttgaaagcccacaggatatgcaaggtaagtcttaagaggtttgatgaaacctaaacaaaacaaaacagaatgttcttatataaccaaatgtttaaagtaaattatcaacagaaggtttttttttgtctgagattttgtgtgtgtgtgcatacattttctgagggcatgtgtgcattttcaaggacaataagaggataactaatatcactagacagaaaggactgtgaaggataaatggatacatggttggatggatagacgaattgattagtagattatatatttaaataaattgtagtagatatctgtataacattaagcatttcttgctaaataaacattttttgaaacttctagtttatagcagtatattcatataaatcataaaaatatataaaaggaaaacttgagaaatagcatttagcttgaattgtttaatgttaaatctggtgtctaaagataaactacattagacctgatttttttataattttctattttagttttcaaaagttaaagccatatcctcctcctctgggtttaaataagtatcttgaactgcagattgattcaccattttatatctttagagggaataaatactgtaaattctttatctgataataagtaaattccttcaacaactatttggcagtcaccttgtttcaaggttaaatctattgcctttttcttctgtgatatgctttattttttgcccaacttggaagttacagtgctgaactcgaattacttaagaatggcaatttagatttatgttaaaaaaaattttaactctcagtgttttggttcattaatgaatactgtgttttgtatggtactttagtgattctgagtaccttcatgaatacaaatattggcaaaataagtttgtgattgattggaggcagggaatccacaaaaataaccttgggttgcattactggccacgttaggatacctaatgtgaaggtttcactttattgctgattacattttttttttttttcaaatatgttatattgtcctgtgcctggaaacaccacctcctttttcaccttttgattttggttcttgcctcatatatttgaatttaattccttatcccctttttcttttgaacattttcttctactgttggcttatagccacacaacagcttgcaacattgagtctttgttgctcatttagaaaaagaaaagtaatttcaaaccctcatgaacttggcctggactccttattttatttctctctttatgcaggtaattaagcactttaaaatgaaaatccagagccttctgtatctgtatgttacagatgaatggttattcttcatttaagtggcactaaagtgtgactatttgtccacaaggggattgaaaactgtattaaaatgtatggggctgttactttgcatatcatattttttaaagaaacaaaataaaatacacagcaatttatttcagagaaaaaattagaatattgagttgggttggttaaaaactatgaattaatggattataaagataaaactgtggctcaagttattcttcctttgaaagacttcttggtcacccattgagagtttctatcttctagaaagagacgaacgaaatgcgtaatcattatatgtatgtatatgagttctggtgcctacctaatatatatattttttacccttctggcaatgctaaaagagaaagatattttattgtgggatacttgatcctgttttaaaaatagaaccatgagccaggggtggtgactcacgcctgtaatcccagcactttgggaggctgaggcgggcggatcacctgaggtcaggagttcgagaccagcctcaacatggagaaaccccgtctctactaaaaatacaaaattagccaggcatagtggtgcatgcctgtaatctcagctactcgggaggctgaggcaggagaattgcttgaacctgggaggcagaggttgcggtgagccgagatcgcgccattgcactccagcctgggcaacaagagcgaaactccgtctcaaaaaaaaacaaaaaacaacaaaaaataggaccatgattccatttctagtataggatcctttgtactagatgatctttccaatatttccatccagtgccaataaattgttttgcttcaagtcactggccctttaaattgaataattagggtcacaagtattggagtagtttccatggaaagtaactttagctacttaaacagtaatctgtctgtgaggactgagttcacaagctgaaaagcattcgtatgcctctggacttcagaacagcaacaatgctgtagttagcagcaatggcatgatggcttcagggcaactgaatatgcaggttggatcttcaagtcaggctatgtcctggagcaccctatatttacccttactctttcccaattttgattgaacacttaaagtatgctagacattgccaggcatgaaaattgaacagtacacaagatgatagaaaacttgacctcaggctgctgacagtctgacatttgtatgttctctgtcttgctgttcccatggcagagattatgtatggtttgttaattactatatgcctaccacctagcacagtgtaggcactcagtaaatatgtgttgaatcacacggtattatagctagagacagtgaagatcatctagtccaagcccctgcctttacttagcacttcaaaacgatactgtcagtgttaggctgtgcttatatttataaaaattttcttcatatatctctcacaaatgtatcattgaatcacctttatagagcatgctgtaatgtataatcagttttaagagagaggatccacagcttttaaagtaaacatcagaaaaaacatagacaaaaaacaaaaacaaaaacaaaaaaacctctcctttgaatggagtttccaaggctatttctagcctgctggggccaatggctttagaaggaaactcatcacctctttcttcctttctctacccaaaataggttgcttgttctgactcagaaaaaattagatggtataggagagaaaaatcagtcgttcttgacccattcgaaggttcatggctgacaccctataataccatattaacaagagcaaagcatacaaatttatttaatgtgagttttatgtgacacaggaaactccataaatgaagactcaaagaaacagggaaaaaccatgtattttatgggcagttgtgcagaagtatgactggtggataaaaggatatgatctaatggtaataagctgggggcaacccatgaaggctggttcagattattttctgtatctctgtatgacagtcttcccccaggtatggggaaaagacacctgtcatgtgaaggtctcttttttttttttttggagacggagcctcactctgtaacccaggttggagtgcagtggcgcgatcccggctcactgcaacctgggttcaaacgattatcctgcctccgcctcccgagtagctgggaatacaggcacacgccaccacgcccagctaattttgtatttttagtaaagaaggggtttcaccatgttagccaggctggtctcgaactcctgacctcaggtgaccagcccacctcagcctcccaaagtgctgggattacaggcacgagccacagcgcccggcctatgtgaaagtctttggtgaggaaggacagagctcagaaagtgatcttcctaggttttatggcttctttcaagggagaggaattctagtttctttgacttgcttcaggagacaaaggaaggtacgaaggagggagggataagttcagagacaccttcttgcttctgtggtcctcctggtgtccttcagctcaaagtattcagcatgccaaggtagcgtacttccagatattgtgttctgaaccccaacactttacttttttaaaaaagtcaaagcatcatttttacttaccaatccttgcttcttctgtcagaaaagaaacccattcttaaaagaggacttcttagacttttaaatatgtgttgtggtccattcttaacatcttaaactatctaaaaaagcacatcaaccacgatgtcgaccttactgcttatatccagttgacaaattccttaccacatttacttgcagagattttgtcaatggcagggttttctgttgcccaaaatcagcttagctttttgattgactgctggttaaatcatttccccaaccggaggacagagagtgactgagcagcaggggcaccattaacacattgacaagaagagctgacagaatgttaatgacattaacaccctgtcaactaactatcaacacttgggatttcctcatagtatgagggaagtcatttgaagtggttacaaatcaagttactgagaaggcacattatcctttccagataattcaaaacagatttggggtcttcactgcactgccattatgttaattgtattccacctttatttattaagataataatttttaagtagatgaaaaaactcacagaaccaccagtgacattgatcacctttgagaacatgccagtaacaggtttcagggagatgataatccacactttgtaaagcaaatgtcatataaaattgacaaaatagaaatgaaagcaaaaacaaccctcaagagcaaagctgttgtgttttgttttgttttgtttttaatgaacatagtaattcaggtcattttctggtgcctaaagaaaaattgagaacttcagattaggctggaggggggaagttcatcacctctgactctctccttaccctcactgtctgctcctctcaaatgcagaaaattagaaagttcaatgcaaacatttatgagactgttcagggagaggagggtacaggatttaaaagggggcattgtcagtaatacagataatgcatacattgagaagcaaattgttttagaaaaccacaaggggggccgggtgcaatggctcacacttgtaatctcagcactttgggaggccaaggcaggtggatcacctgaggtcaggagttcaagaccagcctggccaacatggtaaaaccccgtctctactaaaaatacaaaattagccgggcatggtggcacaagcctataatcccagctactcaggaggctgaggcaggagaatcacttgaacctggcaggcggaggttgcaatgagcagagattgcatcattgcactccagcctgggcggcaaaaagagtaggactccgtaaaaaaaaataaaataaaataaaataaaaaaagaggaaaagagtgctttttaaaaaagtaagattcttagcattttttgaaatatactctcttgacaatggtactggtcaatggaatttttagtttaattgaatttaaatagaaagtattatcatttatgataataataaagtagtaggccgggcacagtggctcatgcctgtaattccagcactttgggaggccgaggcgggtggatgactaggtgaggagttcgagaccagcctggccaacatggcgagaccccgtctctactaaaactacaaaaaaaaattagccaggcatggtggtgcacgcctgtaatcccagctactcaggaggctgaggcagaagaatcgcttgaacccgggcagcagaggttgcagtgagccgagattgtgccactgcactccaacctgggcaacagagtgagactctgtctcaaaatgaataaataaataataataaaaaaaacagtaataatagtaataaactgttatgaaagaaaatcaaagccagaaagaagttaaagtggtaaaggccaattttattcagcaactattgcaataggagagagaccttactatacaacgaggctgcattctgatacaacaaaggcaagtggggatttatagccaagaagcagggtggaagtcaggcaatggaacattactagaaggagatatcaaagataaggggattccccctaaaccaacttgataggattcttgctgaaggcaggcaaggctaataagatatgaagagtggaggatgaggaatttgaccatatatgaagggtggaggatttttgctaaacagacccagtaggattcttgctaaaactggactgtcagggccaaggactgagcctaagaatgaggcctagtcaaaaagaggactcaaggctgggcgcggtggctcacgcctgtaatcccagcactttgggaggccaaggtgggtagatcacctgaggtcagaagttcgagaccagcctagccaacatgttgaaaccccatctctactaaaaatacgaaaattagctgggtgtgatggcaggcgcctgtaatcccagctacttgagaggctgaactaggagaatcacatgaacccaggaggcgaaggttgcagtgagctgagatcacaccattgcactccagcctgggcaacaagagcaaaactctgtctcaaaaaaaaaaaaaaaaaaaaaaggactcagaggaacctgactaaaatttggttcaagagagagtctttgtcactgtttagttaatgtcatatgccagccattatgctaggaatatctatatctatatatctgtctatatattttcctaagtgaccgccaaagcaatactatgaagtaggtactattactaactttattttattttatttattttattttattttattttatttattttattttatttttgagacagagtctcgctctgttggccaggctggagtgcagtggtacagtcccgagttcaagccattctcctgcctcagctgcccaagtagctgggactacaggtgctggccaccacacctgactaatttttgtatttgtatttttagtagagacggggtttcaccatattggccaggctggtctcgaactcctgaccttgtgacccacccgcctcagcctcccaaagtgctgggattacaggcatgagccactgcacccagccttaactttattttaaatgtgataaaattgaggctatagaggttcaaccatgtacaggagatcacataggtaatatgtgtggttcatgagggtcagaattccaattttggtctttccgacattaaaccttgtgcttctaaccatggtattgtgctgcctccgaggttagacctgtttgaaaatctgagataagttctacatttgttccctgtgaaactgtttttttgcttccttttcaatctctctcaaatgggaaaaaaaatgttctttttgaaaggattgtaaactgatttaaaaattagctgctcacttataccatctcctccagaaagccttccctaatcatagcaatcaaaattaatttccctattccctgtatttttataacattttaatactttgattattgtacttgctggtttgcctgtactctgttcatgtacatgtacatatctattttgcatactggtttatgtactcttttcagatacagattctgattcatattttgagtacttcacaacaagcctgtaacaatgctttatagaaagtcaagtgcttaataaatgtttatttaaataggttagagtttattatataattaatataaaacttaacattatggccagtaaacagaacattagcttgtttttctggcatagcctcagtttaacagaagaaaggagtctaacatgtttcaaatgttattcttttatcatgtcttgatttaaaatgcagctattgaaaattatgtcttaacagattttaagatagaaatcacattctaagaccctgtctgaatggagcatatttttaagggtccgttagcacaaaaattttctctttgaagagttttgcttgcttgaaattcaccctgaaattacgtacactatgagctacatttttcaaactttgttcagggaattgatagacatttggtgcatgatgctaatggtgagaagagaatatattgctcagttaaaggatacataaaccctttcaggccacaagagactcatctgggaaatcatctttttcagaacataaaacggaacttaatttgtctgaaagagttaatgtaccctcaacctgacaaattctaatcgctctcaccagaagctaagttttaaaagatgtaaaaacctttctgtgggatttattcatattgagtagaaataacacaaaaaagaagcttgaaagaataaattacccaatatgaatgtggttttttgtgtgtgtatgcacataaggaacatgtagcatgtgcacatgtctattcgtagatgtaaagccattttggtatttataagactataaattggatatcataccaatgaatctgtgaatttgttttctttgctttgatttaaaatttggtaaaagttttcaattatgaaacacgtggtatcttaagcatacatagtttacaggtaataatagtgatgttagtataattcctcaagtaatatactctggtgcaaaatctcaatcatgtactgttttcataatgcagaaaaatatatcagtatgtttttgtataataaaagtgtgtttacttatttctagttaggatgtgtttgacatatagcttatgaaaagtatggcaagtaaacttggcttttcattcagtaatccctgctcttttcttctgtttttgtttgtttgtttgtttgtttgtttgagatggagattctttctgtcacccaggctggagtgcagtggcgccatctcggctcactgcaacctccgcctccaaggttcaagtgattcttctgcctcagcctcccgagtagctgggactacaggtgcataccaacatgcctggctaatttttgtatttttagtagagacggagtttcaccatattagccaggctggccttgaactcctgaccttttgatccgcctgcctcagcctcccaaagtgttgggattacaggtgtgagccaccacacccagcctttcttctggttttaaattgctttacaagatgaagactgaaaaaaaaaaaaaatacaagaaagtataggaaatcattgtttaataatcatgtaatcatgctgtcttttatgttgcaaatgtaagataggataataatgtagtacattgtctgaattaattaatgaagtgaggaatggaaaaaaatatatgacattactgaaaattatctaattgaattttaataataggattgtatgtatacctagtaagacatatatttatagaactataatcaatttgagaggatcatatctcagctacttatttaaggctaagggattcactaatggtaagaatggaaaaatcaatgaaaaatttaaaaaggccgtgtggacaagctttgcaaagatcatcagtgaggagaataggacctagtcacaaactgatgatgtctgaggagacaaagggcatgagtaactgagttgacaatggttctgagaggtaacggtaacaaaccctctttatcgtatcgaaagcaaatatctagtaagtggcttttcatatctgctaagacattatcaaatttgtgcacagcaactctgttcaattactgatctctagatgcctttatcataggcctgactcagaacctatatataaaagtaccttcaaactttagtgttctttcagatgccaagtattttacttaatccatgtgaatgaaaagatatttggactgggtatccattgagttaagctctagccttggtatttgtgaacttaggaaagactgtttacccagtcataaaattgaaaaaatcatacttggcttgcctacttcatataaattgttattaaaattaggtataatagagtgacttttaacatgccttgcaaaatggaaaatgctttgtaaaatagaataaccatttaaaattgtcatttatgtatcattctcccctaaaccgcacaaataggaaataattctatcccccaaggaaaatgttctttgtttaaaaaaaaaaaaaaaaaaaaaaaggcctcttttttccaatttcattttatctaactttaaaaacatttttaagttctagctaactttgctttttgtatgtagaccagtaaagggcacatttttcaaaatgtagtgaatgcttgtagagtaagcaggatgctaacacctcattattcaaggaatatccagatgttcagtgttaaactttgattccttacttttttcactttggtaggaaagaggaagatggagcaatagagtttgaaaattcttgcatactttatgaatgatgacattctatatgctatgacacctataaaataaagattaagggggccaggtgcagtggctcatacctgtaatcccagcactttgggaggccaaggtgggtggatcacctgaggtcaggtgttcgagaccagcctggacaacatggtgaaaccccgtctctactaaaaatacaaaaattagccaggcgcgtggcacgcgcctgtagtcccagctactcgggaggctgaggcaggagaaccgcctgaacccaggaggtggaggttgcagtgagccgagatcatgccactgcactctagcctgggagacagagcgagactccgcctcaaaaaaaataataagagccagtcacggtggctcacgcctgtaatcccagcactttgggagactgaggcgggtggatcacggggtcaggagatctagaccatcctggctaacacagtgaaaccccgtctatactaaaaatacaaaaaaaattagccggtcgtggtggcgggcgcctgtagtcccagctactcgggaggctgaggcaggagaatggcgtgaacccgggaggcggagcttgctgtgagccgagatcacgccactgcactccagcctgggcgacagagcgagactccgtctcaaaaaaaaaaaaaaaaaaaaacaacaacaacaacaacagaaacaaaacaaaacaaagaaagaaatgatcttccttccactgctccaaacttctaagacaatgtatgtgaacgctcaacacagacagaaaacctctactgatatctgcctgaggcaggcaaatcacctgaggtcaggagttcgagaccagcctggtgaacatggtgaaaacccgtctctactaaaaatacaaaaattacccaggcatggtggcacgtgccaccatgagtagtcccatgagtagtcccagctatgagtagtcccaccatgagtagtcccttgagtagtctcatgagtagtcccagctactcaagaggctgaggcaggagaatcacttgaacccaggaggcggaggttgcagtgagccaagatcctgccactgcagtccagcctgtgtgacagcatgggactccgtctcaaaaaaaaagatcaaaaatgttctgagaaaacatcaagtagacctctttggctggaagtagtgagagctgttactaagaaagagggtaaaaatcaaattctaaataattaataatattggtctaaggagtttgaacagtatttggtgggttataaattgctgaaaggcaagaaactcttgttccgtcttctccctgcttccagccaccacatggtatttgcctgagagtgatacttgctacctgccaactactgatccaagtaagtactaaagtcagaattgtttccagtattagaaaggtatgtgtgtgcacccagactcatgtgtctgatggggcaaatggttatttctttgtcttcaataatgcatttaactgttctgtggttgaatttgtaatacagttataataacttgcatttatatagtgttttaaagcttgaaaagatcttttatcttctcatgtctaaccctaaatgttctgtagcaaaaattatcatattaagttttgttttgttttgtttgagacggagtctcactctgtcgtccaggctggagtgcagtggagtggtctcggctcactacaacctctgcctccttggttcaagcagttctccctgcctcagcctcccagatagctggattacaggcgcccgtcaccactccgagctaatttttgtatttttagtagagatgggctttcaccatgtaggccaggctggtctggaactcctgacttcaggtgatccacccgccttggcctcccaaaatgctgggattacaggcctgagccaccacacccagccacatattaagtcttgcacctacttgatgttgttgaggattcatccatttcacaaatatttattggttgattactcactgtgtgccaggcactgtgtcagatagttggaacacagtggtgaacaaaaaagatacaatgcttactgtcaaggagattttactttgctaaaagagatagacattcagcaactacataagcaactatggcaggtgataaggaagagatttataatgccatgccagtcaacaacctagttacaaggactgccctccagagagaataatacttgagctgagatctgaaagatgagtaagaattaattcagggaaaaggtgaagaggaatctttacctcagcctgtttatctacaggtgtttcaaatgtttgacagtttggtaccttggcgatgatttggttagtttcttgtttatggtcttactggatttacaatcctagtggagttttaaagttggagttagaaatctctcaaattgagccaaatcctgaggacattttatgtttaaaaaaccctcttaacttttctcccccaaaagttgcttttttactattggctagggattgagtatggatatttttgaaaagctatgtcagattccgtggaaaacctaaagctctgtgaaccttgtgggagctggaatttttcagctaagaggttcgaatagatttaggtatttatccaaaccgaacttttaaaccaccagagatttgcccattactagtttacatagagcttaactacagtggtttcctctttcaacatttactttttttatttaaacagcttaatcgagagctataaaaacactggatcagtcttttcaaataaaaatgaaatgcaactgccatgcgttagtcttttagaagaagcccttctgcctgtaggcagtttaggtgttaaaatgatggctttttcaataccaaaagatctagtttttgtttgcaaggtcatatctttgaattattagtttataaaaacctggcatatcttcgaattataagtttataaaaacctggcagttcttttgattttagttacaagtgcacacgtgtgtgtgtgcacgtgtgtgtgcatgtgtgtgaaacaccaagagtcatgagatttacattattggcttgttaattaagggaagaattccataattgttttaaatcaatcacactgcacaggggacattttgcctatttgtttttctgcacatattttatatgtcattgtttatgtttgcttaaaatgccaagatgtgcttaagttagtaatgctaatattgatccaaaactctcaatttatgactgattcttcatttttttcttttgtaagtcattgctttgctttaactcttaatgttatcgggaataaggtattttaatactcatttcctttagaggaaataaaaatatcaactttctttttttattttttatttactttatttttatttttagagatgaggtctggctatgttgaccaggctgctctcaaacttctggcctcaagcagtcctcccatcttggcctctcaaagtgctggaattacaggtgtgagccaccacgcctggcctcaacttttcagtaaattaacctggaacacagaaagtcagagaaatgaaataataattccaagttatgcaaataagtacatttatgtacaaagggattgtattaggtgatcttgagcatcactttcagctctaaaaagttcttatattgccaaagctaggtagtacgttcatccttgttctgctcaaacattaaatgcttaaatgttgaattaatttcttctctgattcatcacaccagtattgatattataatattgtgacatcattcctactggtcacaaattcatctattcattcaacaaatatttatcaaaaaaaagtttatcagatacctacaatgtgccaaaccctgtttttttcagtggagattcagtgatgagaaactaaaaaaaaaaaaaaaaaaaaagaaaggcctttgagcatatattcacatatattctagtgttgtagagcatcaaaataaatatgtagtataatatcatacaatgataagtgataaggaaaataaaggtgagtaaaataattcattaaagaatgatagagacacttgtttttaaagttggccagggcaggacccctccaagggagtaacatttaggcagctgtttgaatcaagtgaggagacgatttgcgtgagtaactgagggaagagctttccatgaaggaggaacaactagtgcagaggctgtaaggaatgagcatgagtacaaacacacgtaaggtataacaggaagagcaagaccagtggctggattgcagcaagtgagggagaacgtagaaggagcaaggatagttctgatgtgaaatcatggaagacattgtataagggaaagtcattagagaattgaaaagagataatgacacaggggtgaggatgactggatgaggaagaagggaggttgtcggggtgatgaatcaagagtttggtttgagaggtgggaagtttgagacgcctattaggcatccaagtggagatgtagatatgtgagcctagagtataaggggaaggtacacattaaagacagaaatctaggagccatcgccatggaaattgtgtttaaagccattagactggttaaggtgacctaaaacacatgaacagacggagaagagagaggtccaaggactcaggtctggagtactccaacgtttaaaagtttggaagatgagaagaattttaacgaaggtgtaggggaacttaaaaggtacagcctatgtggtaggaggaagccagaaaattctgttggcctgagagccaaatgacaaaaatgtttgaagaaggatcttttgactaggctctgtgcattgattaaaaaggtattatatgtaaggcattgaacacagacagcagagaggagctagtgacttcagaaccctctaagtattttattgagaaaatgtagactcatatcatgcatctattcttttactttgttatttgttaggatagcacatgcattagatttttttcctctatcatagctgactatttccagatcaatcaaaatgtccctattaagttgtcagttacatcacagataattgccataagccattcatttcatgtttttagtatcctgtgcaataaaacgctgtgaaacactttgaacagttattcagtgaaatctcaattatctggaattctagtaagcatatatctgtttatagataaccaggattttccaaatttgagcattaaccatttgaatgctagaatatttttttaaggaaaagccttctaaagtgcattattatattgagcaccagccatgtgctaggcgttttattaggcactataactatacattcttatagcttatggacctttgtaaataggatgttccaactgttatttatttatttatttatttatttatttatttatttatttatttttgagacagagtcttgctctgtcagccaggctggagtgcagtggcacaatctcagctcactgcaacctccgcctcctgggctaaagcgattttcctgcctcagcctcctgtgtagctgggattacaagcatgtgccaccacgcccggctaatttttgtatttttagtagagacggggtttcaccatgttggccaggctggtctcgaactcctgacctcaggtaatccgcccacctaggcctcccaaagtgctaggattaccggcgtgagccactgcgcccagctccaactgttagttttttatttatttatttatttatttatttatttatttatttgagatggggactcactctgttaccccagctggagtgcaatggtatgatcacagcttactgcagcctcgacctcctgggctcaggtgatcatcccaccccaccctcctgaatagctgggactacaggcacattgctaccacgcccagctaaattttgtattttttgtaaagatggggtttcgccatgttgcccaggctggccaactgtaattcaactacatcttaatgatcttagattatcatcaattcctctcagctgctgtagagatatttatctgataatgcagtatcatatgcctagaaggctttttttctctatccttctgaaactttatttcattttttgctttaagaaggtcacataggtgctctataggcacagatgattgtttggccccttgtgtgtgaataaatgcacatatgcctctttctcatcgttttcagtcattctgtgtacatatatgtctcacagaaatactcatgcatagacacacagacacacacacacacacacatgctatacatttcagggcactatattgaagcaaatatgactattcattttcttgctcacacatacacacacatgtacacatgtctctgatgccactgaggcacctggccaagtggttaattaacctttgcacaaatatattttagaaaagttatgtggcatcaagggctacattactgttggtcctcacaacttcttaccctcaaggaattcagggatggtcaatcttctccttagaaatgactttattcggctgggcgcagtggctcacgcctgtaatgccagaactttgggaggctgagatgggtggatcacgaggtcaagagttcaataccagcctggccaagatggtgaaacctcatctctactaaaaatacaaaaattagccgggcatggtggcgggcacctgtaatcccagctacttgcgaggctgaggcagaaaattgcttgaacccgggaggcggaggttgcagtgagccaagatcacaccactgcattccagcctgggtgacagaggaagactgtctcaaaaaaaaacaacaacaaaaaaaagactttattctctgttgtcagtgtatgttaacccttttattgcatttaatttctacaggtgttagtctactattatttttgttccagtatctcatcaagtcaaataagcacagagtaagaatttcaaagctagagagggctgacaataatagaaaacagaaacatactcaatatatactcctctctcactatgaagctggggcattgcatgaccagaggagtggtactttagtaagattgctctgccaatctagtcattgcatgcagaatgaataaaaaaagggagagactgaaaacaggaaaatcagttaagagagtcaaatatttcctatgtgccgctcagtgttctgggccttcagtctcagagagtaatgaaacggatgaggtgcctgctctcatggagctaaaatttacttgggcatggaatggggtttgggattcagtgctatgttgtgctaagtgctatggaaggaaataaaaccaggttatgtgatggtgactggggagccactttaggttaggagggcctttttgtcgtggtgacgtttgagctgaggcctgaaatatagaaagattccagacatgtaaagatctagttaaaagcattttaggcagggagaatagcttgttcaaaattgtatggaaatggacataaacttagcatattcaagaaacaaaaagaaggccaatatggctggttgtgtggttaacaaaggggagattagtataagatgaaaactgagaaaaaggtagggacaaatcatgtaggtccttgttggccaggataaggagtttggagataactatactaatccaagtgttcagtaaatattattatcactattgagttgagttttaactagacagttctctaaatgagttagtcagtgtttaggaataacccatgctcacagcatcattaaatgtttactgttaattctcactgctctttctcggtttcttgcaaggcattgttgcaaaactaatttatcacatacgttcctagttggggttcttaaaagaacatttctttttctagtatgacagtacagaacatgtgtgtgtatatatgtatatgtctgtgtgtatacttgcatatactatgtctgaaaaatacttttattctgattgaccctttgtacatttctcaaataatatagtttaactacccttgagccagaaactgtgtcagatgctagagatctaatggcgaataagtcatagtacttgtcctaaagattacagtataaataatgtattcttttgatcacaagaaagcttcgtccacaactttgaaggaacaagtactggctattctcctttattattttatgcaaattattatgtttcataaggactcattgccagcatttattttgtttatggactttgaaagtaggagtttcattaactctcagtttggacagtattatctttacatgcagttagtgcagtgactgtcatcatccttattagaataccaccaggacatctggcaagatgtctaatataaagcagctatgttatctatttccaatcaaatgattctttggtgcttcgatgtcctgtaacttctccacttatgtaattctctgccataatctaatttgtaaagtggggtgggagtaaaagaaaatttagaaagaaacacagagcacaaaccctttatcctggtaaagcatctcatgtttcaatttgcagttgttttggtaaagtataaaacaagaaatatgattataaatatagtttttattttttactgtgggtaggatgttttttgactaacacatgcttttaattgcctaatctattttggctttacctttagagaaaaattactgcactttgctgcatctgtcaaaaatgacacgataattctttgagtcaaaacagggtacatgaaatgtgatttttgtttattttctgaagaatagcagaactcattttttgacacatcctttactgtggttaagactccatggcatagaacagactgcttattttgaggttgcaaagtacagctaacctacaagaataagctctctaatatcttctatcaaaccaagaaatgatctgtttcacatgcacatagaaaagaattgattttcttacacaggatgctgccacttggactgtacatagagttgatttgtaatataaattaactcaccaattatcgattgttccatctgactttgaacacattaagaatctgcaaaaagtttctgagttatcaataataagaaagctgtgtatgaaatgtaatggggtgcgtcagctggatccgagttagatattgctgtaaatgttgcttagctttgccatctgtcacatactctttttgcataatattttaatccattaaaatgtgtctttttcttttaaaaaacattagcttacttaggttacaatgaaaaccctttaagaaacagtcagtgaccactgacctttccatgtcttaagttactttgtaactgtttttgcctttgtgccccctcattaagatgaataatgacaatccttagaaacaggaaatgccaagctcccagttgcaatgctaacaagtaggaagtcccattaacttttcaacttctcagacaagaaataaatttggacatgagacattatttctgaaactacttgtcctcaggagcagtgattgaatgaactaaggacttgctttcactaagtggaatggaaaactcatgtcacagcatgtcagtttctgcttaatgaatgagatattccctggggaataaattaggcgcctcacgtacataactcttttagggtacccagacctcattgatttccttttgtagaatagtacccacgtgacttataagactcactgtacaactaaactgactgactttgaccctcatgaatagttttgtcacctgggagggtttggttagaaatggtctccaccccttaataagaaagtcagctctttgctccctgttggctcactgctctcaggccactaaatgaaaggcacttgggtgtcatttagagccatttaccaaatgaactatcttggcctgagaaagttaagcactgttgggcctggcaatttaccataatcaaagagctagagcagaaaatatgcaagatctgatttctggccaatttgtgtttttcccgtgttgctcttggcagatctctgttttgagtagcccactcttctacttctctccatgttattaatttgtaaagtgaaacaaattactgacccttgaattgtgctattacacatgcttgagtaattttatttcatttgcagagaatttcatttcatttatgtattatttatactctacctacttccgaaacaatgtgtactggcttattttaattgtaattcaaatcatctgagtatttttccaagtcctgtcctgaagaagacttgtgtcatcacacatcatttcacatttactgtgctatggtgatatattggttatgatgcaatttctctggccacctaaaaacgactgtattaacaaaacatcatgcctgcagtctaatgtaacttcttttgttgtggtgtggtctattgggaaagaacatgcaacttacagttatgtgcttagttctaccatttatgtgacctagggaaagtcatttgccacatcttgctcaagtttactcagttttaaatgtagttgttaatgcttactccccaaacctttcaaggttatggaaatcaatgcagtaaatactgcatataaaatgtctgtgaattcccatatttctccagttaacaccaggaagaataattgtcagctgaactgaaatgatcaagcagcgttcttgtattcaggcactgttcttttttttttcttttctttcttttttttttttttttttgagacagagtctcactctgttgtccaggctggagtgcagtggtgcaatctcggctcactgcaacctccgcctcccaggttccagcgattctcctgccccagcctcctgagtagctgggattacgggcactcaccaccacgcccggctaatttttgtatttttagtagagatggggtttcaccatgttggtcaagctggcctcgatctcctgaccttgtgatccacccgcatccgcctcccagagtgctgggattacaggcgtgagccaccgtgcccggcctcaggcactgttcagacaaatgagggatggagatgtgacaagagagagttcctattttgaggagccacagtgttgtggtgaaaaaggcccagcacacaaacaattataaaattcccaatgggataagtggcacaagtgaggtatgcaaaagtgtcatagctgacaggaagaggaagcaatgaactctggccaggaaaatgggaactaagtgaaaaattagggtaaaacaagataacgtgtgggaaattccttcagaaacactctgtggatactaagacacaatcttatcaatgtcatttatttaacaagcatttatgtattatttacaatttgccagacaatgttctaaatgtcttacaataggaaatcatttaatcctgttcattcaggtctgtttgctgcgaaaaggaattctagaagcactaaggaaatcctagatacagagattcctttgtcttctagtaaggaggaagcatactgggtcagttaacatccacatgtctgtgaggcaaatggttagaaaagtatataccaaaaataaatgaatgaatgaacaaactaaggaataaagacacaatgaaggagatactatttttattttttttttttttttttgagacagagtttcagtcttattgcccaggatgtagtgcaatggcactaccttgactcactgcaacctctgcctcccgagttcaagcgattctcctgcctcagcctcccgagtagctggaattacaggcatgtgccaccatgcctggctaattttgcgttttgttttgttttgttttttgaaatggagttcctctcttgttgcccaggctggagtgcagtggcgtgatctcggctcaccacaacctccgcttcccaggttcaagcaattctcctgcctcagcctcctgagtagctggcattataggcacccgccaccatgccccactaatttgtatttttaatagagacggggtttttccatgttggtcaggctggtcttgaactcccagtctcaggtgatctgcccgtctcggcctcccaaagtgctgagattacaggtgtgagccactgtgcctggcctaattttgcatttttagtagaaatagggtttctccatgttggtcaggctggtctcgaactcctgacctcaggtgatccgcccgcctcggcctcccaaagtgctgggattacaggcgtgagccaccatgctcggccttgaaggagatactattaacctcattttacatgataggaaaactgtggtacagagggactaagttgcccaaggtcacacagctactaagtggcagacctgagtttgaaccaaatgagtcaggctctagaggtggcagccttaacaaggatgctatactgcttctcccatcacccatcaacacagaagtggacatctttattgctggaatccagcactggaatcccttggtggtccttttgatctctgtttcagtacctatagaaacgacaaggacttaaccagctcttgaaacagctgactacatttttggacagttgtaattactagagagttctgaatttgagccaagatctacttttcctggaacttccacccattgatcctatgtctgctttctgacactacatagactaaaccttcttccacataactgtaaaagtattggaaaacatctcccatgcctcctgcttgaattccacattcccatgtaaaaagaaagtgacatttgagagcaattagatttcattattccattgagcatttatttatggggtgcctattgtgtgcaaattgttatacagtgtgctagcaatcgcagagaaaatgaatagcaccagattcgcatgtacaaagtatgtactctgcactaagctattccactgctacccaaaatgtgcaattatcatttaagatacaaactaatgaatagaattattgcctgcacttatttaaatcagggtttaaataagcagtgtcttgctgggtgcacctgtatacatgccttaattaccccacaggattacaaacctgtgggcagaaactgctaatacagccttgtatttcctaccacacctagcacaggttctttggcagagtaaatgagcaataaatatttttgaatgagtgagagaaatgctgtattcattaatgctgtccttcagataattgctctaaatgatgttcacatgtgatcataacaataacaaatacaattttactttgctgtttgaatttcttcaagttttgtgtgccacattaaatagcactagagaagcaaattttcccagaagaaatgtcgtagtaaaatgtttgaaagacagcaaggtaattcaacagccagaaatacagagctttatagtactgatcagtcttcaactctttttgaaaagattcactgttatcaactgagaacctctccaccaccatgtgagcccagtaaaggcattttctaggttaccatcctggggtgctcctttggtaccaattgttctaatattattattatagtggaaaatgcaacaacatcattgaacctgtaccctgacctttcagttggccttggtgtagagcatcacacagtcaaagaatcaagttcagatcagattttaatcccactacattactgtttgctctgctttttgaggagattgcaatgactatatatatatgcacacacacacacacacacacacacacacacacatgcgtacagacatacatatatacacatatatgtatacacactgtattttatatatctatggaaaatatgtatttccattctgtagtctatgaaaacttgtatgaatggggcaaggtacaatacacaataaaataataatgcccatgttaaaaacttttttttttctttaagatggagtttcgctcttgttgcccaggctggagtgcaatggcatgatcttggctcactgcaacctccacctcccgggttcaagcgattctcctgcctcagcctcccaagtagctgggactacaggcatgcaccaccacgcctggctaatttttgtatttttagtagagacggggtttcactatcttggccaggttggtctcgaactcctgacctcatgatccacccgcctcggcctcccaaagtgctgggattacaggtgtgagcccccacgcccagcctgttaaaaactttttgagtgcctatttgtgaacaagaaacctttctgctgtctcatctggcataaccttaacatcacgcatttatttgtgctacctaacataattagccatgatagaaaactttaatgtaaaagaaaagaaaagaaaactttaatgtagcatcaaatcttgaaaaatcattttaagattcagttgattattttattagccaggacctctgtgaaatgactctaggatgagaactaaaatataatggaatgggagaggttcattcattatgttagagatttggatagtgctaggcctttaattaattaacatttcattaataatctgtaaggagtaccagtaaacagcactttaattaagttcatgggtaatacattaataggtatagaaaataccaatgaagacaggaaaataattcaaatagaccagataatttataagatataggaaaataacaggaattccactggccgcatgcagttccctactcaagcaaataaaaggcagtattcactgcatacattggggtatagaaaataaacaagtacaataagtaaatatccttgttggctgagcgcagtggctcatgtgtgtaatcccagcactttgggaggccgaggcaggcagatcacctaaggttgggagttcgagaccagcctgaccaacatggagaaacccagtctgtactaaaaatacaaaattagctgggcatggtggcacatgtctgtaatcccagctactcgggaggctgaggaaggagaatcgctcaaacccgggaggtggaggttgtggtgagccaagatcgtgccattgcactccagcctgggcaacaagagcgaaactccatctcaaaaaataataataataaataataaataaatatccttgtcaacaatataatggctacaagaagcaaaaacttttgtttctggtggggcctctgaatatatttctacatatagaaatgtaagaatacaagaaatacatacaagaaatatgaataaatttttatatattttggctttatgcatcttagaaacaaaatgattgtatcatctgaatgacagggctagtaaagaacctacatttactgaatgcaaactactggccagttcctgtatttaggcatgataaatacattgtgttttctttaatcttgtctctttttataagttcagatacatgaaaattaacaaggtttcatatccattaagtggtagagcttggttttaaccccgatctttctatggtacttccaataatgatatggacgattgcatgattttatgtgtgagcacatgtgtgtaaaacaggtttggatacatttaccgtcaactaaatggtatactaatcagtgatactcagatatttttcagtaagtttcagtttaggggggatttgtacatgtaaaatggctccaggagtctgtttgactaattaggccacctggggtctcatataatagttattttaggtttccactgagtcagtacccagttatacatgttgtttgacattggtcattttaatgaatacttgagccttaggaaactttatccattatggcaataattttatatatttactcttggccttgacatcattcccaggcagaagtagaagtggtcatcatcattttccttctaatgacttaaaccaagtcatttgctgttgaaactttaacagcaaataaaactagcggtgtgtgtgtgtgtgtgtgtgtgtgtgtgtgtgtgtgtgtgtgtgtgtatagagagagagacagactggaatccgttttgtttttcctatctctaaagtgcatgaattaaaaagatactaaacatacatctttgagtttatcagttcatcaggaacacatttttgaaaaccagaaggactctggataagtacaacttgttttggttataagaaacataactagccaggcacggtggctcatgcctgtaatcccagcaatttgggaggctgaggcaggcagatcacgaggtcaggagttcaagaccagcctgggcagcatggtgaaaccctgtctctactaaaaatacaaaaattagcctggcatggtggcacgtgcctgtaatcccagctactcaggaggctgaggcaggagaattgcttgaacctgggaggcggaggttgcagtgagccgagatcaccccactgcactccagcctcggcaacagagcgagactccatctcaaaaaaaaaaaagaaaagaaacataactaaaagtcatatatcttgttggcagtgaatcagtagaatcatgtcaacatataaaggactattttttactgtcatttttcagcacaagttttttttttgttttttttttgtttttttgtttgtttttattgatcattcttgggtgtttctcgtatagggggatttggcagggtcataggacaatagtggagggaaggtcagcagataaacaagtgaacaaaagtctctggttttcctaggcaaaggaccctgtggcctaccgcagtgtttgtgtccctgggtacttgagattagggagtggtgatgactcttaacgagcatgctgccttcaagcatctgtttaacaaagcccatcttgcaccgcccttaatccaattaaccctgagtggacacagcacatgtttcagagagcaccgggttgggggtaaggtcatagatcaacagcatcccaaggcagaagaatctttcttagtacagaacaaaatggagtctcccatgtccacttctttctacacagacacagcaacaatctgatttctctatcttttccccacatttcccccttttctactcgacaaaactgccatcgtcatcatggcccgttctcaatgagctgctgggtacacctcccagacggggtggcggccgggcagaggggctcctcacttcccagaaggggcggccgggcagaggtgccccccccacctcccagacggggcggctggccgggcaggggctgcccccccaacctccctcccgggaggggcggctggcccggcgggggctgtccccccgcccacctccctcctgggtggggcagctggccgggcgggggctgccccccccacctccctcctgggtggggcggctggccaggcgggggctgcccccccttcacctcccagacggggcggctgccgggcggagacgctcctcacttcccagatggggcggctgccgggcggaggggctcctcacttctcagacggggcggctgccgggcggaggggctcctcacttctcagacggggcggctgccgggcagaggggctcctcacttctcagacggggcggccgggcggaggggctcctcacctcccaaacggggttgcggccggacagaggcgctcctcacatcccagacggggcggcggggcagaggcactccccacatctcagacgatgggcggccgggcagagacgctcctcacttcctagacgggatggcggccgggaagaggcgctcctcacttcccagactgggcagccgggcagaggggctcctcacatctcagatgatgggcggccaggcagagacgctccttgcttcccagactgggtggcggccgggcagaggctgcaatctccgcactttgggaggccaaggcaggcggctgggaggtggaggttgtagctagccgagatcacgccactgcactcagcctgggcaacattgagcactgagtgaacgagactccgtctgcaatcccggcacctcgggaggccgaggctggcagatcactcgcggttaagagctggagaccagcccggccaacacagcgaaaccccgtctccaccaaaaaaatacgaaaaccagtcaggcgtggcggcgcgtgcctgcagtcgcaggcactcggcaggctgaggcaggagaatcaggcagggaggttgcagtgagccgagatggcagcagtacagtccagcttcggctcggcatctgagggagaccgtggggagagggacagggacagggacagggagagggagagggagaacaagtttttaaaataacttttttttaatttttattttatttgagttcattcctaaaactatatgtggtagtaaatttgtaaacaaagtcaggacttattttgctaagtcaccgcagtgagttccttacataaataaggaagacacctgtttattagtcacaaagttccaaccacatcttgttttgcacttctaagagatggaatacccccaatgagtttcctttgctaagcacagagaaggaaacaatgctgatttctagactttatagctaagcaacatttatgctttcagaaatgacctcagaatcctcctcaacacagcattctaggcagcatttatcaattgctttgagttgtaatgcaagccgaaacatacttatctcctccagagtttaccacttaaatggctcatcatgaatgagaattgcctttagtcatgactcagtgtgacattaagtagtttggacataaattatttggaatatgatagatagcctttatatgagaattgtacctgatatatataaattttgctagctgcattccatagaataagagaataaggtgactagatcttcaaggtactgaagttagaaaaactgattgaaatgaaactgtaagaaatgcctaagtggtacaatctatgatcatctagaactgtttctgctagtcaatgttagatactttatcatgtgattaactgaaaatgttctttaaaaaatgccacaactaaagaggcatgtggggctgggagcggtggctcacacctgtaatcccagcactttgggaggccaaggtaggtggatcacctgaggtcaggagtttgagaccagtctggccaacatggggataaccccgtctcttctaaaaattcaaaaagtagccaggcatggtggcgtggacctctaatcccagctacttgggaggctgaggcaggagaattacttgaacccaggaggcggaggtggtagtgagcagagattgcgccactacactccagcctgggcgacagagtgaaacactgtcgcaaaaaaagaaaaaattaaaaataaaaaaaaagacactgcaacggggtgcctttcaaatattagctgaaatgctagaggaatatatcagaggagagaaagctcacccctagaagaaaatgttaggtatggcttcatagagaaggttgcattaatttcaggccttgaaagatgggtaagatggtaggcagaaactggaacagggtccacattccagctgtacagactgtatagagtttcttgagccaggataatgaatctcaaggtatgttccctgaagacctagctgagttaagagtacctggtaagtccagctaaatcctctcccaacaccccttcctactggatttgggagctatccttatgcctcccattcttaccctgttcctcaatctgaatgttgattgtcagggaacttcagtataatccacgctattacttagcccaagtgggaatagtttgtagaaatgactatagccggttgaacatttccattccaaaaatatggattaagggccatgtttctttattgttagcattctcgctctgttgccaggctggagtgcaggggcgcgatctcggctcactgtaacctctgagtccctggttcaagcgattttcctgcctaagcctccggagtagctgggattacaggcacgcgccaccacgcctagttaatttttgtatttttagtagagacagggtttcaccatgttggctagggtggtctcaatctcttgacctcgtgatccgcgtgcctcggcctcccaaagtgctgggactacaggcgtgagccaccacgcccaatcaagaagagctttttaactagagattttaaaacaaatagactttaatttttagagaagttttacatttacagaaaacatgagcacatagtacagagttcttatatcccttctctacctttcagtttccctattattaatatcttgcattagtatggtacttctgttgcagttgatgaacaaatattgatatgttaacaaaagactatagtttatatttgggttcactctatatgttatacatatatgggttttgacaaatgtatgtcatgtatccaccattatagcattatacagaatagtttactgccctaaaaatcccctatgctctaccttttaatccctccttccctccccctaacccctggcaaccactgacctttttgatgtctccataattttgccttcttcaaaatgtcatacaagttggaattctgtaaaagaagattgccttcttttacttagcaatatgcatttaaggctcttccatgtcattttgaggcttgatggttcattgcttgttattgcttaataatattccgttatctggatgcctagaaacagccatgtatttttgaaaatagctccaagacatgtttctatttggctttgcctctggcacaggttgcagcatatcagtgtagtacaatacactgttataagaatcacagacactgagataaggaagggtctgcaccactggttcttccaacagcatgtgtgtagaaggatgcgagacaggcaggctttcaggcacctgaaggacatgtctgtggtttgcagcttactgcgtgcctttaacaaagcagttcacctctctagactttggtttcttcatcttgcaaacaaagggatgtgctagatgagttctgaagtttctctgaattctgaaatttgatcatctgctctcatctccttgtttaaaagttgagaaaagaaagcctggggaaattaactgatctgaataagaggaaatagcaaattattagcattacttggactagaaatctagtctctagatttggtctagcattttttctatcatttcaacctttatgtcctgatttttcatgtaagaacttatttttcttaagaactcctgattaaactaaattgattttttaaaaaaagaaacatagattgaaagtcactgaaatttttttttgagacttttttttttttttttgagtcttgctctgtcacccacgctggagtgcagtggcgcaatctcggctcactgcaacctccacctcccgagagtggggcgattcttctgcctcagcctcctgagtagctgggattacaggtgcccaccaccatacctggctaatttttgtatttttggtagagacgggatttcaccatgttggccaggctggtcttgaactcttgacttcaagtgatccaccagccttgacctcccaaaacatgaatctttttttttttaatttgagctttgactgcatagaaaatgtccatccagtctctgtttctaaaacatgaaattctttaacgttcttaaggcaaacaatttttgtaaaacttttcaccactgatggggttgctcccccttaccacaccagatttaagaggatagtgaatatttatgtctataatagcatgtgaagaatgtggctggtgaaaataagtggaagaatatacatctcgggctgtttcttcagtttccgggcaggctgcaacacttttaacactgctagtgagaagaaaggtgagagagttagctttcctcttggcttggttgcagttaaagtggattcccgaatctcccattttctacattataaatattgagagggacataaatatagatatatggatatgtttgtttgtttttctccctcctgtacttaacaagtgtaaaatcctggaattttctttttccttacttatcacaagttttcttagtctcaatcctttgtagtatttaaccttttagataggagaggtaaataagcccacaccagataagagttacatcacagtagctataattaaggaccggcatggagacatttttaataatagacttgcagccgggcgcggtggctcacgcctgtaatcctagcactttgggaggccgaggtgggtggatcacgaggtcaggagatagagagcatcctggctaacacggtgaaacctcgtctctactaaaaatacaaaaaaaaaattagcccaccgtggtggcgggtgcctgtggtcccaactactcgggaagctgaggcagaagaacgaacccgggaagtggagcttgcagtgagccgagatcgtgccactgcactccagcctgggagacagcgagtctccgtctcaaaataataataataataatgaaataatagacttgctaaatctgaggttaaagtgaacatttttaataatcagtcaaggttaaaatatttgtttaatatggtagtcaatgaaaaaatgttctaaatgaaaacctggtactaaaattattatgtcttcaggttgcctagagaagctggtgaggcactagatattacactgtttctcctctttggaatcatatagttttgatttaattaacagagaaagtctgcatatacaataggggatagagtgtggattttacttctttaatggtttgacaagcagattgcaacaaacaaggtatttggaagcctgctagggtcccagaggccttataaatatgcagtgcacttctctgcatttccccgggtccctgaggtagagatttgatgaataaaattaaaaccaccagatctttttgtatagcttttagctatcactaatttaaactgagtaatgactattttacaggtataccttcagcagtttaaaaagcaaaggaagtgaaatgtgaatgtgttttgactttgtattaatttcctcttaaactgaaagattttctactttttgcatcatgatacgttttctttaaacctaatttcaagagtaaaactctttacgcccctgtaggattgttttatatttaatagtgctattgagactggcatgggacaaaacatgcagacaaagaaagtatttcttgaaaagtgatgtgtatttatatataaacacaacgttggaatagcatactccatttggaacaaggtctttagaattagattttaatagattaaaactcttcttatttactgtatttgtagctcttaatgattgaatagatctctgtggttccttttcaaggatttcttgaaacatactgaaattcatgggtagatcatttaaggctcctgcgccctttaatatattacctagaaatggtagaatattttagaacacatacaaagaaggaggccgggcgcagtggctcacacctgtaatcccagcactttgggaggccgaggtgggtggatcacgaggtcaggagatcgagaccatcctggctaacatggtgaaatcccgtctctactaaaaatacaaaaaattagccgggcgtggcaacggccgcctgtagtcccagctactcgggaggctgaggcaggagaatcgcttgaacccaggaggcggaggttgcagtgagccaagaccgcaccactgcactccagcctgggcaacaaagtgagactccgtctcaaaaaaaaaaaaaacacatacgcaaaaggttaaggtaaaacacaattcattgtatatacatttgcaacaaagttcattaaagtctggggaaaaattgtataatgtaaagctccttagcttgatgtataatgaaaaaatgtagatattacgttaataataaatagcgtgaataatattggcactgggtatacacttactgaaaaggctgggcttttctaatgttaatcctgaggaagaggagagtctcttgcttaaaagtcaacactggtatgttgctttcaagaaaaaaagaaaaaaaaagcattgatgagggtatgaaatttatttactaagtattcagttgtgaagtttgaggagtggaaaaactaatttgtcaaattataccctcagagttcaacagtaaactagatgaagtctcccaggcttataactagcagaaggcacctatgttttgtctttgtgtgcctatggcttcacagcggcaactgaatctcacccagaagtgctaagttgtaattcccagtagccacttttagtgctttttgttttgcgttgttttgttttgtttgagacggagtttcgcactgtcgcttgggctggagtgcagtggcgcgaaattggctcactgcaacctcggctcactgcaacctccgccacccaggttcaagcgattctcctgcctcagcctcccgagtagctgggattacaggcacctgccaccacgcccagctaattttttgtatttttcatagagatggggttttaccatgttggccaggctggtctcgaacccctgacctcatgattcgcctgccttggcctcccaaagtgctgggattacaggcatgagccaccatgcctggcctttagtgcattttttaaagaatgtatccaaataacagacaattgaattaagaaaagcacattgtcatctttaatcctttccatttatttgcctcttgatagatgacctttatatttttgctttttgacaatttctacctgaggcatgatgtaactaaaatttctaacatgatagtggtagttctctggattaatttatgctcatggttttgctttgtttctcccttaccaaaatgctcttttcagtattacacaagaaaaagatcatgatttgcatcatgatgtacatagcaaatttcatgtatgatcgtgtttcctgttccatcacatttctggcattttttttaacccactgggacattaggatgtcataacataattggatgttagacataggttgagaaatcaagggtagtggtagatggaggctgacagacaccttccagatccactttagaggtactgagtattcctaaaccagttatgtaatttgcatgtggtcatatagctagttggtggccaaatcagggatacaacatgtatgtgagtatcattctatcatctatctatctacttattgacagataagaatatacttgctttgtgtaaatgattaccctttgattttgtggttgtcacaaacacatgaaactattcatggatggacctacctgtctgatgatggtggtagtgatgatgatgatgatgttatcctaggatataaccactattctttaacccttgaaactgaggtgcataaggtacaataattcgcccaagctcacatagataacaagtttgcagggctagaaatcttactgagtttcatctgaaatgcagactttcagagagagagagagaggatgcttagtgtgccatatcttacgtctaacaatggctaatgaatctttaaagagaggactactccctagacatgagcgtgttaggactctgttcccatttctacacatttatgcttatatgagggccattgattggccaattttagcatttctttgtactcgtgggatgatatttaaaatatttaacaactgccaggcacggtggctcacgcctgtaatcccagcactttgggaggccaaggcgggcggaacacctgaggtcgggagtttgagaccagcctgaccaacatggagaaaccctgtctctactaaaaatacaaaattagccagatgtggtggcccatgcctgtaattccagctactcggaaggctgaggcaggagaatcacttgaacctgggaggtggaggttgcagtgagtcgagatcgcaccattgcactccagcctgggctacaagagtgaaactccatctcaaaaaaaataataaaataaaataaaatatttaacaactaatatgtcatgagcattgaccaatcaaaatagatgcaatcgtaggctgaactggagtctaagaggcccttgctttgccaggtaccttttagctaacaggtcacgagtatgtctggggagttctgggatgaggggctagtgcagctaggacagaagttatttaccaacttgtatgaaaatatttttttagtattttaataaccaatgcagctatcctaatgtaatctgactaaatattagcacagcatcttgcccagcaagccaagacaacagtggttgttgtgatgttcataaggacatctcttcttggtgtttatgcatgcaatacatgagagttacaagattcctgggctaggcacagtggcccatgcctgtaatcccagcactttgggaggctgaggtgggtggatcacctgaggtcggaagttcgagaccagcctgaccaacatggagaaaccctgtctttactaaaattacaaaattagccgagcatagtggtgcatgcctgtaatcccagctactcgggaggctaaggtaagagaatcgcttgaacccgggaggcggaggttgtggtgagccgagatcgcgccattgtacttcagcgtgggcaacaagactaaagctccgtctcaaaaaaaaaaaaaaaacaaagagttacaagattcccgataagtgaatgaacatgttattgagtcatggtgcaaaggcaaactatatgcatcaggcacatttttttctctcgccagcctcccaggaagttctcaaattgtgaatatttggagttagagagagagagagaatgcttagtgtgccatatcttacttgtgtatctatctcttttctaagctatgaatacctagaaggcaagggctataacctcatttctatcccagtcccctagcacagtatgtggcacagagcactcaatagttattgaacaaataaaagcattcaaccccactgatgaaaagccattctatttgtaatctagagacataaattaaagatatcagtttcctaatcttgcagaagtcattaacctagctgcaagattacttctttataaaacaatgaaaaacagtacagtgtcaccattacaccaagtgtgaggccaactggaaaatgtttataacaatcagatttgcaatgaaagaaacctggaagcaaacccagttatttgaatgaattattccccttccacctttcttgtattttatgcataatgacatgaacctttcaaattcagctttctagaatgcctgtaagattcagttatggggccgggcgcggtggctcatgcctgtaatcccagcactttgggaggctgaggcgggtggatcatgaggtcaggagttcaagaccagcctgaccaacatggtgaaaccccgtctctactaaaaatacaaaaaaaaaaaaaaaaaaaaaaaagattcagttatggtcaggctggcagtctgtataattgtttcaaatgctatgttgcatctttttgcaatagtacatcaatatgtcaggatggatactacaaacttggttattgctataatcctgaacttttaacctatatgtaggatgagcataacccgtagactaggatcaatacacaattgtgtctcctgttactttttttttttgaaacggagtctcactctgttgcccaggctggagtgcagtggcagtgatcttggctcactgcaacctccgcttcctgggttcaagtggttctcccacctcggcctcccgagtagctgggactacaggtgtgtgccaccatgcccagctaatttttgtatttttagtagagacgaggttttaccatgttggccaggctggtctcaaactcctgaccttaagtgatctgcctgccttggcctcccaaagtgctgggattacaggcgtgagccactgtgcccagcctcctgttacttctttaatatttattttgtggggattaccttgtcctacacctagatgaaaatctaggccgtttccatgacttttctgcttgcttttaggtctctaaagtttctgtgagttgctaatacaatctcagcccagaaactttttttttttttttttgagatggagtctggttctgtcgcccaggctggagtgcagtggtgcgatctcggctcactgcaacttctgcctcccgggttcaagcaattctcccgcctcagcctcccaagtaggattacaggtgggattacaggcacacaccaccatgcccagttaatttttgtatttttttagtagatacggggttttaccatgttggccacgctggtctcaaacttctgaccttgtgatctgcccgcctcagcctcccaaagtgctgggattacaggcatgagccaccgcgcctggcccagaaactattaatagaatgctaccctctagcatgctagcaatagtagcaatctaaactctcgggttttaagttaaaagtaaactgttttctgcttccaagctgggctgttgcaatgctagagggggcaaggtacttttctgctttgagaccctcctctgcaattcccttaatgtgggtaatatatttccttcagcttgccacttgcatgttgtcccagtcttctcagagctccatgccacacatattttaacaaggattctctggcggagtacgcctgaactcccagatgttcctcttggataggactgaaatacgggcacctctcactcccacgtggctcacttctagtccatggaaaacactcatgcaggtctttgccctgaaaaactctgagactacagagatcgaatcctgtctgtataccactggcatggggcaccttggcctcttcaggaatgacccagatacccctcttctgggtcccgcaacttcaaggaacacattccttttctgaatagcctgatcaatgtcccttcacttcgctcaacttgaagaatgtagcatctctgtccacatacttggcagtggggtaaggagcaagatggagcaggtgttatcatggcaacaacttcttccaaagaatgtctttcaaaatcctcttttcctccactacatttaccctttcatatttgtgaaatggatgagcaagcttccaacaaagggaatatgagaattataaaaatgattttaagaattttttggagcctggacaacatggtgaaaccccgtctctactaaaaggacaaaaattagctgggtgtggccatgcgtgcctgtaatcccggctatttattctctggcataaaaatcacttgaacctggaggcagaggttgcagtgagccaagatcatgccaccgaactccagcctgggcaacagagtgaaactccgtcgggaaaaaaaaaaaaatttgttttggggaaaattctgcatatggaaatctgtcttatacacacttttctatgtactgtttagctgatacacgtttttctatctactgtttatctgatattgccaatcactgaaaaatgcgaagagtcaaattttaatatctagttacacacaggtatgcttttgttttgttttatacctggaatgctttatatatcagtaggctatataaaattgtcaaaggcatttatgtactttgtagtgattttaggtatgggtgttgggtgctttcatttgtcaccacaaacaaacatattaccacagagtttagatgacacagtattagagtatggaatcaagctcttgtcttttgaagttgatgttgtgacctgtgtaaaaagaagttttaaaagtcaattatttaaaaaaaaaaaaaaaaagtaaagaaaagaaagaaaccagcctggccaacttggtgaaccctgtctctactgaaaataccaaaattggccgggcctagtatgcacctttaatcccagctactcgggaggctgaggcaggagaatcacttgaacccaggaggcagaggttgcagtgagccaagatcgcaccactgcaccccagcctgggtaacagagtgagactctgtctcaaaaaaaaaaaaaaaaaaaaaaaaaaaattaatgccttcacaaagacaaatatcttgtttatggtgaggaagacttaaaagcaaatctggattttctgtttgactgaaagagtctagatacaggattttagaacgatggtgattttggagtattatctgtgcagcaaaggaggaaaaacaaaacacatacaaatgaaaagtgcttctagatgatgctgagggcttggctgaggttggtgagtataaattagtattgttgctactttataattctgtgatttccttcagtatcctgcagtcaccctagtataacagcagagatagtacttgaagtatttggtccagagttagagctttacttggcagacgtggaagcagtaaggttaaaggaaattgacagggctagtaattatataatttaaatgatgaactgtggggccatgctaaattgtgaaggaagggaggccaggaatcaactaatagatggcttaaatgaaaagatttctgcaggccggtcgcagtggctcacacctgtaatcctagcactttgggaggccaaggtgggtggatcacgaggtcaggagttcgagaacagcctggccaacatggtgaaccccatctctactaaaagtacaaaaattagctgggtgtggtggcacatgcctatagtctcagctacttgggaggctgaggcaggagaatcgcttgaacctgggaggcacaggttgcagtgagctgagatcacaccattgcactccagcctgggtgacagcgcgagactctgtctcaaaaaaaaaaaaaaaaacaccgattcactctaagagcactttctcataaccttggaaagccagccaattagaactggttaagctcctcatttgtcctccttgattacctagctccctcatgaacttaacgtgtcatatatttcaggtgccccattttaaattttattgtgagcaacattccttctcttgtaacaactttattttcttagttaactaatgttttaatattgatgaattcttcccgtgtattttctaaactcaccaatttgtttttgtccagggtgttgctgcttctatggttattttgaaggtgctttttgctcaaatgagttatggactctatcaaccaaatacgggatttttgagacagaaatctgacattcagcaagggtacagaaatcttgctctctaaattgatgttaaaacataacatgtccataattaatgtattataacatttgtctataatcttcccaggtgttgaaatggtagtttcatactgcttgcctttcaacatatatggacattgtttaatccattcagaaattcagaaatattcaagataaatcacaaatacaaaacatgctgtaatgccactaatcttttctattagatttgctttaaatggtgtcatgtttatgtcttcatttacattgtccatttaataggcttccccagcagtcctgctctggtaattagctggcttatttatacctcaacaccttgagctgctacatctcatttaacttactgctctttaaagttcttgtatctcagtggttctcaaccctcaatacacattagaatcatctggggaacttttaaaaaatactgatgcctggacaccatcccagatcaattaaatcagaatctgaaagttgtagctctgagaaccatgggttcctaacctttgaccaatgccactgcaaacactgtgcttaaggtgaggttgaagcagtaaaaacaacaatccaatttttttttttttttggtttgttttttgacccagggtcttgctctgtcgcccaggctgtagtgcagtggtgtaatttctgctcactgtaacctctgcctcctgggttcaagcgattctcctgcctcagcctcccgagtagctgggactacacgcgtgtgccagcacacctggctaacttttggcatttttagtagagacagctttttgccatgttggccaggccagcctcaagtgagctgtctgccttggcctcccaaagtgctgggattacaggcatgagccaccgcatccagccagcaatccactgcttgacctcatcccttccactcttattttccttcccttggcagtaatttaaatatatatatatatatatatataattagatatcatcacattcatgggttatcaaaacttagtatttctccaccaaccctaaaatgccattggaaaatgcaatagaattctggaagtaagattgtatttgaaaattataaaagagatccatttgctttgctttcattttattgtaatgcaaagagaaacagagcaaggagactatcagcaaagacaaaggagattgaaagagcataagacatttaggaagctaaaggttgtttagcataattgagccttagaatagtttccaagggaacagggcgggcaaagctggagaggtaagcatgatccacattctgagggactttggatctcatttcaaggggtttcatcatgactggttacataacttgtgtggccacaaaaagtatgtagccagtacaatatgaaaatgtggggcccttgttaaaaatcattgagaatttcaagatgtcagcataagagtattaaaccatgcacagggctcttctaaacattggcctgtgtgtgactgcacaggacttatgcccaggaagttggccctgggtttaattatatcctgagggtgatgtgggacctaaaagatttaggcagtgacttgaggtcattgtaaagattgttctgaccttggttggaaaatggattgttggacccagagaacaaggttctacaatggctttaagaaagctagtgtatctgtcttggccgggctggtcacgcctgtaatcccaacacactgggaggccgaggcaggtgtatcacttgaggttgggagcttgagaccagcctggccaacgtggtgaaaccctgtctctactaaaatacaaaaaaagaaaaaaattagccaggagtggtggcaggtgcctgtaatcccagctactgtagaggctgagacaggagaattgcttgaacccttgaacccggcaggcagaggttgcagtgagccaagaccatgccactgactccagcctgggtaacagagccaggctctgtcaaaaaaaaaacaaaaaagctgggtgctgtggctcatgcctgtaatcccagccctttgggaggccgaggcgggcagatcacctgaggtcaggagtttgagaccagcctggccaacatggtgaaaccccgtctctactaaaaaatacaaaaaaattatccaggcatgttggcacgtgcccataatcccagctacttggtggctgaggcaggagaattgcttgaacctgggaggtagaggagacagaggttgtggtgagccgagatcgcaccactgcattccagcctgggcaacaagagcaaaaactctgtctcaaaaaaataaaaataaattttaaaaagctagtgtgtctatctccatattttttctgtgaattttaactattgtgatggtaatattagtgataggaccaggaatagcttctactaatacaacaagtaaacaaagtaaacacttttttttttttgagacagagtctcactctgttgccaggctggagtgcagtggcgcgttctgggctcactgcaacctccgcctcctggtttcaagcgattctcccacctcagcctcccaagtagctgagattacaggcacccgccacatctcccggctaatttttgtttttgtattttagtagagatggggtttcaccatgttggtcaggctggtctcgaacgcatgacctcaggtgattcccccacctcagcctcccaaagtgctggaattacaggcatgagccaccgggcccagcaagtaaacactttcatatacaatactgtcatttgatccttcaactatctggttgtcaggcaaggcatatgttattatccttagtttacagataaggaaacagttaagtcacttgccaaaaattacatgactagtgattgatgtatacaggatttgaatcagcccttctgacatttacactactgatatttctgctctattaatactgctagttttattagctacttatagaagcaattttttttttttttttttgagacagagtcttgctctgtcacccaggctggagtgcagtggatcctcctgcctcagcctcctgaataggtgggaccacaggtgcatgacaccacaccaggctaattttttaatctttatttttgtagaaacagggtcttgccatgttgcccaggctggtctagaactcctgggctcaagcagtcctcctgtgtcaccctcctaatatagaagcaatttttaaaacatccatttgtacagtatttagtagattttattaaattgtaactgaagttattgtctactgtgttttcaaagcctctcattacagagatccacatgatgaaatttgtactaccagaaagatctttatgtagaaagatgtctgttttcttttaatcagatgttaaaaattatgttacatgcatcactcttttagcctagctgccagagaacctatgtgccaatttaatacccaatttttttttttttttttgagacggagtctcactctgtcaccaggctggagtgcagtggggcgatcttggctcactgcaacctccgcctcctgggttcaagcgattcccctgcctcagcctcccgagtagctgggactacagggatgtgccaccatgcccggctaatttttaatatccaatttttaaaactagctcatacagctcctcaactcactcaagagcatgtctactattgttatcgttgataatgctattttcacattatatttaactttcttatattaaatgttataagttgcttcaaatatatttggaagcggtcaggatataaattcttaataaactaaataatagccatttggaaatttatgcaaaagaaaaaagcagtgtttaaatggctgagcaatagtataacagacttacccactcaagcttattaaagccagaattaactgacaagtcagataagcattccctaattaaatgaaagaggagaatgaataataacatgaaagtgaaaaaggatgtgtgagcctacaaaagacttaggccaacaaatctactcttagagattttctaatgtcactataaattctagtacctctgtgtcctactcaatatctctcgtgtttttatcgtcttccatgcttaggtcttgtttttattttaggcctgtctttgttgatatttctttcttttttttttttttttttttttttttgagacggagtctagctctgtcgccagtctggagtgcagtggcacaatatcttggctcactgcaacctccgcctcccaggttcaggccattctcctgcctcagcctcccgagtagctgggattacaggcatgcaccaccaggcccagctaatttttgtatttttagtggagacggggtttcaccatgttggccaggatggtctctgtctcctgacctcgtaatctgcccaccttggcctcccaaagtgttgggattacaggcgtgagccactgcccccggtctttgttgacatttctttattattattttgtgtatgtcatgactagggatttagatatttgaaggccttgtcttttataatagatataacaagtaaatttaggaactttatattttataaatagttgattatttttatagactcactatgtttagattgttttaggtgtttatttctttttgtaatttaagcacttagacttagttacactccagggaaaaacaacattcttttaatagtcttggtttcacattttcttgattctcttgtctatctttgtttgttcctaatttgtacataaatagtgattaaagttcagagtggctactgcaaaagataatgtttgaatttcaaaacttaccttatttcttttatgatattaatatgttcgaagtatcaagtaaaattttagcatttgagaccatgtggaatataagcttctatgtataggggagatcttataaaaacagcttgaaggaaggtgttcagcagaatttattggctggattgaatatctagtccaccattcacccctatatttgaatggattccttgccttcttatcctgggtaggttcgtagtttatcttgtcacatgccagccgttgttgtccaccctggacttcgcctcttaagtaatagacagcccctgactttcacccataaattatctgatggtgactggtttgcctccttggttttctttcactgcccagtgccagcctatctaagcaagatctctataaagataacatccttatttattaggactggaaagtaatttagaaacattccagttcgttggtcttaatttatggatgagaaaactgagacccagaaagaggaagtgacttacatctgtattgaataacattttgtaacatattggaatccaaacatgcagattatttctatagcactttgtctagtttttttaagaaattatatttctctttgagttattcaagttatatttgtgcatattagttacaggaggcagattagtctttcttactttatttcacacagatgattataggaatgtagagcatccacaagaaaaaaatcaatagcacttaatataacaatttagatatatcatactctattgaactttgaagctatttgttatacactatcatcatcatatttttttctcttaaacatatgtaggtcataaaattgaattgtaaaattgcgagtaatttttataatttagcaaatattcaactaatatttacggagttccaggtatgtgacattacatttgtgttttctttacgccatcactacttgatcttgcttttgtgtacgaaacacttcatctgcttttataattttcctctattttaccttctttcttcatttcccttggctgtcttcactagtcccaaaactttaatcaacgctttaacatgcaggactattagctttatgtctcccttttttgctcactctttgacacaccagccctaatcttctaaccattaactccatgtttctacctagatatagatccttaacccccgaactcagtatatttactaataaactcattcatcttcctctggaatctatttcttttaatgttaccatcactttccttagttatacaggtttatcactggtggttttcttgataccactctctcttgcctcccacatccattcaataattatcatttttaccatttgtttagcatttaccatgagcttttggaattcaaatattatcttttgcagtagccactttgaacttttgtcactattcacgtatgaattaggaacaaacaaaggtagacaagagaatcatgaaaatgtgaaaccaatactattaaaacaatgttgcttttccctggagtgtaattaagtctaagtgcttaaattacgacaatgaaataaacacctaaaacaatctaaacatagtgattctataaaaataatcaaatatgtgccaggcctttaacatttcatcctcagaactatcctatgagttaggagttactatggtctccattttacagttggatcaactgaggcacagagaaattagggaccttcctaaattcagaagactagtaaacagaagagttaagattcaaatctacacaatctgactctatagttaaggctcttaatcactgcattcagttgcttgctaaattaatacatgctgtattttcttcttttttttttttttgagatggagtttcacttttgtcgcctatgctggagtgcaatggcctaatctcagctcactgcaacctccgcctctcaggttcaagctattctcctgcctcagcctcctgagtagctgggattacaggcgtgcaccaccatgcccagctaatttttgtatttttagtagagacagggcttcaccacgttggccaggctggtctcgaactcctaacttcaggtcatctgcccacttcaacctcccagagtgctgggattacagggttgagccaccatacgcagccatattttcttcttttacaatgtatttgttcccatctagtcactttctattattaccttggcacaagctctcattacttcttgccagaactattgcagtagtagtctagccagttcccccgtctctacctccctccagtccatttcatatactttcctgagataaatctttcccaagcatggctaggtgtatttagctgtccttagcctagagaaaaatggagtggctccaaactaattaggcccttgaataatataggaattttccctactacccttcatttatcttgtgatctaagcaaacttaattacttcctgaaacaccattctctttatgtattaatttatctatgcctgaagttgtcagctttatgttcttatttatgtatattattttataattatccatattatacattatcctgtgtacatgtatctctgggacatatagctattgtatatgtgtattgcttgttttccctctgagatctttaaattctctcacatgtaagcatatgttgttgatgtattctgaaaatgttttttatgtgtcattggcgtgattgtgattttacaccataatttcccaatgtttatgtaaacattataggaactctgtatttgaatatgaaactctttatgccattagggcatttgccccatctataccttttctggttcctattttaaccagggacatgaatttgtagcctggccagctatagttataggtattggctacagaacttttttttttttttttttgagacggagttttgctcttgttgcccaggctggagtgcagtggcatgatcgcggctcaccgcaacctctgcctttcgggttcaagcgattctcctgcctcaggctcccaagtagctgggattacaggcatgcgccaccacgcccggctaattttgtatttttagtagagatagggtttctccatgttggtcaggctggtctcgaactcccgacctcaggtgatctgcccacctcagcctcccaaagtgctgggattacaggtgtgagccaccaggcctggcctttttttttttttttttttttttttttttttttttaaacaaaactaactggctcttacaagaatcagactcatgaccttggcctcattagcactatgagctaaccaagtctgacatatagaaattacacaagcgacaactcataagagaaaccagaactgtaagatggccttttggaaataattttcttaaagagcatatccaaatggagaccttcatttagcagcttataacaaattcttgatcgcagagttgcttcattttaagagtgaaaaacaatataacaatagcagtagaaattgaaagcagggaagttttcctgacatattgttttctttcttgtataatgtagatttatttagaacaggggctctaaccacctgtcagtaatatgtttctgtcaattttcctgtagatttttattcatggaaatagcactggtggcaaacatgagctagtgagtgaaagtatcctacacaattccccaaacgcctctgccagtttattttagtgttaatttttagtgcactttttttttttttttttttcagtgtggttggagcaaaacagagattaagagaaaattgctatggttctactggtttggataaatgggacaggtgccaacaattaccactggtgtgacttttccccccaatataagcattactattatgactattttgtttcctccttttacaaaatgccaggtggaatttatagagttcttattgtgaaaactaagacctattcctgattcttttctgaatttcatgactttgggaatatcctttagtttatatactacagttaccccctccataatatggggataccatggtgttaagattgatgtaagaattaatgtgtttaccagtcagtcttctagccaaacaaaaataagacacatttgcacagctttagttgtcagagaggtctggagcaattgttacatcctatatatacttctgcttgtgattttgagggcttagggtatgttgcttcaatcatatttataactaatgctgtatttttttactatttctgattgctaccttaactaaattaattttttcctcataccctgatactaggcatttggaatttagtaagtagctgaaatttgaataaatagcaaaaacggtataagtttttcaggttttttttttttttttttgagctggctagaacagacacatggattgaacatgatatctgacattgttgataatataatgagtaatatcaaggaacggtgaaggaagtgttgtagtttctaattttttcaatatggaagtgaatctactctatgataagtgcaacacagcttatctaatgctacttaaattgaaaaaaaaatgagagttccatgataagatttaaaaagtcatgtttgcaaaactcatttgaatagtcagaagtatagaaagtcgtcattaggcagctcttcatatatttgttactaaatcatctatgcagttacagattttatatatgtgtttttttcacatttaccattaagggactcttagtcctttttttttttttttttttattgaaacggagtctcactgtgttacccaggctggggtgtagtggcgcgatcttggctcactgcaagctccgcctcccgggttcacgcctttctcctaccccagcctcccaagtagctgggactacaggtgtccaccaccacgcccagctaatttttttttgtattttttagtagagacggggtttcaccgtgtcagcctgaatcgtctcgatctactgacctcgtgatccgcccgcctccgcctcccaaagtgctgggattacaggcgtgagccaccgtgcccagcctcttagtccttttcttacctgtgtgagtttatcagtgctacacaaaccaggaagaatgttaatttgctggctgcctcccttgagctgtttaccacgtttttgaggcagaatagaaaaggaaaggaacttaattgagtgtaataaactttaaaaaatctttccaggccaattgagcagtcatttcattacttttaagacaagcagggaatgatctataaagagggaaaataagaggaactagctgtgaggactaaatgaaacaaagacataaagagtacagcatagtataaagcacatggtatcctctaaatagtaataataatggttattggtaaggccttgaactaaattatgcttgaactaaatatacccaaaaacataacaattcagatttaaaaatgatgaattgcccagtgacgtttaccatcaacccctatggataagatgtttcattttagagagtgcttggtagaaaatgctagatggaaaagtcagaggattctttgttacagactacatagcttgaaatttatcttgtaataatgcattaatggaaaaataggaagacctcaatcatagattcaacttttagcactgggtgcaatgtccctcatttttgagatactgcgagattcagatgatttgcccaaggtcataccatttgttagtgaccaaagaagatcttgaacctcagacatctgatataaagttattccagtgttctttttattttaacaacctgacatcaggatggatattataaaaatagcgccaaatgtcagtctaaagcaaaatatttttgtatttcaataaaaaaatgaaaattatacattggatgaaatgtatatgactaaagtaaacaggcttttgaaatttaaatcaaggctctttcatagaatctgcataataaatgccatttatagttaatttattctatatgtcatatatttaaaatgcattcaaaatcaaatatcaagactaaattgtactccagttgaaaatccatgacaattttctctttgtctaaatcctagctgatatttgtttattgcacccctttcttttagaataatagaagcttgagaactatgcttggtaatataacaagaaagcatgattatagatataaatgatgtaacaagaattctattcccagttgtgcgttgtaagactgacaaacattggattaatgttgaataggtcatttgcaattctatgctgtttgtagagaaatcatattttgctattcttaggaacttacatatgagtttgttttggaggttttctgaaacatgaaagacataaaaaagacagacttttcctgtagcaattcatggaatacgttgtacattgttcttcctaaactacgtaactctctatgtgaataagacatcatatcctacaagccttacaaactttgactgtccctggacctcttgtgagaataaattaaagatgtcatgtctcatatattttgttatcagtgaggaaaaagaaataacattttctttttcatattttggtagagagtgcatatgattgatagtgaaatacatgcctatagtaactatttgtagttatatatagatggaacaattcagtgacgctttccaactttatcaggacctaagacttttacctttccaagtccaaagtgactaactgtaactctactagtaatttttttaaaaagcttatttaaaaaaaaaaaaaaaaacaagaagaatgtctccggccgggcgcggtggctcacgcctgtaatcccagcactttgggaggccgaggcgggcggatcacaaggtcaggagattgagaccatcctggctaacacggtgaaaccccgtctctactaaaaatacaaaaaattagccgggcatggtggcgggcgcctgtagtcccagctacttgggaggctgaggcaggagaatggcgtgaacccgggaggcggaggttgctgtgagccgagatcacgccactgcactccagcctgggccacagagcaagactccgtcttaaaaaaaaaaaaaaaaaaaaaaaaaaaaaaaaaagaagaagaagaatgtctccatagttattcataacaattgtgaaaatttaagtaattggccgggcgcagtggctcacgcctgtaatcccagcactttgggaggccgaggtgggcggattacaaagtcaggagatcgacatcgcgccactgcactccagcgtaggccacagagcgagactccgtctcaaaaaaaaaaaaaaaaaaaaagaaaatttaagtaattggatgagttgttttcgtataaattggatgtatacgtttgatgtcctcattgtgttcagcaagctaagatgtatatgtacagttaaacatgagtcatgccctctatgatgagtttaaacatttaaaccaaatatttgttacatatgatacattaagtacaaatgttttttatctatggtaccttaatttatataacatatcttaggttataaactgtttgtttataacaacaaataaagcgaagtattcaaaatggcttgtagcaaggtgctgagacatgtgaaggagtgccagattgttcttgataatttacttcccacctctgactcacttttacatggtcagctttcagagaataagcacaaagatgttagcaaaattaagggcactttaaagtttttgttgagatgtttttaagtcttaaacaaaatttcaaatccagagatttgtgggaccaaaatgatgaattaaaagagaaggattcagtgtattttctgaaaaattattcattacctatagctgatacgaccagtgccagccatgaattacctagtccccatgcattgacagctgatttacattcttgcgccagctccttatctcatagtagatcaggcgtttgagtagcatagcattagcttatctgtttttttaagatcaatagaactcaacaaaggacgatagaactgtataccccagtcaataagttagacacttattaaaccttttataaaagtattggatatggccgagcacagtggctcacgcctgtaatcccagcactttgggaggccgaggcgggcagatcacaaggtcaagagatcgagaacatcctggtcaacatggtgaaaccccatctctactaaaaatacaaaaattagctaggcatggtggtgcgtgcctgtagtcccagctattcaggaggttgaagcaggagaatcacttgaacccgggaggcagaggttgcagtgagctgagatcgcaccactgcactccagcctgacgatagagcaagactccatctcaaaaaaaaaaaaaaaaaaaaaagtattggacactcagccaggcatggtggctcacacctgtaatcccagcactttgggaggccgaggtgggcggatcacctgagggcaggagctcaagaccaacctggccaatatggtgaaaccctgtctctacttaaaaatacaaaaaattagccgggtgtggtggtgcatgcctgtaatcctagctacccaggaggctgaggcaggagaattgcttgaacttgggaggcagaggttgcagtgagatgagactgtgccattgcactccagcctgggcagcaagagcaaaactctatctccaaaaaataaaaattaaaaaataaaataaaataaaatagtattggacactcatcctctgaggaggcagtgtaactgggtgagaaaaaactctcttatatatcctttaggtacagctctgatttctgatgataagcttgctataaaacaatctattaaaaatgattctggctgggcatggtggctcatgtcccaaagtcatcccagcactttgggagactgaggcaggcagatcatctgaggtcaggagttcaagaccagcctggccaacatggtgaaacccgtctctaccaaaaatacaaaaattagccgggcgcggtgtcgtgcgcctatagtcacagctacttgggtggctgaggcatgagaatcgcttgaacccaggaggcggaggttgcagtgagccgagatcgcgccactgcactccagcctaggggatagagtgagactctgtctccaaaacaaaagatatctcctataccttgcataagcaaatgatgtgaggaaaacttgcttaattaagatcccaattttgttttggtgcttttgacactcttcatgcttgactaaactttttcattatggatttgcatttcttttactttttcttttcttttacttttcatttcttttacttatatgaataaaaggtctattcccttattggtttgaatttgggttacttggtgtctttggtcagtaaagagaaataatttgttttagcatccaatggattatggtctgcttcccaattgtttttgtttttcaattccatcctgatactggaacaacagatcatcttgtttttgctacaaacaggtgacacccaactatagtttgtgtatattgtaagacatacagagagtgttacaaattcccagtgttttcctctgtttcttagtcctgtactattcaggaattgtttcacacgagccttgataaactagctttctcaagaaagaaggttatgatatgttgttgttttgagatgttgaaattatgttaaattatgcataggaggtattatttatttattgagtttagtgctcccaaactgtattctacagaatattgttctacaggatgttacaataatgttaaaaaagggaaagaaaaagtatggaggtagtcaaggggatcatctgtggcaaataagttgtgaatgtgctgggttaaacaaagacaaacagatctattttctgcagaacttctcatgacttttaatatgctatttttattgtaaatctataaggggctatactataaaacatttctctaacttatttagccatggggtgtgtgtgtgtgtgtaatactttttaacatctcaagtatggcacacagtttgggaaaaggtggtctagctatttgttcttgtatgcaaaaggcatgggtaaaatggacacaggacaaaattgttaaaatgttgtttgtaacatgcctacagaccttgttggcaaagcttcctgattataggaaatccccattgaaatattcagggggagaaaaaaatcaaataggattattttttaaatgcattggctataacaccctgtatgttgaatgtgggaaatagactaattttagctaatatataaataaacagtatggattatatcaaacccaggacttcagaacattatgaagctgtgcataagtgcaagcctgagtattgttaattagtaaggatgtggttttcagatcatgtcatccagttataacaacataccataaacactgtccaagcattgtcagtttgtaaacgtatcatttgctgtgagttacttaaaacattcaaaaggtgtttaacaacagtaatagttgatctgagaagaaatcacagtggtcgatcttgaataattataacagcagtattaaaaccatgggactgcagtgaagctgtgatcatgaaagaacctcatgttacaacataaaactctctgtgaaccattactgagaacagaacaacactgaaaaaggcccggatagatatattgctagaaacagttgccctagttatttagtttcaaaatgaagtagcagagaatcccatatgggaaaagtacttgtacatatctctgtgatggtgttcatctcacgatgtttgattccattttgatgggtttgttgatagcatgattcctgctgtcactatgatttgtgtttattatagctgtttcctttttaataaaggatgctgttgcatataaacactgacatgaagctatcttttcagaaattgcattctgtatgctgatatagtcattgcaatgttgtaaagtgagtattttgctaccaacagagttggattatatattttaatatatcgattagtgtattttgttgtttcaatataagaaaggacctatagttatatttattttgcatttgttcttaggtagtatacacactttcaaggagagatagcacagtaggcaatacaatgtggctgaagcacaccttgatagaagaacaaataaaggactgggcagaggtgaaaatgattatgtaggaagtaggagaaagtcagattcaccatagtcgaagagtcatggcaggagaccattgaaagtcaagaggcaccatctgtcctaagctgagctgaggcagtgtctaactgccatagccaagagtaggagctaagaaatctcagaccgagaaaatagccaaagattgaggggctaggttgggcgcggtggctcatgcctgtaatcccatcactctgggaggccgaggcaggtggatcacctgaggtcaggaattaaagaccagcctggtcaacatggtgaaactctgtctccactaaatacacaaaaattagctgggcgtggtggcgggcgcctgtaatcccagctacttaggaagctgagataggagaatcacttgaacccaggaggcagagattgcagtgagaaaagattgcaccattgcactccagcctgggcaagaagagagaaactccgtctcaaaaaacaaacaaacaaacaaaaaacaacaataacaacaaaattggctaggcgcggtggctcatgcctgtaatcccagcactttgggaggccgaggcaggcagattacctgaggtcaggagttcgagaccaacctggacaacatggtgaaacctcatctctacttaaaaaaagacaaaaattagctggacgtggtggtgcgtgcctgtaatcccagctacttgggaggctgaggcagggagaatcacttgaacctgtgaagtggaggttgcagtgagccaggatcatgccattgcactccagcctgggcgacagagcgagactccttctccaaaaaaaaaaaaaaaaagaaagaaagaaagaatgggaaatgggaggcaagaaggtagggaactgtcactagggcagttcagctggttgtgctgaatagtgtttttctcacctagagctgcttttaacaacctcatacctaatggcattttaaattttatgtctggccccagaaaaaggtttgcctgtaaaataaattgaacatgattgaatagaaagtataaagaaaaaaaaaaaaccttccgtacatctggtttaattaatttacagtcctctagcaaagtgtcattaaaggcatttctgatcagatccagattggcagcaaatccaaacccatcatttcctctctccttttttgcctccccgcatctctccttcttaggttagaaaaggatctgtttgaattagccaaggatatactacgttgtagatggtgagggcagaagtacattaagcagaattcagcataactctctttggcccccagagtagcttcagggggcagggccattggtggtggtgaggttgtggggagggtttgtggtatgtagggataaccttcctggcccctttctgtaagctgtcaccagatctggaatgttcaaatcttgctgtatcactgctctttttcatacagacctatcattaccattcaggaagaatttctgcaatctatatacgttctcatttaatgggatatttacaaattctgagccttccttatctctgaaccaaattcagcattaccaatactgccaggtatcctggaacaacatctcgttttccatttccttgcaatccgtttatcattttccttcttctccacatgccaatacactctctaatttctttgtatctgggtggttatgatactgccctgtttttggagggccacagtaacaaattcatttcctcgtgagtatttgttcttacttatccaaattagccttatggaagcacttgtaacagataaacatttgctttggaactttgtgctcttaccttaaaggaactagctttaagctttgaatctgaagtaggaatagagataagaaaaaaagactttccacactaaagagacagttaacaaaggctgagaagtgggaaactctgaaaggtaaggggcaccgaattgttacatttaattggattattggatagataatgaattgtgaatggggcagtttaagataagacagaaatgtctattgagaccagacccctctgggtcttgagtacctaaggaagaagctcttattatatgtataaataaggtttttgagtagaaccccactgaaaggctgcttgctgacttgaataaaaagccactgttgaatcaccaggatgatcttgccagttacaaaacccttgccttgtgaaactaaaagtttattcctataaagtagaaatagtcatagctgactctgtatgggaaaaaatgaaatgagcatttatgcaaaagcttgaagcatgcacctgcctttcaggtttaatccttgtgtctcatttggcaaaccagttgtaccctttgtctgaaacactcctgcacttcatctgaatggaaaccctttcatttctgttatgagattgaataaccaggtgattggaggaagactacagttaagtgtgatttatagacaatagattttgccagaggagattttgaagctatgtaaaaattctttttattttttcatgatatttactaaggttttatcgatttcagattcagtctcaatataaaatagtaataacattagtggtacaaatttcattagcacatacttagatgtaagaaatcataggctgggtgcggtggctcactcctataatcccagcactttgggaggttgaggcgggtggatcacctgaggtcaggggttcaagaccagcctgaccaacatggagaaaccccatctctactaaaaatacaaaattagccgggcgtggtggcgcatgcctgtaatctcagctactcgggaggctgaggcaggagaatcacttgaacctgggaggcagaggttgcagtgagacaagattgcgccattgcactccagcctgggcaacaagaacaagactctgtctcaaaaaaaaaaaaaaaaaagaaaaagaaaaagatatcattactatagattagattggcatgactcaaccttctttagaggttagttgtttctactgagtatgtttgccatttggagatctggcatttggggagtatttgtgcttcaggtggtttgaaaggcagatcttataagtttataacattgtcatctattttcaataggtttttgatattgaaaggaatcatttccaaacagtatcactactgtctaaacactgagtagttacacatacatattagcaatgactaaaaaaatactgtttgcagcaaggttggaaagaaatagaatgatctaggcataaaccacatatcttcctaattaaatgaaacagtatttcattgctgcttaacctactcttgtcttacagattgaccttgactcaattccaggtcagaagtcttcccacactgtgcttattaaggtctctggcatttgaaatggcagagctgctctaatcttcaaatcccatcgctttactttgcttgctatactcccttttccctcacttctgtacagcctacaagtcttatgtgttaaaaagcctctgctaaggccaggcgcggtggctcacgtctgtaatcccagcatttttaggaggctgaggctggcagatcacctgaggtcaggagttccagaccagcctgaccaacatggtgaaaccccatcttttttttttttttttttttttttgagacggagtctcgcactgtcgtccaggctggagtgcactggcatgatctcggctcactgcaagctcggcctcccgggttcacaccattctcctgcctcagcctcccaagtagctgtgactacaggcacctgccaccacgcccggcaaatttttttgtatttttagtagagacggggtttcaccatgttagccaggatggatgaaaccccatctttactaaaaattcaaaattagctgggcgtggtggtgcatgcctgtaaccccagctacttgggaggctgaggcaggagatggctcgaacctgggaggcagaggttgtagtgagctgagatcgtgccattgcactccagcctggggaacaagagtgaaactccgtctcaaaaaaacaaaacaaaacaaaaagcctctgctagcagatttttgatcaacattttcttttatcagtggcttgctcaattttatttatttattttttttttgagacggagtctcgctgtgtcatccaggctgaagtgcagtggcgtgatcttggcttactgcaacatctgcctcctgggttcaagcgactcctgcctcagcctcccgagtagctgggattacaggcatgaaccaccacacctggctattttttatatttttagtagagacggggtttcaccatactggccaggctggtctctcgaactcctggcctcaggtgatccgcccacctcagcctcccaaagtgctggaattacaggcatgagccaccgcgcccggccaattttacattttttatacccaattttcattgatgcattctcaagacttaaataataatgaagtgcctgcccatatgtaatatttcctgatactccatgggctttagcggtaaggtaactttgtcatataagaacctaaaataactgtagttacacttttaaaatagcttgttttgctagtgttgctatagaaaatgctttataaataacatttcaagaactgtgtttctctgaatctccttatcgttgccagaatgtttcccagtaacttatctgtatctacaaagaaagtgctatgtttagatactggtcagttctaagtcattttcattgatgacaacattaaatataagttatacaaaatagtagatattccaactaaaattttatctcttctttgtgaaggatctgtttcagtccttaagaaatagagtcatttgaatgggaaaacctagaaacagttttaaggcccagggtatggtgaagtcaccaacctgtttcttctctgccagttctaatcttgacataacaagaaagttactggacaatcaatcatgacctttaggggtgtgggggaaggaaaagaaaagacaagtttaggcagctcctctatttctaaagaatgtcatagagaaatttaaagaaatccttgctatactttacctggccccctcctggattaactcatgaggcaaatgagatttcctcactctgaatttgcaaagcgacaaaatttccaccaaagaatcagcatgaatgggatttgaagaatggaataaaaagtgaattaaattactgatcaccctaattttcaatactcattcattcattcagcaaaaatttattaagtgcctcctaatctgctagatagtgttgtaggttctggaaataccatagtacacagataaacatttctgccttcctggagcttatgtaatagtaaggaaaaacagatgaaataaagacattgcaaagtatgttcaaaggcgataaatgccatagggtataaaagtgaagagggagtttggtggtatgttcgtattttagatagcacagagggaaagccttattgacttggtgagttctgaataaggatctaaagaaagttaagtcatgcagatatgtggggaaagagcattccaagcattccaaatgcaaagaccctgaggcaaaaagctggtgtgttccaggaaaagtaaaagtagtgagtccagttgcctgaagctcatgaatgagagggagagtcgtagaagataaggtaagaaaaattgtgaggggtggagggagttgtacacccaaatgatatagaaacttatggatctgccgggtgtggtggggtggctcgcgactgtaatctcagcgctttgggacgctgatgcgggcagatcacttgaggtcaggagtttgagaccagcctggccaacatggtgaaaccccatctctaccaaaaaatataaaaattagccgggcatggtggcaggcgcctgtaatcgcgctacttgggaggctggggcaagagaattgcttgaacctgggaggcggaggttgcagtgagccgagattgcgccattgcactccagcctgggcgacagagcgagactccatctcaaaaaataaaaaaaagaaaaaattagaaaaagaaacttgtgggtcataataaggacctgagctattatttaaagatgagaagccattgaaaggttttgagtggaggagagacatgcactcagttaggtacaaacagaatcaccctgaataatgtgttaagaacagactgataagcaaggcagatgggaagcagggagacccataggaagtaattgcaataatctaggagactattgcagtaatctaggctagtattagtagaggtgatgaaaagtagccgaatacctagatatgatgtaaatgcccagtgggttcaccttgccagctacctagacagagctgatttatcaagataggacagttgcaataaagaaagagtaattcactcagagccagctgtgcagtacaccagagttttattactcaaatcagtctccctgagcattcggggatcagagtttttaaggacaacttggtggggggaagcctgtgagccgggagtgctgattggttaggtcagagatgaaatcatagggagtcaaagctgtcttcttgtgctgagttagttcctgggtgcggggacacaagatcagatgagccagtttatctatcagggtgatgccagctgatccatcaagtgcagggtctgcacaatttctcaagcactgatcttaggagcagtttagggagtttcagaatcttgtagcctccagctgcatgactcctaaaccataatccctggctaatttgttagtcctacaaaggcagtctagtctccaggaaagaagggaatttgccttgggaaatgccgttatcatcttttttttttgggtgggggaggacagagtctcgcctgtggcctaggctggagtgcagtggaacaatctcggctcactgcaagctctgtctcctgggttcataccattctcctgcctcagcctccccagtagctgggactacaggcgcccgccaccaagcccggctagttttttgtgttttttagtagaggcggggtttcaccatgttagccaggatggtctcgatctcctaacctcatgatccgcccacctcagcctcccaaggtgctgggattacaggcgtgagccaccatgccggcctatcatctttgttttaaactataaactaagttcctcctaaagttagttcagcctacgcccaggaatgaacaaggacagcttggaggttaaaagcaagatgaagttggttaggtcagatgtctttcactgtctcagttacaattttgcaatgctagtttcaatgtcagtttgtaccatatgaaattgccaatatttgatcacttttgatcaatagaatcctttttttttttttttttttttttttttgagatggagctctgttgctcaggctggagtgcagtgtcatgttctcagctcattgcaacctcctcctccccagttcaagagattctcctgcctcagcctcccgagtagctgggattacaggtgcctgccaccacgcccggctaatttttatatttttagtagagacggggttttgccatgctggccaggctggtcttgaactcctgatctcaggtgatctgccgcctcagccctccaaagtgctgggattacgggcatcggccagtgcacccggcaagaatccataatttctagtggttctttctaactttttgaaagtagaatggatagaagtttactaaaattatacactagatgtgtgggatatgagaggagtgaaggaaaattcccaaggcttttgagctaagcacatggtaagaatagagttgtcattaactgagacaatggagagcccatggctattaattggacacttctgagctagtcagctttagtttaccgaagtctaaattcaggcagcttttggctgggcgcggtggctcacacctgtaatcccagcacttcgggaggctgaggtgggcggatcacgaggtcaggagatcgagaccatcctgtctaacatggtgaaatcctgtctctactaaaaatataagaaaaaaaaatttagccgggcgtggtggcgggtgcctgtagtcccagctactggggaggttgaggtaggagaatggcgtgaacccgggaggcagagtttgcagtgatccgagatcgcgccactgcactccagcctgggagacagagtgagactccgtctcaaaataaaataaaataataaattcaggcagcttttttgttgctgtatactagtggtcacaagtgaacactggataatatgcacaattcattgtagatccatccacattgctggcaaaaataatcaagctttcctgttacactgattgatactgggtctgtgtggtcatcttcttataagaaatatggtcatcttcatagaaaaataactttatatcttttatataacatggtttgaaaaatgtgatttcaactttgtcatcgtgctgcttctttcaacttttattgtctaagctcattttcttcattttattatattctttcatgacttcctctcactctaaatcagttaagattcagctagaatatatgttggtacatacaatttggaaagattgtctttatgttctgtgatcaaatgtgaaaaatagaaccatggagtcaaaacagagtaaggctttactgtttttttttgagacagagtctccctctctcgccccggctggagtgcagtggtgtgatctcggctcactgcaacatccacctcccgggttcaagcgatttttctgtctcagcttcccaagtagctgggattacaggagtccaccaccatgcccggctaattttttgtatttttagtagagacaggttttcaccatgttggctaggctggtatcgaactcctgacctcaagtgatccacccgcctcggcttcccaaagtgctaggattacaggcatgagccaccgtgcccggcctggctttactgttttgtaaaactgctttcaggaagtaattaaggtagatacacacaagcccaagttgaacaacattatatctcacttactttgaatggcctagtcaggaatattgtatatatccataaacgtgaaagtaaaacatttgacgatgtattttctttaggtgtattaagatataaggccaggctgggcatggtggctcatacctgtaatcccaacactttgagtggctgaggtgggaagatcacttgagcccaggatttcaagacgagcctgggacacatagtgaaaccctgtctctacaaaaaaaaaaaaaaaaattatctaggtgtggtggcgcacacctgtagtcccagctactcggtaggctaagacagggaggatcactttagccctgaaggttgaggctgcagtgtgctatgatcatgccactgcactgcagtctggaagacagagtgagattctgtctcaaaaaataataataataatggtatgaggccagttcatcacagtaaaaaataatattgtggaaaatctatagtgttgagttagattcaacttagaaattagcaaacactgataactacttgtcaaaaatgctgataatgtactttcaatagaggtcacagtatttgtctagaatgagttaaagataagagtctatacctttgctgtgactttatctttttgcctgactagtgtctctttgatatatatctttctatactgtaggggctgatttcttctgcgtttgaatttatgaggcaaatagaattggactgaaaaggtgttagagaatttagagaaatacttaaatgaatcactcagtttgtttaaatttagaaacaataaaagctgtttgttcaggctactattttcaagataccatgttgtgtatgagcataaatagtgccccaggttgctggaaggcaggcttggttttgtttttgagaaatgttttagttgaacaatttttaaaagaagaattgatccacatgtttaacatttcactcccccagaccagcctgggcaacatggtaaaacaggaaaggaagatgagaaataatattctcctattattatggaaacatacctttaatatatggccattgactgaatgcttagttttacttatcattctccttttttgttagactcttagccttcttctccctgcccttaaagaccctataagagagaaaaacaggtatacaagtcagttgccatggtgcacaactgtagtttcagctattcaggaagctgaggcatgatgattgcttgagaccaggagatctgggctgcagtaacgatcatggtgcctgtaagtagccactgcaccctagccttggcaagtgagaccctggctcttgaaacaacaaaacaaaacaagtacacaaataaagcaagtaatataaggcatgatatggcgtaacagagatgcttttgtgttttaagcatttttactggagattaatgagtggatgtgaattttaaggtgtgctccaaggtacccaaggggtttccatcaagatgcatcagaggttgctgatgggattggaaacttatcccctttacccccactcctctacacacatgctcacacagagcagctccacttttatctgttttataaattgggtttttgtgtagcactgtgaaaagaaagtgttctttttgtttgtttgttttgggttgggatgggtttgaaagtgttcttttaaccattttttttttttttaaaccacagctgtaatagaaagaacacgagctttggagtaagaaacatctgagttgaaattttagttttgctcttagatgatgcttacctcatccatcaccataagctcttccttgtttctcaattttgatcttcattttgagtatcaaatgagagatgtgtagagtgcctattgcattgactgatcaaggattcctgttagattggaaaactgtgagttctattaaactattttttatatcatagatattattttaaaaccttgagaaaagcaggttcacatatttattaagccgatgattacattttttaacttagcccaagtttctttatgtaatttggcctaaatatatctgagatcctttaagccatctatcgatatttgtacttgatcatcgcatcatagtgatctcacgatgttgagatgttcaactcctgagcccttggggtagccagtgccctctagcgggttggtttgccttagcaaccttgagcagccttgtccgtttaccctagtgtgccatgtaaataatatcatttcctaaatatgccgtgaagacattgatttaaagaagcatagatgatccttcctgttctgtttttctcctcctctgttctttctcttctcactttcttgtcttcaaatcccctggtttaaggccaaagaaatcagtagactagccgagcgcagtggctcaggcctgtaatcccaacactttgggaggccgaggcaggcggatcacgaggtcaggagtccgagactagcctgaccaatatggtgaaaccccgtctctactaaaaatacaaaaaaaaaaaaaaaaaaaaactagccgggcctggtggcgcgcaccagtagtcccagctactcgggaggctgaggcagtagaattgcttgaacccaggaggcagaggttgcagtgagccgagattgtgccactgcactccatcccgggccatagagggagactccgtctcaagaaaaaagaaatcagtagactagagggtaggcagcataagcaatttgatgatgggagacagtccatttctttttcctgtacctcaagccctatttagatagactttatttacatattaaggaaaaaaaacatgttttgacaagttgactagtttcctcctgggtttccattttccttgagcaaaatctgcaacagtctcatgtagatggggtaaatgggtttatgtgtgggggtccatgccacatgaagaagttagatgtgcactagcttccataataggaacagcaagaattgaaacagaaaggaaatagaaaccagtgcagggtgtctaggcaagatgagaaagcaaattgcttggaatatgaattgcatgatgactattgtaatgcttctattattttctgaaaagtaagaatgtctttatgttgagcttgaaccagaaggattactgagtccattctgtgttcaatctgtaaagaaataaactaaaacaggtgaacattgaaaatgttacaatgtcataatttgttttttttagcccaatcaccacttttctgattgcaaagtaagtccttcagtcaaatccattgtttgtctgtggttcttatgattaacttccttaaactcaaataacgtttgaaactcaacattttaaggatgtttttaaataagcattattctaacggtgcaaggacattttttaatgccttgccttctcttgcctaggaaatagaaggcagaattaagacttgaaacatcattttcctttcttttaagtgatgattcagtattttagttgattgtaaacagacattcctcttttgcttatgattacctgatgataattcaagttaaatcattgagataataaatctcatacattgatttgatgagagaaatcagtgttaacgccaaaccatgttgaaattggtcttagagatataagccattttgcaggagtgtgtttttgactaatcatgccagagagaaattaatcgaattgtggaatattacactttgcattcatgaaagaatgtgataatgccactactcttcaaatgcatgaatgtgactgaagggaacagtaattatctgcattcctttctactttaggagccagtgtatcctgaccttgtccgtgattgtaatcaccgtaacttgattagagattttttaaattatttttcaattgacacattttaatttatttatggggtacaatctgatgttttgatacatagctatattatgatacaaccagtttagctagtgtatccatcacctgtgcatttatcatttctttgcagtgagaaattatataagatacaatattttactgttaaacatagttaccctactgtgcaatagaacaccaaaatttattcttactatctaattgtaactttgtacctattgaccagcctctctccatccttcccttcctcttcccctctccagtctcaaccactggtctatccttttttgtttgtttgttttttgagatggagtcttgctctgtcgcacaggctagagtgcaatggcgccatctcggctcactgcaacttccgcctcccaggttcaagcgattctcctgcctcagcctcccgagtagctgggattacaggcacctgccaccacacccggctaatttttgtatttttagtagagacggagtttcactatcttggccaggctggtctccaactcctgacctcgtgatccaccagcctcggcctctcaaagtgctgggattacaagcgtgagccacaacgccctgccgcccactggtctattcttgattacagttttctttttttttctttactttttttttttttttttttttttttttgagatggagtttctctcttgttgcccaggctggagtgcaatggcataatctcggctcactgcaatctctgcctcccgggttcaagctattctcagcctcctgagtagctgggattacaggcacccgccaccatgcctgactatttttgtatttttagtacagacaaagtttcaccatgttggccaggttggtctcgaacccctgacctcaagtgatccacccgccttagcctcccaaagtggtgagattacaggcatgagccaccacgcccggccgattacagttttcaagatgtcatgtcatccttgctgttctaaacatcacccaaaattggagaaagaatagtggtaaaacagtagcgacattaaacttaggtaaagcttctcagtgatattattaatagaatcagaaataaatgacgttttcttataaggattcaaacacagaaaatcttcaagaaataccagtagctgtattttttttcccttctgagccaaaggttagattgggaggactgtattttgatagactccttacgacattttaaaataaattcttcagatctagaaagttgactctgaatattttccattcataattttgagaattttctaaaattgatgagcaaacagttatgcagtaagaaaaagattgtatagaaattgataatttgttctctttccatttatcgctgatgctccctttctcacttctacaaataaaaagtttcaaatctttgttctttgtctcttccatggcaatatagaagttataaggtaataaatcaaatttggaaaaagatcttttttcctactctaattgtagggctttaactcttatagagaatcagaacgttaaagtacttctcatataaaattcccctttttttttttttttgagacggagtctcgctctttggcccaggccagactgcagtggcgctatctcggctcactgcaagctccgcctcccgggttcatgccattctcccctcagcctcccaagtagctgggactacaggcgcccaccactgcacccggctaattttttgtatttttagtaaagacggagtttcaccgtgttagctaggatggtctcaatctcctgacctcgtgatctgcccgcctcagcctcccaaagtgctgggataacaggcgtgagccaccacgcccggccaaaattcccataatattatttcaaaatagaattagtgcctagtataacacctagtactgagtaggcactcagtcagtatctgtgtaggaaggaatagatgggacatgataaatataattgataataaatattggccggttgcagtggctcatgcctgcaatcccagcactttgggaggccgaggcaggtggatcccctgaggtcaggggtttgagaccagcttggccaacatggtgaaaccccatctctactaaaagtacaaaaaatagccgggtgtggtggtgtgtgcctgtaatcacagttacttgggagactgaggcaggagaattgcatgaacctgggaggcggaggttccagcgagccaagattgcgccattgcactccagcctgggtgacagagtgagactctgtctcaaaaaaaaaatatatatatatataattgataataaaaattgataatattaaataataataatattaaatatactcttgaaagactatgtttttctgctgctagacatactactttgtaaccaaaaaagcatacttatttgtttttgtgaaacattcacaacataaatggttaaacagcataaaggaccgtatgtttgagtgttacctctaaattaactaactgtaggcactgaaggatttccatgaacacaggacttttagtactaaaactagggggtctatcccaggcaaactagaacaaactgatcacccttaaaattatctctcaatttggccaggcgcggtagctcttggctgtaatcccagcactctgggaagccgaggcgggcggatcacctgaggtcaggaggtcgagaccagactggccaattgtggtgaaaccctgtctatactaaaaatacaaaaattacccacacgtggtggcgggcgcctgcagtcccggctgctcaggaggctgaggcagtagaattgcttgaacccaggagactgaggttgcagtgagccaggatggtgccactgcactccagcctgagtaacagagcgagactccgtctcaaaaaaaaaaaaaaaaaaaaaaaatctctcaagttgaggctgccttgaatgtaggttaagctttctggataacttcttacattaaaatttttggataatttacattacaaactgagtcaaatgaaagatcttttattttacttgaaatatataacatattcagcatagaaggagtaaaaagaaaagtataaaaaatattttcattaaaagctatgtctttaatttctgatggaattagtagagattttattactaattcatttagtatttatgagtccactatggttgtcagttatcctttatgacataatttataagattactgataggagcacattttctaagctgaaacatttagaataccattatacaattctttaatagctggagacggaaaagagagtgctagatggagaattaacctctgaatcatgttatgcactagggacttagggttacttttggagtagtatggaaacaaatttaagaatagagtgtgcagtataactttataacacggctcattttcagtgtcagagatcaaataaataatgtgaaatatagcattactgtgcagtagaaatccaaaataatgcaggtagcatatgatataggcattatcataccccttaacgcacaacaaaaggtgtttattattatcataatgttattttccctaatatttatttgctttaataaattattattgcaaaataagtaatataaattaaatgaatttacatgtcattgcattcagatttacatatatacatatgcatgtacgttcacatacattcacatatgtatgtgtttttgttgttgtgttgttatttttttttttttttttttttttgagatggaatctcgctctgtcccccaggctggagtgcagtggtgcaatctccgctcactgcaaactccgcctcccaggttcatgccattctcctgcctcagcctcccgagtagctgggactacaggcgcccaccaccaagcccggctaattttttgtatttttagtagagacggggtttcaccatgttagccaggatggtctctagttcctgacctcatgatccgcccgcctcggcctcccaaagtgctgggattacaggcgtgagccaccgcgcccggccatgtatgtgtcttaaatggctatttgccagatctttaaagttgccttccaattttggctgagaatcatcttagaaactgttttgatttcaggcatatatatacaaatgacatgctagtttatacctttaaaagtatatttgcatgtagcataatttggaaggacgtatttttattaaagtatttggattaataaatgttaatgtcaaatctaaaagcccacagcaatggagttgaaaatttaattttaactaaattttaatgtattcatcaaatatgtgttccacagtatttaatgaagatatattgtttataattcacactttgcagacccctttgaagacaataaaggcatacttttaggacagaaaatattctacatagtttgtgaattggagccaatgttctcttgagtttattcttcttatttttaatgcaatttaaaaaatgtatttagggcacatttctgtaagtttaagcatatgattctttatgggagagtagaaaaagaaatcaaatatattttgcgaggtggaagaaaagctgaacataggatatagaaggggcaatgccaaaaggaaaggaaatgaggatggggaagggccatatttttaattacttccaaagggcactggtgtatgttttataaccattcatctctgtttttatgaagcactaactccctgaagcacaaaaattacatgtgtgtgcctgaaggcatacacaaagaaaacaccagaaaccatagctgactcttagtcactggtttaatatgtacagttttggagaggtctgggagtctatctgaatctactgattttgattagtttttaaagaatgaaaaaacaaacaaaaaaaaaccctttcacatgaaacctaccactcaaaatttaagttggattagagatagtgctttgagatttccttcctgactaaaaagtaggttgttgatagcaaaagatcttttgcaactctagtatttgctgtaaactatgatatattcctacaagtacaaatagaaatattttaacatttattcttaagtttatcccagttcttttttttttttttttttttgagagaagtctcactcttataccccaggtttgattgcaatggctcaatctcggctcacttcaacctccgcctcccaggttcaaatgattctcctgcctctgcctcccaaatagctgggattaagtcgcctgccaccacgcccggctaatttttgtatattttagtagagacggggtttccccatgttggccaggctggtctcgatctgctgacctcaggtgatccgcccacctcagcctcccaaagtgctgggattataggcatgagccaccgcacccagcccctgagcttactttttaagaactggcataggccgggcacagtagctgggattacaggcgtgagccactgtgcccgccctatgccagttcttaaaaagtaagcttggccgggcgcggtggctcacgcctgtaatcccagcactttgggaggccgaggcgggcggatcacgaggtcaggagatcgagaccatcctggcgaacacggtgaaaccctgtctctactaaaaatacaaaaaattagccgggcgtggtggcgggcgcctgtagtcccagctactctggaggctgaggcgggagaatggcgtgaacccgggaggcggagcttgcagtgagccgagatcgcaccattgcactccagcctgggtgacagagtgagactccgtctcaagaaaaaaaaaaaaaaaaaaaaagctcagggaccgggtgcggtggctcatgcctgtaatcccagcactttgggaggccgaggtgggcggatcacctgaggtcaggagttcgacaccagcctgaccaacacggagaaaccccatctctactaaaaatacaaaattagccaggagtggtggcgcatgcctgtaatcccagctactcaggaggctgaggcaggagaatctcttgaacccgggaggcagatgttgcagtgagccgagatcacgccattgcaccccagcctgggcaacaggagcgaaactctgtctcaaaaaaaaaaaaaaaaaaaaaataagtaagctcagaaaaagaggctctttataggctaaatcaaataacttgttgaacctaatttttaaatttggctcttatttgtgtactcagtatttagatctaatttgactctgataataaccaactttaagtgaagcagctaccctttggtgcctacagatgactctcctttcaataaaacatatttaaatagatgacagtgatattttctatgatattcccattcgagaagccccttgctgtggttctggcaaggcttccacagcaggtgatgtggggctcatgagaggagtgccttacttactcctatagaaagctataataaaaggagcaaataaatacctcttgtagctaagaatctgatgtaccacttaatattttcaggtggcaactgcactgtcatttcatataaaattcctttcattagctataaaaaacattgcctgcctgccagctgtttggaaagcatcgtaagatcaggaaaatgacaaaacagcccctcattcgcagtagatacaatgaactagtcaaatagtacatttttaaaatctatcttttgcaaaaagaatttttgcttttcatctcatgcgtttttgtttttaatgacggcatctcaatttttgttcttgtttttttctatctaagctaataaacagattgtgatagtctgtactcaaacacaaaggttcaagagatctggaagaacctgcatatagtagagtataaaaggcctgtgcaacttagactcaaatgtatcaatgcctacaggaaaacaccacaggtcagctctttgtatattctctagtcaggtaatgataacctaaactatctctatgagactgctgaaaagttatcgaagtaaattatttttcttgtcttttttttttgagatggagtctctcttgctctatcgcccaggctggagtgcagtggcatgatcttggctcactgcaacatccacctcctggttcaagcgattctcctgcctcagcctctcgagtagcttggcttacagacacctgccaccacacccagctaatttttgtatttttagtagagacggggttttgccatgttggccaggctggtctcaaactcctgacctcaggtgatccgcccacctcggcatcccaaagtgctgggattacaggcatgagccacctcacccggccaataaattatttttcttaaacatgtatcattcatcttagagtgtagaaacattgaccctggtgatgaccattgttatttgtgcacatggctgtggatgaagaggtaaatgaacagcctccattgtccactgcctgcgtgtggaggaggctctgtggttggccttatgtctgatgagtgcaatctgcatctgcaactctgcttcttatagccataatttgcctaatagtattgctcaaggagagaaaatacatatccatatcttcaggaatataggaccatctggtgagaattacttttaatggctacattgaatattagtagttgattgttaatacagagagtaggaaggacattataatgctcaatagttgtccagtctgggcagttactcagctgtcttagacaagaccaagttttgccttttttagtttttcatcttaatgttattttattttattttattttattttattttattttattttattttattttgagatggagtctcactctgtcgcccaggctggagtgcagtggtgtgatctcggctcactgcaagctccgcgtcccgggttcacaccattctcctgcctcagcctcccgagtagctgggactacaggcgcccgccaccgcgcccagctaattttttgtatgtttagtagagacggggtttcactgtgttcgccaggatggtctcgatctcctgacctcgtgattcacctgccttggcctcccaaagtgctgggattacaggcgtgagccaccacgcccggcctaatgttattttaggtattttaggtgtggtgcctagttttcaactcttgttaaatatttcttaatgcataattctaagaggtttcatttaaacttgatctactttatttaatctaaggcatttgcagtattgtttctgttctttaatttagtaaaaggaaagttaattattgtattctttggagtaggaagtctttgtgaatttaaatatttgtcgtatagaagtctaacaaaaaatattctttttaaaatatggtcaaatacaaattgaaagcaactatatctgtagaaaatttttcataaaaatcattgactgaaggaacaaaagcatgtcattgtatataccaacccttctttatgcattatccactaaaatgacatttcaaaagattcacagtgggtagcatatggaatactccataaacactgattagatttaataatgtttgtatcactgtttgggaacatgtacaaggaatgcgaccgccatatattattaacatcaaaataactcagaagaaaagctcctaattaaagcagggttggtttagagacttagcaaaattgcagccagaaataaccacctacccacctgcccgggacttggggcttgctttcatgcatgcaaaacagacttgattcttagagcttcaagatagctgctatgaaaattataatgggctgtgacaataccattttcagcccgtccagttctgcaccaaacctagtttcagaaggacaacactactgcttgagttgaggtttcagccaagtagcatcaaaggaaagcaagtttgtggtttgcagttctgctgagctgcactcagtgactctgcatgattgattagtatccttttgctttgcaaatgtgcatatattaagttcagcattgcagtttgcaaagattcactcatggcctgccatggtaattgatgcacacctgtcctagggagcaatgtatgagtttttttgtgctttcacataagaagtctctggagtatttttaattggtcatctctagaagagggaaacaggagcagattaaaagtatacaggaaaaggaggttgttctacaagcagtttaaaaatctatttgaaaaagatccccaccacttataagctgaatagttataattaatttgtatccctgcattctaaaataagagtactcaacaggttttatttttatggacaagtatctgtgggcttaggaaatttctttctttcttgtcttttttttgaagatggagtctcactctgttgcccaggctggagtgcagtggcgccatctctgctcactgcaacctccgcctcctgggttcaagcaattctcctgcctcagcctccaaagtagctgggattacaggtgcctgccaccccgcccggctaatttttgtatttttagtagagacagggtttcaccatgttggccaggctggtctcaaactactgacctcaggcaatccgcctgcctcagcctcccaaagtgctaggattacaggcatgagctaccgcgcccggcctaggaaatttcattgttatttattgttgtttttgttttgtttttatttttgtttgagacagtctcgctctgtcgcccaggctggattgcagtggcacagtcttggctcattgcaacctccgcctccccagttcaaacaattctcatgcctcagcctcctgagtagctggaattacaggtgcctgccaccacacctggctactggctaatttttgtatttttagtagagacagggtttcgccatgttggccaggctgggctcgaactcctgacctcaggtgatccacctgccttggcctcccaaagtgctgggagtacaggcgcaagccactgcacctggcctaatttttgtatttttagtagagacggggtttcaccatgttggccaggctggtctcaaactcctgacctcagatgatctgcccgtttctgcctcccaaagtgctaggattacaggcgtgagccaccacacccagcctgttatatgtttaaccctttttccaagttgacatttccctgatactttggctttttaaatagcatacccttccccacaattcatttaatgaatcccttcttaatttacttaaaaacaaagatgttcctccagaagcaaccagtttttttctgtattgtttagggattgtgttttctggttttgtaatagtatcagaacatataggtaaatattattttggagtctagtttaatcagatcactcttttgctatagaaatatgttactagcttcttaacggccaggcggagtgtctcatgcctgtaatcccagcactttgggaggctgaggcaggtggatcacttgaggtcaggagttcaagatcagcctggcaaacattgtgaaaccccatctctcctaaaaaatcaaaaattagccatgcatggtggcgcacgcctgtagtcccagctacttgggaggctgaggttggagaatcgcttgatcccgggaggcagaggttgcagtgagctgagattgcactactacactccagcctgatacagagtgagactctgtatcaaaaaacaaacaaacaaacaaacaaaaaacaactatgttattagctccttaaattataagtcatttcattgctttctctggacctagcatctatcattgctcttgtttacatctcagtaaacatctcagtttcaatctgatttagataaatgtgattttttaagctgaaattcctaaatcagtagtaagtgtgcaaatattttaaagattatttgccatatgttattttagatacttatccctatttttctgcttttaattagaaaaaataatttataaactggatgatgttaaaatatataaataatttattaatttcattcataaaatgagctctaatatatatacttcttatatttctagactaatatacagccacattcatcattttttcctagtacattagtatttttatctaaattaattttcacccgctaatgaatattaggaagcactatacatcattaaaagtatttattccaagatgatttccccaaatgtgttactatgtaaacatactctgtttacccctccctttccatcaaaaatagccttaaggcatcatgataaaaatgatactgtatttatggacaggataaatcaaacacagtgaagatgaaagaatcagattaggcattccatttgcttactcagtatggtttctcttatgcccaggtttccatctttacagaacttattgggcatgtttcacccacactgcaatgtaactgattttcttttctctgccatctgctgttcagttaatatgtgtttggatgtgtgttttatgcaaaataactaacagtctaacattttggcacattttgctcttatgtcttgacaatgtctgggcatttgtagataaaagagatatatttttgttttacatgtaagtgagtgaaaatcactttcccccacccacctctctaaaatgagaaaacactgagaggctaaaaggaaagagcccacatttaaaaaagaaacaaacattaaatcttatttcagagtgattcaaatattgatatccagtagaagcatatatgaacaattagagtgtcttggtttttatttttttgaaacttcactaaactggacactggtgtatataacctgttctatcagttgttggagattttctctacgtctgaaagtctttagaccagccaatgactactttcaatattctgagggagtaacatgtcctccaaggcaccaggacattacaaaagggagagcacatgtgagggaacgagccgggttctccacttatggttggctcaatcatagaacttttctcttgtagttaatacctctaattccattgctgttttcatagtaactctgtgtaacacttagaagcctttgctcgacattgtcacaaagtagctctaaaatgtggatctcatagtctatctgggcacatctattggcattttttctgccctccctgcattcttagacacacacacacacacacacacacacacacacacacacacacacaccccacatgctttctctgggctctaatcaaagcctttgtataatgaattgcctaggggagaaggagaaagtcactgacccctctctcctgaacttgcacagagccatatgactactcaaacatagaaataaaaatttagatttggtgtttgtgtgtgtgtgtgtgtgtgtgtgtgtatgtgtgtgtatgtgtgtgtagagttagtgacctaaatagaagtttgcctatttcttcctttattgtggtaaaaacacataatgtgaaatctaccctcttaataaatttttgaatgtacagtacattgttaataataagcacaatgttgtaccacagatctctagaaaattttcatcttgcataactgaaactctacacctactcaatagcaactccccatttccctcacccctcagcccctggtagccacctactctctgtttctatgagtttgactactttagatacttcatataagtggaatcatacagtatttgtcctgtgactgacttatttcatggatcataatgtcctcaaggctcatccatgtcgtaacatatgacaagatgtgtttctttctttcttttttttttttttgagacagagtcttgctctgtcacccaggctggagtgcagtggtgcaatcttggctcactgcaacatctgcctcccaggttcaagtgattttcctgcctcaacctcccaagtagctgggattacaggcgcccgccaccacgcccagctaactttcgtatttttagtagagatggggtctcaccatgttggtcaggatggtcttgaactcctaacctcaggtgatctacccacctcagcctcccaaagtgctgggattacaagtgtgagccactgcacccagccttttgatgtctttgtttttaaagactgaataatattccattatatgtataaaccacattttctttattccttgaaggacatgtagattctttcaacttcttggctcttgtgaataatgctgcattgaatataggagtgcaactatctcttcaagatcctgcctttttctttttttcagtccaagagctggctttgaataacacattgacattgaaatatatatggttcctaagatcatgtaattttttgagatgtcagagacacctagagacagcaaacacattaaagatagattcacagttctagtttatatccatgtcacaaactgaacactactgaagctattttgttattgtttgttttcctcaagcagaaaattttcacagggcacatttttgtctctaacaaaggaaagaaaagaaaagaaatgtgttctttggaagtaatgccactgtattcaaatagcttcttccacataaagctaaaaatgtctttcagagttaaataatgcagtttcatatttaagacatacattaaattgatactaggaaaaaaacacaaaatccaccagtgacccagtaaaattagtaaattcttaatgtatgtataagtatatacacatacatacctacacgtacacagaaatgcatatattttagggaaaccttaaaagagaaaaggagttgctgaacagcttaggaaatacagtacaaacaaaaagcagtattgtctgcaaaaaaatttttgttgcaaaagtaatattttccttgtggaaattctggtccagagttgggctattacctatattgaataaattcagggaaacattctgaaatgtttgactgctatgattgaagtattatattaaagtactttatatcgtgaaatgcacttgttttcaaccatgcaaacagttttattaagtaggaggatatcagggttaaggttaggtttacatgaccatatgagaaaatttatataaggtgatggcatgaatggattctgatcttcaaactagacaactagaagttggaattctaatgtcaggggtatcaaacagcccacatggaaaagaaatgagagtctttaataagcaattgggttagaaaatatatagtatttcaatgtcattattttatttcagagtaacatgtctgtcattgagatagtttactgtaggttaaattcagtatgaggttgccatgtacttgcaaggttcttaaccctgttttagagatcataagacataaaagtgtgcaaaatatattcattctagaatagggagtttcctacactaaacaaccagcttaaataatatattcaagtgttttcatgagaaaaaaatcaaaatactttttatcaagatgttagtgctttcattttacctgaatacttatagaatctagcattatacagctggaaggaaccttgcagaatttctactcaaattgctttattttgtatctgctgtgagggatgtaaattccacagatcatcttgtatatatataaaaagggctaaatctcttgcctcagttcatagatcttttgaatgcacagaattggctcttatctttattagtaaacttgatttggaagacatttccttttttgttgccacttctttacctcattggtgattttagttaagtaagcaaagataaacaagaagtggaaaagcagtatcagctgaattgaaaccactacttagattgaaaaagcatgattggacactatctataattcagtataattctcaaacctaaaatgggacatttgaaaataagtgtaggaaaaatacttataaaatgggaaaaatggaaataaaatgtccaaagaattcagaaaattatactaaagggtccaatcaaacccaaatatgtacatattcattccaaaacaacagacatatcagaagtacctggtaccataaaaattaaaatacacacacactcacaaagactgcacaatataatgagaaacatcgtctcagacacttggcatcaccatttctaagtaatttcataactgtatccagttattcttgaatctgtagtaatatttcttaaactcctttttgccctagctctgtcactgttcaataaaactagattccccagggaccttccctttggcaaaattcacactgagtacagtttttgtttcattgatatttgtagtaaaatcatcctttataatcattgaaactgttagcacagactgcaggatctgatagtttgctctgtagttagatatttccagaatatcctatatttggggggagtatatcaaggccaagcatattcggactaaaggaatgtccactgaaccaacaagaatgttaagggagccttgttaaagtactgtcctgatctcgatccgattggctaagaggaagtcttcctgtccttgctccttgtacttcttactgctttgtacttcttactgctgccatgcaacctgatctccattttatcaaggagcctatatacttcaactgcctattagatttcactatcccagtatttcacagataccacaaactcaatttgtctaaaactagtcattattctctgcccccaaaatagtgctcccttacttgtttctcaagttctgataaaacacaagctcacacaaaacatactaagagtcacccaggctgtaaaactcaaggggtattgtcaatattcccctctctctagccactaatatctagtcagtcaccatgttccatggattctacttccttcatattccttttttttttctttgagatggagtctcactctgtcgctcaggctggagtggagtggtgtgatctccactcactgtaacctccgcctcccaggttcaagcgattctcctgcctcagcctcctgagtagctgggattacaggcatgcaccaccatgcctgattaatttttgtagttttagtagagacggggtttcaccatgttggccgggctggtctcgaactcctgacctcaggtgatccgcccgcctcggcctcccaaagtgctgggattacatgcgtgagccaccgcccccgacccatatttcttatatctatcccctgctttccatttgcagtactgttctgttagcttcccagatgctctccctatgtccaatctctcatctctccaaattatccttctcctgttgccaaactagattcctaaaaacaggtaaggtcatgttactcctctgattaaaaatattgataactcatcacctgcaaaggaaacttgaaaacattaacatgcatttcattccttttcaggcttatcccctctatagctccctgcttgtgcaagctaccttatctcagaatagttccagttccttaacagttctagatacattgaggccgggcacagtggctcaagcctgtaatcccagcactttgggaggccgaggcgggcggatcacgaggtcaggagatcgagaccatcctggctaatccggtgaaacctcgtctctactaaaaatacaaaaaaattagccgagcgtggtggcgggcgcctgtagtcccagctactcgggaggctgaggcaggagaatggcgtgaacccgggaggcggagcttgcagtgagccgagatcgcgccactgcactccagtctgggcgacagagcaagactccgtctcaaaaaaaaaaaaaaaacaaaaaacaattctagatacattgagacctttgctcatgctattttcattgcctggagtgtcttctctctggatagaaaaatcctttccatacctcaagatggaatttggaagttacttccttgtgaaacttcctaatgattccaaagtcaggcctttctatgtgaaatttattttaccacatgctagtttaaaaaaacaaaacaaaacaaaaaaaaaaacagagcaggcacggtggctcacgcctgtaatcccagcactttgagaggctgaggcgggtggatcacaaggtcaggagtttgagaccagcctggccaacatagtgaaacgccgtctctattaaaaatacaaaaaatagtcgggtgtggtggcaggcgcctgtaatcccagctcttcaggagactgaggcaggagaatcccgtgaatctgggaggcggaggttgcagtgagccgagaacgcaccactgcactccagccgaggcgacagtgcaagacttcgtctcaaaaaacaaaaacaaaacaaaaaaaaaaaaaaaaaagaggaagcaaactatgggctaaacatgctggtttaaaacagttttgtctgaatccaccacatactatctagatggcgatgaaaaagttagttggtctccctgaggctaatttcatcatgtgtaaaatgtagttaataatagcatatataggccattgtgggggttaaataagacaaagcttgttaagcatttagttcaatgcctgcttccttgtaagagttcaataaacattagtttctgctactgaggctctgctgttacttatcgtctcctaacactagtttataaattcagtgagggttaggaaccatgtcttatcactttactttctttttctctatttaatctctagcagtttcttatatattatcgcagcatgataaatgatgctgagaactgagtgtgaggtagggcttggggtaggaccttatctaattaacatctgtgtatgcctaccatgaatattaaataataatactgacattccaaaatatacacatcaatctcaaaaatgtttaaccataactcctgtattccggtaaacacaactatatggcaatcttaatagttatgtattgcctaacacctgttattttttaactgcctttgattctgtgtaacattctcaataatttatcaaatgtactttaattggatatttacatactgcatactcttctcattagtaggaactagcaaatagacttactatcatttagattgtattctatgcttcatttaaattagtctgagagtttttggttgttgttagtgtgtatgtatgtgttttaatttaggcaccattttttataccttaagcaaaggaaatctgatcctaccacttctttgtttaaaccttgtcaatgacttacgttttgggcaagaaagagttttaaatgcttaatagatctatagaatctggttcctgcttacctcaggaaccatctccttcctcactcccacttaactccgtagtctctagtattctaggcctttttcatcttctttgtgttcctagaatatttaatatccttccaagccttccctcatactaccacaatactccttgtggctcttaccatccaggtttgagttttagtgcgtcatctttcaagaagcatttccagactcatggcctacccctgtcccccacaagtctattaagtctcccaaatatacattcttataacaacttaagctttgcagtcacacttttcttttcttttctttttttttttttttttttgagacggagtctcgctctgtcacccaggctggaatgcagtggcacgatcttggctcactgtaagctccgcctcccgggttcacgccggttctcctgcctcagcctcccgagtagctgggactacaggcgcccgccaccacgcccggctaattttttttttgtatttttagtagagatggggtttcaccatgttagccaggatggtctcgatctcctgatctcgtgatccgcccgcctcggcctcccaaagtgctggtattacagttgtgagccacagctcccagcctgcagtcacacttttcaaattgcaatttaaaaaatgttttgtatttgtttaatgtatattttccccactcaactgacatctccttggaaagcagtaaccttgtctgaatattcactactccgtcatcagcacctagaagatacctggcacatagtaggcatttaatcaaaatgtttgaataaatgagtgaagaaatcactctgctgggtgactaaggatgcaaagctaaactctgtcttcgaaggaaggataaaaagacagacacataaaagacaagagagtgaataaagaaagtgggtagagaaaattaagagtgctgagtgtacttcttatctctctaataactaccacatttgtgactttaacaggaggcttatttaaaagcattttttttatcctagctgactcagaccatttatggaaaagtggggtcattgcagaatgtttttatctttctggtagcataattacctcctctatgttaaaaactgaggactttggttcaaaatactcaccactgactatactatctttgttatattatttaaatgtcctatgcctcgattttctttctttcttttctttttttttttttattttaacaagatctactctttaggtagtgagagagcactaagaaaatggctactccaatggggcaggaggtaaaaaagagaagcaggggtacttgatatacttcggatagtacaaatctggtgattctgatccccagaagggattatggactgatatggtttgtctgtgtccccacccaaatgtcatcttgaattgtagtccccataatctccacgtgtcatgggagggacccattgggaagtgattggatcatggggacagtttcctccatgctgttttcatgatagtgagttctcatgagatctgatggttttatcactgtctggcatttcccctgctggcattcattccctcccctgccaccctgtgaagaggcgccttccaccatgattgtaagtttcctgaggactccccagccatgtgagactgtgggtcaattaaacctctttcctttataaattacccagtctcaggtatttcttcataccaacatgagaacagactaatacatggacgtaaccccacattgggtgtcagaataacggaaaaggtgtaaaagtgaggtgactgattctcctctggaaggtttgcagggaggctgtcctagtgggctgccaccaggatagttgctactcacctgtgtcctggcctggtcctggctgagtcctcacccaaactgctctgatgggtggcagtaatgatagccatgcctcagttttataatctgattttttttttttttttttgaaactgagtttcgctcgttgctcaggctggagtgcagtggtgcaatctcagctcactgcaacctccatctcctgggttcaagcaattctcgtgcctcagcctcagaagtagctgagatgacaggtgtgcgccaccacgcctggctaattttgtatttttagtagaaatggggtttcgccatgttggtcaggctggtgtcaaactcctgacctcaggtaatctgcccgcctcggcctcccaaagtgctgggattataagcgtgagccaccgtacctggcctataatctgatttttaacagaatttttttagtctatatcttgaactattttaaagtattatgttgaacccaaatgaaaattaatacatgcattccatattatccttgttaatgcttcatatttgtaaatacttgtcaatgcatattcatcacataatgtgtggtttgtaagtttcacatattttaatattatttttaaagtacatttctttgaaatgttaataatttctaactaaaaattatccaaattaaatggaaaaattcatgttttgtttttagcattaagaggaatcttttctgacaggttttaaaaagtggaaatgctgtctatattttaatagattgtatatttgtgacttccttttatttaaatgggtaattatgccaggttgttaactaaagcttgtgtgaaggttaagtggatctcaagttgatttttccatgttcttcaacaatccagcagtaatgatatttaatatttcaggcttttaaaatgaaaattataagtaactaaggtactacctatgaagatgaaaaattgtagcaactgatttgactcaagtatctatgagctctataaactcttcatttcccagtgctctgctaatgcttattctaattctaatggaacatgttttttgtggtaacaattactccttacatcaaaattaagtaaaatgataaacagttttctacacatagcattgatgaagtgatcctactttaccaataggatcagttagagggcaagggggtataacacctgccttcagctacctgaaatagtcaaaaccaatataaatgtacattaaagtataaaggaaataacttactttctattttggtataagcttatggaggaattacaactatctcaggttgaattttaagtccatactgttagtatattactaaggaatataatctagaaattcatatatagtcacacaaaaacatgagtgataaaagctttaagagaattctatatagtgcataaataccccagtaattctgatcactgcttccctagatgagattccctagataaaaatgctttgtgggctgggtgcagtggctcactcctgtaatcccagcactgagaggcctgggtgggcaaatcacttgaggtcaggaaggagttcgagactaacctaaccaacatgatgaaaccccatctctactaaaaataaagaaattagctgggcatggtgctggccacctgtaatcccggctacatgggaggctgagacaagagaatcacttgaacctgtgaggcagaggttgcagcgagccgagatcacgccactgccctccagcatgggagatagagtgagattctatctcaaaagaaaaaaaaaggaaataaaaatgcgttgtgggacttatgataaatgttttataaattaactttccagattcatgactgagaccaaactgatttcaaattaataacattttcaaaacattagcattttaccttgcagtgttttaaaatgctgcacacattttagtttataaaccccacaaagaacacttctgttagggagaagatgatgtgattttagcttacagttatcttaaataacttcatgcttgaaaaatcagaaatatttgtctttgtagaacaaggaatttgaaaggggactagtaaaaggaaaattgcattgaatttcttattttcctctcatacttgccaagtttatatgtattagatatgtcccacttcactgccataaggttatatttattttaggttataaattactctgaattaccttcatcttggaaggtccattgttttcccagagttcttctctttaaatatttcaaggacttccaaagttgcttaaacagatgggaagaggtcactctacattttgatcctggaatagtctaatcatcctccccagagtgtcctgttctttgaagcttttgtagttgttgtcactctctcctgtggcaccaaatgccaggaaatctgggtattcaggagcaaatgccctttggctgctgatcgtaccagtgccttcagtagtttctcagggaactgtgttaggagaggttctagcattagttatatagtgtgtccataaccagctttcccgtgtcaccctaaatatggccataggcttctccctcagtgctgccaaaacacaactaagggcaggctgcctggccgagtcacaccaatcataatggtctacaatacactttcttaagtctcagttatattcagtcttaaccccaagtgaggagtaacagtaacccagatcaaatctctactgatgaaacaagctttctcctccttctccatagacaaggtcctgttaaagatatacccactttatattataaatagaaatctacaggtagctgtaaagataccttgtatctctacgacatgaaaatgtcattctgtttctagaatcaaaactgcctgtaagccaccaaatagccttgctggttttttgttttattgttttttttgtttttttttttttttgagatggagcctcgctctgtcgctcaggctggagtgcagtggcatcatctcggctcactgcaacctctgcctcccgagttcaagccattctcctgccttagcctcccgaatagctgggattacaggtaccctccaccacatcctgctgttttttgtatttttagaaaagatggggtttcaccacatccaggttggtctcgaactcctgaccttaagtgatccacctgccttggcctcccaaagtgctgggatttcacgcgtgagccactgtgccctggcaattagcctttcataaaatgcattttatagtaagtttttttttttttttttttttgtgaggcatcccactacatacatttaagtcttatttctactgggtatggtggtagatgcctgtaggcccagctactcagaagactgagatgagaggattgcttgagcccgggagttctgggctataatgcgctaggctgattgggcatctgcactaaggtccacattaacatggtgacctttcagtaacgggggaccactaggttgcttaagcaggggttacctagcccaggtcagaaacaaagtaggtaaaaactctcatgctgatcagtagtggaattgcacctgtgaatagccaccacactccagccttggcaacataacaagattctgtctcttagaaaaaaataaaaagacttattttctttaaaccgtattcttaatttctattctctaatataggagataaacaaaatggccagttttaaattttatctattgtattagggttctccagagaaaaagaatatatatatatttcttttttatataaaataagaatattttatacatctatatatagagagagagaattatggaggctgagacatcttgtcatctaacctccaagcttctgcaagctaaaaaaccaggaaaactgatggtatagttccaatacaaatccacaggcctgagaaccaggggagccaattgtttatgccccagtcccagtcccttggcccaaaaaccaggaatgtcaatgtcccagggcaagagatgatagacggctcagctccagaagagagagagagcattcacccttctccactttggtgttttatcttggccctcaacaaattggatcatttcccaccctcattgaggagggtgatcttctttactcagtctactgattcacatgcaaattcttccagaaacaccctcacagtcacacccagagacaatgtttcaccagctatctggacatcctttaactcagtcaaattgacataaaattaactattacatctactaaaatatctactagagcaacattcaggtctaaagacacaaacttaatttaggctgaccatcattctactgataaacatattcactattacatatatagctttaaaataaatatgattgaagccaaccttgttattaaaatgtatttaagatgttcagattgatgaaacgaggggattaaaatgcgttctcaaatacaatgaaatagtactgtaaaaatattctcagtaaatgagttttgctgtgaaattggtttaagattcataaaagggatttcaggtttttaagtactcaagtcagcccatgacccagccttcagtggtgtcatcctatgcagtgttagaatgagcctttactccttcaacaaatatttcttaagaactgtatagcttactggttaagaacatgggttctggaggcacactcagtttatttccatttttgtgacatactagctgtgtgaccttatgcaattatttttttatctcagaaagctgttgtgaagatgaaatgagttagtccatgggaagtcttccacagcggctcacacaatttattttttaaaaaggttaggtacagttacattgtcgttattgttgattttcatttcttttgttactgctactatttcttctctgtgccaggcgcacgtctaggtgttgatgagtcagtgatcagagaaggtctactttcatggaccatatttttaagtagggaaaggtaggcaataaacagattgaaataagaaataagaaaaatagacaaaagagataatgtcagatagtgattaagttctcagatgaaataaaataggtcagagtaacagtgatggggatggatattttagattggatagttggggaaagcctctatgaggaagtggcatttgagctgcgactgaatggcttggtgggaaagaaacagtctaggcagagagaacaagtgcaaaggccctgagttgtctgtgaccttggtatgttgaaggaacagaaagaaggttgatgtagccaggcatagtactttaaagggagaatggcatgagcttacattgcagggatgggtagcggacaaatcatgtagagccttgtaaatcatgggaaagactttggattttcttccaagtgttgtagaaagttattagagggttttcagaaaggaatttacatttgaaatatcaacagataccattttttaaaaaattcaagtagagatgatatgtagacagttgattatgaaagtgtgtgtctcaggggagagattgggataggagagatataaatttgggcgtcatcaatatagatgatatttaaagctatgtgaattgctgaaatcaactagacagagaatgtagatagagggctcaggaccaagccctctactctaacattttatagaagtcgccagaggaatccaggcatggtggctcacgcctgtaatcccagcacgttgggtggcccaggcgggtggatcacctgaggtcaggagttcaagaccagcctggccaacatggtgaaaccccatctctactaaaaatacaaaaattagctgggcatggtggcatgcgcctgtaatctcagctacttgggaggctgaggcgggagaatcgcttgaacccgggaggcggaggttgcagtgagctgagatcatgccactacactccagcctgggtgacagagtgagactctgtctcaaaaaaacaaaacaaaagaaagcaaagcaaaaaaaaaaaagaaagaaagaaattattaccagaggagaggaagtgagaaagaaaacttttcatttctgtgtcacagaaattaagagaagtagctaaatgtgtcatatgctgctgagacctaaaaagaaaaataaaggagttaatattggattttgccacatgaaggtcactattattgtaaacaatacactgctatatgaaaagaactagatatcatgccatggactattacagtgtctacattctaaccctaaatggatgactgccttttatctagctcccacaactctaaaatttgaatggtaatattgctctgcctttttgaaaaggttgttataaagaatatgggatataatggaaggaaaggtatataataagtgataaagtcttatacacatgcaaatcgatggtggtagaattatttgtactattagattataaacttcttcagggtagagattaaggctttaatgatcattctatcgaccacaatgcttagcatgataccaccccagtatcttgtatttagtggcttaaaaaacaaaataaaaatttcccacatgaagccaggtgtggtggcatacatctgtagtcccagctacttgaaaggctaagacgggaggatggcttgagcctgggagttcgaggctgcagtgagctatgattgtgccactgcactccagcctgagtaacagagcaagatcctgtctctaaaaaataatatagataatttaaaataaataataagtttttaaaattcccacattaaatacagggatgatatggagtgatgttgtccacttcttttcttacctgcagtcccatataggatttggtgacatggttgcaattgtgaaaaatttcagtgctgactcgccagccatctatcccttttacaaagtaatctctttgaagataagtgaaggatttagagattgggctgctttccatttgttattttcaagataaaccattctcagaatttttcaggtttcctcacttgggtacgagacaatttctgaaatcagtttttgttctataagaacaaatttatgaaattcggtatcactacatggacatgttttagctggtgaaaaattgtgttatgataaatggggaacatacaaattttcccttttttgttatctttggctttttctctgtgttatacagatgttgagctttctgcaatatgcaaacagtttagtaatttgcattgcaaatagattacaagtaagtgacctttgcaaagtgcttctgcctagcgagtccctggaatgaatctgttttatttagggaagagaggctagaaaacagaaatgtcactttcattctttgctaaaaaatgaagagtcttctttctgctatgcttaaatatgatgataaacattttcttaaaaaccaatatatatatgatgacagtctcaaaggtaaaaatcagaatgtttttatatgaagcattacgtgtacccttccattgctaaaaaggaaagtagagtctgtcagaaatgtgtttgttttttcgggtctattgacacaaaaatgggcttgaggactaaaagatttaatgtggcttgtcagcatgaaagaggctgttgtgttgttaatgtgaatgctaatacttacgtagcataaaaaaagaacataggaagtgggcatctcacttttaaaatcatggtgtattccataagtgtcagctgcaaagtaactttccagaaatggtctgatttccccattgacttccattatagaactagagctgtgttcccatggaaaataaatttggccccaggttataataaaacacagtgaagaattcagaaaatcttataaagtcaagtttttcaaggcacaattatcagtacttgataaaataataacaccacaaaatattaatactctatagtagatcttaaaatagtatgccccagactgcaccattatttttctatacaattccaagtctattacttttgcatctagagaaattttacttctgtgatcattattaatttttaatggatttaactctaatttaaactgttgattttgtttccttttttctttatggttagtccacttacctttttctaaaacattcttatctatgacaatcaaaagttactagccatagaagaaagaccagaaggaaatgctccaaaatgttcacaatacttgtttctgagtgggaaattttagttgatttaagtttttaatttctaagttgtaaaaaagggccatttatatcttctataatcagaaaaaatgtattataatttctataagtataaatttatatatagtgagatatctttagtaggacacatttatatatttggttcattttatgatttggtaatggtagttgttaagatcatttattccttcaaaatttttttaaaactggtaaaattagtttctggagataatagcttctacttaattttctagaacatactactcaaagtgtgggcctggaccagcaacatcagcatcacttggaaattagttggaaatgataattcttaggcccctgatctggggccccaggaaacagctatttgtgttttaacaagccctttgggcgattaaggttctaaagctacagaaaattctctctagagctacagcaaattttctttacctctctctccttctcctccctctccctctgtgtccctctctccctctccccttcatcctctcttctccctccccccttccctccttctccgtcttcctcctttcttgccaggccacttcctctcctttatagaggaaaagtagtttctcttctcacccattgctgggtttgtagctgagacctctaaaacaaaagacagattaacaagaggaaaacttatggatttatttaatataagttttatgtgacacaggagccctcaaaaatgaagaccaaaagaaatagggaaacttgtatatttttatgattaggtttgatgaagagtggacagtagggaaatataatcaggcaaagggggtatgatctaatggtaatgagctgggggaacttagcaaggcatatttgttcagattcttctctgtgtccatatgtctccagagataaggacattcttttccttcaggtataggaggagcagctctgaaatgagggtcttataacctacttcagaggcagttaagagaatcattttcttgcctgcttcaggagaaaaggattagaagatcagagagaacttcctgcttttgctgatttctcaaatgccaaggtgccatattttggggaagtgtgtcttgaaccccatcaccttcttccttctctgtttcctttcctcatgtgggttatgcatatatgtatacacacacacatatataacactcatatacagaattcactataacctctttttttttttttttttttttgagacagagtctcacactgtcgcccaggctggagtgcagtggcgcaatcttggctcagcacagcctccacctcccgagttcaagcaattttcctgcctcagcttcccgagtagctgggagtacaggcgcgtgtcaccatgcctggctaatttttttgtacttttagtggagacggggtttcactgtgttggccaggctggcctcaaactcctgaccttgtaatctgctcaccttggcctcccaaagtgctgggattacaggcatgagccactgcacctggcctcactataacctctatctctacttatatagagatgtatattaaaaagagagaaaaaaaaatatatatatagttttttctttaagttttttgccactgttttctaccttactcataaaaatatatgaggccgttttctggtatttatgcctatatgctttcatttagcaaacattttctaacaaatgttccgtgtggctacatattgaatagttctgcctaatttaaagatcttcaagtctcactaaccaatataatgactctatcaagttattttgggctaaaatgtgtcttccccaaaattcatatgttgaagtcctaaccaccatgtacctcagaatgtgactatatttgaacatagggactttaaggaagtaattaagttaaaatgagctgattagggtgggccctaatccaatatgtctagtgtaagaagaagcgattaggatacagacaggggaacgactatggagagacctcagaagaaactaaacccaccagaccctgatctcagacttctagcctccagaattgtgagaaaatcagtttctgttgtttaagccacctaatctgtggtattttaccatggcagccctaacaaactaatacacaagtatttgtgcattactaatgtatttatagaagtgatgatttaatttaatcttaacatctagtgattgattgcctttaaaaggtactgttgagccatgttccttaacaaaaagctacagctttacaaagactgcccgagaacagtatgaaaaactctccaccatgcacaacaacatgatgaagctctatgagaatcttggagaatacttcatttttgactcaaagacagtgagcatagaagagttctttggtgatctcaacaacttccgaactttgtttttggtaagtaatacatcttaaagcattgcaagacctgttgcttatatttctgaatgttttccttctattgtcattttatgttcctattgactatattgatttcatgtgacatttttttaataagaattgacagatattttatacctgtgacatggataaaaattaagttataagtcatggctggcttaacataatgtggacctaaatgaatcatcttcaatgttaagtatacatgggaaatgttttactgaaattttataggaaatgaatgaattggtacttaaataaccccaatttttatatagcataatattataatttcacgtagcgtaaacattaatatctagaacttttcacataataaattcaaatgctgtgatttataaataagtttctttcacagcctaaatgagaaactgattttgaattggactgtgtaaataacattgaatacctaaagtttctttcacaatgtgggctcttgttttaaactggaactcttgaggatcacagtaaatattagcattaattgggggtggcaattagggtacaagttatgatgctaaaaggaatcaaaggctttgctatataaatgctatggaaatacacgtcctctgcatctaacaaaggagtagcaggaagagcacagactgattgcaatagtaacagaaagatatgcataatagttgatatcaaacaggtaaaggtgtgtgtgtatatatatatgtgtgtgtatatatatgtgtatatatatgtgtgtatatatatgtgtatttatatatgtgtgtgtatatatatatatatattttttttttttttaattttttttgatatggaatcttgctctgttgcccaggctggagtgcaatggcgtgatctcggctcactgcaacctctgcctcccaggttcaagtgattctcctgcctcagcctcccgagtagctgggattacaggcacatgccaccacgcccagctaatttttgtatttttagtagagatggggtttcaccatgttggccaggctggtctcgaactcctgacctcaagtgatccacctacctcagcctaccaaagtgttgggattacaggcgtgaggacctctagcaataatccccaacaggaagatcagttaacaaacaaattcattccagtgtgaggtattcccaaagcagtactttctttgtattcccaaagcagtactttctttgtcaatgctgttgccctgtgaaatcatttgattttggtgtgacttcatctgtgagatatgaatatgcttgtggaaatcaaattgctttcatctcctaacccagggcctataacccagagcatacccgaacagttaaacaagcagctttagtcacagaagttaatccacaaacttccagaagtatgatcatatgtcttcttttttgctgaaaatattagttgatttttgtctttgacccttcatagagacacatactttttagctaacccataactagtagaatgtgttctactggcaatgagaagagggctaagagaagtagtcaaatcattttcaaaacttaaaagctgattatatgctatgaacacataagcgcacaggttatatctacttggattattttcaaaaaggacaaaacaatgaacattaaaaaggaatgatgaccagaaaatatactttagttgacacactgaaatgataaatccaataattttttttgtaacaatgtctgtgggtgaatggatatataagaatatgtatgtggctaggcgcggtggctcacacctgtaatcccagcactttgggaggccgaggcgggtggatcacctgaggtcaggagtttgagaccagcctggccaacatggtgaaaccctgtctctactaataatacaaaaattagccggtcgtggtggcgggtgcctgtaatcccagctacttgggaggctgaggcaggagaatcgcttgaatctgggaggcgaaggttgcagtgagccgctggagacagtgagactctctgtcccaaaataaataaataaataaaagaatatatatgtaaaatatataagaatacatatgattaatattgttgatctccatttagatcctaaaacactgtctgtcttattatatgttcccttacctccccaatacacagacacagagtagtagatggtgtacttgcccccccatgttgcagcattcttctaataattccagtgttacagcctgtgtgtactcatattagccatatgcctagaaggctaagaactctacttgtatcacttttcaatcataacttgttttttaaaaatgtaagaatattattgttaacgagacctgattttgtatcctggtactgccactaaaaagctgtgtgactttgagtaagtcatttgtcctttctagctatccatttctgtctgtcttttgtaaaatgaaagagttaaaggattgatctctaagaattcttttccctgttagtagtctgagtcacagttcgaatttcagagatggcagagtcatatatattacatacatatgtaggatatgttttatgtctttctgctgacttcactgcacatgtagcttgagtacagagtaagaatttttcatatattgtcactgaatgtaaataatttgatattcttatgtccagtttcatgtccatttaagttaatttcttgagaacctgttacgattaactttcaaaacaagtaatcagatcctaaatgtgtcaaccaatctgaaacacttacctaatgcactcctgaccagccattgctatctttgccttatataacagtactgctaccacttctatctacaaatctttatcaacttgctgccatgagaattaggtgtgcaacgtattaactgttttgaacgtgggtgggacatataacctctctgggcatttgtttccttgtctataaaagacggaaaataatttaagccatgtcttcctcactactatctgaaaagaccttgaaacctatgctatacagatgtagaatattattagccattctctgactatcctttccattaactactgaaaaccaacttgattttggtaatgctctgggtcacagataaaaggaagagaatggtttctctctatccatgagtggggacagacaaacaaatgcaatataatttgataagtgctgccatagaaatatgttaaggtgcgataataacataaaggaggaactgcctaactctgcctgtgttggccagagaggccttcatagaaaaagtgacattagggcccggcgcggtggctcacgcctgtaatcccagcactttgggaggccgaggcgggtggatcacaaggtcaagagatcgagaccacggtgaaaccccgtctctactaaaaatacaaaaaattagccgggcgtggtggcgggcgcctgtagtcccagctactcgggaggctgaggcaggagaatagcgtgaacctgggaggcggagcttgcagtgagccaagatcacgccactgtactccagcctgggcgacagagagagactccgtctcaaaacaaaacaaaacaaaaaaaagtgacattagggcagagtcttgaaaaatccataggcgtttgacaagcaggtttgaggtttttatacctgacctttaagtcgaagactcctaaatcaacatcaccaacttcagtcaatcctttgtgctcaccatgttcctgtttcatagtgaacttgaagtgatttcactctcccaggggagggaagaaccctgaaagattggcaaaaattgtaatcgccagaagttcccattttcttagtgctttgtgtgtttggcctcagggttcttagcactaaaagcatattggactatagatggaagcaataaaataccagtagtgctgagaagaaaataagagttctgatgcatgtgctaccaaaaattacttccaaatgagctcagagtttcatcttgggagatctatttggcatatgtagcataaacaaaatgcacataccaaaaaatcttcctccgatagagatatcctctaaaagatggggcaaatacaaataaaagaatttgacattatggattaagatctttttgaaagtaaacaattcaaatgaatgaaagcagaattggataatgtctttggaagacttctattagttaatattcctattctatattactcagctaatgaggatatcaaaggtattccagatgaatgtacaatatattggtatcaaggtatatataattagaaacatttctaaattcagaattgagaccctttctagttagtttctcagagatttcatgagtttaaagaacagcatacaggccaggctcagtggctcaagccggtaatcccagcactttgggaggccaaggtgggcagatcacgaggtcaggagatcgagaccatcctggctaacacggtgaaaccccgtctctactaaaaatacaaaaaaattagccgggcatggtggcaggtgcctgtagtcccagctacttgggaggctgaggcaggagaatggtgtgaacccaggaggcggagcttgcagtgagccaagatcacgccactgtactccagtctgggggacagagtgagaatctgtctccaaaaaaaaaaaaaaaaaaaaaaagaacagcatacaatatagacaaaattaatagcccctaaatttaagttgcatattttgtggaagaaaatcaaattccatgatacacaatggagactcaggagggttttgtggtaggaggggtgtggataatgagaaaaattacttaatgggtatgatgtatgttattcgggtgatggataccctaaaagctctgacttgacgactgtgcaatccatgcatgtaacaagattgcacttgtacttcataagtgtatacaaataaatcaaattccatatttatgcaatgtctaaacatcttttttgcttattctcctttctatgcttcagtcattcttttagttcaaatagttgactgcacaaatagtcttttttttcttttgagatattttgaatagaatattcaaaatcggtgaaccgtatatgtttcaccaccatgcagtatcttgcttaggcataaaaattaatttcagctgttgggaaagtgttcacggcaagtattatacttctataactttcacagctccaaataaattatagaaaatacttcttttctgttttaaatctgtcagtttcctgctgcttctgtgtgtttttgttttgcttttttaaagaacaatatgttacccaggcactccataaatatttgttgtgtgtgtgtcctcattctgtacctcatataccaaatataggaataaggctttgcagaattattagattcattgacataacttgaaaatgttaccgttgcttttaatcatgccagccaatttcccctcaacaaaatcagtatgtgctactgttcatttgataaactttggaacagctcctagatgagcattaaaataactaagtgttaagatgctaaatgatatcaagtaatcatagcgttttatgccattattcaggcttgctgcttctacttcccagattgactgattgattgagaccgggttgctctgtttcccaggctggagtgcagtggtatgatcatagctcactgtatcctcaaactcctgggctcaagtgatcctcccacctcagcctcctaagtaactaggactacaggcatgcatcaccatgcctggctaaatttttaatttttaatagagatgagatctcgctgtgttgcccaggcttatcttgttttcctggcctcaagcaatcctcctgcctcaacctcccaaagtgctggaattacatgcatgagccactttgcctgaccctagataacttttgaatccatccatttctctccaagcccactgacactatttgaattcctggcttcaaccatctctcgtccggactataataatgacctcctgactggtatctgtgtcttcttctcttacccatttccatttcctaatccattcaccccattttagtcagaataaaattaaaaacaaaagaaaccaaacaagataaccttagtttcctgacttaagattctttcataacttccctgtggcctcaggataaatctgagcttttttttgagatggagtcttgctctgtcgcccaggctggagtacagtggcttgatctcagctcactgcaacctccaccccctgggttcaagtgattctcctgcctcagcctcctgagtagctgggattacaggcacccaccaccacgcctggctaatttttgtatttttagtaggagacggggtttcgccatgttggccaggctggtctcaaactcctgacctcaggtgatccacctgcctcggcctcccaaagtgctaggattataggcgtgggccactgcacccgaccaaatctgagctttttaaactaaaatggtttacaaaatcaaaagagctatggttactttaaaggccagaccatctatggttggctctgaatgggccgcagtcacttagattgaactcttctcccaaattgggaaatgttacttctggaaagtagaagcagtagaacaagataatagcaagttcctaagaggaactgtgtctctcagaacaaagagaaactttggaagcaccatatgaaaattcaaaaaaggctgaaaggccaaagtatgattgtcattatgcctttattgctcccatagctggtgtgacatggagagttataaccactgagttcactcttacgttaattctcagggatgttcttccttctatcttaagtaattgttctttaaaaacctaaacttgtctgagagctccctgtgtagccatgttggcttatggagataattaattttgaaaatctctcatctctcttaagctatcttcccttttacaaggcctcagtcatgtctaaatctaaactataattggaaagtcaatgagtatatctgcatttagttaggcttgaaagactaaattgataatatacagaaaatttgattcatttattaatggtaatttacctttaaagaaatgagggtgaatttttacatgaaaggattgtgtatataatccctgatccaaaatgacttaagttgttttgacacatttttaaaccaagcacttgacattaaaaaaaaaaaaaacttcagtattataaaaatggtaggcttatgtgagaaaccaaatatattgtttaacaaagtagtgtcttaatcagtaatgtaaattctgatatctagaatttcatcatccagaaatttctattagatgcctcataagttggtgcctctttgctttgccagtaaaatggtaatattctgaaaacaaccttaagaagctgcaagaccgtgatgtgcttctttaatgatatagttttttttgtaaactagatgtctccaggtctcttcatttatgaattcagagggggtgtccttagtaacagtaatccaaatatcccagttatctcctcttttcccccactggcaggactcaagctctttacaaagtctttacccctaaaagtacacctggagtcatttcatgggtgctgaaaacgtcatctgtagtcaccagttgaaatttgctcaccaatcagcaactgagtgcctttattctagagtgatgaaaatatagcaatgaacaaaacagacaaagcccctgcctgtcctgtcttgctgtagcttcagctccattctgctaaatgctttttgcaggcaaaactgcttggggttgcctttaatgaaaatgcctatgtgtgggccaagggtacagtttcctactgctccaattttgtcatcaatcttgaagtaccattgtggtattatgttcagtgcagaagtagccatgtttcacaggacacttcataaaaacagttcattttgcatctcttctgatccctttctccttggagactaaaaactgtttcaactcctagagacctgaagggaatcctaaaatcttaagcccctccattgccctccttctccccttttgttcaagtgcctaggcatgtatcttccttttcctaggagctgggaataaataaaatgccagcataaatcgtttcatgcaaatagagccctaagggcccaccaactctctctagttaatcatatacacccagataattccctttgagctcagctgggaccaccctgggtatatagccttaggtttattttgatctgttgcaactctttgaaaataggcaatccatggaaaatatatggtaactctattaagcagaatatttgaccggaatacctcattccccagctgtgccagagagcagactttactgtattttacagatatcattgaattcttctttagaaagagatgtcacctatcaaatgttgtattctctttgactgtttactttgggccagaagtggatgtcctatttctcttatatgatttttccttgtatagaaaagctaaatatcatatcatagggaactaaaggaatatgtaataagggaagacatggtttaaggaaaactcaaactccctaacatgataaaaaaaaatacctactagtatggatggtttttaaatatgtatgcattttagattaatattataaaactaaaaaaacagttttttctaaaaatatttataaaagttgacagaattgtttatgacaagctgaattttaccctttaaaaatctgacaatataataattaacaatgaaaatattaacaaaatcagttcaatgccaccttttcctattaaagtctaataagaactagaatcaggaaacagaatgtaatatctttagttccagcaacaacgcctcatgcagaatttttcacagaagtgttccctataaataagttattattgaattatgtccaaacaccaggaagtgggaaagtgtaagataagcaatatggtatacaagctgaccttttccagaagtcttgagattggccagaggtattgattgtgatcagagcatgcctgtttcaacctaagcatgaagatccctgaggttaatactactggtggcaccctctcagctggctgaatttttcttcattctgcttcatcctgttttgtttgtccatttgctaattaatcttctgtcagaaaagatgccgtcacccctgaataaggcagtagaagggaggacttccccggaattgtgcccattgagctcctttggtatgcctgccccctcttcttctcccccctccttccagttgcctaccaacttgttcaagtcatttcctctaagaagccctccctaacttccatttcggtgtagattacccttctctgtgctctcatacctccatcttagcacattttaccctgtaatatgtttatctccataccctcgtgattaatactataattagcctactgtgggtcaaacacagtgctgatctcgaaggatatgtatgaatggcttaatgaattaatagaacaatgagtgaatcaaacaaaaaatcaaaatatttgctctccagagctcacattctagtgggaaaggcagtgaaagaacaaatagtggtaatgaaatataatacatatgtacaaagagcttgtaagcacagagcagtgaggcatttcttctgtctgatttaaggaaagcttcaaagacatagagatatgtgaactgggtctgatcattgttttgctactatatggcctttcatgttttaaggagcactttcctttttgttctcccccacctcatttggtgtttaattttaatggtaaacatacattgtctcctagttttccatgctgagttcaaagtggaaaaacagctattttgttgccagagaagcagttaccagctaattatgatgatctaaaggttatctgccatatgcttagatgagcagtaaccaagcttcagttacttcttatgactgacagttgtcctgagcaataggacaattgatgcagattatctagggcaaaagcaactgcttaaagtctgacttgcctggtgttaatttaggccagtggttctcacccaagagcgattttgcctcccaagggacatttggcaagatctagagacatttttgtttatcacaactaagtaggatctgcaactggcatcaagtggctgaaaccaggaacactgttaaccatcctacaatggacaggagagcctcccacaataaataaatattcagcccaaaatgtcagtaatgttgagattgagaaaccctgtttcaggattacctgcaaaagattttttaaaaaaaattataaaaaatcagtggaaaacaatgtgcaatagtccaaattaataagcaaaatctactagataagttaatattatatctatcatattgatgtaatattttaataatttcaaatgttaatttgatcactgtattgttacagttactacttttttctatagctttgaaacatcccagtttatatggcttgtaaaattttttaattaccaatcatgcatgtaaattgtagaaaaattagaaaatataaataccaaaaagaaaaaaaactgtcgactgcaattccactatccagagttaattaatattaatacctcggtacatatccttccaggcattttcctatgcatgtacataagtatttagattgtgaatttgtttttcttaaaataataataaaaagacttctgaaaatttaagttttaaatttatattttcttgtaaaaaggctagtggatcatgcttatatggatatgtccatccacattcagtgtatagtgccgttggttatgtcttcagttgtgattaaacatgttaattggctcacttcatgatgcccttttacaaacacctggtctttggcaccatgctaacaatcatgactactgtaagccatctgtaaagagatcggtagaatcttgatttctctttttgttttctacataataccctcattaaacttccctgtgtcaaggggccttaaatcagtaattggtgactgtccagttaggctattcacactagtgtttcttaagcactttgctgttgttctctgctgtgcactttgatttaagaaccattacttacctaaactagggtgttcttttttaatcattgcaaattgttaataatataatgatttgtaatctaatcacaaaaattcttaacaaaagcaatgttacgatttaaaatgagagtaagtgtcctatatatgtcctatatatgtgtgtgtgtgtgcgtgtgtgtatttttttcctttgtttctgtcatcctcttcttgaatcaaatttcattgtcatggaatacagtctcctaaactgctttttaaagatctgaaacatggataatcttttttttttttttttttttttttatgatacagagtctcgctctgttgcccaggctgtagtgaagtggcaggtctcggctcactgcaacctccgcctcccaggctcaagcgattctcctgcctcagcctcccaagtagctgggattacaggcacctgccaccacgcctggctaatttttgtatttttagtagagatggggtttcaccatgttggtcaggctggtcttgaactctggacctcgtaatccacccacctcagcctcccaaagtgctgggaatacaggcgtgagccactgcgcccggccatgttataatcttaataatgaggcagctactatttttgctcatatccattttaatttctgtttctgcaaacatacggttttggaatattcagaatttcctgacattgttcatggggtattgggcaaaccagagaatacatagtattcctgaaaagctaatcatccattcaaatcttgacattttgaaatggaagatgctctattattcttcagggatcttatatattttgtgctcaaactactggattactcagtatgacagtgtagttgaagtcattttattttattttttcaaatttattaatcaggcacaaaagagccaaacttcatactggagacactatagtttagaatagtgtattatttgttcgtgctcaattgtctttggtctagtaataaaaaactaaagtctcatatacattggggacatataaaacagcagtaattaacaaaacagtctgggtgcggtggctcacgcctgtaatcccagcactttgggaggccaaggcgggtgaatcatgaggtcaggagttcgagaccagcctggccaacatggtgaaaccccgtctctattaaaaatacaaaaaaaaaaaaaaaaattaggtgggcatagtgccgggcgcctataatcccagctacttgggaggctgaggcaggagaatcacttgaacccgggaggtggaagttgcagtgagccaagatcgtgcctctggactccagcccaggcgacagagcaagacttcatctctaaaacaaacaaacaaacagatgattatgtaaaatggatgaaatcgcaaatataactgtattaaacaatataacctctacatgggagatatgggttggtgttccccaaaaacttgaaactttattttgaatgttaattatttttagtgttgtgagcaatcctccttcatcaaatgacatctacgagatattatttgtgaaagtatttgctcctttgtttaaaatataagatttgtaaataaaaatttaagatgaagccttttttaggtgacagtctccttctgttgcccaggctggagtacagtgatgcagtcatagctcactgtagcctcagacccctgggctcaagctatccttccacctcagcctcttgagtagctaggactacaggtgcacaccaccatgctcggctaatcttcttcttcttctttttttttttttttttcttttttagagacaggatcgtgctatgttgcccaggctggtcttgaactcctggcctcaagcagtcttcctgcctcagcctcccaaagtgttggaattacaggcatgagccaccatgcctggccagaagcattttttaatacatcctaattatatggttgttatttcatactatattaaaagttttagaatagaatatattcaaatagatagacttgtttcatgtgagcattatttaggcaaaatatgttttaggtaactctttaggtaacagtctttaatgaataggccaaattaattttcaattattactataagtgcttgtgtatgtagatattattgctcaagtttttctgtaagtacctgaaaataattgatttaactctgcttttgaacgcactagcatattttgatgtttattcttttgtataatgtattaggatgcctttagctgcctagtgacataaaacataactaaaattagcttaagaatatggttttactctcttacatcacaagaagtgtagaggtaaggcagttacagggttggttaattcagtagcttagtaatattattaaggacccaggatattccagatatttctgttctgccatccttggcatgttggctcttggttgcacaatggctgtagttgttccaggcatcacattcaaatatggggacgtctaacaaaggagagtgtgttgtctctatgaagcttttttttcaattagggagaaaagcttttccagcagctcctgggcagattgattccttcacattttgttgtccaggattgtgccacatgcccatccatccctaaactaatcaccatcaaggagaaccttagattaatccatggctttgccagcaagtaagatggctggcattggcagcgcgcggtggctcacgcctgtaatcccagcactttgggaggccaaggcgggtggatcacttgaggtcaggagttcgagaccagcctggccaacatggtgaaaccctgtctctactaaaaatacaaaaattagccgggtgtggtggtgggcatctgtaatcccagctacttcagaggctgaggcaggagaatctcttgaacccaggaggcggaggttgcagtgagccgagatggtaccactgccctccagtctgggcgacagagcaagagtctgtctcaagaaaattaaaaaaaaaaaaaagactggcattgcatggattgggacatgcaactaaaagtatcaatatagcacaaaagtaaattgttgctcagtattatttgaattgtcaaacgttgcaaattggcaaaagaaaaataaatgagatgttatctgtgaaatatacacttgtgttcaattaaatagtttttaaaaatcttagaaaacagaaatgtaaatagaaaacattacccatttattttgaagttatccttcactgtttgcgttctgtctttcgctagaatatacttacacaaggacattctgcttttctaatttgcttgaaaagctattagtttacttgctttctttttctcattcattcattcaaggattatttattgagtgcctattaaacagtggacactgttctagccactggcattgtttgatttatttcagtaaactaaaacagattttaaagctctgccatcatggagccaaatgtggaaaatgagaaaataaactataaacataattattgggaaaattatattacaagttagaacgttaagtgctatggaaagaagaaatcataccagtggaatggccacatgacagtggctaaaaggtttcaacaatagttataaagttccattgtgcaatcaatttcttaagctaagatttagattttaacagtgtaaatgtttcctaaaattcagggatcactgagttgtcctatttagaagacttcactaggtacagttagatgatttttatacaaacccgaactatttcatcagccatgtatccttatgtgatgtagaagaaataaaaattaattctgtcccactttacagaaaaagtcttgccaagggctttattgtttcagttaaataattgtaacattatcttctggaatatggaggatatacaaatagagaactttacctagaagcccggcatattgtctacttttagacacagatcaaatttaaaaattaaagaggaaacacctgagaagaaatctgtccttttcctaatgccatttcaaaatcaatggctcttgcctttgttaattaagcaagttaaaacctttccttgttcaagagaaaacaaagcaaaacagtatttttgctattaaaaacgccaactaggccaggcgcagtggctcacgcctataatcccagcactttgggaggctgaggtgggcgggtcactttaggccaggagttcgagaccagcctggccaacatggcaaaaccccatctctactaaaaatacaaaaaaaaaaaaaattagcgtggcattgtggcttgcacctgtaatcccagctatttaagaggttgaggcaggagaatcacttgaacctggaaggcgaaggttgctgtgagccgatatcacgccactgcactccagcctgggtgacagagcgtgactctgcctcaaaaaaaaaaaaaaaaaaaaaaaaaaacctaacaaatacagattcagtctcagtcactacttcttcctcaagggaactcggatatcttatttaagaagatagacaataacatcccgaaatgggtttctagacaggaagctctgacaaaaggtgagatgtatagcaaagcatgtagtgaagtaaaagcatatttttagtgccaaaaatatgaaaaattataaggaacttacaaagacatttagttcatcttggattcctttcccctggtccttgttctctgccaactgtcagctagttgatctgataaactaatgcagtactaatgtgtcactcattctgtattacatacatgccctttaaattcaggacaatgccttaattcagcagagcaattctgctgtcaagaacttcttgcaacatggctagctgatagaggaaatattggagggaaagacagcctttcttgtacctctgaaagaacatcatatatgtagctgcacaatcttcctgggtctagaatttttccccccacctcacaccctcctcccaaggacatttcacaatttaacctgtctgttctggtgtcataatatagctttgtcaaattggcatcttcctgggagtgacctccccttcgacatggatcagagaattcaggcaacccaaaaccctgatccagcccaccctgtcttttgagaggctggaaactcaggagtttcattggcagagatgtagtatcaactcagctttgattttccctttctttctgggtgacatttacttttttatatattgtcccttaggcagaaatactacactcaccttgtaggcttagcaggatgtctacagggggttaccccaagcttactgtgtgaaacccaagccatgctcagctcacttactcagccacggagacaaaagacaattagtgccttatggtatagtaggtacaaaagaaatgttttatactccagatttcctccctactctaccttatggtatggtacatatacagcctgatcactagaataatcctttgtcataataaaggcgggatttcttggtttgattttcagtaaaaatgtctcctggtgtttttttttttttttttttggatctccttccttcaatcttaaataaagcatttccaaaggtcttacttttggtcctgcatatttttcttcctgggtagttgatatctattccaatggctcctacactttcctgagttgtgattttattattcagctctagacccaagtttattttctgttggatgcctctaactagatttgccataactacctcaaactcagcatattcaaaagggaactcattacatccttttcaactttctcccatattctctttggctgatggtacaacttgatatcttcttttccctcgctatttacatctgttcagtctccatttcatacccagcttatgcagttaaaactcaagagactctatctgttttttatgatttccccatcagaatcttaccaaagcaccgttgtttgcatgttctatattaagtctcagcaaagaaaaaaaaatcttactttcatcctcactttaacggcccaagtttcagtgtttgtcctctctccttcccatggactactgcagtaatcttttagttctcctgagcttagtcttagcactctctaaactgtatgctgctgccagatactgttttctaaaacgtaggtttcattgggacattcaccttctcagaaaccttcagtggccttccatgggtgacagtaaagcctagactagcatttggaaacccttggtaatctaactctccccagccactaccctttttctctgattggaatacagtcacacgcacagtctcccttctacctggtgaaattgttttcaactttcaaaactccatttagtggctactttccctgttatgcctttcctaataccccctgctgaactccagggaaaattaccccctatttggtatgctcatcatatttttctttttctttctttcttttttttttcattttttttttgtttgttttgttttgttctgtgatggagtcttgctctgctgtccaggctggggtacagtggtacaatctcggctcactgcaatctccacctcctgggttcagttctcctgccccagcctcccaagtagctaggactacaggtgcacaccaccatgcccagctaatttttgtatttttagtagagacagggttaccatgttggccaggctggtctcgaactcctggcctgaagtgtactacccgcctcagcctcccaaagtgctggtgtgagccatcgcacccggtgctcatatcatattgttaatgtggcttttgtaatattcaactaattggtgatgtacagacctgccttctttgtgctgtgaattcctttacagtaaatacgtctcacttatctttgaatttttattacacaacagagtgtgtggcacataaaagtaaccagcaaatatttattgattggtaaccatgtttgtaattggtaatcatgttcctactgttctagaaatctaataataaatggtcttttagattaatatttcaaagccctctagctgtctctctctgcctctctctttctctctgccaccttttcaagatctttcattattttaacgactccttttactcttcgtcaacattgatttagcaaatatttgactcaagtacttaaacttgtctactttcactccatcactctaagttgtgaaatcccaaagtgagctatattttcctggtataattcttgagcagagctaataataggcacaggaagtacctcatgtttactccattttatttctacattctagcatcaaacctctcatttgtcagcctttgtgatttactgttcacttatgattgaccgtgaccatttacatcttcattatttatccatagccagcagacacctgcttatgtcactagatttttttttctctttatgataaaaatcattagagaaggactattcttcaaacataccttcaaacatctttctactttctctaagtcttactagcttcaaagatcctttgaagaaagaattgaaaattccaacttctcttttctggggagttgctatacttttaaaaagtgtaataattctaagtttcacgggataaaattttgtcatttaaaatttcttaagtatattatagtgtcatattttatttttatgagtgcttaagtataagcacaatatgcaaaaagtaacacagatttcattgtactagagtatccatgagtcaaaagggcatacagaagtttacattgaaagaagtcaagtctaacacatgacatttattattgcaaagtgttgtataggaaataaaattcaatgtgtctgtaaatgccctaaatcctcttataagttatttgtccaacatgttaagcctaatggaaaaaaatccctttataccaataaataaggcaacttaagcagaagattcatgatgaagccagaaaaactctataaataatggggtagtacccagggaggagggaggtaaaggaaagggcagtagatcattagcacaataaggaaaggatattcccatcagtaagtaagcagtgatatttggccaaatctaggtcatgatcaaggatataatcacaagtgagatgttttacattgtgcaatgtagctggcatactcatctacagatggaatggcttgcttcccagaatgcaatcactactatataacagtgtccttattatttccagtttggaaaagaggattgtaaagcagaatatctctggttccgacctgtatcccattcaaacatgatccacgctattttgttttcagatatttttacagaccaactctctgctgtatcatacccaagatttagggtgtcaaagaaagatatgaaattgtatattcattgtatttttttgtttgttttataaactaatgactcagaaacatatacctatagagccagaatagcctaggatagaaactaaggaattctctatcggtaaaatatctttttttttttttttttgagatggagtttctctcttgttgcccaggctggagtgcaatggcacaatctcggttcactgcaacctctgcctcccaggttcaagtgattctcctgcctcagcctcccaagtagctgggattacaggtgctcgccaccaggcccagctaattttttttgtatttttagtagagatggggttttgccatgttggccaggttggtctcgaactcctgacctcaggtgatccgagtgcctcgcttcggcctcccaaagtgctgggattacaggcgtgagccactgctcctggccctctatcggtaagttatcttaataactcaggctcctggcaagttttgcctaacccttcagcagctaactaatctttcaaatagttttctagagaaagtagtttcataacttgacttgattccattgctttgccatccttaatgtaaacttctttttaattatcagagtttctctttttaaaatttaaattcaggtcctattattttgacgtgggaaactctggaagatatctaataagacttgttctttaaatacatatccacttcatgtctatggatatagttatatcccttaattcaatcttccctgagcttaattatccatcttttgttcatggtttggcatttcccaaacgttcagcacttcttttattcttcatcggacatcaggtttttacatattctttaaacagtggaggatccagatttgtgaggctgtattttgtataatttgggagcagccatttaagaaaaggaatttttttttaaaagaaatcttttttatttttaaattttagcaaaacacatggccaagtgagcacattgccagtgcccctcccatgcaagttagaagtcctaatgcttttgctcattagcttcatggtgaatctgtctctgccctttgagtcgttcatcccataaattaaccacagctcttttaaaaaggccaaactgtcaaaaagtataagcccaagtaagatattggctatcacatatgcatgctggtctggtatttacactaaattaatcagcattgtcttcattaagtaagaaatagttattgcatgcctcttttgtattaggtgctgtaataggcttatagttaagggtgcttatcttaatagaatatcacacctgaagcaaactaaaccaacagagtctaccctttctttttttttttttttttttttttgagacgaagtttcgctcttgttgcccagactggagtgcaatggcacgatcttggctcactgcacaacctccacctcccaggttcaagcgatactcctgccttagcctcccgagcagctgggattacaggcatgcacaaccacgcctggctgatttttgtatttttattagagacaagttttctccatgttggtcaggctggtctcgaactccctacctcaggtgatccgcccgcctcagcctcccacagtgctgggattacaggcgtgagccaccgcgaccagccagaatctacctttcagaggctgttaaactaagccaacaccgaagcaaatgtgcataaaggatatctatgaatatctgaatgcatgttaaatacataatggatatattaacattatatataaaatagggtgagtgcatcttgtagtgatggttagtgaagcagcccttgaagtctccaatttaatctgagggaggagaggtttaaaggtatgcttgctctataacttcattgcccttaccagcaatattacctagtggcgtgaggttaatttaaggaccaccatgaccactaagtgctatgttttcatacttttccacacctcatcagtgctcctttttttgtttgtgttgctcggtttccattcatttttgatgttttatatatatatatatttctctacatataaagattaccctgagttttcagacaacatcaataaagggaaaggtgctaccccataattactgaaaggacatcttgctgtcaatatcttggaagataggacaacaaatcatcaaacaatcactttctacttacaaaagcacaaggttctgactggcaatcaagaaggctttgtgaaaaacaaattgagcaaaaccatcttaatctacttctttgaaagaatctgttccccatactgcaaaaaaaatctctctgttcactaggatttttattccctcccatgtgacagtcattctcaatgattgaaaataataagaactagactttagagtacgattttaactgatagtaagacagtgctctaggtgggtctgggacatagagcaaaagtagactaaccctctagtgcttcttttgatgatccctaagagccatgagtgaaagaggcttgtttgtgatgcttattattgattccccagggactagaacggtatgtgacagttcatgctggataatgaatgaatgaatgtttcctgcttctcaatgaaggcataagtcactggatattaatcagcctacttttttcttacctttattgcttccctgccctcttcttcctttccctgtccctctcatcacccaaaggacagataaattttcaatggcagtatgtccagagagatttctaacacttcattaaaaaaggaattttattggctgtgtatgttccctcagaaataggatcaagctcagttaggaattagtaagatataaattaagggcaccaagcaggtagcatgcagacaagaacatacataaattcactggaaaaagattcttgatttttagtggaacagtacagtactaaccatgaattagcagtatatgaggtgtaactgttttttaaagaagacaaatcagaaatgtgtaaagtcaaagaaattttaagcctcttgttatcttaattgaaggataatgatattaccctaaatattttgggaacccttattttggatttccctaagagttatgcagcatgtgctttaggtctttccaggagtactaaatatttgtaatctgagggtgcgcttgatttttggaaatagccggaagttacatcaagccaagttttatcaataagatacatgatcaaactgagtaacaaaatatgtggtcaaaaatattgtgaatataaaataatgagactaatttcatttgattcagaggttaattcggaacgaggagtttcaattacagtgtaatagccctcaccaacacaagtttaggacttccaaaggtggctatttgtaggacaggattcagcagatatatcggaaccaatcttctaactttacagttgcacttgaaaatgttacaaaacaaatgctataatattttagaagatttagagcatgaaaaactggtagatattggatagcacatctcttagagtattgtttccagctttgtcctcttcttttttggggaggcaggtgaggatggagaagtctataatttaaaaataatatctaacaagtagagaacacccagaagaaaacctaaacattattaaatgtaggcaaattagtctctatgagaaagttattgttcagaaaatggtattgattggcttaatttaaagtcccaacagtttttctcaagggtctcttggatcccatccttcccccagtactctacaagctaagaaattcacctgcgttgcatttagggattagtttcaactttgtggaattcaggcaatatggcggttcctggggacaagctacacctccatgaaaaagttttaaggaagatattgaccaagtttctatttcacagaggccaacagacaagacgtgggcttaaaaaactgacagcttttagcgaggcataaggaaatatttcctttttgaggaggttaagtatcagaagaggttcctgagggagatcatggaaccctatccacaggcagaacattagagcaagcattcttctagagcccttcctgttctgtgagtctataattctacttgtcaaggtaatttgatattcttatccaagtctctaaggtgcttttgccaccacctaaattggtctcatcaaaaaccttattgattgtgctgcctctcccatcttctaagatggtgacagtattaaggcagtaaactcagatctcagacctgtcacataccacttgttttgtcatttccctccacctatacctccccaagatgttttttcattaaaatattgttaccagtcactttagaatttcattctgttcctttggttcaaaaaattgtaattaatttcctatagtcacttaaagcacttcgtagattttaatcaacagaggtctacattggcatgttgagctcagttgtttatcccttccagatggagataaatattctcaaatacctactaagaaaaatatgtctgcagaaacctgcagcattagaaaacctattctttgctgcagattgcagattaacttctagctaatcagagttcagcattctaatggactgtgacgggagagacagtttttcccccaacttcagatcacatgtttctgcagttgtaaggcaaattttaaaaggccttggggatcacagccagccttcattatcggtgcatgaccgctttgtaaccaactgtaagtttaatatccaaggagatttgcacataacagtcttttttctttcttcttgtttttaataattcacctttgagattctcttcaccaccatgctggtgtgcaaagatctgtttgtctgtcaaacctacagatatgtagcgcatgtgaaagctacattaattttttatttgtttcctaaggaggctgaacaataagctggttttgctgaatacaagagggctacttcagtgaacacatacttgaattcacttcagctggctccctcacctgcagcacagcagtttctcctatgattctcccctctgccaaaagggagtcacttatacaactaaactcaaggactttttgtataaaccatccacctgaacctgagaaggttttgtctgaaaccaaaagattactagaaaagctgtgtaaagcagggcgtggtggctcaggcctgtaatcccagcactttgggagggcaaggcaggcggatcacctgagatggggagttcgagaccagtctgaccaacatggagaaaccctgtctctactaaaaaaaatacaaaaaaaattagctgggcgtggtgtcgcacgcctgtagtcccagctactcaggaggctgaggcaggagaatcacttgaacccaggaggcagaggttgcagttagctgagattgtgccattgcactccagcctgggcaacaagagcgaaactccgtctcaaaaaaaaaaaagaaagaaaagccgtgtaacactgtttgtggatcctgcaagtatctcattcaaaacaaatgcctcattttcaaaattagaacacttcttttaactttggagactcaatgtaaacactaatctctacacaagtgaatttcctcagcggaatattgagctatgtcagtgtgacaaatgtcatggatatcgggcctctgaaacgctaagcactggcatttttaagaaaataaatgtagatgtcagtgaaccataacctatagatgattagaaagaaacttaccattcgaaagtggatgttttcttcaaggctgctaagattttctacaataaagaaatatgaggtgcgtagggaactatgtgtagagacgttctcggtaatttaatgttttgaaaactcccaggctgaaaactattattatgtaaatcaactagctccagctgctaattcttagaaaatggaaagagtatctaaagtttaactagattttgaccttttatgttatgaagactacaacaaggaagaaagaggaagtttgttagggggttattttttaaggtggtcagggaaggcttcactcataagacagacattcaagcagagacttaagggagatactttttttttttttttttttttgagacggagtttcgctcttgttgcccaggctggagtgcaatggcgcgactcggctcactgcaacctccgcctcccaggttcaagcgattctcctgcctcagcctcccgaacagctgggattacaggcatgcaccaccatgcctggctaattttgtatttttagtagagacggggtttctccatgttggtcaggtttcaaacccctgacctcaggtgatccgcctgcctcggcctcccaaagtgctagaattacaggcgtgagccactgtgcccggcctgagggaggtacttaagagcagaaggaacgcaagtgtaaagatgaggagcgagggagaccagtggggctggaagagaatagctgaggaagagatgaggacagagagaggtaacaggaggtcagatcacataaggctttatatgctattggaagcactatttttttttcaactatgagtaggaatagatggcctcactgccagaaaaaaaagaagggaagagatgaggacagggcttcaggggaaggtgaaaattaaagggtgggacagggaagtatagtctagaatggatatggagggaatgcaatgctgtctgtaggaagaaatgaacatagtacctcaggaatcaaagagggaagaaaatttctattttgtttggtttagcagattacctatggtctgttatacttctgtgtttcataccatatttacacaggttaataagcatgcctttaatccctgtctaactacagtatcaatacatttgttcagtgtctgttactgaggcacctaactacttgagcaagctaatcaaggtttcaattaccccagtgagaaagaagttctacttctctgttgcaatcgtagttgattggttgatgaagtatttataagatctttcataagaggaactttaaaggtcacttgtaccataataagtggaaatcgctgggaaagaaaaagtttagcagtattatagtgctgataaagtcttcagaggtactgactctcagagtctagttactgcagctgaaaattctttgccctgagcatttgtcatgactccttcaatccaatatgccctttaaacacagtgaaactatagaaaaggaatatctaatgttgttgggtgttaattaaggagtaggcttccttcctttccttaatggaaagccttaatttgtcttcagttgcagctgaaaattctaaagactcatttccaccatcttatgtaggttttttctctaatgatcaggttgttcaatttcttgttcagatgctgaaaaactcatcttgactcacactgtatcttcctacttgtaacctgatgtgatcattctcaaatgggagtgaaaaagacctgtacaactatatgagtcctgatttacttttgatattctttaagattttcacccacctttactataataacaaataaggacctcagcccaagctacaaatcaggtagaggtaacatacattgggatctgtgtttcctatcacctcttttctccttggttccaggcaagtgcaacaaaagtgtcaatagtataggccaggtgtgttagctcatgcctgtaatcctagcactttgggaggttgaggcgggtggatcacctgagatcagcagtttgagaccagcctgaccaacatggtgaaaccccgtctctactaaaaatacaaaaattacctgggcgtcgtggtgggcacctgtaatcccagctactcgggaggctgaggcaggagagttgcttgaacctgggaggcggaggttgcagtgagccaagatcgtgccattgcactccagccagggcgacaagagcacaactccatctcaaaaaaaacaaaaacaaacaaacaaaaaaaactgtcagtagtagccaaaacaattcaagcacagaatatgttaactatatgaagtagaggaaaagggaagaagaatttttaaaaagaaaaaactttttggtaaaatgatgaaaagttattgcatatagaattgcctttcctgtttcattgtcatgtttaggacatctttgggacagggaaaggaaactgctgctataaccttacctagttcactggtctggacaacctgtccattgctacctattttgcctcctgttatgactggaatgaaatgagaaccccaccaataagcaaaaagtttccacctttcatcctatctcctacttgcaatccctcagtagtgatattccagcacagctaacagcctcctatcagtaaagatgggaaaagtatcagaaagcttagcaaggcctggggtagggaaccaagtgtgggctaattctcctggtccttccgtaaacattaaggcagactaagtgaatccctcattctaagacaaatgttccctaaagaagtaaaattaaactcctattttccaaagcaattggacttttattgtactgtgtgctttattttctgagtgaggtgacagaactagagatgtttaaaaaaaaaaaaaacagtaattcccctccaaatttactacctttccccaggaaccttcatcactcagtttttgctacagtcctgtaaggcatgttgaaacttgagtaaaatgatgcatgaatttgttagtcaaaatagcaaattattctatgacctttattatttcttagatttgtcaaatatgatatcctaacaccaagaattttcccccaaaacctcctgtttattttacctctatcttttttctcttggcacagaaagacgagtcctattatctgttcaaagttggtggcttagagagtgtgtgggtgttttgtttcttcaaatttttacctgatgttgcaagattttcatatcaaaaagaattcttctttctccccagtgtgcacgcacatatgtggacatggtcctggattggaggaaatggagtacagaccctgaaatgcatgggacctttgtattgcccaaatgtggaataatataataataaccaccaccatttattgaacatgttttatgtgccaggcactgttattaatagctttatatgtgattcctcattaaatcgcaaaccaacactgtgaagtacaggtacaatcatgtgttgcttaatgacagggatacagtctgaaaaatgcattgttaggtgatttcattgttgtatgaacatgacagagtgtacttatacaaacctagatgctatggcctactatacatttagactatacggtatacgtaagcctgttgttcgtcgactacaaacctgtacggcatgttactgtacagaatacagtatgtaacacattggtaagtatttgtgtatctaaacatctaaacagaagaggaacaataaaaatactatattaaaaataaaaatggtacacctgtattagggcacttagcatgaatgcaccttagaagattggaagttgctgtcctcagacacaagcacacacattagcctaggactacacagggtcaggatcatcagtatcactgtcttccatctccatgtgttaccccactggaaatcttcaggggcaataacacacatggagttgtcatcttgtgtgataacaatgccttcttctggaggacttgaaggacctgcccgaggccattttacagttaacttgttataagtaggtgtacactctaaatggtagaaagtatggtatagcaaatacgtaaaccagtaacatagtcacttattatcagtatcaagtactgtgtattgtacatcattgtatgcactatacttttataggactggtaatgcagtaggtttgtttataccagcatcaccataataagtacatgagtaatgtgttgtgctctgacattatggtggccgtttcctcactaggtaaaaggaatttatcagttctgttataatcttatgggactgccttcatatatgtggtcccatctgttgtactacatgtcattatgagatgcatgactatatttcacagattcagaaaagagggttagctcagttaagtaaatggcccaagggcataaagcactatggtctctagaggagcttggatttaaactagatctcccagcccttcaaggccatcctgtgttcattatgatatgctgttttacttagaaagtttggattatggatcccgacttaaaatgatccatataaagaggacaatttcctattatttttactctggccataaaattacaggtaagacatttaaaaaaaatcttatcaagatgcataaaattagaattatacttatctaggaaatatggaaatggatggtattctggtcaggggttatttaataaaaattttaagtgttttatttttaaaagaggcgactgaaagaaacaatttaaaaattcttcagtgtctagcaaaaaaaaacccagaaaacttaaaaaaaaaaatctaaaagcacagtctgaattaaagcaaagaaagaatcagttgctcagagagttcaagattaaaaatgtgaaaaatatttaaaaattagctgggcttggctgggcacagcagcacacacctacaatcccagcactttaggaggccaaggcgggcggatcacttgaggtcaggagtttgagaccagcctggccaacatggtgagaccccgtctctacaaaaaatacaaaaattatttgggcatggtgtcacatgcctgtaatcccagctactcgagaggctgaggtgggagaatcgcttgaacccaggaggcggagcttgcagtgagctgagatcgcgccactgcactccagcctgggcgacagagtgagactccgtctcaaaaaaaaaaaaaaattagctgggcttggtggtgcaagcctgtaatctcagcactttgggaggccgaggcaggaggatcacttgacttcaagaccagcctgggcaacatagctgggctccatctgtagaaaggaaggaaagaaaggaaaggaaagaaaaaagaaagaaaagaaagaaactttgccaggcatggcagctcacacctgtagtcccagctacttgaaaggttgaagcaggaggatctcttgagcctaggaatttgaggttgcagtaagctgaaattgtaccactgcaccgcagtctgggtgacagagggagaccctgactctaaaaaaaattgtggaatttcccctattttgttgagttttcattaaaactactatctcagtgactcatatttagtgtataaaaagatttgcaatataatacacaccacgtttctttatattgttgccaaatcatttctctcagtatcattttcaaatccttccaacacccctgatcaacgaagaaatactcctcagtgtgatcacagtattcctctggcaccagagttaccaatttgttcaccatgacatttctaatttacgtaattttatggttatgtgactctactatcatacaacttctgatactgtaatgaactgaaagtcttgccaactatattcacgcgggtaaccagaatgatccaaaactcaaaagagaaaatgaatacattcctagtatttttttttcttttcatgagtgccaagttacagtgatatatatggaatcgtagaattaccttagatgccaatattatggtacagttgaaaatcatattcagtatagttatgagggtagatagtatcaggttggtatatttccagtcatagattatgtcctcataacttccccaaaaagggaggaagggggtttgcaaaataagtcattgaaaacagatgtggtcatttgtctgtcaatgactgaattcttgctgttcaaacttttaaatgattctgttatacataataatcacagctactatataataagcatttcctctgtaccaggctttgtcttaagtgttttatataagcattatttcacttaatctgttcaacagtcctgtgatttaagtagtatcttgattctgcagatgtggaaactaaagctcaaagagatgaactaacttgttcaaggtcacacagtttttaggataagtgatggagctttgatttgaaaccagatttttctgattccaggatccttactaccaatggttttatttctctgtccctgaaatatgccttcagctttcagtgatctcatggtgcttgtaaagtacttgagcagtcagtcatctctggaataggaagccattagaagccatgaaagtaaggaattgtttgctgtaatggtggtggtggtggtagtggtggtttatgttttcaaatatcaaggcaaggttggaagatgcttgcttcgtgtagacctgacctgaatgaggctggcatctgggctccttggaattttctgaatcagtttcatccatttcttaaagcttaattgaaataaatgagaggtcttagcatttacgtgaatttctttctttttttttttagcatatgacatttttagtctgtaggtcttatttagtgattatgcatagcaagggaaataagatttgtaatttattcactttttttttcagtaaggcaatagaggtttcagtgagagattttaaaaattaggttggtgaatatttcgtagtaaatcctagatacatttttcattatattttactcattttgtaccttttaccaacccttaacagatatgccagtaaaactgagacttttttctgtaaacatatttcttatcttgtatgaggttagtaccaaaacactttttcaattagcatccttttaacagaacactgtcctgtacaatgacagaatctaatcagttggcatttccaaccctgagaaataatgattaatgcttacttgagaatgatctttaagtactcatgagttagtgttttaaaatgtttagtgaggcttgacaagtacaaagtaatgttaatcagtcaattatttaggggattttcttaacctgaccttaaatttgctcctactgcttttgttcttttgattatttgatttttattttgtaagaattaggatgatgagaatacatcccatccctcaaaataatttttttcttcaccagcttttacatttttagaagggttaaacaatgtcttaaaaactaaagattattgatatgaaactgtctttaagatttccctttctctaagcatgcattttctatccctaatttcctaaagccagagccaagtaaaaacaccaagaggaatatgttattcttttcagcatgaggccttttcatgaaaacagcactagtgaccagaatcttattctagtctgtgttgcttgaaaaatatatgcctttgtagatgttttcatttactgtcaataatgccaaaccacagaaatggtttttttaattctgttttggcctcttaaagattacacattgccattacaaattgtgattgttttgtagttaaatctattcctgaaacatttcagatataaactgatagacctattacttgttctgttttatcctttagtagatctacattcatgttgttttagtggtgccttttgcaagcttccctctcatataaaaatttaatctctagccttattttcttctatcgcaaattgtatcactttgatttttatatgaactttttttttagttttagcatattttccagaaataataaatacatggagaatgctacagaaatagcatgattcaagttcatgtacaatataatgcctatcaataatctgtatcaacatttctattttcaaaatgtggttttgatttgggcgtttctttttgtaatcatttctactgtctttattagatgatcttagtcgatcaaaggatgcttataaaaaatcaacacagtcttgggaatcggactgccaggtttatgaaatgaaaatataggattcccagttgaagctgaatttcagataatgaataattttttagtatcaatatatcctaaatattacatgattttttttctatttaagtatgttccaaatattatatgagacatacttctactaacaaaagtattcacagtttatctgaaatgtaaatttaactgagaagcctgtattttatctggcaactctatttggaaggcatcatagtagtgaaaatgaacatagaggctaatgccaaacagtcctaggtggttgtgttacttaagaagctgtgtagctttgggtatgtcacttagcctacctgaacctaaatttcatgtataaaatggaacaaataatacctactttgcaggttttctataaagattataaagtatgtatttaagactagataatgtttaaaactcctggtacataatagatttcccttaaagagtagctgttattatcagaacaaagaagaaatacaaatgcaagtaaccagccgttttttttccctccatcttaataaactatgtgaggaatcctaatgggagcactcagcatgtaaacaacccattagattgataatataatagtccacccagatcttggtgactgtttaccaaattagagatttgaccactaataaaatatatacaagcattagccttctttctttcctctgctacttgcctcttttcatgttacttaccaaacattatatagcttattagtatcagggcctgaatatgtgatgccttttcacattgttttttcccttttgagttacaattttacttccatcctgtctttcttagacatctatttattaatgtgattaatttttattgagataatttacataccataaaatttaccattgtagtttatataattcagtggtttggccgggtgcggtggctcacgcctgtaatcccagcacactgggaggccaagccgggcttatcacttgaggtcaggagttcgagaccagcctaaccaacatggtgaaaccccagttgtcaccactggagtgggatcatactggcatctggcaggtagaggccagggatgctgctaaacatcccacaacgcataggacagctcctaccaaagaataatctagcccaaagtgacagtcgtgctgaggttgagaaaccctgctttaaaattatgattctagtatgccagtttatttttaagtggtagtctttgagttcatctacaatagccaggtacctttgtgctcctagcctattgctatggagtctaagagcacaaaaacaatgacaggagaaaggggaggtaccagtgaaggtaaaatcatttagattttgtaggaagaaatcaattcttgcaagtcaggagaattttgaaagtgtttttaaggctattttaaactgctgtgtcttttaacataaagaaaaaaattatttcaatataaacccctccaggcaaagccttgtagacgtattctcgttattgagtctttttctttagggtttctggaacaaaatagtttttgtcaaacagcttgtacatgctatgaagtatatttaatcaatcataatagaaaaaagaaacagagcagcttgatggagggaacttgtagttgatatgtctctgcattcgtgatttacctgaactcaaaggaagttgatattccagctgatcacattaattcagctttgtctaataccaactactggaatgtactcattcacttatgttccacaaataatctatccaaaataaaacagacaatagcttgaaatatgtttcagcatttctaaatattttcacaagtaaaaagctgtcatatttgaaggtatttcttttctgtgataatactgttgattgtttcctgccctgcatgattagatgtaatcattatcaccagcaccaggaccaccatcatcgccatcatagactaaaattccttgattataatatatcaggatctattctaagcactttatgtttgtatcatttttcctcacaaaactcctataaggtagtttttttcttaatctcaattttgcagataacagaaaagtacacaataaaggggataaaatacttgctgagtcatatttccttactatgtcttctcatgtgtcaaactagttcatattttaacaatacataaagtatacttattgttaaatctgtaacattgatgtccttaattttctggcaccctagataatggcaattgaagactgagttatttctaaatcttttttcaagaagagatattttacaattaattgtctctctcaaaagtatatatatgcacattcaggctgctgtaataccttcccatctctgcatatttatataaatttaaaactgtgcaatttctccattatataagtaatggaaaggtttttgtttaactttgtttatatgtataggaagcagtgagagaaaattcaaaactgtgcaatgtctctattatataagtaatggaaaggtttccatttaactttgtttatatgtataggaagcagtgagagaaaacaataagagaagagaaatggaagagaagaccaggagggcaaaacttgcaaaagagaaagctgaacaagaaaagttagaacgccagaagaaaaagaaacaactcattgatataaacaaaggtatgaaaatatttccaatttttacaaaaatgcaagaagtacaaaataattgcagttatttatttttggattataaagtaaattttcatagaaaattcacaatagtattagttacttgtgctaaatttctctcatgatgctatgtgtggtttcctatctccctacgctgagcattcaggatttttgataaccaatgcaagatgatattttgttgagatagtgtttttctccctacttttcttgccatagtatattatattctggatgaggcagtggggagggaaaaagtgggtgagatgaaatgtgaaaaacgggtatggggagataagccttagcttttaacttcattttgttggcacatgtctgttggcagtgcagtaacagttaacagtcttccttggaagcttgaacattttaagtcctaagaaatattgacagcactattacaagttgaataaaatagggaaaggcatcttgcacagctataaacctaagtacaagatgctggcatgtccatatagtttaaagtaagttgtttgaggccgggcacagtggcttatgcctgtaatcccagtactttgggagaccgaggcgggagggtcgcttgaggtgaggagttcaagaccagcctgcgcaacatggtgaaacccatctctacaaaaaatacaaaaattagccaggcatggtggcaggcgcctgtaatcccagctgcccaggaggctgaggtgagagaattgcttgaaactggggggcggaggctacagtgatccaagatcatgccactgcactccagcctaggcaacagagcgagactgtatctcaaaaaataaataaataaataaataaataaataaataaagttgttttattggttagcaagagtgactgtatattgttggtgagttgtttggtttggttggtttactttctaaagaagagagggcaaaaaaagaaagtgattggtatcaggtatctgcacactgaaaatttaggaataaaaaaagcatgcatagtctttgtcacctgaggtttagagaatttaggaacaaaacaaaacaaaatctgaataagatacaaggtaatatgattaatatggaccatgtattactgaagataacaatagtaaaaattgcaagcactctataatattgaccacatgccaagcatggttgtaagacttttacgtatttatttatttatttttttgagtcagagtctagctctgtcgcccaagctggagtgcagtggcttgatctcggctcactgcaacctctgcctcctgggttcaagcaattctcctgcctcagcctcccgagtagctgggattacaggtgcctgctaccatgcccagctaatttttgtatttttagtagagacagggtttcactgtgttgaccaggctggtctcgaactcctgacctcgtgatccacccacctcggcctcccaaagtgctgggattacaagcgtgagccactgcacccggcacttttacatattttaagtcaatcctcacaccatctctatgaggtaggtactattatcatctcattttacagatagaaaactgaggctcatagaaattaaggaacttggccaaggtcacacaaacaggaagtactagcaccaagattagaatccaagtcgtctcactatagaatctttccatttacctatgccactgtcaggagaaaatgataacaacaacaactaacatatagcacttgctatttaccaagaactattctaggaattttacatttaggaaccaatttaatcctcatagaaccctattaggaaagtactactatctcattttaaaatgacaaaactgaggcacagagaagttaagtaacttgcccaaggtcacaatgatagtgagaggtagaaccaagatttgaacccaggcagtgtgtaaccagagttaattattattatgtgtttttaagtgtaattattaattataacaatcattatcaagtattttgcagtaatgtcttaatggctaatcttctaaagtaatatccgtactgttaagtttagtctttgtacttttaaaatatataaacattttcaggaattgactatagtttatatcttccacccaggaaacaaatataacattttaacagaagaaaaaaagtaatattatgtaaaaagctgtgttaaaatagaatagtatcaacataatttagcaaacgaacttcataattagaatcaggaaaactggtcatgactgaggtcactctatcaggaggtaagcactagagtacagcatggcaatatgtgtttataggaagttatcattgaaaaggtgaagaagtcagtagaaaagttctgaaagtggctgggcatggtggctcacgcctgtaatcccagcactttgggaggctaaggtgggtggatcacgaggtcaagagttcgagaccaacctggctaatatggtgaaacaccgtctctactaaaaatacaaaaattagccaggcgtggtggtgcgcacctgtagtcccagctactcgggaggctgaggcagaagaatcgcttgaacccaggaggtggaagttgcagtgagccgagatctcaccactgcactccagcctgggtgacagagtgagactctgtctcaaaataaaaaaaaaaagaaaagttctgaaagttagctcctttatgtgcagggaggagtagtcggagaagaggccagaagagatagtaggggacaggggacagattgtgagctctctttctttcttttttttttttttttaattatactttaagttctggagtacacttgtagaatgtgcagttttgttacataggtatacacgtgccatggtagtttgctgcacccatcaacccatcatctatttctcctaatggtatctttctttcttttctgctatgccaagggtcttaatgctgaaagctatgggaagcccatgaatgtttataaactggaaaatgatgtacatagtcaggattcttagatcattttgtttttgttttgttttgtttttttgtttttgttttgtttttgtttgagacagggtctcactctgtcacccatgatggagtgcagtgccatgatctcagctcactgtaacctcccagccagaaaggtcattttgacagaagcagaaagaatgtattagaaggggaaagccctaagaaaatagaggttatgaggatattgtcatagtcctgacaagagatgatggtggcctgaactaatacagtgacagtgagatttaaaaagcaacaagaggtgtattagtcagagttcttttgagaaacagaactagtaagatgtgtgtgtacacaaacacatatacacacacagatttattttatggaattggctcaagtgattatagaagctggcaagtttaaaatctgcaaggcaggaggacaggctagagacccagaggaaagccaatgttacagttcaagtctgaaaactatctgctgcagaattctctcttgcttgggggatgtcggtgtttttgttctagtcaggccctcaactgattggatgaggcccactcacatcatgaggtacaaaccgctttacccaaagttcactgatttaaatgttgatctcatccaaaaacaccctcacagaaactaccaaaataatgtttgaccaaatatctggacattgtggcccagccaagttgacatataaaattaacgatcatgagagggtgttaaaggacagaattgacaggtgctgatgattgattggatgtgtaaatcaaaggaggcaagtgttaaagaagatggtatgcttcacagagaaagcaaactcaggaatagagcacattttctcaggagagttacaatgactaatatcattttaaacatgtttagttccaccttgtaaagatggaaaatgtctaagaagccattgtatatgtgattgtgaaactcaggaaagaagtctaaactaaccatatcggcttggggatcattggtttttatttgaacattaaagttacagtgtactagtttgccagggctgccataagaaaatgccacaagctaagtagcttagaacaacagatacatgttgtctgacagttctggaggctagaagtccaagatcaaggtgtcagcagggtcatgctccttttgaagagtctacggtaggatctgtgtcagacctctctcctagattctagtagttttctgctttgtcacagcataacttcaaccttcaaatggcattctccctgtgtgcatatctgtcttttcacatggtgtttattttataaaaataccagtgatattgaattaaaggcccaccctactttattttatttctttagagatggagtctcactctgtcacccaggctggaatacagagatgtgatcatagctcactgcagcctcaaactcctaggcagaagcaatcctcctccctcagcctcccatgtagctgggaatataggtgtatgctaacatgcccagctgctcttagttactgtttttttttcctaaaataaatattttagaacaatcacctcttaattacatagttcaacttatagcatgtgtgtttgaatgggatcaccacggtaaagtataaatcagaggttctgaaactatttgatctcagaacccatttacactaaaaatcattgaggaccccaaatgccttttgtttatctaagttgtttatattgacatttatcatcttagagttgaaactgagataattttaaaattatcgattgattcaattaaaataacaatagtaaaccttttcatgttaaaataaataaccttttaaatgaaaactacctatattttccaaaacaaaaaaagaattagaagagaaaaagaataatgtcataaatctcttcacagtctgacttaataagacagcttgattctcatacctacttttctattcaatctgattcaatatcattcttcatgtaacttctggaaaacttcacgatacactcaggaaagaatgagaaatagaaaggcaaaaaagtgtcagtattattatgaaaatagttttcaccttgcaaatccctgaaatgatctttcggggcctccaggagtcccccgccacactccagcattgctggagtgaacaatgaaaagagtaagtggttaaaaatggagcctatcggccgagtgcagaggctcacacctgtaatcccagcactttgggtggcctaggcgggtggatcatgaggtcaggagttcaagaccagcctggccaagatggtgaaaccccgtctctactaaaaatacaaaaattagctgggcatggtggcaggtgcctgtaatcccagctactcgggaggctgaggcagagaattgcttgaacccggggggcagaagttgcagtgagccgagatcacgccactgcactccagcctgggctacagagcgagactctgtctcaaaaaaaaaaaaaaaaaaaaaggagcctatccagttttgttctgagaatgtaatctttctcccacactacagcaattcctacgctcctccaagtgtttattaacctttcactgttctcctaaaaatgtgtctataacagacaaagaaagaagggcttattttgattgtgtctagttgttataggaccaacaagtttgtatgcctgctgcacagtaacagaccaataccctgagacaactgggatgcagcagagaaagacattaatgattgcagggcaccaagcaaagagatgggaggagaccctcaaatccatcccctcaaggagttctgggctgggatgtttaagtggatctcggagagtagggggctggaaaattggagtcattgattgaccagggcaagggggatgaaatcatcaggatgtggaaactgcattctttggtgagtcagcttcttgtgggatccttcagaccagctgacatcagtagtttcattggtacacagcactgaaagaatagctccaatggaaaacttaatgttttataatgttcaagttgttatctacacagcagttaaggggaactataatcttgtaacagggtctgtgtgattttgaagcaataagtaccgaacaactatgaggaagcaggtcaagccggtcagagagcaagctgacttaatgattaacactgaatcactgaatgtaccacaagcttggtttatctttttccctgctttctgtctttttttttttttttttttttttttttttgagacagggtctcactctgttgccaagactggagtgcagtggcgcagtcttgtctcgctacagtctctgcctcccgggctcaaacgatcctcccacgtcagcctccccagtaactgggaatataggcacacaccaccatgcccagctaatttttgtattttttgtaggtgtgtggtttcgccatgttgcccaggctggtcttgaactcctgagattaagcgatctgccttggcctcccaaagtactgggattataggcgtgagctactgtgcctggcctattttcttttcttttcttttcttttcttttttttgagatggagtcttgctctgttatcaaggctggagtgcagtgatgcaatctcagctcactacaacctctgcctcctgggttcaagtgattctcctgcctcagcctcccaagtagctgggattacaggcatgagccaccacgcccggccttggcctattttcatttctttctctcctttcttccctgattaatttttaaatttttatagggatggtttcatagtctgtatgtattttcatttgctaatatttagttaattaccttttcaaatgtcattgagaccgtaagataaatatccaaataagtttttatgcatatgctcagctgagtgatttgagcatgaaaaataaatttttaaaaattggatttattttttatgttttagtaccatagctctatttacgtatcagtcaaatagtaaactactgttaccttcttgactcatggcccatgtgttacaaatattattattatttattgtaatgttactttatacttggactatatgtgcctttgtacttataaatatgtttcaaaaacagatccttccattgcaagtgtgtagttttaattatgaaaatgaaaagatgcaggaaagaaagagtaagaataatagagttgggtgtctgtcaagatggagctcactgtctgagtttctcagagagtgtcttatgaaagatgctcttatcaactagatggaaggcagttgtgagccttctgagagctgggaggaatcatgatggagacatatcatatgtgaatccatggggcgtgaaagcctatggaagatgtgagtgaagtgtcatcagaaagtgatttatataactttaaatatgtccaattagaacattgtaatcttctcttccaccgaaagagagatgatatagaacatttcattgccattgcgaggtatgtaatatatagtacatagaggtatttcatgcatgggaccaaagatacataccattggaaccataggatcttacctgtaacaaaagtagagagttccctggataaagtaagtcacattggaaattacaaataactttttaaaaaagtgtacactttccgtaaagcttctatttcctatcaatgtagcaaaggacaaacacttctcccccaaccttttttttttaacacatctattgcttagtagatgtaacttagcaaaagtaaggtatctttatgtggcatgcaaaattatatacattcatcaaggagaaatatttgaggatttaattattcagaaaaataatagtataaagcaaacacaaagattatttctgtaatctacatttgatcaactgagctcagaattaagtaatgatatcatgaaaaccaagcagccagagaattatatctttcaagttaaatccataaaaaaataccatgtaccaaggctatattttgagagatttggagatcagaaggcaaatgccatgataagaaacagtttttttaattgtaaaggagaaaatagatatgattaaatattaaagagacaggcattttataaacattaagtggtattactaaaaatttaaattctgtgtgttcagaagtgaagatcagtcttagctctgctacctagctttatgacctagttctgttgccttatctcttcatgcctcagttacctcatgtgtaatataggataatgacattcacctcttatagttttagtgaagattaagtgagataattaagtacagtacaaaacacaggacctagaatatacttgctgctgctgacacgatgaaagagtcatttttatgcttcttgaagaatctagtaaaaactcaagaaatagtctccacccttaagaagttttcatttttgtcagagaaataaaataaaggtgacctagcaaacattaaactgtgtgctgatacataatagagattatttgctctttaactctatctaaaaagggaaatcagtgaggtctggtaaaattacataaagtttcatggagaaggctaaatacagcctctgaacataccagtcaagctagaccctgaaggatgggtaacatttggctgagcagaggtgaaactatccaagtaaaagggaataacatcagcagtagtgcacgtcagcacataaggcagcatgctttatgtaggatatgtgtatagcccacaggaaaatacatcaaaacgattaagagaatgggtcctaagttcaagtcccagcaccacagtttgctagccatataatctctgacaaggtgtttcatctttctgtgcctcaattttttcttctgtaaaaccagagactggtgttatttatactgtagtctgtttattgattatacgttaatggcatttggcctattaccagtccctgatagttaaatgttcagtcagtattttctgttggtgtcgttttagtgaagggtttgatttggaaaattgttggaaaggtaggatggagccgggctgtgaaagagccttccaagtcaggcaggggagttgtggcatgatgaggtaggagagctaaggtcattatgggaattcatttagggattttcaagaagtaagccagaagcacaagaaaggagaggagactacaaggaggatgtagctggaaaagaacagtgaaaggtgatgaaaagggagtgagctcatacctgattctctcttcaaaggagtttaaacctgaagcagtttgagaagatggtaacaggaaggaaaaaatttcataaaggagattttaaaagcagttggaagttgcaagcaacagattgactgatgagcaagagacatctttttaaaagaacagcacagttttaccagtagataattatatattgatatattttggcacattaggctatttgatccatccaatcaacgtttattgcaccattttccaaataattataattagagcatgcacagtaatataccacttatttaaatgtaaaattgagaaagctaatttaaatgcaacaaaaatatgctaagtcaacaaatgtactctaaaatgcgtgcaacagtatgcaaactatgtaaagtacttggtctaatctatgttctccaatgtttggctatattgatatagaggataattatgttagggaccactaaaaaaaagattaattagttctgtaggtagaagagaaaaagcttaccaaatatttgtaaataaatctctttcttttcatgtttatggaagtcagcaaattaactgcaaaatcttagaggaagcaataggaaaaagtatgttaaaatgggtattttgaaattgcaaactataagcatgattcttatgcaaatattaatttaatcaggaagagttttactcctccttgtataagattatatggaaatcagaattgcctgtttacttctagtgtcatgataaagaatgaggtaccttagatttgatgaaaaatcagtcttcagagagttgatgagcagttttgccaaataaacctaaacatttaaactctggttgatagcaattttgtttttatctgttttcctagttgtaaaataattacatcttataagtgaataaactcatttcacattatattattttgatctgaataggtcaatttatgtttcttactgtcataccccagacattaaattatagtcaccaaaattatagattagaaaactcacaaataatggaattgattcaagtagcagtaaatcacctccaataatataaattaatgaggcaatatcggtactatcgttccggcatatttttacaactgctaataaacagctcatagatgctaatacaaagtaaaacaagtttgtatgcttggtggacctagaaaacagtctttggcctagcaaagccttacctatgaagagaaaaagtgtatctggctgatactatgtttactttaagttacctagtttcctaccttagcaaagatttcaagaaatctatgtttatataaagatcagaatttttttctctttgttctctagatttgatttttcagtgaaaatttgggttttgtttccccagataaaattattcagtacagtaaagacttacccaggtctttggagcttctcacacattaagatgtttagtatgaattcgtgactttgttattttaatgaaatatctttaggtccatgttaaggcaatatcgtgtcatgctgctgccattcagtcaacatttgttgaatttctaagttcaagcattgggataaaagatattgagatgcaaagaggaggagctcccattgtagcaatcatcaaatgataaaccacaccctgctggttgaatctgctgatccccagtgacatgtaatctgtcagatctctccatcattggtttagcctgtgattgaaatgagtttacccctcttgcctttggagccagacaaaaccagttcacatcatggccctgctccctacatggtgtatccttgaacaactcatctaacctctctgatcctcgaggacagagaaaacaacagcatcaacctcgtaggattttcataagaagtaaatgagaggatacatgtaaatctcttagtacttgcctggcacatggttagcatgtaataagtgttaaatgttatccctttgataataataattatttagtgaacatatcaaggaaaattatcaatggcaataatcattacaataagatcttgattgactagcctaaaagaagtggagttttgattaatctgactttataattatatagaaagctgtttatgcatcagtctttatcatctgaaatctttctcaactctttgtacaactctcctcgcactctcccaaccacctccgcccacaaaaaaattttggctttacatgttacacaggtgaaaatgtgcagcagcatgtggcacatagatataattttggacatgtagccagcacacaatatacatttactggtagatcattaggatttcgttattgtctctgggccattattcagagcatcagtgatcagtatacactagcattggagcatgtgctttatctgtactatttccagaatacactctagattaattgaagattctagttattttttcctgtagcctatttgagccacttatcactagtaattttttttttctgaccccatactaaaataattacatttctggcttcagttctcgggaaataagtgctaaactctcattctatctgccttagcagtaaaacaaatttctacatctactaaaaatattcttttaaatgagagacaaaaataaatatgtgaaacaagataggtaatatactttagatctcattaagagttcttacattctaaatgcagaaactcagatttgcaaaaactgtaagagctgtcttcagtgtgctgaacatttaacaagatttcatcaatttgtatgtagaagatgagtaacactggcagttacaaatttggcttttctctacaatatatgcttgttgctatatatgatttatgcaactttactaggcagaaatctatgaaaatattagagcaggtaagtgaaaacaataaaactgactatataagaaattaccaaaacacattgtaggtggcctaatcatttattaaaaacatgctttgttccatattttaatattctaattcttattacagaaaagtgtcaaatgaataacagctgttatacagcaacattgcaattaattttgctctgttctcagtcaaatgcacttagattcatgtcagtaattacacctaacagattcacagaaccaacaaactgcactgaacccaactgagtctctaatgacttttttttaaattatatttggtccacccacattgaattcccgagcccctgggctgctttagaatcaggacaaaatctactgttacacttggccgggcgcagtggctcacacctgtaatcccggcactttgggaggctgaggcgggcagatcatctgaggtcaggagttcgagaccagcctggccaacatggtgaaaccccgtctctactaaaactacaaaaattagctgggtatggtggcggatgcctgtaatcccagctactcgagaggctgaggcaggagaattgcttgaacccgggtactccagtctgggcgacagagtgagactctgtctaaaaaaaataaataaataaattccgttgttacactgaatgtgcaaaaggattatggacaaaaacctttcagtgattgttaatttaattccacaagtatttattcagtgcctacagtgtgctgatctgtggtgacatatcctaatcaaagtatgattgactgataacttagcactattaacctatttcaggggttattaactatcagcctttctccctctcttatgtgtgtctgttctgtaagaaataatggttgttgcttcatgtagtcccataggtgtatgtatatactcacacaggaccgtatgtagcatataatatttttcacatatcatatataatctcttaaaatcatctatatttctttttttataaatagtcaatcctcagtcctctgttacacccctcacacatgaacaacctataaagtatatagtatcttaacttgttagtgggataaaatggaaaagaagacatcgtttaagaaagcaattatacctttgtcacaatggtattaggaagacattaaaacctaaacttagaatacctgcttgtcatatatatcaacagtaggtttcatatgctatttcgtaacagcttagaagatgatggtatgattcatttgaaaatcaaaaaataattatccttttaaatgtgcaattaactatggatggcataatacttttatttgtttgaaccagcactggaatctactttaaatgtactttaaaaaaaaaaattctttttgtcagactagatatttcagagctcctgtatttgatttagccttttctatttgctgagccctggagaaagttgcgtaggaattatttggggcatcattaaataggatggatgcatataggtctaggaagactcaggcatagccctgctgaggattggacagggtccaggaggttccttttacatccgtgtggttctgtggtataagataaccacattctcagagtatgctggtttaggctgtgttgtaatctgtaaatcatagtgtcttgttttgtttgtctctttagtcccatatttttataatgtaatccctaccccaattttttagctaataattttacgcagttgagtgtttgaagttgaagaagttttccaaatttcctgttgatctcaccaatatctacacattcttggttgagtcactaccttgtctgattttctagaacagtatttctgtgaaaggaaaatgtgttccctctagtcctcttttgtcaaaaaccctttgcacttgctttcttttgccaattgaaccttttttgaaatgcatcagtagggagagcttgcctagcctttgctagacaggagtagctgtaggtgcatttaaacaatccaacttgaaaaggggatttctctctttctatttgaaaacaattgaaaatgaaaagtgtatgtctcaggacagagtgcttaaccgacctcattctactgaacttcagcatggtatatgaaactacctcccctgtgtcttccccagtgttttaaaaagatgcttaacttgtttgaggcaactggttctgagtcagagctctctatccagcatcaccagaatccattatgttgttaggtcttgttataccgttctttgcatctcttttttcttcactcaaatagtcaatacagctttgttctaagggctatctgatcatgttttgaggggaaatcgagattgagctatagagatgaactatggttacattaacctttaaatgtaaccacattccttcccccacagtacattcacatgcagcctgtacttttaagtaatcctgtaagctcctgtggctaaagcatgttgaaagtatctattttcaactgagtaaccctgacagtagatgaaacctccaaaagatacctccctcctcaagggtggaagtgggggtaggggcaatggttggcagtgcagttttcagcctattctccctcatcctctctctttttttaagaccctagaggagcaaggtaaacatctttataaggaaatgtatgagttagctcttttaaaaccacagataagtataatcttaggaaaagagatcatgtgccctagactttagtagttaacatttcttctgaaggatgtgattttttttttttttttttgtgatggagtcttgctctgtctcccaggctggagtgcaatggtgcgacctcagctcactgcaacctccgcctcccgggttcaagcaattccaattctctgcctcagcctcctgagtagctgggattacaggcacccaccaccacgcctggctaatttttgtatttttagtagagacggggtttcaccatcttggccaggctggtcttgaactgctgaccacatgatccacctgcctcggcctcccaaagtctggtattataggcgtgagccattgcacccggccggatgtgattttttttaaagacaaagtaactaaagactaattgatgctgacataccaaagtaaaaccagaagtctgtattgaggagccatctcaaaaatttactttaagacagtatgtcttaaagaaaaaaatgtattatttaaatggaaagtaggaccatatgccaggttttgtttgttttgtttgttgtcatatttttgttgttgtttgagatgggacataagagactagttgcttgtctcacagatatggtagggaaaggaaaccttttggtggaagttagccatctcttcaatctctgatattcaaggagtacccagttttggttcaccaaatgtaagtcctttgttataagcatcctcttttatgttggtttgtttggcctgtagacagtttctgaaactaatttcttatttgcatgtaatgctttcatataatattcatctgtaaaaccatttggatttttcgagttgatacatttttatcattctgctgcacctctctcccctccttctttgggcttgttgcactgtcatgctcctcctgatgcattgcttcctggtgggtgacatcatgatttgtgagcaacccgatatataaataaggtggtgagaactgcctcagcaattcagtttctatttgaaaggcattaagcagcctctttctgttttcttacatttttctctactttgtgttttcacagttttattaggcactgtagaaggacctgtttttctctttcattacatttctgaaaatcattaggttgattcaaaatcttttggaaatgtaatgcccccttatgctataatatacctctcatactgtatacattttggtcacacccagatgtggagtttagcaataactaacaactactaatttttaggagcatcctaggaatacagatgctttcagcagtatgtttttattttcactgatattaaaggagtatttatcttagaagagtggtaggaaagcacacatgaatttggaccttaatccttgactatgtagacattgaatattcataggtgttttgtgtgctatggtaggtgtggaaatatatgtgagatcaatatcacttcacctcaatatcttcaaaagtgaatatggatatggttttgttagctgaactcattagcaaagatgccttttaaaaatagcaaaggttacagtatatataatgtatgtgtgaatatccacatattattagatagattccaacatgagtatttgtatgtgtttctgttaacaatataatttactatcacagcttatttttcaaaattccattgaagtataaagctggttagaaagatatacggcatctttttctttttttcagctctcctaaggtataattgacaaataaattgtacatattgacagtgtactatgtgatgttttgacatatgtatacattgtgaaatgattaaatcaatctaattaacatattcatcacctcatatacttttttggtggtgagaacattttagatctactctctgagcaattttttagggtacaatacagtattattaactataaccaccatgctgtacaatcagtctccagaacttattcatcctgtctaactggaactttgtactctttaaccaacatctgcccatctcttcccccagctgttggcaaccaccactctttctgcttttatgagattgacttttttagattgcacatctaagtgagatcatgcagtatttgtttttgtgtaaacaagcatacagtattgatgtcaaggtcttgtattacccaccttagaacaagacagtaggatcattatttttattcagttaatgttcatttatacttacccacatattattcatttttttttttttttttagacaagggagtctcactgtgttgctcaggctggccacgaactcctgggctcaagtgatcctcctgcgtcagcctccccactagctaggattacaggagtataccatggccctagctccacattttactcttcattcttttttagcatttcagagcatccatctggaattaactctttttgcctgaaatactctttcctttgggcaatgatagcaaagtatttgggcagagcttcttcaggaactttctgagtcaagtcagacccaagccttgtcccacccctcccccaaggcatgggacctttgcccttcttgttaacctcctatgatctttcattcctattgtcccatctcactaacagtgttcctcgtgtgttctgactcatcactttagctgattctctctcatcccttagtttacctggtttcattttctgatttagggccttgcatagtctgattgattagtctcagtttcaagtcataacctccttgctttctcgaggttcatccagccccactcccctcaccccaccccttgttaattagcaggccaatgtactaccatctttcagcctgagtttcttctgaaagaacactgctgttctctgttgatactgtagcatcttggcaggtgcctcaggaaccctgctactgtgggtttagtacttcagattcttgccatgctgcagcttcagcataacctgggaactggttagaaatgcaaagtttctggcttcactctaaacccactgaataagaaactgggtgggggtaaggggacagcaatccattttctaacaacctccctaggtgattctgatgtacactaaagtttaagaaccctagagcccaatgactcatcttatttcacaagtgtggcaactgagttactccaggtccataaagccagtttagtgctaaacagtagagccaggagtagcctacttcagcccaccaccttgtctactaggcttctctatgttacttgtgctgaacattgtttttagttaaatattagaactgagtcatgacattgctgtacatttgcaaatgagaggcttgtcctctaagctttgcattccttctgccagtgacagtatcagtcagaatcaagtagttctcagtgacaaagtgggaggatacccttggcattggactctttacagggaactcagtagagtctttgtgttgttcattatggctttggttgatgtataatatattgccatgttcttaaaactaaaacatgctagaataaactcaacaagtgataaggaatgatcatttgcatcgtgtgtgtgtgtgtgtgtgtgtgtgtgtgtagatgtattaatatttagtttgtaaaatgaattaccagagaatttcttaagtagcaatgtccctgtatattaaaatgtaactctttgaaagtgggaaggaggtagataatgagttggataactgttcaggaacacatctactgaagagcacatttacattctcttagttcctaatatagtattagtatacttattcaataattgtccttgtttgtatgtactttagaacattttgttcacccttgctggatgttctcatatcttctttagataacaagtaaacatgtctgagagtttccatttgttttagtttgacatctttgccctataaaccctcatgtatctgaactttagaggaaaggaaatctgaagctactatttcaatcttttctgctttcaattttatttttaacaaccaaacagttctttctgatgataaggaatcagagcattgagaccattttcttactaaatcatgcttatgtggatggaaaaagttagtgcagcctctaacggaagtgacttaaccagtgggaaattcttcctttatatgattttataaatacaaaagtaaaatcgcattaagaaattatcaggaatagtaactactgcataattttgaagaccctgtaatctttcagatgttataagaaacttgtgaaaaatggacaaccaagatagtttatgatgttacagatgagttttgttttaccataactggctacataatttgtggagctccttgcaaaatgaaaatgtgggacctcttgttcaaagattattcagaatttcaagatggcagcagcagagcagtaaaccaagtgtgaggcccttctgagagcagggccctatgtgactgctcaagttgcacacccatgaaacctctgtggtttacctaattgagacagttaatgagagaagcaaaatgtgcaccactttgttcctggaataaaatgaatgttttgacttgaataaaagtgagaatcttttaacaaaaagccacttctacaaaaggctcttcctgtaagtgacctcttttattcatttcaaaatgtctttttctatcaattccagcatgatctttgtcacaaataaaaaagggagctttccccatgagaatttctgtcaagaaacaatcttcttcaactctcttctgatatgtgaagaaatagttcttatctctcttaaagtaggtttgaaccttattctctgatgaatactttacatactctaagcaaacagcttcaaatttctcacagattttgccgatgagattcccatttctcttttttagtccctaatgactgaaggtatcgtatctagggatagtttacaccacattctctataagtaatgtaataggacttatagcatttcattttgcagcatatctttgggtctgtttgcacttaatgtggagttcgctttgagtaatatcagtcctttgaatttgttttatgtgatttggtttttataaaacattaggatgctctctagattatccagcccagttccctgcctctaggtgtacctgaatgtaactctgtaagacaaatggttatacagtaagtttctaaatgtcccaggaaaacaaaaatgtaatggtacagataatcctttttttttttttttgagacagacttttgctcttattgcccaggctggagtgcaatggctcaatcttggctcaccacaacctctgcctccctgggttcaagcgattctcctgtcttagcctcccgtgtagctgggattacaggcatgcaccaccacgcctagctaattttgtatttttagtagagacagggtttctccatgttggtcaggctggtctcgaactcccgacctcaggtgatctgccagtctcagcctcacaaagtgctgggattacaggcatgagccaccacgcctggcctcagataatccctatatagtgagggatgttcagggaaataccagctgtacttgtattcctggcaagttccattattcttgaatgtaatcattattctttttttaattgcagttatttgatgtgtcttattcctttacttcagtgaaagttttatttgtaaacctaaccttatttatattcttggccgagaaaatagaaagcagacttttctacccagtatagtccactgtgtaaaactcttgaaaactttctcatcacatttgtcagctgtctctgatacatagacagacctgagttaatgattgttattgtttacatttcttttttctttaatgaaaaactattgaattattcagtttttattaaaagttcaatgatttttatatttcagatgctctttagtattcaatatattcacagcatactccaagtctccctcactggtccactggttctaatatttactagaataattttatttaccatatgcttgtgtcatattggaaatgttaggggaaaaattgaattttgaatgtgaaaggtcctttcttcttttatcaaaaggaaaaaaatgcattctctgacattaataaaagtcatgctgacgttctcttacaagaaactcactaaaatgacaaagagcatgaaaaaatgtaattaggtgtttgagctgagttggttggtttgttctcctacctgataaattctaatacacagaaataaaattccagttaatgagaaagtgcaaacatggcagatatatcgatattctagataatattgtcattatttcatgtgcttacgatagaaaaaaataaatttgacttttttgcaaatattgctgggttttcctctgaaaagcactataatgagtggatttatttattcaattctcagtgagttactggctgaatcaaggttttggaaaaataaacatgtattctctatctctaagtatattaactaatctataaaggcttgacattcattaatgcttgctgagggaaaaaatgagttctagagattgtgttttgctcagtactgcataacttactttcacaagctctgcttaagctttgatttctaaatctctccccagtgaaatcatacctcaaagatgtttcattaaaatgacaagataagctccctcgcatccctatgctggagtgggggcaagggacagagttttgggagatcttgcaaaacggttcctaagctttagggaaagaagtgcaaattattgacttcagtgaaaaattgacaacatctccatggtgaagacagtagccaaaagggtgggccaactgtgtgccaagcctccgcttgtcttgatcttgttctcatggttgtgctgatgactcatgggggttggatttgtgtaatgtaggaaccattagaaaatccatgcttttcaagtaatgcattttagaaaaatatttttaaatgcatattttcattgtcataacctgcattgtacaatcttccacttttcgttccctacctcttttctatttggaaatattttctcagagtgttggtagtagttcacatggcttaattatgtctctaaatattagttcaaaccatatgaaattgttgccatttgactgttttttgcctacaaaatgacaatgtaatatggttcaatctaataagaaatatataattcccaaacagaaaggtaatatcctagtattacttaatcactttttgttgtggatgaaactcagattctaccttagttgatcattttctggctgtgagataattttctcacagattgttggcattgaaagagaactcttaaataggaaaaccctctccctgggcatccagggccaccctggaaaacaagccttaatgaagtcacctgatcagtaacctggtctcctgtggatatagttctcctgtttgcattgtacatctttagggaaaaaatgcagtatagttggttaatttatcagtctttatttttgttccagtgaaacaaaatgccctggccattctaattagatcaagagtcactgtgatgtctttgatagagctgggtgttaacaaggtttttctcagctaccagttttcaaattgttttttaaaaatggatgattaatccatccagcacttgttgatttctcccggtttgactctgaggtggaagtgacatcttcctcactttactacccaattcagagtgtaccttaaaatagcttcctctaaactggatataaagatgtcagcaatgtgtagattctctaaatatgcttttccttctttgttcaagacagtgctaatgtgagtgcttagttactaaaacaaatataatgacatttttaaagcctcacacagttggataattgctttaaagaaatcatggtacatttttttacttcctcttcctgaaatagaaatcatagtcctattgaagacccaggattccatacgtcgtaagagtataagtagtgtattccttttaaaggatggggataaatttcccctatactaaaaatcaccagctgccgtagaagtgctgagtgaaaaatggttcttatcatttctttgtggactgcaatttccccctgttgatataggctataaataggaaataaacagccttgaatgaaatcagatatagtatgcaaagatttcactgatgagtttaggtgagcaactcataaaaagaacaaaatattgcctggtcctaaatctttgccaaggaacctttagtaacctccttgctctcaaccattttggcaaataccactttttaactccattttttggagagtaacagatatttgtttttgaatttttttttacataaaaaagagtaaaaataattaagaatattaaaaattatgactgttacacgaacaagcaaaataaacatagtcttgaatatcttttaatataattagcagtttctccctttatgacatttatctgagataatttatcagcatttggactatactaaaatgaattgcttttctaaacagtagaaacttggcttctgtaaatacctgatccatgccgaaagtataatgtagaagtaggcttttctattaactattgtttgaagaaccaaaagtctatagtatttttctgtgttcttcagatatattacatatcaaacaagtaaagatttttaaagaatatttcattttactttattagcaaataattctctttatgattattattactggccatgaattcttttaatctccaaattagcccacatagaggaaaaaaaaaactacacaatttgcctatttggaagataccttacaattctctcttttacatagtgctatctattgagtaagtgcccagtggttatgcattgatagtttgaaagagttaattggaaactacgtaggagtttgctgaaagcatgattgaagcagtgatgatgaactgtatctaagtttgccctgctttcctctctggagcccactgttccaagaagagacatagttaaaaacaaatttgaaattgtaaatcttttctagttaatcccaagcaagaaattaagtgcctatttgcaagtctggctctgaccatacctctattcattttactaaaatataatgatatttgcagacagtagtgacacaacagtaactagatggcaacatagtaacttcataaaatagcatatgatataaatcatggaagtttttgaattaaaaatatcaaagaactgcaaaggtcaagtagacacatcaacttaaagcacttatgaagttaagctctaaggaatgacagtcttttaatgccactattttctctggttttaccagctttggggaggttatttaagcataatttttattcatgactttattttaaaagaaccacatgatgttcagaaattgatataattatatctctgaggtattggtgcagaattttgtaattctataccattttcttacaagtgatcaactctcatgtaattcaatggcatccatattatttattcagtaatctgtaattatagatttcctctaatgaagcaccctatgctttattgccctgggttctcaggagctctgtgggtgtcaattttagaaaatttgaaattgggaaagctatattttcccagatgaacattataaagtaatgaagaggttagtaagtgttgccttgattgtttgaaacaccaaaaggcaataccacccaatatacaattatcatattacttttagtataccatcttctttttttaatttaaaggttagattcaattaaatggtagtagcagtatgttaaatttactgtgagtatatgccttaggaagttatttatctatttattttgaagttaatttttttctattggagaacaacttctcttttacgaagtaaagtatgtaattaaggtctacctgaattttaattattagaacagaatattattaatatgtatttataaaaattgtctaaattacctgaatttagaacatttaagtttctaaagcactcattccctcatttgattccttgaatagatctggtgagctaaagtatatttatgtggtagtctttctaaaagcaatattcatttaaacttggcaagtgtaaagtatctaggcttggtattttttcttttgctattttttagaatttatgtgtatcttttctttccaaaattaagcacatgagggaagatgtataggtgtgaacactcaaggtatgtacaaaatgataaagacaagtagcctaacggggagttgaagaagccaaagaaaaatttttggaagcaacttataaaaccattgtagattggattggatctgatacacattgaatcttagaaaagaggatgatgttattaaacttatagtttagtaatgggagagactagaaacagggaattcaacaagttaatccatgtagtagtaatccaggttaagggttgagtgataatgttggagaggaaactctgattatgaaatattttgcctgtgaagaagtggtatagctgagtcatgttttaaatttggagatgaaagaatgtcaaagaccatgcatagattccaagcctggggaataatcagaaatgaaaaaattgggataagaagtcattaggggtatggttgggtggggaatttgtccacgattaaataagtcttagacatgctaaatctcagatgatgggaaatcttgtaaataacattgtttgagggtagctgataatttagacctgaaatgggactgagcatgaatagtgaggatgtggattccattccaagatggccaaataggaacagctgcagtctgcagctcctagagtgatcgacacagaagatggtgatttctgtgtttccaactgaggtacctggttcatctcactgggactggttagacagtgggtgcagcccacagagtgcgagccgaagcagggcagggcatcacctcacccgggaagcacaaggggtcagaggatttccctttcctagccaaaggaagccatgacagactgtacctggaaaatcgggacactcccaccgaaatactgagcttttccaatagtcttagcaaatggcacaccaggagattatatcccgtgcctggctcagcgggccccacgctcacggagccttgcttactgctagcacagcagtctgagattgacctgcaaggcagcagcctggcagggggtgaggtgtccaccattgctgaggcttgagtagataaacaaagtggctggggaagctcgaactgggcggagcccacctcagctctgcaaggcatgctgcctctgtagaccccaactctgggggcagggcatagctgaacaaaaggcatcagaaacttctgcagacttaaacatccctgtctgacagctctggagagagcagtggttctcccagcacagtgtttgagctctgagaacagactgcctcctcaagtgggtccctgacccccgtgtagcctaactgggagacacctcccagtttgggcctactgacacctcatacaggcgagtgaccctctgggatgaagcttccagaggaaggatcaggcagcaatatttgctgttctgcagtgtttgctgttctgcaatatttgctgttctgcagcctctgctggtgatacccaggcaaacagggtctggagtggacttccagcagactccaccagagctgcagctgagggacctgactcgtagaaggaaaactaacaaacagaaaggaatagcatcaacatcaataaaaaggacatccacaccaaaaccgaatctgtaggtcaccagcgtcaatgaccaaatgtagagaaaaccacaaagatggggagaaaccagagcagaaaaggtgaaaattctaaaaatcagagcacctcttctcctccaaaggattacaggtcctctccagcaacgaaacaaagctggacagagaatgactttgacgagctgacagaagtagggttcagaaggtcagtaataacaaacttctccgagctaaaggaggatgttcaaacccattgcaaggaagctaaaaatgttggaagaagattagacgaatggctaactagaataaacagtgtagagaagacacctgatggagctgaaaaccatggcatgagaactacgtgatgcatgcacaagcttcaatagatgattcaatgaagtggaagaaaggctatcagtgattgaagatcaaattaatgaaataaagcgagaggagaagttcaaagaaaaaagagtaaaaagaaatgaacaaagcctccaaaaaatatgggactatgtgaaaaggcgaaatctacatttgattggtgtacctgaaagtgacggggagaatggaaccaagttggaaaacactctgcaggatattatccaggagaacctccccaacctagcaaggcaggccaacatccaaattcaggaaaaacagagaccgccacaaagatactcctcaagaagagcaaccccaggacacataattgtcagattcaccaaggttgaaatgaaggaaaaaatgctaagggcagccagagagaaaggtcgggttacccacaaagggaagcccatcagactaacagcagatctctcagcagaaactacaagccagaagagagtgggggccaatattcaacattcttaaagaaaagaattttcaacttagaatttcatatccagccaaactaagcttcataagtgaaggacaaataaaatcctttacagacaaacaaatgctgagagattgtgtcaccaccagcctgccttacaagagctcttgaaggaagcactaagcatggaaaggaacaactggtaccagccactgcaaaaacatgccaaattgtaaagaccatcgaggctaggaagaaactgcatcaactaacaggcaaaataaccagctaacatcataatgacaggatcaaattcacaaataacaatattaagcttaaatgcaaataggctaaatgccccaattaaaagacacagactggcaagttgaataaagagtcaagacccatcagtgtgctatattcaggagacacatctgatgtgcagagacacacataggctcaaaataaagggacagaggaagatctaccaaacaaatggaaagcaacgaaaagcaggggttgcaatcctagtctctgataaaacagactttaaaccaacaaagatcaaaagagacaaagaaggctgtgacatactggtaaagggatcaattcaacaagaagagctgactatcctaaatatatatgcacccaatacaggagcacccagattcataaagcaagtccttagagacctaagaagagacttagactcccacacaataataatgggagactttaacaccccactgtcaatattagacagatcaatgagacagaaggttaacaaagatatccaggacttgaactcagctctgcaccaagcagacctaatagacatctacagtactctccacccgaaatcaacagaatatgcattcttctcagcaccacatcacacttattccaaaattgaccacatagttggaagtaaagcactcctcagcaaatgtaaaagaacagaaatcacaacaaactgtctctcagaccacagtgcaatcaaattagtactcaggattaagaaactcactcaaaaccacacaactacatggaaactgaacaacctgctcctgaatgactactgggtacataacgaaatgaaggcagagataaagatgttctttgaaaccagtgagaacaaaggcacaacatacaagaatctctgggacacatttaaagcagcatgtagaggaaaatttatagcactaaatgcccacaagagaaagcaggaaacatctaaaatcaacaccctaacatcacaattaaaagaactagagaagcaagaggaaacaaattcaaaagccagcacaagacaagaaataactaagatcagagcagaactgaaggagatagagacacaaaaaacccttcaaaaaatcaatgaatccaggagctggttttttgaaattatcaacaaaattgatagaccactagcaagactaataaagaagaaaagagagaagaatcaaatggacacaataaaaaatgataaagggggtattaccactgatcccacagaaatacaaactaccatcagagaatactataaacacctctatgcaaataaactagaaaatctagaagaaatggataaattcctggacacatacaccatcccaagactaaaccaggaagaagttgaatctctgaatagaccaataacaggctctgaaattgaggcaataattaatagcctaccaacaaagaaaaagtccaggaccagacggatttgcagctgaattctaccagaagtacaaagaggagctggtaccattccttctgaaactattccaatcaatagaaaaagagggaatcctccctaactcattttatgaggccagcatcatcctgataccaaagcctggcagagacacaaccaaaaaagagaattttagaccaatatccctgatgaacatcgatgtgaaaatcctcaataaaatagtggtaaaccgaatccagcagcacaccaaaaagcttatccatcatgatcaagttggcttcatccctgggatgcaaggctggttcaatatatgcaaatcaatgaacataatccatcacataaacagaaccaaaaacaaaaaccacatgattatctcagtggttgcagaaaaggccttcgacagaattctacaacccttcatgctaaaaactctcaataaactaggtattgatggaacatatctcaaaataataagagctatttatgacaaacccacagccaacatcatactgaatgggcaaactggaagcattccctttgaaaactggcacaagacagggatgccctctctcaccactcctattcaacatagtgttggaagttctggccagggcaatcagacgagaaagaaaaaaggggtattcaattaggaaaagaggaagtcaaattgtccctgtttgcagatgacatgattgtatatttagaaaatcccatcatctcactcaaatctccataagctgataatcaacttcagcaaagtttcaggatagaaaatcaatgtgcaaaaatcacaagcattcctatacacaaataacagacaaacagagagccaaatcatgagtgaactcccattcacaattgctacaaagacaataaaatacctagggatccaacttacaagggatgtgaaggacatcttcaaggaggactacaaaccaccactcaacgaaatagaagaggacacaaacaaatagaagaagaatattccatgctcatggataggaagattaatattgtgaaaatggccatactgcccaaggtaatttatagattcagtgccatccccatcaaactaccaatgacttccttcacagaattggaaaaaactattttacagttcacatggaaccaaaaaaagagcccgcattgtcaagacaatcctaagccaaaagaacaaagctggaggcatcacactacctgacttcaacctatactacaaggctacagtaaccaaaacagcatggtactggtaccaaaacagagagatagcccaatagaacataacagaggcatcagaaataatactacacatctacaaccatctgatctttgacaaacctgacagtaacaagaaatggggaaaggattccctatttaataaatggtgctgggaaaactggctagccatatgtagaaagctgaaactgtccaggcatggtggctgacgcctataatcccagcacttttggaggccaaggcaggtggatcacgagttcaggagatcaagaccatcctggctaacatggtgaaaccctgtctctactaaaaatataaaaaattagccgggcatggtggtgggcgcctgtagtcccagctacttgggaggctgaggcaggagaatggtgtgaacccaggaggcagagcttcttgcagtgagtgggagatcacgccactgtactccagcctgggcgacagagcaagactctgtctcaaaaaaaaaaaaaaaaaagctgaaactggatcccttccttacaccttatacaaaaattaatcaagatggattaaagatttaagtgttagacataaagccataaaaaccctagaagaaaacctaggcaataccattcaggacatgggcatgggcaaggatttcatgactaaaacaccaaaagcaatggcaacaaaagccaaatgggatctaattaaactaaagtgcttccgcacagcaaaagaaaccaccatcagagtgaacaggcaagctacagaatgggagaaaattttcacaatctacccatctgacaaagggctaacatccagaatctacaaagaccttacacaaatttacaagaaaaaaacaaccccatcaaaaagtgggcaaaggatatgaacaaacagttctcaaaagaagacatttatgcagccaaaagacacatgaaaaaatgctcatcatcactggccatcagagaaatgcaaatcagaaccacagtgagataccgtctcacaccagttagaatggcgatcattaaaaagtcaggaaccaacagatactggagaggatgtggagaaataggaacgcttttacattgttggtgagagtataaactagttcaaccattgtggaagacagtgtggcgattcctcaaggatctagaactagaaataccatttgacccagccatcccattactgggtatataaccaaaggattataaatcatgctactataaagacacatgcacacgtttgtttattgcagcactattcacaatagcaaaaacttggaaccaacccaaatgtccatcaacgatagactggattaagaaaatgtggcacatattcaccatgaaatactatgcagccataaaaaacgatgagttcttgtcctttgtagggacatggatgaagctgggaaccatcattctgagcaaagtatcacagggacagaaaaccaaacaccgcatgttctcactcataggtgggaatctaacaatgagatcacttggacacagggcagggaacatcacacatgggggcgtgttgtggggtggggggcagggggagggatagcattaggagaaatacctaatgtaaatgacgagttaatggatgcagcaaaccaacatggcacatgtatacctatgtaacaagcctgcatgtcgtgcacatgtaccctagaacttaaagtataattaagaaaaaaaaatagtgaggatgtgaattaagacatcaccaccatggacaggaactagaagctttgaaactgagataacttcccagaatccaagaaagcaatggccacagactatccagtgacaccttggcctgttttctgaataattatctttcagcagcttgtttcagttttatcaacagacagaagtaagtctgctaagagcacaaatatattctagttaattgagaaagaatccagagtcagactggctatttcctggagcagattattgaactgcccttaagaaattattgagggatttagatcaaggcttaaaggtaaatccttcccccttccatcttgttacatcaaatgtaaattacaatattgagttatgataatccatatcagaagcatataccttcagctgtttttctgaagcttgtgacaagagacaggcttttatacattgctgaccatgttttgtaccatgtcatcctccactactttcacattagacaagaggttgattcttgacccaaagacagcctactttggctgctctactttgtaaaagatagcctgtaatatacacctcttccaaaaggctgttctgtgctggttgaatcaatttgattatttttcttagggagtttggactcaaagacacaaagatagaaaattagttggtaaatggcagaagagaaaattaaaacagatactaagagttaggtgtacatgagtagagctcatgagtaggggagaatggacaccaagatactaaagtcgtaacattaatgagtcactaggactattgtgcctggagggagagttgtggttatatcttgaatgatccttgggttctttgtgaggcctgaccatgcagctgctgaaacctgtttccttttcttctttacttctgcatatatccttatactaacccctcatctttgttttcttgcaagccatataacatgtttatcaaaagggttatagcagtagccaattaagtaacagacactccctcttttccttctccttcttccctgccccaagccactagtggatctaatttctctaaggaaaaagaggggcaggggaagtgagtggtgccacccatttgccccttcaggtacctgggtccgaaagacaaaccagcaatggaggagggaaacactttgaagcatatgtaagattaataattaaactacaaccagaaagttatggaatcttcccaagatgttattacaggacttgaaaggaagatttgacattgtatgtctgggagcaatggtgaagaaaaccaaaaaataattttatgttcataccctcactgaggtgagacttctcaataaactagatattaacagttatacatgccctttttcaaactacttttgcttttttaaaaaagcaaaaatatataatatcatcatataaaaggaaaggatgatacactcctcaatttgaaaagggtggttgtaataaggacacataagtttgcagcagtgtgcattcaaaaaatagggtggtcacacatacacacacacacacacacacacatacacacacacacacacgagatttattgtactttaaaaataatgaacaccggatcacctgaggtcaggagtttgagaccagcttgaccaacatggcaaaaccccatctctgctaaaaatacaaaaattagcctgggcgtggtgtcacctgcctgtaatcccagctacttgggaggctgaggcaggagaatcgcttgaacccaggaggcacaggccacagtgagcagagatcgtgccactgcactccagcctgggtgacagagaaggactctgtcttaaaaaaataataaataaaaataagaaacagttaagttccggcgtaaaaaatagaataaagttgttacagtaacccccacttatctgagaaggatacactccaagaccctgcccctctgcccctgccccagtggatgcctggaccctgtatacaatgtttttttttttctccatacatacatacctatgataaagtttaatttataaattaggcacagtaagtgattaacaaccacaataataaagtaaaacaattcagcaaaataggggttacttgtaaacaagtaccaggataccatgacaattaactgatcactgagatggtggctaactgactcctgggcaaggagcatctgtagcatggagacactgaacaaagggcaccatgctactcagaaaggcatgcaatttaaaatgtatgaattgtttgtttctggaattttccatggaatcttttcagaccatagttgactgtggataactgaagccatggaaattgaagctggataaggtgggatctactgttttgccttcctgcagttatgcaaggagttggcaggggaattgattcattatttaattttataatgaaagaaagaagaacattaggattcaaaagttggattaccaaatgatgacttgtcaactcattccctgcactccaagtatcagcaaattaagagtaccagttccttcatttgccacatttttatactccgtgggctgccattactattctcatgtgtcacttgtgttacagttacctgactgcactctcataaggacagttcttgaaaagccgcttccataccatacttgctttgtgcctgtgcttggcactgaagaagacacagatacacatttgacctcctgatggtgctctggaagccaaaatgattcctttccctctcaccttcctgattaggcttgtgtttgtgtgtcttatgaagatggttagctatattttacggtgttatattctgagatggcaatctagttgaagtccataggtaaggagctaggtcttttgtagagaagctgagtttattcagtgttattcagaggcagtctcagacagcaaagcaaaacttgaaaagcagatttccccttggcttttgaaaaacctctcttctcttttttgtgactgttcttttggaactggactttatgggctctaaaatgtaaattcagaaagaaatgaatgtgtaattgttgcttcattatcttgtgtcattcttggctttggctctccaaaattgctctcttcaattgcaagtagacttatattgaatgttgatgttctttccctccttccacctgtgatgaggccttgttttactgatgtggctggtccttgccaaggtccttcagcacctcaaaagcagattgtgagatccacacatatctgtacctagcatgatttttttttttaaagacacagcatctcactatgttggcccacactggccttgaactcctgagctcaagagatcctcccactttggcctcctgagtagtggaggctacgggtgcacaccaccacatccagcaattagcatatgcttgtcgttgacagtatatgctctagagcaggggttggcaaacattttctgtaaagggccacgtagtaaatattttaggctttgtgggccataaggtctcttactgcaacaactcaactctgctgttgtggcattaacacagctataaactaaacataatgaatgatcttggctgtgtttccataaacatagggactaaaatttgaattttgtgaaattgttatgtagcacaaaatattattctttttaaaatgtcaaaatcatccttagcacatgtgctggtaaaaaaccgccagtaggctggatttaatcacaagaaatgtagtttgacttcctctactcaaggcgtctcggggtcctaaagctggttctgtcacttcacaactatgtgaccttgaacaagttaattcacccaaattaccctcagtttctttacctggccaataaaataggttggtgtggaaatttcaatataaatctcttcgaacactgcctgccatatagtcagcattcaataaatggtagatattattaatattcctacctccaaagacatctttgttttatcttttcagagattaaactcagattactttggtacatcattttgaattgagttagatttgttctttttccaaatttgttttttacttacttttcccttcacaagccttccatgctcttagtaagtaaatgattctgataagacacacggagtatttcaaagctctctttgaaatattaattatttaaaatatcgaatgtgagatttttttttccagaggcataaactggtttttctggtaagcgttaacatttaggtttattgggtgcttgtttatttatagaatgtgtaattttcatctctcaatcttctagcatataggtaactgggaaaaaatgaataagcataaacatttttttaaccaccatttgctatcaaactctctcaccttatgcaaagtgtcaaaatgtgcctttggctgaaatgtttcttcactgaaactctaccattagaaataacaagcttctctttaagatatacatacattagggaaagttaactcaccaattcagttcccctaacaaacttttaggtaacacctaccatgtagacattttgggagaaatcacttcatccatccttcatcatttatcagtttggggtataatatccacttatgacccctaatacagtatttattccatggcaaaatgtacctaaaacattaattttaaaagtatttaggaacagtagtattcactatgaagtttatctgggatttgatgattcacctcactataggaaactgttaattacctgttctggcaaggagatgagatactagaatgaatgaactctctaaccgacattttcccctatggttttaactttaattgctctgagattaattttctttttagtggataccactgtgcaaggcctcaacctgggaatgtaatgtttttctgttttgttttacaaactttcgactaccacatcatgtaattactacactgcccctagctcatcctgtggattctagtaatttcttctaagctcctgtgtcctcttttccatcttgaaagttttcttcttttgaataagagcatctgccttcattattttccatagaactttatactttctatttatgccctcttctaatctctttggaatatcttgatttccttaaacactttctggctgtaaataacttcatagactattatcttagttaccatctgttgattttccaagtcaccattaactccattcttcactcacttccaattaaaccacaaactaacaaaatcctcttgtcgcctaaaggctttctaggtgcttgtggactgaaatataagttgctgaggtttttttgatgactattgacacagtgctttgccaaatggtttgatttctcttatttctgattcatttatggttttactattactcttactgatagatattaaagtcttgcagaacgatgtgttattttcaccatattgtggtaaccttttacttagtctttattatctcctattgtttcatgttaaattctgagagttatttgtcagccgtgggccttcatgtttgttagatctcagagaagggatttttattttcctcttctttaataaatgagcagtcttcaattttgtgttatctacaaatctgtataacttgcagcacgttcttaatctggaccatgatagataccgtgaaaaagattgaatctagcactggtttttcttgcactccacttgtcatcgccttcttatgctgtcaacttccatttactactgctgatgaccttgctcacaaaacaattttgcgtttctatttattcttttaccaataatgaccaaattggccatctgactgtacctagagttctatgcagaataatatttgtcactgcaaatcaaattgtatttgtcatataattgatttctctcccaatctggtccactttgcatgctacggtgaggctgatcttaaatgccacctttgtcatgtcactgtcctgttgaagatcaatcagtgggtttttagagtccactgaagcacattcaagtttcttaaaatgatatccaagctcctttagaactttgctctgatattacctatccaactgtaactcctgtatctttcaactctgtttctctcctcatgctttatcatggataccatccatattttatttcaggtggctatgctgattcaaagtggcctcaactcttttttacccccttaaaattatgtgatataaatagacaaaactaatatatgatgatagatattcagacatatgtttcctctgagtgggcaaaagagaattttctagagagttggaaatgttcaatatcatgattgtggtggtagttacatggatgtatgcatttttcaagactcttcaaactgtacaattagtatctttccatttcaacatttgtaaatttacacacacacacacacagtgcacatgtatgtgcactaggagttcagatatttagattttattatctgtgaaccagtatgatctgttttttttttaaatctgtttttgtgtcttttacatgaaattataataaagtgctctagaaatgtaatgttttcagaggcttaagtcccatttcttccatgaaatcttccctaactcctcaagcccacagaaagcttagttttatttttaaaaatgatttcatatgtgcaagtattatctcacataaagaagggtcctactttcagtaagaagccttttgcttctatgggatcatttaacagtgattggttcatagcaacttttttcaactttgagcagctcaacttttgcagaaaactttaattatacaatctagaattcaaggaggctataacagtgaattaaaaccattatgcctcggttaagattttaggaaatgatttttatagtattggctttacttcagtaattttcaaggtgtgataaactggaatacagtcttaggaaatgagagagtccagggcacttggtgcttaagtgcctagaggagtaaggggtattctaattaataatgtttgataaaaaggaaggagagcacagagtaatttcaaaaactatgaagggtcagagattttgccctacttgcatgccaacaagttagcctgctgcagtttcagcgatgctggcagaacacacaagactcctgggtcagagacacataactcttgttattcattcatgatacagcaagcaatatgagcttcacgttcacattgttttcctttgccctccaacccccagagttggaaagcaaacctagaccagggttgggaaggcaaacctaggtggatgctgcactcacggtgggtttgtgtcattgctgaggaatccctgcttagggaacccaaatcttttataatggactgaacacaaacctgcctgacatttttcctagagggagatataacctgtctgcaaagcaaatgaacctgtcgtcttctctagaggaagacactgtatcttccaaggttgttttctgtaaaaacatccttgaaaagatagtacagaaaaaggccatcagtgcctctgttcacaaaatgtgcagaaatgtgagaaacccatagagaattgtctgtaagtaagtatgtgctagccaataggaataggcttgcacaaaggtatagcagaggtaattcatttacctagtgctaattgtaatctgtatcatctccaaacccttttgtgaaaattaagacaacacaacacaagtaaatgctgatactgaaaattaagcagcaggcattcggcatctactaaatgacaaatactaagggaaacatgaaaaagaaggtacaacccataccttttatttgatatgatgataagtagctcacacaaagcccacagatgcatgcagcccacctaagtccttagtaatatctgtgactttcaagctgagtagaaagttgcttctaaagtgttacctctcagatatgcccataagttattattttagtggctaaaagcattacaaaattttcccttgatattctttcactcagttaaataggtattgtatgttgtaaaaaacacattttttgcacgtgttcaataaagtttttgtcttttttaatgaaataaacacataaacaattttttttcttgaggttgaactcgtagaccaaaaaaaaccctactcactactaattacatctaagtaagaattaatggttctatgaacttggaagttctaagtgaactgtcaacctcaaattaaatcacatacaaaatttcactgaaatgcattcaaaatgaagagtaacttctttcaaaggatcatgttgacttccattttgttttaggaagactaactgaaatataatcaatcccatgattatattcataaaaccttgattcagtaaggttagacattttatgaaaaatactcagcttctttgaaagttatcgtggagcaaaagaaaaagtaatgggggactgaagcctacatttctttcctttaatacatcagtgatatttacaaaaattttttttttagcagaactatttggcatatatgttctcagaagggacaatattaccccaaaagggatgaatactggttcttgggaatgtgggtggaaaaacatcttagatattgcaatggtttgtagccttccaaaggaccgcggtacataaacagacgtacaagatatctgtggcattaaatgttaacaataggggtcattagaaaaaatatctaaaaagactcccagtgggaggaagacaataatgaaaaaaggttgagagacgttgctctagcataatatttcgacaagtatagtgaggtagcaactactaaattaagcaaaggtatttatttttattcccacttgactttatttattttgagacagggtctcactctgtcacccaggctggagtgcagtggcatgctcatggctcactgtaaccccaacctcccaggctcaagtgaccctcccgccccagcctcctgagtagctgagactatacatgcacatgccaccacacccagctatttttttttcttttgtattttttgtaaagatggggtttcaccatgttgtccaggccagtctcaaactcctgagctcaagtgatcctcccaccttggcctgccaaagtgctgggattacaggcatgagccactgcacccagcctcctctcaactttttgtcatatttgtttttccatctttttatctaattacaatataatagcattaaagaattttaataaaacaatatctataatgttatacatttttatgtttgcatattatttaggtaaatcataaatatattttttcagtaatttacatatatttacttttctacatagtctttataattatcatttttgtaaggatacataaaatttcacttgtgctgttgtcctcaccttcttgtacttatatatctctaaaaattccttccctgtcttctttgcaattctgcttctcctgactgcctgttaaaagttgggtttctctgattctggggaggggattaggaagacattagtcaaaagacacaaaatttcagttggacaagaggaataagctcaagagatctattgtacatcatggtaacagtagttaataacaatatattgtgtattcaaaaattgctcagagattttaagtgttctgactaccaaaaaatggtgacatatgttaaacagcttgatttagtcattccacaatgtttacatatattaaaacatcatggtagggtgcagtggctcatgcctgtgatcctagcaccttgggaggctgaggttggctgatcacttgaggtcaggagtttgagaccagcctggccaacatggtgaaaccttgtttctactaaaaatacaaaaaaaaaattagctcccgcatggtggtgcacacttgtaatcccagctacttgggaggctgaggcaggagaatcgcttgaacttgggaggtggaggttgcagtgagcctcgatcacaccactgcactccaacctcggcaacagagggagactcggtctcaaaaaaaaaaaaaaaatcatatactgggtgtgtgtgtgtatgtatatgtgtgtgtgtgtgtgtgtataatttttacttgtcaattaaaaattcttaaatattttttaaaaagttgaggttctctggaattgcatcttctattctatccttcttctaatatactttttcagggtaggtaatctcatccaccatccaatgacacccaaatctttagctccagcccagagttcacttttgcatttcggacccacatttccaacttctttttcattatttctacttatatatttcttagatatataaaatagatcacattttctcatacttgtttatccctggtcatctaaactcctctccttaatctcaccctccttctcttgcctgctaagtcctattgactgtattaatgccttcaaaatatccatcctctccattcactttgctctctgtttagttcaggatatgtgttatttagacaattatgctatgcacctaaaaatttccctgcctttttttttttttgagatggagtctcgccctgtcacccaggctggatggagtgcagtggcgtgatctcggctcaccacaacctccacctcccaggttcaagcaattctcctgtctcagcctcccgaatagctgggattacaggcgcctgccatcacacctggctaattttttttatttttagtagaatcggggtttcaccatgttggtcaggctggtcttgaactcctgagctcaagtgatcctcccaccttggcctcccaaagtgctgggattacaggtgtgagccactgtgcccggctaaaatttccctgccttttgtctcaccatcctctgagtcattctccacaatgctgtctaacaagtctttctaaagaataaatctgatcaggttacttccttttgtttatagctgatatgcccagtacagtaaccaccatctgcatgtagctattgagtgcctgaaatgtggctaatctgaactgacgtgtgcagaagtaaatatgtactagatttctaagagttagtctgataagaagaatgtaaaatacatcattttgaaaatacatttggttgaatgtttacttaatgtactaaaaatcaatttggccaggcgcagtagctcacgcctgaaatcccagcactttgggaggccgaggcaggcggatcacttgaggtcaggagttcgagaccagcctggccaacatggtgaaaccctgtctctactgaaaaatacaaaaattagccgggcatggtggcaggcgcctgtaatcctagctacttgggaggctgaggcaggagaattgcttgaacccaggaggcggaggttgtagtgagcagagattgcgccactgcactcctgcctgttcaacagagtgagactctggctcaaaaaaaaaaaaatcaattttacctttttttattttttaatattactactagaatatttagcattatttatgtggttcacatttatggcctgcattttatacctagtgaatcctgttaacttatcgaatagtgttcaagccccatatcatagaattttcatctttcatcatctgggcactaattcctagttcatttcaacttcttccagctattgagcaaagagcactgggcttggtatcagactgatctgagttcatacttgggcctctccaccacagttgaaatacatatagttcttatctcagtatgttgtgaggattaaaatatctaacaactgtaaagtgtcaactgcatataatttaattctcccaggtacattctagccataccaaactaccttcaggtctttttttttctattgaaaagagcaggtgatacttcagatgtgtctgtgagcttaatgaatgttgttttgtttgttttgtttttgtttttgtttttgtttttgtttttgtttttgtagatggaatctcagtctgttgcccgggctggagtgcagtggtacaatctcagctcactgtaacctctggctcccgggttcaagttcaagtgattctcctgcctcagcctcccgagtagctgggactacaggtgcccaccaccatgcctggctaatttttatatttttagtggactctgggtttcaccatgttggtcaggctggtcttgaactcctgacctcaagtgagccacctgcctcagcctcccaaagtgctaggattacaggcatgagccaccacgcccagcctcttaatgaatgttacaactacacaatcccctttccatgtttactcaatgggctctacttcatttttcctgttttcaccaaatattagacctgagaacctcagtgtttctcttcatttttttttttcattcaataccccatcctagagagtttattttaaaagaataaattattataacattggagaagtttcagatcaaatgcagaacataatcaaaaaatattttagcttgctcttgtcccataagaaaatgtattttcagctgggcgcagtggctcacgcctataatcccagtactttgggaggccgaggtgggcggatcacctgaagtcaggagttcgagaccagcctgaccaacagggagaaacctgtctctactaaaaatacaaaaactagccaggcgtggtggcgcacgcctgtaatcccagctactcaggatgctgagacaggagaatcgcttgaaccccggaggcagaggttgtggtgagccaagatcacgatcacgccattgcactccagcttgggcaacaagagcgaaactctgtctcaaaaaaaaaaaaaaaatgtattttcatttgtgatctcataccccatagttaattttttaaacaaagtaggatttagatttaactttggaatagcatcagaaacaatgtcctttccctcttccctccttcttctcttaaccctcttgcctgcaaattgtcatctacctcacactcacacatttagctaccctcaaggtagccacctatttagggtccttttcatcagctaggccagttaggaagagcaggctgagctcactggggattatgcacagtgtaatagagactttctggccattgacaccttgagacaaacactctaacaaatctttaaagtgtttttcatggctagagttgtcaaagataggaggagggtaaaatgttttaaatgctgtttctgttaggaatttccacgaacatcttctgagcatcccacttatggctccttaacagttctttcccataggaaaagtttagacacacagcagcattctaaaaaggaagtgggactctggctgatgtccctaaaagttaaaatgtggcctttcagataatgtggtcacctttttctttatacagtgttagcatctcaaaatggtaaaggatatggattaggtaagaattgaatgcaaatgtgttttgcaaatagtgttttctaagataatcgcagatgatggttgaatgccgaaagtattaatacaatcagtatttaaccttgtgtaactccgcttcatcaaatcacgccctgcacattgattgcattaagctgagtcagtggtttcttggttaggaatatcttataagaatcttaacaggaaggcagcagtagctgatcagctactgtttatttgcatactgagcgtgtcatcaataatacaaaagacaaggtctttaagttgaaagaacagtgggattggcatgaatttttcttaatggtgcataataagcaaagtagtctgtggtgccagaaactgacaggatccattatgttaaaacagatatatgtctttaatttaggggtattatgtaaatctgacaggagtttttccctttattttcctgtagtttaactttaattgctccaagattaattctgatttctccctttctccagagggtgatgagactggtgtgatggataatcttctagaagccctacaatcaggtgcagcattcagagaccgtcgaaagcggattccaaggaatccaggtaaaacacattccacctcacatagtattgtaaaatatgaatgttcagagcaaagtagcaacaccaaaaaaaaaaaaggaaaaataaaaatacttcctcatgaagactttttttaacagttgatctcagctcatgtgtgaaatctcagcaggcatctacatgattgcaagtttcaacttggtaaatgtatcttcaaataactgtagactttacaacaaaaatcagaaacaaggactcccactgtgtttaatattaaatattttaattgttattttatgagcatgtggtttaggtggaaagtagtttaaaaccataaatgtaattaaatcattaaaagtaattggccctaaggagatcacattagctattcacaggtaaggaaactgagacaatgcttgtttctagagaccgttttggttttgcagtgcagtctgttctctgtgatccatgttaataaagggaggagaggaacagatactccaagatcccctcaaatcccaaagtttttgtttttatatttgattagtaacagttaaagccacactatgaaaatagatctcaggggaagaaaaatcgtaaaagaagtaaaacaacctccctcacccaagtgaactggaaagttgtctactttctctgttcataccctatggtagaagtaaataatgtaatagctcctctaaggataatccaagtaggctgaactgtctacctcctctcagtaaagttttctatttgtagctcatatctttcttgaagtagagaaagaaattaggtatgttgattttaagactcctcttcatgggctgtaaagctatatggagaagtaaatgaaaaatggaaaattaatagtcaatatgtaaactctacttcatttagattaataagatttgccttaaatagcctgcaattccaaaaatattctctatttggactggaagttaccatgtgtcatttaatggaaattagtagctctcaaaaccattgtattgcaacaaacgagtgagagaaatggggcccagaacatagttgtccaggaaagcttttggcagtgatgaccttgatggcagaagacaatatatgttatattcatctttttcacatttgggtgaatcctgatggatattggataacattctgcctctgctatttatggatggtccctgagagattaacctaaagataagatttgattgagaggaaacaagtgttttggttggagtataagactacttttatgtatatgaatgcatcgtagatggcctacaaaaagggtggaagactggacgaaaaaaagaatggaagtctgtatttataagttcatattcattttgaaggtaatgctgcatggcagaatactaggagcactactcatctataactatgaggcagccattccacttatccgcagcctttgtctgtaaatgagaatgttctaccatgccatcaagcccctatcacctcttaaggaaaataaaaaccttcactgctctttcttgaactatcagagcaatagtagtcagtgaaaggtgaactgaaatcatttttgtatcaattcatttctctgttaagcagctgataagtgaaaacatgttattctgggccataaaagaactgccataatttttctaggctgtttattttaaaaatgcacatttgctaaagcccttgtctgattagtctcacacctcatactgattccagaaaaactgtacttggagagagagatcattccatggggtttctgtgagtttggtactcaagggaatatagtgttgtcaactgtgaaacaccaagaatatattcacaaactgcataattttatagtactgattccaagtaatctaaattgggatttcctttggtttgtagctggagtgcctccatgaacacatagggttaaaaatatcactcgatttagctgtggcagtcattccaagtggcagcagccaaagcaaatgtccagaggtaaaacgaaactcgaatgcagacagtggcagtggttgggaagcaccttggtcatcagtagaagagctggaagtgagggagtggggacagaaggcacagagtttacaagtctgccaaaaaactctgtctgcctctttctggaagaagcagaaccggggacttttacagatttcctccttgcctcagcccttcctagctagatcatcttttcctgctagtcccgttatttttactttcttaggcacctgatttgtttcctttccaagatcccattgacttggtattgttatactttccctgttcaacattgacattcttgatcttttccaacaacctccacttcagcatgatgagataaaagcagaaaaggctaattataaagaaggctatcttcccccaagtaaagtaaaataaaaggaaaatccaaaaaacactaaaatcagagtcaaccacaatcagcggagatgtacttactgctctgcttgccattttcattaccatcgcttatagatgggtattactgttatgtaaaatacagagctctaccattgtgtttctaattgtaatctttttatttattttttatttattattatttttttgagacggactcttgccctgttgcccaggctggagtacagtggtgcgatctcggcccactgcaacctccacctcctgggttcaagagattctcgtgcctcagcctctccagtatctgggattacagggacataccaccatgcccagctaattgttgtatttttattttatttttatttttatttttatattttgagatagagtcttgctctgttgcccaggctgcagtacagtggcatgatcttggctcactgcagcctctacctcccaggttcaagtgattctgctgactcagcctcccgagtatctgggactacaggtgcccgccaccacgtccagctagtttttgtatttttagtagagatggtatttcgccaggttggccaggctggcctcaaactcctgacctcaggtgatccgcccacctcggcctcccaaagtgctgggattacaggcgtgagccaccatgcccggccaaattgttgtatttttagtagagactgtgttttgccctattgcccaggctggtctcgaactcctgacctcaggtgatctacccacttgggcctcccaaattgctgggagtagaggtgtgagccactgtgcccggccatctaattgtaatgttttaaattttatatgtaaacaagatgaggtgatagtctgtattcttcattagaaaatcaaaatgttaataaatgatatgattagttgcctaaattataaatcgcccactctgagcctgtgccccctacccaagacctaccatatttagtaactcagaaggagcttccacatattgcctccagcccattcagcggatgtgctgtttcagttaagtaccaaaaggcatttcaaggtagactatcatatcagtagtgataattgaaaatatttttttttaataaaaaacaaaaaggctgggcgtggtggctcatccctataatcccagcactttgggaggctgaggtgagaggatcatttgagctcaggagtttgaggacagcctggacaacatagcaaaaccccatctctacaaaaaaatacaaaaaaaaattagccaagcatggtggcatgtgcctgtagtcccagctactcaggtggctgaggtgagaggattgcttgagcacggtaggcagacgttgcaatgagtagagatcgtgccactgcactccagcctggatgacagagccagaccctgactcaaaaaaagaaaaaaagaaaatattaactggtgtatcacaggccccagatagtcgaaatgtacacaggtgataaataacgactctggttgtactggtgcatactagctgaatattaacccagatcacaagctttgctgatgtcaaaatcagagattaggaaatgagcccctaaatattcatttattgtacatctgctgtgtaaaaggtactatgctgtacatgatgagggaagatgtagaaataattaagataagatttccttagttataagaccctgtgtattataggaacgataaaaagcacagaaagactacagaataaggcagaagataataagtatcatacaagaggtgttaataacatactgtgtgacttcagagaatgggacttgcatgcattatcagatatatcagaaaaataataatggaggaaaagactgaaggatgagtagggattccaacagtgagagctggagttagggatagtgggcattttagtcaaaagaaatgtcattaagaaaaacagaggcaagaaagttcaaagcatttttcaacaatggcaaacagtacagtaagaaaataggatatatatagcatagaagtataggggtaattctggaaaattaggtttgctccatatcagggagtgcttgaatgagagactaaggtgttaacttacaattctctaagcaatggggatttattgaaggcttttaagcagtggaggaacacaagttacgcattagaatatttaaaggagtataagtaatcaattaggagtctattgtcatattcttatttagagataatttagcgtgagaggagtagtcaagaggcaaagataaccctatggctttgagtatgactggctaagaagacatttgggttactaaacttttttttttttttttttgagaaggagtctcactctgtccccaggctgaagtgcagtggtgcgatctccgctcactgcaacctccgcctcccaggttcaagcaattctcatgcctcagcctcctgagtagctgggattacaggcacacgccaccgcacccagctaatttttttttaatttttagtagagacgaggtttcatcatattggccaggatggtctcaatctcctgacctcatgatccgcccgccttggcctcccaaagtgctgggactacaggtgtgagctaccgcacccagccgtaaggttactaaactattaagatcaagaaaaggagtggtgatagtagaagaaggtaaattcagttttggataagttaaactgaaagtgatagcagaacactgaggtcaagatgtccagaagatttttggaaatatagttacagatttcatgacaaaatgaattcttgagtgttctggatatagtgtggataggggaagggattgttatagggatttttaagagaaaagaaaaccaaagacagagacttggaaacaccttcactaaggggctaaaagaagatagacaaggagcaattgggcaggtaggagaatccagacattattgtcctagaaacaaaggaagagggaagtcctaagaagggaggagaggtgaacatttttgacaatgacatacgctctggtggaataaaaaagggtaaaaaaccgatgatttgctatttgggagctttctaatgactttttgaagagcatcctttcaatattgtgatggaactgggaagagaatacagagctatgcagagtagatggtgaggctatagggaaagatcatattcattcaacagttgagcagtcttattgaatgcctcctcggtgcattatactgagttaggtactgaggatacaaaatcaaacgggagcctagaggagctcacatactgtttgggaaaacacgaatataaaccatgtgatcaatttacaatgcggtcttctatatgctgtaatagagataggaacagtaagcctgtgcagcataggagttagagtaaccactcccaaccccccacctctctcctttgtgtctgtataatatgggctattctttctagcagtttggtgggtgaaaggtacatctcatttttccttcacaacctagtatggatttatcttctctgaattttgctaaatctttcttgatcctgtgttgttacagcctttgttaccacataagataataagttgcatacatttaccatctactttgtaaagaattgccctggctgtgtaattgtaagatcaaagataagctttggaggaaaaagaagcacatagagagacaccttgcaggagtgaaaatgactctttttttttttctttttttccttttttttttttttgagatggactctcactctgttgcccaggctggagtgcggtggcgcgatcttggctcactgcaagctccgcctctcgggttcatgccattctcttgcctcagcctcccaagtagctgggactacagggcctgccaccacgcccggctaatttttgtatttttagtagaggcggggtttcaccgtgttagccaggatggtctcaatctcctgacctcgtgatccaccctccttggcctccaaaagtgctgggattacaggcgtgagccaccgtgcccagccagaaaaccactcttaaaatacaaatacacaactccacatctgttttattgccaaatagctatagatacttagagcttgcttctctttcttcaaccaacccgacttttttattctttgcccactgtaagtaaatataaatgggcttctcagcaataggtggatatctaacttagcattttggctatgactggattttgatatatagttctagacattaaaaaaacacacaagagaagcattatgaagaaatgaaaccaggaaacaataaatgtattttggttttagaaccacacggggcaaccaagaaaactaaatttcaaaaatcaggagcaactcaggagacacatgatcctagttttatgtgtcagcaagataacagtataaatgagaaggtataatttaccatttgagaacagataggggacaagaaacaatgttatacaacagagaaaaagaaacctccgtatgtattagggaagaataatttcacagcaaaacaaaacccacatttccccaggcctcactgcctcatgtaaataagaaaactcaaattttgctggctcttgtctctacatacacattcagcacctcatctgctataagggatctatgaagcatttctgggagttatcagggggcatttcacagaaacaagcaaacaccaccgttcctccacctctgctataatatcatgcatttctacgcttgctgtcttctgtagcagcagggactcatggcttcacaacgccagagtttgacagtcatcattgacaaagtaggggggaaatgcctctctcttttcctttagtgcggcactccacctgtgtaccaagtagtactgcttatgcctcagactattacagataattttagagaaagagctttcaattttaaatgacaccctcccccgcccaccatcacagaggatttgacccaagatggcaagagccaaagacaagctcataacagatcccacgtaatactcagcatcatcttgatgaccaaggtctattgtggttttgtgcttgttttgttttattattactaggtcttgctggtcgttcattccaagctgtttacttctttctccctgaagataagttcttcttcatgaactttctcagtctctgttttataaatgtcagaatcttatactaccacactaagccccatttagtctataatacattcattatattgtaatatacaattaaaatctggttttagaaagtaatgcaaggaaataaataaaagcatgacattcatccaagtaatacttattaatcaaatactaggggccaggcagcagtgctagggccttggagtacaaatatgggtcttgcccttaaaaactcagagcctcatgggaaagacatatgatataaatttcataatataagtgttcaaaaagtgctaaaaagagcaactaaccgcctggagaattcaagagaggcttcatgatgaaagtggcctttgatctatgtttggaaggatgagtagtagtttgggggaaaacaagaggaataggcttttcagataaaggaaatgacaaaaacatgtgatggagatatgaaggagtaaagtggcaatgatgaaaagttagtttgttgtagcaaagagccagcagggggtttaaagtaaaggattacatgattttacacacacacacacacacacacacacacacacacgtaaatgagtttgaggctggagacagattttggggacatctgcacatatatatgtttattgaaaccttgggatcacccagaaaggacatctcaaatgagagggttgaggatggtacatttgggaattataatatttaagaggtaaatagagaaatcaacaaaggatactcagaaagaaaaaaaaattagggaagaagagaagcagtaaaaagtggtacctaagagctgggcatggaggcacgtgcctgtaatcccaactggcaagaggaatacttgagccctggaatttgagaccagcctgggcaacatagtgagaccctctctttaaaaaaaaaaaaaaagaaaaaaaaaagtagtacctggaagaccaagagtagagagaatttcagaatggagaattagtcaacatggtcacatcctatagaaaagctaggcagaatgacaactgataattgaccaatgggtttttcaactagcagattacacctgaccttttcccatgtactttcaatgtaattttgagggccaagaggcagcttcttgttttttttttttgtttgtttgttttttttttttttttttttttttgagacagggtctgactctgtcacccaggctgtagtgcagtggtgcgatcaccactccctgcagcctcaaactcccaagctcagatgatcctcccacctcagccttctgtgtaactgggatgacaggtgcatgccaccacgcccagctatttttacttatttatttattttttttgtagagatggggttttgtcatgctgcccgggctggtcttgaacttttgggcccaagccatctgcccgcctcagcctatcaaattgctgggattacaggcataagccaccacgccacaccaagagccaggatataatgcattaaataatgaagaatatattttataccttgaatgctgagatttgagggaaagaaaagtagttagaagacaatgaaaagataaattgtgtctcttttagagattctgacaggaaacgctagacacaccaaagatcttgaatggaattgtcaatcactaataattatgccaaattttactttcaaatatgtgatgccccctgcttaattcagttgcatttgttgagcatatactgtgtgatttagctaaactaccttagcatgcctagtgatttgtagttgtgtgatatgtaattcatagcctccaatgtagagttttactctcataagttaaaatgaagaacatttatggctcatacaaagagggactggattgagggtagaggagagatattcttgagttaacagggtagaagagggtaggatggaaaaggtgccaaaaatgaataggagttgggcacagtggctcacacctttaatcccagcactttgtagagccaaggcaggaggatctcttgagcccaggagttcaagaccaccctaggcaacacagggcgaccttgtctctacaaaaatttttatttgaaaattagccaggggtggggtgcggtggttcacacctgtaatcccagcactttgggaggccgaggcagggggatcacaaggtcaggagttcgagaccagcctggccaacatagtgaaaccacatctctactaaaaatacaaaaattagctgggcgtggtggcacgcgcctgtaatcccagctacttgggctgaggcaggagaatcgcttgaacccaggaggcagaggttgcagtgagccgagatcgtgccattgcactccagcctgagcgacagggcgagactccgtctcaaaaaaaaaaaaagaaaagaaaagaaaattagccaggtgtggtggtacacacctgtagtccgagctactcaggaggctgtggtgggagaatcacttgagtccaggaggttgaggctgcagtgagctgtgatcgtgccactgcactccagcccaggtgacagagccagactctgtctcaaaataaaagaggggcggggggtgggtggggccaccttaagaaaatctttgtcaacttcagaattaactggtttgcaaagggtgaaagtcaggagcaggtgggtggtagtacatatgtaattctcttgatgggagggaagcaggtggtcgaataggggcaaatcagatatccttatgctagccacttagttttctcagcagcatgagtccaggagtctcggagaaatgataaacatccaggtgatagttaataacatgagggtgggtcagataatctctggagaatgagtagagcagtgatcctaagacagaaccctggagaaaagaaacatttatggcagtgattctcagctctggccacacactggtattactttgaggtacttctaggaaatacccacgtccagttcctctctgaagcaatcaaattgaaatctataggattggagcacagatgatagcatgttcaaaaattatttagccaattttaatgtgcttccaaagttgagaaccaccaatttatgggactagctcggaatttggagcctatgaaagacagcatgggccaggcgcagttgctcatgcctgtaatcccagcactttgggaggccaaggcaggcagatcacctgaggtcaggagttcgagaccagcctggccaacatggtgaaaccccgtctctactaaaaatacaaaaattagctgagtgtggtggcagacacctgtaatcccagccactcgggaggctgaagcaggagaatcgcttgaacccgggaggtggaggttgcagtgagccgagattgcaccattgcactccagcctgggggacaagagtaagacttcgtctcacaaaaaaaaaaaaaaaaaaaaagaaagagagagtgtgaaggtattgattatggagatatggggagaagaaagctattgtggtatcacaggggccaaaggagtagagcttttcaaagagaaagagcttaataacatcaaatatagcagagattacatggacatagagtgtggaataatagacatgggagactcaaatgacatagagtgtggaataatagacatgggagactcaaataggatgtaagggtaggaggggggtgagagatgagaaattacttaatgggtacaatgtacattatttggatggtggttacaataaaagctcagacttcaccactacaggatatatccatgtaacaaaactgcccttgtaccccttaaatttatacaaatttataaacatgtacctgagaggatgactaaaataaggattggaaaggatccactggatttcactaatagaaattcattggtgaccttagccaaaagagtttcaggagaatctgtttggagggaggcgataagaaaggggtagaagtaggctgggcgcagtggctcacgcctataatcctagcactttgggaggctgaggccgacagatcacctgaggtcgggagttcgagaccagcctgaccaacatggagaaaccccgtctctactaaaaatacaaaattagccgggcatggtggtgcatgcctgtaatcccagctactcgggaggctgaggcaggagaatcgcttgaacctctgtctaaaaaaaaaaggagtagaagtcagattgcattgagttctcaagtgctattagagaccacttaatttagtgtctttttttcatcacttcatatgaatcttctgatgaagtgtgtacctgtattggctatgtaatttttgtttgtttccattttctttttatttttaaatgaaaattaaattttacttttggggccaggcgcagtggctcacgcctgtaatcccagcactttcggaggctgaggcaggcggatcacgaggtcaggagatcgagaccatcctggcctatatggtgaaaccctgtctctactaaaaatacaaaaattagccgggcgtggtggcacatgcctgtaatcccagctactggaggctgaggcaggagaatggcttgaaccaggaagtcagaggttgcagtgagccgagatcgtgccactgcactccagcctggcgacagagcgagactccgtctcaaaaaaataaataaataaaataaaataaaatttacttttgggacagacatcacatgtattggctaataagatctagctttgcattaaggaagctagaaactgaagattgctatgtagtctatccttgatcattccttgacaattagagaacaaattgagcatggaccatttatcccctatttatatgcaaaattgttctaagtaagtattgatgatgttctctatagaaatttcaatcactcacttccttgtctgttctcctacacaatattatcagctctgctgcacatttcctcattggtgatccctgcaggaaaataggagataaggtcaattctagttgacttttatgagaatatgattatagcaggctttctttagttattggaatatgtgataagttaggacaaacaattatgcagcaataaatttatcttggttgttttaagttcatgtcaaaaattcagacatgctaatgttggtagctaagctcacacaactacctgcttatttacaaacttgcaattcaggaataaatgattgggatcttatatggcaagtgcatgatgccagtctaacaggagcagacgctctgtgcatttgcaactacaaaaaacaaaaagatactcaacaggttgtcataagtaccttaaaatttctagaaaattaagtgcttttacaactaaaggaaaataaacatttattctaattggtggccttgattatgggaaagtttctctcatacaggctcatttctatattattaagtattttcctaaatagggataagaaattttaagctctgcttgctttacagcagaatccatctgctttcccagtggacatcccaagacaaccagatttacctggacatgaatgtacttctgacccttcaattttcattaaacctttagatacacctcttctgtgtattaaaatttgaaccttactcctggtagttccttttcttgttgcccattaaaatgagaggagtggaagctgaaagaaggaaggaagaaagcagtaggtatcttaagcgccacagttgttttgttttgggttttgttgttgttgtgattgtttgttttgaggtagggtcaccctctgtcacccaggctggagcacaatggcatgatcatggctctttgcagccttgactctcatgggctcaagggattctcccccacagcccctcaaccccacccccagcctcccgagtagctggaactataggctcacagcactgtgcctggctaattttaaatttttttgtagacagagtctcactatgttgcccatgctggtctcgaactcctgggcttaagcagttcctttgcctcggcctctcagagtgctaagattacaagcgtgatccactgcactcagcccacagaacccttttgagatttcagttcttctattatttcttggtatcttttgcatttgcaaaataccttgaatctaagatagtgcctcacctattccgggaagccttttaaagttatgctcaaagtcaactctcttaaagatatattgatagatgatacaaagtataaaaatactatgcttataactatattctgctgttaaaagattgtgatttatttttagcatctagcacataactcatagcatatgcttttgatacctgcttgttgaatacttcacaattattttaaaaagattgaatctacacaaaagcctgtttaatatattatacctaaagctgtctctgaagtttgaaatttgagggatggaggaaatagaaattgtattctacatcactgtaaatgaaatcccattaaagctgagtttttatgagcaagctcgcatgtcctatgtatgttaccttcacgtgacctttctactcagtaatgtttatgcttgacaagtaaagaaaaatgccgactttatataaaaaacacaatgtaactgtatgccattattcttattcttacattcattgtgtttgcatttgactgctacccctatgtcattctcaactcaaatcatggtttgttccactcccacatggctacttagagggcaaattcctaaatactgccagagaaaataagaatagagtgacaataatacccttttgtttcagctttacatatgttctcgtcagtctttgcaaatactgtgatgctctataagatggggaaatagaagttagtgaatttctttagaatatcagtaagtaaataattgcttttccaactgtcacacttatttgctcagaagaatagatctttctcgtttaagggttttattcagttctacgtaatagtatgtaagactgttataaggatttgatctgtttgtttgagggacttctggaatccaggatggtattttccctttccacttgggaaggttttagcttcagattttaggtttactggtctgttctattgtttgtctagcatagatacagtataccacaagcaatacaatactctctgggcaatgaacaggaattttttttttttaatttcatacattattcacaaatctgcagtggtttcagaaagtcagtgtatatcctggacacaaagaaatgaaaaacaaaaacaagggtatgattttcatatagttctttggaaagttaatgctattgtgcatggatttcatttttatttcagttataatacctgttcgagctttagcagccttatagttattaatcaaaagtgtacatgtttatcttttttcataataaaccgatagattatctccaaatacttggagctaaactatgaaggaatgtttgtatcaggaggggtaagcaatatgattttctgtggataatccagtgtttattttaattatgtttgtgacatcatctcagttgtctatatcagtactaccttatgtggaagagataatgagaaatgacagcgctttgtacataatatttgtggatttaattctattgtcatatcatcaaccataaacaatcatgaattgaaaagaaaaaggactttaaaaagtacttttctagtacatagattttactttatggtccaaatttaaacaaactcttttgcacctggaagaacattataataagctcagttagtagtcctaaaaacccagaacgtggaagcacccagatgatgcctatccttagtgactgggtataataaattagtgagtaattattagaaattattagaaaataaatttagaaatgaagttccaacatcatgtgtttctaggaaattattagagaatcttttaaatgttgaatttccataggatacaggttgggaaggacaaatgggaagaaaaatgtcacatctaacaattgaaataatgtttttttgttgccataaacagtattgatcagtttgcatggcttatttagaactgaaacttcctggcagaggaagatgcaaagcactgagaaaatattatgggcaagttgaatgctgtccacacagattgtaagcattatagattatccctttttcacttttttcctgcttcccgtactttatggtcctgaggctttttgcgcactactttcctcactttgttctcctgattcagaagaattttgttttatctgtttatctccctcgtaacactgtttcttttttctttttcttttttgagaaggagtctcgctctgttgcccaggcaacagagtgcagtggtgcgatcttggctcactgcaacctctgtccccaggattcaagagattctcgtgtcacagtctcctgagtagctgggattacaggtgcccgccaccatgcccagctaatttttcttattgttttttgttgtttttttttttttgtatttttagtagagatggagtttcaccctgttggccaggatagtttcaaactcctgacctcaggtgatctgcccgcctcggcctcccaaagtgctgggattacaggcgtgagccaccacacccagcccctcacaacactggttttcacctccattgccccaacctgctattctacacattagttgtgggtaagaaaaactggggggaaaaatcaggaaaatataggtgtctaagcattgtttcaagtcttttatctgtcttaagtctcagcattctgtctggtttatgggggggaaaaaaaaccaagagcgacgatacacattactccaaataaaccctctcttaatttatgtaaaattgttctaatcttggtgggggtgggggaagaagcgtttaaaagggatagataaaaattcctggatgaaattcttggttgccagcctttttggaattatgacctcatcaccactggaatttacaagtgtttgtgatagtgagtaaggcatcaagtagataattaaccttttgtatttctatattaatgatttcatcaattagtatacacaattgcaaaatgactacataattattttgctctcaaaaaagtctacactcttaaaaaaactttaaaaggaaaaaatatcttttcataaaagttcctcaaactacagtgcatatttatttacatttgacaagtgtgaatgtgtttaatgaaaaggaaaaaattctgtatttcaatatgtagaacaggttggtaggtttagcattttttatttttgtctctccaaattcagtcaaaatagttcttactaaaacaggtcatacttaaattctactctagggggagttctttattattaaggcatgtaaaacaaagaaaaaaataatttaaagcactttccttataacctaattgatatgttaatgtttttctctaatattttgaaaatatacacctatgttcatccacgtgtttttgttttgttttgttttttaaacttggaggcttgctccaataaaagtaggactctgtagtgcatgtgtttatctgtttacctaaactgaagtatggccccaggaaaatagtatatttgattgattgtgtgtggtttttttaaaccaaatcatgcaaatcattttaattatgcataacttcaaactactacttaactcccattcttgacaattaaagaggttttgttctcctaattgggtgggttataaaagttaaatgttgcaaaaaaaaaaaaaaaactatgaaagaagctcaatttcgaagtatggcttcttttctgggccctataatatgtggtacatgtcctggcataattgaaggtaaaaagggtagtggttaggtggaattcatcacagagtatctcttcctctgtctccaaagctgcttttgcaccaattagctatgaccttttcttctagccttggggtgtaagattactaggggcaacaatttctgaaatattttctttctaatattagtttaagcaaatttccttgcagagctgactattctttcatggtttctggttttctttttcttttttttttcttccgtctgctgcttctttccactaagctgctaaatctttcgctgaggaattaaatgtaatgtttctagaaacattaatagcttgtgcccttttctgagtgtcctacttcagaaatattgcagctgcagtggtattacgggctatcatttcttcctgtttctctcagcagggaagttccagctttaaggtagatctgagttcttttattcctgggctaggtctcggagattttctttttctcaatgatgtgaatgccttagtcagggttttaaaagcctattgcttctttgtcaacttatttcacattggttcactatgcagctcatagtaataatggagaccgggcaagagtataaatgaataattataaatcaaaccctcctattggaaaagcaacccaaagcagggggctgtgtgggtactgtcatggtaacctcacctctagagatggtgggtggtgcgttagctctgtatgtaacagggaaaatcctccacaggctgtaaaatgttgaaagcacggttaaaataaaaacaaaccaccgttacattttttacggtagtttgggttataggactacaatgtggccaaatgaaaaggttttttaatttgacttgcgtgtggggcagagaatggcagggctttgttgaggctccctcccttgtttatttcttcccctccaaagcatgcctgttagatggttcttctttcttatcccatttcacttgtcattttatttgttttcaatttaaatatcacgctatttaagaaatagtcactgcttttgaagtttattttacagagctgtaagttttattgagacaaaataattttctaaaaatattagttgagaaaattagctaaatccttttcaaataataaaagaaggcagatttaacttattcaattttgacatctaatttgaatcttttgtgcttgttgtcctaaaagctactaccacttgttaaatttgaacaagtggagagaacaaaacagacatagtagaatattctacttaactagctttaaattaattttagattacacagaaccacatcttcattattaaagtcagaaattcaatatatattccaaattgttctactcttctaactcctttaataatgtcaagattttgtaacaggaaaacagggaattaatattttgttatggtataaatgtttttctttctaacctaacatgaaactaaaaattattttttcccacacttatgactcttaatagctaattgaaacagaactcacatgagtaatttatattaccgactacctgccacttaagcgttaatagagactgagcaagaatataaatgaataattacaaatcaaaccctccttttggaaaagcaccccaaagcaggggctctgtgaatactgtcatggtaacctcacctttatggaaagagaaataaagttttgaaataaaaggaaataagcctactttgaaaagattgtatatcattaacaatttttgtggtttatattttcctgaataagctagttttaaaacatataaacacattaagttggaagtgaatcttactaatgccagcactagttataattcatgattagcactggggcaagctgataatttgaaaatctcacagatttttactgctatttgtacccgtctatgttaactgtaccaatgataaaataataatcaaaggactgatggcttaatataatagctattgtgttctaaatatcttttatgctttgacattaaatgtctctcttgctttcgtatctgctttcaaaaatctactacccattcctgatagtatttaactggagttattagtcctttgacagtgctgcatgctattgacagtatcttttaatttgcttaatttcctgacatttgctatgttaattttttactttgggactttttaatgccagatttgtgcttaaaatagaaaagccctctactaataagatttagtcatatcacctaagtactacagagttgtcccagatgtaatagggagagataaagaagggatcacagataataagttttctctgctttccccacaaagttattactacaagctttaagtctcagcttttattgataaatataagtacaggttatctaaggaaagcctatgcctatttataatagcattcaaatctggtgttagtaattgctttaggccacaccactccataaacagtcccaaggcaatttgaaaacaggtatttgttgcataatctgtttttattacaaatgccttttgttttatgatttttgtattaaagtaatgaaactaaataatactttctggttaactagcaggtaaacgactttatgcaatatagatgtattatattttgtgaaactaccgatggtcattcaaagggaagattgttgggaaggggtggaggaaggtagtattttcaattggttacccggcttttaacaaaacaattcctattataatcccagggaatttcatctgactaaatctccactcagacgacaagcaaggagtgagagctgcagccaaagggacaaagagtggggggaaccagtggctgaatgagtcccaccatggtgccctttagtgggtcccattgtgccgtgggttagcacttctcaccattgcttatgaaaatactcagcattgaataatgctgtatgtcttacattctactcactaaaattgcttatgcaatttcaattggctatggtatttatcatttactgtcctctgcattatatagcatggttaagcctaagaagcagctgccttttttttttttaagtggatcaagcgattgttatgtattgtgtgaatatcagttcaagtttcttgagtgctgtagcatctagatgaagggtagtaaataaacattaggctcttaaaataaaaagacttttatgcgattcttcaaattctacattgcctggaaataaatagtggctattggtcccttttattttaataaaatttagatatatccaccagctgtgagcacatataaatctgcactttaatgttaatggaagttaggcatgggtatcaagaggtaaaaatcctagaagatattataaaatcatgttatgtagctcagtttttacagtggttcgaatgtaaggggtattctacatgccataaattactatgtatacaatctttaacctacaacatccttgaataaatagctttagaatcataagcttggttagtttcttttaaagtatagggaggcggtgaatgtattttaattataaaagcctcttagaaaatctgacatggtaaaaggagctatattatgtgtacacgtatgtagctcctttggtgtttggtaagagcactagttgccactctagtattttttcccattgtctgctcaggctgttttcggtctgagactttctcatcccgcagcccccacctctgtataacttttgccctgagtccttcaattgcatagactcttttctttctcttttcatttctgaggtgaatctgggagcccttatgtcccacaatttactgaagtgctataattatggcctttatcttttattaacatacctacatgctatgcttttctgtggtagcccagaatattaatgcaattagcacccttcattaagatgtactgtccattttgaatgacagctttaagtcacaggataagcctcctatacaatgggctacttttttttttttttttaaaggaagaagggaagatttgtaatttttaagaagtgaaaacttctagaaaatctttcattgctaatcctcccaaaccacccaaaaaagagcaagttttgacgttgaaacttcaggaaatcttcatactgataggatcttttccacactttaaaaagttaatccttaagttaatcacaatgaagacaccctgcttatttcctacagtggctaagaagataaagtgagatggtgaatgtgaaacttctttgaaacttttaaagtgtatttatttaaaatttgaatagagctttaaagtgtttaaagattattatcaatactatgttaaatcaatgccacttaaacccttcagtatcttcccatttcttctaggagaaatttaaattttttacagtagctcaaaaggctctgtgtgatctgacatgtatgtacattacctgccgcatctccaacagtccaacgctgtgagaaaatgtgatatccattacatttgaaccacaagactgttgttatattagaaagggaagcattgttttggtgcagatatcttctagtattcatctctcaaataagtctttttggtaaaattaagcaggattttgacattagaagacatgatgccgaatttaagttgtatgatgattattttgatgttattatgaaaataagtgcaatgttattggtttcatttatttctattatataattgattaaaataatgaacaattaaaatgtaagcaatgatttatggggtgcttaactcatagcagtaaatatagtatattgaacttacagttgcattgcctgttagacactatcaatatagaataagtctgatattttctaaatggaacaattagaacaaaccttattttaaagtgtgcctttccccatactccatgttccaaataattataagaaaacctactgcttctgttattacacgtttacaaagcaatagaaatattgcctgtaacctggccttcatagttcaactttagacttctttttttatgactacatctatactgtggaaaatgttttattttcctaggtaagctatgctattgtagtaaaatttttgaaaggaaaattattttggatcaaggacaagcaactctagcagttcagttgtttttttatctcattatttttcaatctaggaaaaatatttaaatatataacaccaatattttgcttggatagattgaagcttcagatgttttagttagaaatggactgcaaaaataatatctcttaaaaaaagaaacgaatatagtcaaatatgtgtctaagaaatacaacttgtgcatacatcctatagtatctctataaagatttcatcttgtttttctgattgaagtgttcattactagagacaaatgtatttttaagtcttgtgattagagggggccacagccatcatagctctattagaggcagaaatataacattaatattttagtgtttcatttgctttcatgaaacttatgaacagaagctatcagtgtctagggtttatcttcaaatgacaaatttagcattctgtaaaaagtgatactaggacttcctgctgaggtcatctagagtttgaccatccttagaaatgactgtgggtagattcttattctcaagtgctagaggttcttgttctctttttacattggattttgatggtgaccaacatgactgtgaaaaggaattgtaccacatgaagagatacacttatagaattacaaattggtcagtgccccttttctagtattccagaattatctgactaaaatgattttgtttagttccattttctaaaagttaaaacacaaaatacaatggacgtaggcttctgaagtgttctgagtcacccacgtgaaaagtcatggctaagattgtttatgtccctggcacataatatgtcgtcagtaaagatttctagaatgaataaataacttttccaaataaatgctctgttttatcaattacatatccctcttgtcttccttcttttcttggccaacttctttgaagtgtactgccatcatatatttttctcttttaaaatgttttccattattaaaggtaatgtatgttcattgtagaaaatgtgggaatgtgtaaaatataaagacaaaggaaaatgcatagtctcaacatccagaagcaaccacctttacattttgtttttttcttctatcttgtatttctatgcatattttacattgttcatattatactgtatacaaagttgtatatactacttttccacctaaatttataagcatttttacattaatgaatatcttgataagtctccttttaaatggttgtatattatttgaacgtaagaatgtatgatattcactccatccatcccttaaattagaaattgaatttgtttctttttttttgctaccataaataatgctgttgtaaacatctttctacatatagtacatatactatatgtagaaaatcagtacagcttttccctagaagagattcagaaagtaaatgacatgaggattttttactacttactagatgcaaagcatgattaacttgggtcaagtcagtgcataaaatctgtaatcactgatttgaatatactatatttacattctttgaacaaatattttaatatttattatagccaaagcctgatggtacaaagatggaccttaccccaaaggaatatactgtctagtatgaaaagagaaacacaataaattaaactgttaggttgagccatatgacgttgttgtttgacctatgaaaatatttatttcatgtgattcaatttaaaataatataggatgataaggataatattgaagcaagtacatggtggcttgggaacacagataagtaagtaattagatcttccgaagagagataacacagattattgctgcttattcagcagaaataaatttaaacgagggaacttttatatctgtgtaggtgtgtattagaaagctgctaggtcaggctcatgcatcagatttatggtattctgtaacattgcagcacaggaacacttcacctctctgaaagtccactcttccagcaactgtacctacctggaaatgctatctatctcttcaaaatatggcagtaaacctgaaagtaagcaaaaacaaaaatatccctcaacaggcgaaaggaatgtgatcaagtccttaaaaagcagcatgtagacttttatcaaaagagagtcttccaagtaccttactcaaaatctatttattatgttagacatagttctatcaaattggattttctatttttttcaccgtccagcaaatgggaaacagcatacataccaggattgagaggtagacagatactttaagactcactggaagcactaagacgtgatagttaatatcttgactatagtggaagagatgaaataattatcaaagcagataatatcttaaaaaacaaaaagcagaatacagactgtataattggtctcaactatgtaaaaaaaagaaataggtatatatatacgcagctgctaattaaaaaattggagtgaaatacaccaaaatattaatagtctttgtggctataccatggtatatgagtgatttgtacttccttcacattttttacaatattcttcagtgactctctgctgattatatcattagaataaataaaataataattggctgggtgcggtgactcacgcctgtaatcccagcactttgggaggcctaagcaggcggatcacgaggtcatgagatcgagactatcctggccaacatggtgaaattccatctctactaaaaataaaaaaaattagccgggtgtggtggtgcacgcctgtagtcccaggtactcgggaggctgaggcaggagaatcgcttgaacctgagaggcggaggttgcagtgagccaagattgcaccactgcactccagcctggtgacagagtgagacttcgtctcaaaaaaaaaaaaaaattaaaattaaatttgtaaatgaaaaagatctttgagcatagaacagttttggtctatttagagaagaaacaaatagacacacctcaaatatgccctacagaccttgtaggtacagcacagcacagtatttgatgttcatgataattatgcgaattagcaaaaatgtattttcaatagattgtccttacggaggcagcaaagtgtacaatatatcttcaaaatatttctatacaaaatggctaagataaaaattgttgctatttaggacgtatagactctctgctatccagatcaactcactgtgtgaggtttctggatagctgagatcctattttagcttttctattttaaaatgaaattactcaacagctatttgtcctattaaattatgcaatattattatatctaagcttcctgttctaagtgtccatagctatttgttgaggcattattctcagatgggcatggaaacaaatatttatctgattattcttttgtaaatggcccagttatatgttaaaatatatcttttttcctcaaatgtgatgtttctaccgtttgatgttgcctttgttcgttgacccttgcttttttcagactttcactaaataagagactatttacatatttccaaacgattgcaaaatattaaaatcaaatcataaattattcaagctattggggaagtttcctgtgaaaacatatacaccataaagaataatgtatttagaatatctccctgttggtagtattacaattgaagcacagttgttgttactcattcctctcctcttacatgtaataatcaaataatacaacaacaaaaccaaatatagtaaaaataaattcactgcccgtggggaagaatcttaaatattacctttattgtatatgtttgaagtatgtttgtagctttagttgcatcttcatcactccttagcagtctccttgttcattgtttactgaatcatatgcctctgctattcttccagattttctctattctctgtagtccctcaaactgaaacttgcacctgacagttttagtaaatgaccatctttttcaagttcccttcatttccctcagtgtcacttcccgaggcaaactttgtgctcctaatctcattcctcttacctccttcagaatcatgcttctttccttcttaatgtctttctttaaattgacttctttctacagaaatgctcatgtcctccttgaacttaaaagcaatcctcaggccgggcgcggtggctcacgcctgtaatcccagcactttgggaggccgaggcgggcggatcacgaggtcaggagatcgagaccatctggctaacacggtgaaaccccgtctctactaaaaaatacaaaaaattagccgggcgtggtggcgggcgcctgtagtcccagctactcgcaaggctgaggcaggagagtggcgtgaacctgggaggcggagcttgcagtgagccgagatcgcgccgctgcactccagcctgggcgacagagcaagactccgtctcagaaaaaaaaaaaaaggcaatcttcagtgataaaccaaacaataaataaacagagtatgtccctaagttactatcctatgtctagctggggagaaaagacatggacacaccaaagaagtaagagataagatatgtatataacaatatttgtgtaccatgtatgaatttgcaggcactaatacccattgatgagctctatttggctattgggactgtgcctctcctaattgtgtggcttggttggaattgcttcatctgatgtggaacctcaatagtcagtcaatgatttgttgtctctttacttattcactctttattttgaaattttcaagtatatacaaaatacaataatataaaaaaaactcatgaacccagcttccacaatgatcaattcatgatcaattttgttttctccatactgctactcttggatattttgaaacagctctcagacattatgtttttttcatctgtgaacgtttctgtaagcatccacaaaagatgaagactatttctaacgtaaccaaatactattatcatatcttactaagaaaaaaaatccttaataacaaatatctatttagtgtttacatttccctgattatctgctttggtttttttgttttgttttgtttttttgttttttgtttttgagatggagtcttgctctgtcactcaggctggagtgcagtggcactatctcggctcactgtaacctctgcctcctgggttcaagcaatcctcctgccaaagcctcccgagtagctgggattacaggcacccgccaccatgcctggctaattattgtgtttttagtagagacggggtttcaccatgttggccaggctgttctccaactcctgagctcaagtgatccacccctctcccaaagtgctggaattacaggcgtgagccaccacgcccagccaattatctactctttttggttagtatgaattggaaaccaaacaaagttgattcattattatggttctgttaagtctctttttaacaatggaatcccccttgtgttaattatcaattattcatcaattgctgcataacaagttacctttaaaacgtagaagcttaaaactacaaatgtttattatttcatagtttctgtgggtcaagaatttgggagcagcttagctgagtgatcgtttcagtgtctctcatgagattgcagtcaagatattggaccgggctatggttgtctctgggtctgaggctagaggatctactccaagatcagttcttcactatacgggcctctctatagagcttcttgactgttgctatggtctgaatgttttgtccccccaaaatacatatgttgaaacataatcccaatgtgatagtattaaatggtgaggcctttggaaagtgattacccttataaaagaggctcaagggagcatgtttgctccttcagccatgtgaagacacctagaaggtacctctgtgaaacagggaacgagcccttatcagataccaaatttactggtgccttgatattagacgtcccagcccccagaactgtgagcaataaataccactgggtatgttgttatagtagcccaaatggactaagacaagcatctttacaacatggcatctggcttccccaagagtgagtgatctaagagagaaagcaaagaggaaaccacagtgcattctgtatcctagtcttggaagtgatataacaatacttctgtcatattctgccaatcacacaaaccaacccagaaacaatgtgggagggaattacaccagagtatgaataccaaggggttgggataattggggggattcatcttggaggctgactgctccaccttttcatctatctctcctttttttcttgtaattttcaggggttttttttccattttctttttctttcttttctttcgttctttttttttttttttctcaaaatcttgagctcaagcgattctctcaccttgacctcccaaagtgttaggattacagatgtgagccaccatgcccagcccagtttttattgttgaagcaaccaggtcatttgtctgattgagtttatattttgttcattgcatcccactgtgttatttacctgtttctttgcctgtccccctactccatatattttctgtaaatttatagttagataaaccaagccactctaaagcttgatcagattcaggttttgtctttttgtcaagatgtcctttttttgttggtgttgtgaggttttatattggagcacatgatggctagtttactctttttgttatattagcagccactgatgattctctagctccattagttcaaaagagtactattctattattcctcctttaattagtttgattacttcataaaaaaaatgccccctcatcaactatttgattacatgaaggtacatttcatataatgaagggatgagaagtacttctctctttttgtcagtaagttgttgtctctctagaatcctctaaaggtaacaagtgaggtctgggaaccaacatgggtatgctgaagcagagtctccagggataggtgctggtcatggggatcttgaaaacgcttcctatgtgattctaatttggtcctctattaacttctaccaatctccattcccagagtctgacttaggtatgggagggggccaaggattctgtttttgttttttcttttaatctctagatactcctcttcagctgacaagtttggggaacactacactagaaaacacctttttaaacttactgtggctatatgcatctatgctattctcacaggccatgggtgtctcaagtttactctcaagccagctgccatgttgtaaagatgcttgtcttagtccattgggttaaggagagttgagagtctcgcttagtgctatagttatagcaaacactatggagttagactgtgtgggtctaaatcttggctctgccacttactagctttgtgaccttggggcagtgaattacctttctgcctcagtattctcacatgtaaaatggaaatgatagtaggattttcctcgtgggtgttttgagaactatatgagttaacattgtgtttagaacagggttttgtaaggatttcttaaatacataatagagttatctccctctgggagcacttccttggaacgttttattgataaaagccaaatgtggtggttactaatctcatcatgataacattgtcatttattggatgtttatatatgccaggcatgatgggttatgtatattctgcagttcacataatcctcatatcaatcctacaaaattagcaatattattttaattttacgtatcaacaaactgagtctctgagaagtaacttgctcagtgtaatagagctcataagtgatggtgtagatatgacatatattaaagaggcagcatgatggttaagagcacagaatctgaagctaagctctctgggttcaaatcctggcactaccacttcctagttgtgtatcttgggcaagttatttaacctatgtatcagtttccttatctgtaaaatgaggataatagttatacctacctcatgggttattatgaggattaaatgagttaatactttctaagcacctaaaatggtccctagcacaaaatgttgcagaactcttccttagttcagctaaagacagagttctttgtcccacagccacaaaaattcaggcccgcagacaatttgaatggtgaacaagcagggttttatttggtgaaaaggaagaaaagggggaaacatcctgctagagcaggatgttagaatcccaacttccacacaggaaaaggaggggccaggctcctccccagtgtaaacttaacgaggctccaccttagtgggcaggctgtttggagtttctccagggaccccctcccacctgactgtctcaataataaatactttgtatgtactagctcgttattattactgctattattatttttattagttagagtttaaagaaaaagcagcagtaaaaaaggagagactgaagttgccaataaggaagggaatacatgtatttcaataaatgccttaataaataaataaatcttcaggaggagagaaaaggagagttgtctcgccacaaagatgagcagaatagaaaacagttgatttctaggcgaaggcagatgattaaactcctgggagatagattcatttttacaaggtagaaatcaagctaatcctttagaaatgaagaaaggaaggtagaattggaagcctgtggaggcaggggaggtctggggacacttggggagtcaaaccacagagcacgcactagacatagccaagttgtgttttgtcaatgcttgatcatggctgaattccttgtggctaaaaaaaattatgcctggtggaggggatagctcagcagcctagtgacagcaacaagttcagacatggttgaatgggatggttatgatggtaagtagaagtgaaggagcgtggaacaaggaatcaggagacttggattcattttttaactttagtatatcaactagcttgtatgacctcgaatagttcgcttgacctttggatctcagttaattcacttgtgaaataagagagctacatcagtttatctctaacattacttctaattccagaatgtatgaccctacagggccgattctagcatctagctgcaccagaaaggagtcaattgaaatggcaagagttaagaaagtaatgggaaggcccagggaggttgggatgcaggttcaataaaagtgaaggtagatgagggaactcgtgtcagtctctcagtctttctgcctttaagatttttcttttctgcactcaaaattctaagactagtttgtcttttttttttttttgtagcaaatatcattatggctattgtgaatttaataggctatgtttgacacacacaagagtaaatgttattttagttttacatatctaaaatgttcattaacacatcagaaataaacagttcacttgtagggagttattttttttcttttaaacagaacataacaaaagagtattttatgctttcccgtgcccataataacattacattttggagtagctaactaggttgcttgaacacgctgttacagaactggttaatccataattcagcaggttcttggcttccaagttgccttattgacaagcctgaagaaagtggatggaactaattagcactcagcattataaaataggaagaattagataaagcagcttcaatattaaactcagacccctatgaagatattccctttagttatggggattttgaaatgatggacaggctaaaccaaaactcataatcctattacagtctcctacacccacctaataagcttcaagagccgtttccttggagtctgggatattgccatcttcctctaggcttttctgtatatagcttataaattctttacttgtttccactaaatactttgttatttaaaatagcataaaagagagtatataagtatatatacatattgaggtattttgactgtaataatacccttggcctgtagggaacttcaaattattaataatttcagaggaaagctttttaagaaaaaagctccaggcttagctgtaatgaggcatttgaaaaggaggaggggttatgtttatgtgcgtaatgaaaatattgaaccctttgggatgttatgaaccatggtgcactaataaatgatcttcccatttcagtgttccagcagacatctttgtacccctgatgtactcttgcaaaatgcctatagctcacatatccttttaaatatttctatctcctaacattcgttactgtgggtgggggtgcaacaggataaatctgatggagaaaggaggacaatacaagaagcagacaaagttggtggtttagaataatgagcccattttcagctgagctgtgtagttcatatgaattaattaaccccttacaaacatttgtctgacaatccaaattctcattcagttcaatgggttttataattatcatttaactaaatagcactaagaactgtttatatcctgacattaaggaagctttgtcgaattctttttctgtaaatcatctgaagttgtttacaatttgcagtagtcttggtttgtgctcaggttgctgttttgctgctttaaaaaatattttcagggtgctaattatagaatatgctctagagtttggttagctttgtaagagtagaagacctttgtaaagaacgttttcacattttaattggaagaatgtaggcttaagctattatctgtcatgttaaacaaaaggaatccgatgatgctcaatggatatagaatgattaattactcattcttaagacctgtgccatttagttcctggtgataagatggtgataaagcactttttacccagaaagagagaaatgagagtattgtgatgaccatgctgcaacagagtgtgagaacacttaaaaaaaaaaaaagtttgaaatgagaagcatctgggacctcccttctatgctgttgtgtatgtaattgcttttaattttgtacaaaaagttaaggtactattaataagcattttacttcattgagtgtcttctgattacaaggaacaaaaagctatttaaactgggtgttcattgaacagatacagagaggctcaagggaattcagggcaggatgtattatacacctagacctagagccctggaaatgggatctttgctctcctttcaaggtggctctgtggtccttcacatcatgagttcatgggcctttaatctagtgcttgaaacgagacttcacttatcctcatctaactgctccttctacctcctgacaaagattcttgggtcccaattctatgttcctgtgacaggaatgttatctgaatccttttttttttttttttgcaccaggccccaagtctttgacaagcctaggatggttcccctgtaggtcggggtccttccctgattcaatcagctattaccattttatttatttgtttatttttattattatttttttgagactgagtctcactctgtcaccaagctggagtgcaatgaggtgatctcggctcactgcaacctctgcctcccgggttcaagcgattctcctgcctcagccccccaagtagctgggactataggcacacactaccacacctggctaatttttgtatttttagtagagacagggtttcaccatgttggccaggctgatcttgaactcctgacctcaggtgatctgcccacctcagcctcccaaatgctgggattatgctcccggcctctactatttgtattatataataacaaatttaatcctcacaaaaatcctattaggttaagtactattactatattcccttttatagtgggggaaactgaggcaaggagaggttaagtaacatttccaaggttatgtaactccagggtctgtgatgagttaggagatctggtttctaatgcttgacccatcactgtgcgaatgacttgaagtgaatcacttaatctccctgggcattcagccattccatgaacagtttaaaaattgtttttctaattttttttattgacaaactaaagggaggaatcaggtccactgccacattgtcataggcactgcttggttgtatggaacagaaatctacataaggtagcttgagtgaaggggtatttatttaaggatgtgataagcaaccttgtggacatccaaggataggaaacaacagtgagaccacagagtgtcttaggctggaaccaaaatggaaaagttagaaatataagttgctctcaggccgggggtggtggctcatgcctgtaatcccagcactttgggaggccgaggcgggcagatcacaaggtcagatcgagaccatcctggctaacacggtgaaaccccatctctactaaaaaaaaaaaaaaaaaaaaaaaaaaaaaattagccgggcatggtggcacacacctgtagtcccagctaatcaggaggctgaggcaggagaatggcatgaacccaggaggcggagcttgcagtgagcccagatcgcgccattggtttcctttgtttgaacatgactgccacaactatgatacagtatgttgcttacttcaagtgcctatctttatgtgacatgggtctctccaagttcagattcttgtgacagaatctgactgatccagctagcctgtgaatttgtttcccttaagtcaggtgttcattctgtggccaatcagccagagcagagataagatcacatggtgataggactgtcaccttttccaggcacttgatgaaagagcagattctctgagaagggtatgggaagggctggcaaatagactgatgtttgctacacccataatcctagcactctaacacaattttaaagcatattgtgtatttctccatagatcatcattttggctacataaatatatatatatgtatgtttttgttgttgttgttttgttttgtttttgagacggagttttgctgttgttgcccaggctggagtgcaatggcacaatcttggctcactgcaacatctgccttctgggttcaagcaattctcctgcctcagcctcccaagtgctggaattacaggcatgcaccaccacgcctggctaattttgtatttttagtagagacagggtttctccattttggtcaggctggtctcgaactcctgacctcaggtgatctaccctcctcggcctcccaaagtgctgggattacaggcatgagccaccgcgcccggccatggctacataaatattttttaagcacttcactgtataccagggactttactaggactacactagcttcaggccctccatttcctaatttgtaaaatgaactatcctgtcttgctttagaattcacccacacacacacacacacacacgtttatgcgtttatctatattatactgaatacaattgtcctttcatatccgtagattctacattcatggattcaatgaaaggcatatcgaaaatatttttaaaaatgacatctgtactaaacatgcacagacttttttcatgtcccctaaacaatacagtataacaacttttacatagcattaacattttattaggtattttaagttgtcaagagatgattttaagtatacgggaggatgtacataggtgatatgcaaatactatgccatcttatataaggaacttgagcatctgctaattttctggtttctgaaggaagttctgtaaccaattcctcatggatacctagggatgatggtatattgcctttgttaccaaaccaaccggaattttgtttgtttgtttgttttgaggtgaagttttgctcttgttgcccaggctggggtgcaatggtgcaatctcggctcactgcaacctccaactcctgggttcaaacgattttcctgcctcagcctcccaagtagctgggattacaggcattcaccatcacacctggctaattttgtatttttagtagatatggggtttcaccatgttggtcaggctggtctcgaactcctgacctcaggtgatccacccacctcagcctcccaaagtgctgggattacaagcatgagccaccacgcttggtcccagccagaatttatttatccaaatgaatgttgtgcagtaccctgaatttgagctagagaagaaattcagtataatttcttcagttacatctagtgtttaaccaaactttagtattacccaggttacttattgatttggctctgaaatatttgttttgtaaaacaaatctattaaaagtcaaagacttgctgtcatcaaaactatttaaaaggctgtgaggcctactgtaaagatatcccaaagaaggacttcacaaatgttttttgccaatgatagaatcattccttaattctgtagctcctaaagtaactaccttgaagagcacggatcttaccaacatatgtaggttgtttaaaaaatcattcatattatgtacagaatcaaagatttaaaaaagtatacaagatacaaatacccagttaaatctatagttaggcatttgagacttaaaaaacaatttggtgggactctttactgaagtattaaaaaacagaattctatctcacatctatttcacctactgtgacccagtatctaaatatgtcagtatacttctcttcttatgctcacataggaaaaaattggattgaaatgcttaggacacactggaaactagatgaatttagagcttttagaggaaaaacaccttgccacagatctcccctgaaccagccaagttaattaatcttggtttttgttgttgctcttgctgttgttttaccatagttatgcaaaagtaatgctgcaagtacagaccaaagccccagaggaggtagttgaagttcagcaaaatagatttaccaaatccatttgtgtttgcctggttttatgttggcatttagagtctatctttattttggtagctttgtagcctgagagtgagagagaatatatgtgtataggtatgtttatatgtattgctgacaaattcaaagacatttgattaaatatgctttatgtaagaagtgaaaagtattgtgtatattttttctttttctgtggattacaatatcttcatttctgtggttactttttgcaaaagattagtccagattcatcactctagtttctaagaggaatgaaagacaatttaaagctaaattcaaattctatgtaagtagtataatctgatgaacacacccttttatcccaaatttagagcaacaaatgttttatttaatttgagaatatgagataggaaaagtccatcataaaagtggtttcagaagctcaaaatgttaactatagcttccatgcgttacagtcccgtgatgctcatttaattctaaagtaagtcactgttgtttctagaaaactagtcatagttagactaattcctttttgttgttgttcaaagatttgaaataaatgcacaaagtcttccttctttgtagtagactagtatcctggtttctgcatttttcctgaggaattatactttaagacctaagataaacaatgtagaagaatcctctaaatgtgacttgtggattccctttgtacaggacatattctttggtgttaatcatgatcctgaatcattcctgccccagccttttgtctcatcttccctattgtacatttacaaattggccctaatgggtaagaaagaaacagacaactaaaatagctataagatgaacagcagttttttaaaaaactttaaaatatttttcacactctacaggggaataagcagataatttgcatatacacttgtggctctgtgatgttttcatataccagaatttaacacctttgcaaaatcctagcagagaccatggggatacacaattagatgcttaatctaaacctggaacaatgtgatttgggctgatttgcagagagactgtaaaagctgaaaaatcagtttgacaacgttcctgctgggattggcctgcaataaatgtttgcagtggtatttggaggccatgccagtttattcagatcactggggcttaggagatgatgcctacagtaaaacttgagttcactgcttatcagggaatgtgtgaaggctcccaggctgaaggttcattaggtcagtatgtaagagctgtcaatcagaccaagctgtcaggggaatacttttttaaaaaacaaacagaagtaaaatttttctacttaggatttttccacattgcatcccttctgccatcatatcgtccatacaagagacagcccttgtgagagagtagaatattagcccattgtaatgttccgaatgtcagcctttggccaccatcacctatgagcacggctgctgctcttagtaatcattgtggtcacttaggatgaatgggatagaatggttgtccaaagtacataagtctttaaggagttaaggacttgcatcatattcattagccccagtattttaccactgtgatggaaacatagaaggtgctcagatgtttattgatctcaacatcaagaacagaaactactatatgaatctagcatacatatggcctttaccgccccatttcccattcttggctttaacaaaatttgacaaaattatttcctgtatttcttccatattgtcaagcgtgtattgttttatagctagaaaacctattatttaggtttgattttggtgtatttactgattgagcatgactagaagaatattcgaaaggtctttgtgaaaaaaaaaaaaaaaaacatcgtattacttgtaaaggaagccaagaaggtttggaggtgcaccgtttattaggttttgtgtgaacatttaacactaaaacattagttaatatatattaaccatttagatgattgtaaaacattatatccatgtggcaagtcactaaatcaaaacacaggtaactggaacagactgacagaaaacacagttggcctcatcagatacatagaaaccatagtaggatgaccaagataaacagtatagctatgaaaacatcaagttgatgatagcatagactctaattattatcatcgatagaatgtgaatgtataataaagtgaattatatagtttttgtttaactcttgttttaattagcaccagattcagctacagttgtatttatgaatctatgttaatttctaataattagaatgaattacttcttcctaagataatactcttcctagaatggaaatttagaaaatatactctattaaatatcagttgattttctttccaggtggcatccattaggacaaacattatgaaaaggccactgaccaaaatgttgatttcctagctgacacctggaagaaaaataaacttatgtttaatggaatagactgtctaaatccctgttttgagaagagttcacattcatgaatatgtattcattgctgaattcaatagattcgagtagtgaaggacatccgtatcatagaaagtcgcatctattcattaacttacaactttccaaagaaacaagcaagaatgcagcttgagatggagtgctggcaatacgcagttcattcctttattatgtgacacgtttatcatgacctgcatgataactaatgaaataaatatgagatttgtgtattatctgtggcctaatttgttgaacttctcattttaagttacagtagcacaatcctaaatcagtattataaatgagctgtttatggttttgtcttattcagtgttctaggtgcattatgtttttttatttatacatttcaaataatttttctctttatttcttcttttctgcagtggtaaatcatccctgtgcaacaagggctaatccaagatcagctacataaacggcctgagtgctgttttaaacaggattgggtgatggtacaacatgactttttaagataatcaagtagtaaaagtttctagtggaaacatgatattcattttgtctggtgctcttttctttctgcctaaggctttctgataaaatttatgctatatgccccttaataccgatttcatgatggttaaccatatctatgcctggaaagaaaatatagacttgggaagaaaacagatatatagtctacaatgaatatttctagcttgcattcaagatgactgtgttgtgcagaacattctgccaggcattaagtgggatacaaaagcagtctaacatatgatctctgtcctatgaatgtgtttttaaaatgtatactagtcattattggagtgactattatataaagacaaaagccactagggtagccatggttttttgccagttattagccatatatagtgcgtgcatgcacacatacacacacacatacatatatgtaatatataattttagtatatttaaattaatccatattttcaagaacttcattaacttgaacactcagaaataccctgagtgttttaagacataattgcaaataactcatgtaatgcgtatatttttatatctttgcatgtatgaagtttatacattcaggcttgtgcaaatgtgtttatatcatttgcctaagcccttgattatttacatgttcctatgtgggatcacagtccttcagatatgaatcatagcacagtgatttctttacatattcgtattctactattgagatactttaagaatcctgtgagttgtgtacctggaaatataaaattgatattattattaatccattcagaaatcatattgggcaatagcactactacatgtacatttagtagcaaacatagatagaatatttggagataatgaagatttcaatactgtgttaagaaaaaaaaaaaaaacaaccacgcaagagactcggctcttggctctcagctccaaagcatgtgaaatattcaacttaataagaacataactgcaggaagcacttctaggtcatgggagttgctatgcacaaaagaggtatggttgttctagctcagagaagcttccacatatattatttattgaggaagcctcattttaatgctgtatagagaagcccgaatgacatactcttcacaagtggcagtattggtattacagcattccaagggtgtgagacttagtttggaaatgaactgagaaaaagcaaataatatttcttaactattgtagaaaatggaggtgtcgctaggaaaattatattttcctctggtctttctcaccatttatttattccgctcaccaaggaccctggcttttgaggagaggtccatggctgagagaacattaaaaggaaagagtgaaagtggagaatgcagatgcatatttggattcaggaggaaggggaggttcaacaggtgccttctatagcagagttggttgttaagtcacactacccacaacatgctacccacaataaccacagaagaaaggttacacatacataggtctgttctcccttttatgctcacttaccacacaaatgacatctttgtgcctgttgttcggggtcattgcctaaaaaagttgagttgaaactggcaatgaagaaagaatgggccgggcatggtggctcacgcctgtaatcccaacactttgagaggccaaggcgggcggatcacctgaggtcaggagttcaagaccagcctggccaacatggtgaaaccccgtctctactaaaaatacaaaaaatcagccgggcgtggtggtgtgcctgtaatcccaactactcgggaggctgaggcaggagaattgcttgaacctgggaggtggaggttgcagtgagccaagatcgcgccattgcactccagactgggcaacgagagtgaaaatccgtctcaaaaaaaaaaaaaaaaaaaaaaggaaagaaaaacacagaaagagtggaggactttaacatttcttgagtacctattgttttcctggcatgttctaggtgtcatatgtacagcatctcattgcatcttcacaacattcctgagcattaggttttcttttcccaggtttacaggggaagaaatggaagattagagaagttaagtagcttgggcaaggtcgcagctggtgaatggctgaatcagaatctgaacaccagtttgtctaattctatcctgcatgctatttccttacaatgttccctttcacttaggggctcatgcaaaagatttatgatttccttcagattttctttggtcatagtgctctaaacacttgtagctgaatttttagttcttacctcaaataagtctgataacactactacatttttaaaaaatgagtgatataatttgtagaaatagtcactggaatgcttttaagagatttcaaatcatagagttgaaaattcatgctgtgctctaggcattattgatcctgagccatctcatgcaggtagatataaatcctcttcttaaagatctctggtgaaaaaacactttcaggcttttccatagtaatttacctcattgctgaaaatgtttacagataggtgtatgcacattgttaggaccaatgacataatgcccagttgcagtgaatcaagctaataaaataataatcctttttaaaattataatcttcaaagggtttccgaaaatcacttataggaagtttatgtgattttgctgtttctctaggaaaggcagttacgtttgaatatttaaatgatcaggccttgtgtgggtcacacagggatttttattttgcatttggattccctttatggtttaaatcacagatctctaccttaaatgcaaatgaatggagtgttgagaattgacataattttttaaattgccatagttatttccagggagctttatacctcagtataagtatcttatcctgtattataattgcttgcttgtttgtccttctaacaagaccatgagcaattggaggacaaggattgtgccttactcatcacagtatctctagtgtttagcataatgcttgacacacaggagtgatcaatagttatctattgagtgactgaattaatttctccaattgattctgcttagacaggcctttctcctacattcccccaaatgcaacctgctaattcacatttctctatcctggtttatgttatttctctcaactggagtgctctttccttcttttctccacttatataagtccacctagttcttcctggtacaactagttgctacatgagtcctgttctaactattccagatctcatagagtcatgtcctcctcatgccttgactcttttagcctatgggatgccccacacactttagccctttattatgtgcagctttatattatttgccaatttaaaaaatatttttgtcttgttttcccaaccattatgaaaagtagccatgtgttgtatcattttctctccccttcatagtgacttaagtgtggaagagaccgttggataacaaactatggcctataagccaaatccagtccaaaacctaagaatatttcttttttaaaaaattaattaattaattaatttatttttgagacagagtcttgctgtgtcgcccaggctggagtgcaatggcgtaatctctgctcactgcaacctccgccccctggactcaagtgattctcctgcctcagcctcctgagtagctgggattacagacgcccgccaccatgccctgctaactttttgcatttttagtagagacggggtttcaccgtgttggtcaggcttggtcttgaactcctgacctcgtgatctgcccgccttggcctcccaaagtgctggcattataggtgtgagccaccacgcccagcaagaatatttcttatgattttaaatggtaagaaaacaatcacaagggctgggtgtagtggctcacgcctgtaatcccaacattttgggaggccgaggtaggtggatcacttgaggtcaggagttcgagaccagcctggccaacatggtgaaacctgtctgtactaaaaatacaaaaattagccaggcgtggtaccaggttcctgtagtcccagctactcaggaggctgaggcaggaaaatcacttgaacccaggagacagaggttgcagtgagcagagatcatgccactgcactctagcctaggcggcaaagggagactgtctcaaaaaccacaagaaaaacaatattttgtgacatgaaaattatatgaaattcaactctccataaataaagttttttgcaacattgccacgtttattcatttacacattatttatgcctgcttttgggctacagcagtagagttgagcaattgtgacagagactctgtggcccacaaagcctaaaatatttactatctgaccctttacagggaaagtttgccgactgctggagtagatcatcaatgagtacttactggttaaataattcattgtcttatgactctattctattatgaaacaagatagtctgaaagtactgttaattatgctgtcttgccttacataaagaaaaatagtaataaaagcaacctctggagaacagattatttttatcttttagttggtgaagtataaaaattttcattttctcattctctggtaaagtgacttatagtgcccttattagttttaaaccttttcaaatatgcagaacctcttcctgcagagattttaaagaacagggtaaggccaggcatggtggcttatgcctgtaatcccagcactttgggaggccgaggcgggtagatcacctgaggtgaggagttcgagaccagcctggctgacatggtgaaaccctgtctctactaaaaatacaaaacattagccgggtgtggtggcgggtgcctgtaatcccagctactcgagaggctgagacaggagaatccctcgaacccaagagacagaggttgcagtgagcagagatcgtgccactgcactccagcctgagtgacagagcatgactccatctcaaaaaaaaaaaaaattaataatagtaataataaagaacagggtagatgattatcgttctgggatggactagataacttctagtattgtgcagcccagtgattccttgaatctcctctaaatgtaaaccttgctttattagaaatgagaaatctgatttgtggatatgaagtctccgcatcccccataactccttgattctcctttgccaggacctccccccaccctccacttttggtttaatctagttcttctaattaaatatgagataattaaagttcacagagtttaaacccagcaggtttgatttaatgataaaaatcttggtttgtcagcttttcaaggcataatcctggctgctgccttatctgacaggtagtcagcctagcaggtctgaggatgaaaaccagagcatctcatcttttcaggcatgacttgctatttatcttctgaggcataatttacaattgccctatagaaaatgggtagggttaaataagtagaaaaggtctccttttgctttggctcaattaattcatttcctatgcggttgtcgatgactaggcttacaaagtagacagatgtatttcaaatgaggagaaaatgccccaaacatagcatatttgattattgtaaattattcctttactcactgaatatgtaaagtatgtaaatttagtcctgctgtcaaaaggtagctctgtaccattagtttctgcagcagacaaggcctgctgcatcctgtactgcattttcagagagataattctaatgacagcttgagcaattgccttaatgagccagaaaggtgttcttttttattcgtgtttagctgcttagagtcatctgaaatagagatcatctgtagatattacagagtgaaaaaagacatgggttatcttattaatgtgtttctccaagcatgctaagaatgaaccatcaatcaggtatttgccaagaaaatagcttgttgtcagttctgtataggtgatatggcaacctgaaatgcaagtttaggttctaattatcatgctagctaagtaaaagagttgtcaagttgcatctataagtcattttgggaaatattgtagggcttaccaaattgatcacaaaatagcattaatattgtaaacctgaagtgaacaacataaccagttttttaaaaataaggcactctacttgagtcatcaggaaaacattagaaatctacctatgtgcatcatattatatgtaaaatttagtttaattggagctttgtgttgttagaacccaacacattaatattaacatttgagacaaatttcctatcatctgagtctttcattctaagtgaaatgtccatattttctcattaatttgggtctatttaaagatcagtcacatcacagtaacataaagattggaaaagtaatgttcacattttagttaaagtcatgaaatatatacctataattgactatggtgttttgatttggttataaagtatagctgtaccttccacacggagttaagagaagtcctggcttaacacattagtggtagaaagtgtaagtttacacttaagccactccccagccaaggatttgcataaaaaatgagtgaagttcagcttgggtttatgttagcaaaatggcaaatgtagaggcacgctaaaggtcctttctgccacccttgtatacaatacatgtctgcatcttgcctaatcttaattaaatgtctttattaaatctttattaaattaataaaatgtcttctgggtctgaggactgaaattctgaaatgtaaccaatatttaagagcttaaacagtgcttctgtatagaacttgtagtatgaaatatgacttcaaaaaagcctgagctgtagaattaattttttcaattgaatgagtaatactgctttaaaaaatatacatggccgggcgccgtggctcatgcctgtaatcccagcactttgggaggccgaggtagggagttcgagaccaacctgaccaacatgcagaaaccctgtctctacttaaaaaaatacaaaattagccaggtgtggtggcacatgcctgtaatcccagctactcaggaggctgaggcaggagaatcgcttgaagccgggaggtggaggttgtggtgagccgagattgcgccattgcactccagcctgggcaacaagagcaaaactctgtctcaaaaaaaaaaaaaaaaaaaaaaaaatatatatatatatatacacacacacacacacacacacacacacacacacacacacatacacacacacatcctttttatggcctcgtgcagtggctcacccctgtaatcccagcactttgggaggccatggtgggcggatcacctgaggtcaggagttcaagactagcctggccaacatggtgaaaccccatctctactaataatacaaaaatcggccaggcatggtaactggcctctgtaatcccatctacttgggaggctgaggcagggagaattgcttaaacctgggaggtggaggttgcagtgagcagagatcgtgcaactgcactccagcctgggcaacagagtgagactctctcaaaaaatatatataggccgtgtgctgtggctcacacctgtaatcccggcactatgggaggccaaggtgggtggatcacctgaggtcaggagttcgagaccagcctgaccaacatggtgaaacccgtctgtactaaaaatacaaaaattagccaggagtcccagctactctggaggctgaggcaggagaatggcttgagcctgggaggcagaggttgcagtgagccaagattgtgccattgcactccaacctgggtgacagagcaagactccgtctaaaaaaaaatctatctatctatctatatatatatatgtgtgtgtgtgtgtatacatgtatatatatacacacatcctttttagtttaaataatccattgtattagaaagaaaaagttacactagtgaatcagctctacagttttcagaaggtgaatcaaataattactaaattgaagtacagtaagatgaactatcatgtgaaattatatttccctataaatttcttatgaaatcttgcattgatttgtgcatgtgtgtttgactaatgaagtgaagtgtgggactactatagaatttagatttaatgcctaggtaatgggtacttgtccaattacaggtcttcatgaagtttctaatgaaaaaaacactaaagagctcttcttctcagctgtatcataaatgacaaaaatctcagctccccaggcctaagtcagtaataagtggaagagtgactcttctagttactaattcatttgtggagttttccaaagttagcttgcattgtaagtttcttataaggaggatcatttcatgagagttggttttttgctattgtcacaattgtgtaatcgtccccatagaagcatgatatgcatacacttaacacattcaatttgtaattcttcttgctagtaaagccaaaaattctatcccatgcttagacatccatggaggtgatcattataatgcattatttgtcaaattttattctttttcaaaactccaaagaaaatgtgacattctactatgtctttgaatctctgattatatacatttgtttatgttaatctataacatgttacttggtttctttgaagctctgttttctagttgatgatgctaaaatttatgttaattcacatctaggtgtacttgaaatcacctaatttgaaattgcagttcttaaacagctctaagaaatataattatgtaaagaatattttgaatgaaattttgaataaattggtagaaacatagttaattgttcgctgcatcccaaaacagtaggcttggaaagtgatgcttttctactttaattttaaatcttgtacattttataagaaaggagtaagcctatccccatattaggcaagtcagattaaatgttagttccattaattcagagaaaataagctcagttaatgatgattcaatgccagttgaaaaataaacagatatgcaaaatcttggtttcttcctgtaatttcttaccatttttttcagtttctttgttgttctgttaaatctttagttaggttatggtagaatgccgtggtacctcattgttctttaactctagtgattggttgtttttaattacattaatggtagttttttgttttttttgtttgttaattttttggtatatcaaacattttctgttaaaggagaaaggaaagaagagctttgacttacaaactgacttgaaagctattccagcaattggttgtctttgaagtaggcaatttaccctttttttcccttcaaaatcagttatactacatatttcctttttgaagcaggaaagaatgaactgtgcatcacagttctgttatctatagcaaatctgtaactcctgaatcctttcttcccgaccccacccaccctgggggctacttctctaccattagtttatggtcatcagagaattacaacaagtagagcagcacagccttgtgctttctactctaaaggtattgcttccccagacaactgaaacttgagttaagcccatgccccaggaaaagaaaggtcaggaagttattttgctttctggaaggctacagagatgagagcaaaggagatgaagagccttggcatctactccagaattgcttttgactgccagacttcgatctaatctctatggcacatcatcagcattcactgtgtacctcatacacaaaagcagaagagtagctggatttctttaaaattgtgcccttcatttgtttcccttgcatgttctatttccccaattaactttgtgagccctgggcaaattagttaacctcactgggcctcaaaggcctcatctataaaatgaatggtttagaatagatgatctttgatcccttccattgcaagcattctatgctgtgaaacctcaaggctgtaaactatatgagagtaggagccaatttttttttttatcattttttttatctccccacagggcctaatgtaactttgactgtactaccttgctttcactatgtgaagtagattttgaagacagctctaatatgtactaaactcgattagaaattagacatcccattttagttgaaagtcagcttattaggtagatgttatatgaacttgcttatttcaaaaggaaaaaaaattctgggaaatgaatcattgggatggaattaagtaatcccatttaggaaaatagtactttaataataggctatgaaagagttatgggttgaattgtcacccaaaaaggtatgtttaagtcctaatccccagtatctgtgaataggaccttgtttgtgattggaggctttgaaaatgtaatcaagttaagatatggtcatactggatgagggtgcaccctaaatccaatgactggtgtccttataagtaggccatgtgggacacaaagacacacagggagaatgccacgtaactgtggaagcatagactggagtgatgcgactgccaaggaatcccaaggattgatggctaccataaaaagctaggagagagaagtgcaacaaattctccatcagaaccttcaaaagaaccaaccctgccctgtaccttaacttcagaattcttgtgtccagagctgtgagagaatacatttctgttattgtaagtcacccagtctgtcataatttattatggcagacctaggaaactaatacagaagatgtggacactggcctaggaaaagtccccaaagaatacataaagctctggactggaacagtcatagcttgcaactaccgtaggacatctactttcagcctaggatgtcttcatattttataaaatataaatctagatagtaatagaacattaagatctttggagcaactcaccattccttacgagatcaggaccgatcttatacaaaccctgatcagctgaattaggatcacatttgttataattattaccgatcccttgagagccacctttgacccagcatatcatacccacaagcctaagagtaagctgcagaaagactgtttcttagaatggttgtccattattgactaccctcttctaccttatgcatgtttcttttgtccttttttcgttaaccatttataaagttagatgctaaagaatattgagctcagaaatagtatttccaaataaacaatgtgtaaatcaatttaagctgtttacttccccattgggaataatctctcttactttctacctatgaaaacttcacccaggctttcaccatgcatagctcagatcccatctacctcatcaaggcttcgttgaattccccatttgaaagtaatctgcttgctgtaattacataacttatactctctatgtagttctgttgacacttagcaaaaagtaccctatattatagttttgtttttacatctctgtgttttattgttaaagaaaaaattattctgacacttgttaaatatggtaaggctgacttcattcagagggactactacagtggaattttgtagtacggtagtgagattaagccaaactccacacacaagaagtaccaagtggacatttatagccatgaaccagggtgggggtcgattgatggaaaattactaagaggaaacatcaggcctaagggcattccagctaaactgacttgacaggattcttgctgaagtcagaccaagatgataagatatccagagtgaggaataaggaatttgatcagataatcaagggtgagggatctgcactaaactaacccagtagtatttttgctaaaacaggactaaatgagccagggacagagcctaagtttgggtctagttaaaaagggagctcagaagaatctgactcaagtttggtcaaaggagagagtctgtcattatctcctcaatgagattctagagaataggaattataattcatactcttttgtatctctactccctactgcccccacccccatgaaaaacagtgtatgcatgtcataaagtagtttgtaattgagtatttttcattgatggttgactaattttgacagagccgacaccttaattcaccagttaaattggctctaggcacagccttgcacaactcatcattatttgactaaatgaagacaatatattctaagactctggtacagaatttctggttaacagtggttggcataatttattctcttgcctgccattttcaagtgatgttactgctttgaactcattttttaaagtaatatttataaatataactggtaaaagtgtggcatctttggccaatgaaaagaattgctgtcagcttgagaaaagaaacgtaaagcactaagtatactagaaattgcagacatcctcacaaaagtgatggattaatgaccacatacagcattatgaaagctagttatggtttgcttaaaccagtctctctctttatggcattctcaatctttttaaacagctaggatataataacattttaaaaattaaagtatttcacataaccaagaacttgatatgaaatgagcaacattaagcacaaaacaattgaagcttcaaatactggagcaggcaagaattttaaacagcccgaatgaataaggatgcaacattgttgtgcttcttcagatgcaggaataatcaggctcagaggttagcagaaagagattttatagcaataatggctccccataccatttttctcttgtgactttgactcacaaaggtgaagctttcatttgaagatttgatacaatgcagctgccaacagcaggggggagaatttggccaaatggctggactctctcaaacatctgtgagggacagagattgagagggagagacagggagaaattgagagagatataaaaggaaaagaggaggggaccaaaaagaaaaaaaaaaaaaaagatttgcattaccaatgacaaatcaaagttgaaagtttgcctttcctgttgtcattcattgccattcatatttagaaagcagactgctgtgataattgatttgatggtccagcttgagtggaagcacttctgggcatagcagcctcagagatgccaaaaaagaagaaaaggtgggaatgaaataatgcactactttctcctcagaggcatgtggcccagtttttaagagcagaaaaacatgctctggggtggggggagtagaaacctaaagaacttagtaataaatacaaaaatgaccatatagctccagtcagataaaaataggcattcaaaccaagacaatgagaggacatattttactgacaagtgaataataggggagtgtggtggaaataatctgatttttaacagactctgtcctttgggagtaccttttttgctcttcttttatatagagacaaaagtgatttcttttctaaaaagccttttaatttttaagcttttcatactagattgatagttcagaaggagaaaaagaaaacaataattgagactgaaaagctatatatgtgcccggattatgtaaacatcactgaatttccttgaagcaataggtaataatgaagcttgtccttagatttgtgagtagaggttggtgttcagccattgcttcctgctgatatgaataagttaggaaactaaagtgccagttgaagggggcaaaagagagagagagagaaagagttttttaaagtactgaattcactgcctgacctcttaatcacaactgccaattggattgtatgccctgtcattccatttaagaacctaaacaaaccagataaaagacatagctgtcaaaacacaaattttaatcagaacctgtttgtcttttgagagaaatatacttgtgttcaaaagtagatcagtcctttaactttgttacctttctctcttttcttccctctcccttctatcttcagttctcctttcttcatttacgtacctagctagctgcctctacttatacctacagagaaagcctgttgtttggcctcattgaatgtgtcatacatatgcagctgttatgcaaatatcaataccgtcccatcacaatttctgttttcctggtaaggttctcaactacagtgagacattaaattttctgagttaaaacaacaacagcaacaaccaaaaccctcaaatgtatgacttatttttaaaagattcatccaaaattaatatggaggaaacagtgttagctgtcagtataatgtatgacagtatttctgaaaatcttttaaaaaaatcatgagaattacctgggaaacttactaaaattcattatacaatgtatacctatatcaaaacatcacgttgtaccccataaatatatatagttattatatatcaatcataaattgtttaaaaatttagagtatcagaccataccccaggtcttgaatcacagtatatagtgctcaggaatctacattttaacaagtgcccagatcatttttctacatactactgaagtttgaataccagagacataatagttaaagagcaatatttaattacatcaactggaatctaattccgtttttaccattactagttgtgtaaacttaggcaaattatctagcctttctaaaacttagtttcttcatccatgaaatgtatgtaacaatgcctacctaatagggttattctgagaattaaataacataacgaatataaaacacagcacagtagctggtgattctaatatcaatacatagtcaatattattgatattgtttatcttttatgatttagaaataggttcttttctatgggttgttcatattgcgcccttgtaaataatagtttctatttccattttatattaacatagacggtacttttccatgtctcaaggatgtataagattaaacatcaggccaggtgtggtggctcatgcctgtaatcccagcactttgggaggccgaggcgggcagatcacgatgtcaggagatcgagaccatcctggctaacacggtgaaaccccatctctactaaaaatacaaaaattagccaggcgtggtggcacgtgcctgtagtcccagctactcaggaggctgaggcaggagaatcacttgaacctgggaggcggaggttgcggtgagcgatatcacgccactgcactccagcctggtgacagagcgagaaaaaaaaaagaaaagaaaagattaaatatcatccccatcacttcatcttacccagtggggaaacaaactattttaaactaaagtagtagcacatgcttactggcatagagcagaacattcttattaataccaactctatgtaaataactagatatatacattattcacatctgaatgtgtaattaaagaccatttaggtactgaacttgatgaatgagagggaaaaatgtctgggatgtcaatgtgatactgtaaataccgaaggcaattcacagtgtgactagtagcaccacctgtctcacacccaaagataattcatcaaataataccacgtctaaactggcagattctttgtcttcatagcctaaaatagagaaaagatcactagattttttttttaaaaatctaatcccaaaacttaccagctctgttacttcagacaaacctcttaaccctcagtgcccccatctataaaataaggataattatatttgccccacctcacagccttgaagtgaaaagaaatgtggtaatgtatccaggaagcatttataaactaaatgctatacaaacaaatggtgttatttcatacctattcaaatggactgaaagtcatttgaaaatgttatcaacttttgaccgtgattgtattctcattttccaaggaagtccaaaagatagattaaatttgaattcttcattgttgtgccttgctgatttttgcttgaggtgatcacactgcattgatgcatttttacacagcttttgttgaatattccttggtccaaaagctttcagctttatggctttgaagctccaattccctgatcaatgtctgaacttgtgaagcttgaaatttgtcatttggcattgacttatgtgtaaatctgagtcaaaattcagtgtcctttaaacatctcggggcaaattttcagcatggcctcatttttactgatatgatcatgtatttgtaagtacagattgccacttttgtcctcaagagagcacaaagtggtcattgcacctgccatgaggtaattgaaggtgcaaaaaatcccacttctacaaaaaagtctttataacactcccttcctttacacccctcccttctgttcctctgtgtgtaccgaaaataaaaaaaaaaaaagaaataatgctattagcaggctatgaatagagatcagcatttcttttcaagaaaaataaactgcatttaatttgggcttctcttaaaaaaataagatacccggtgtaatttaaaataaaaatattgatggaaatggcaatgtctttcataattattattcaattgcaatgttatatactccataacttaagcaaatgagtagttttgactactggaaaatagcatttgaaagtcaattatggaacttccagcacacctatagttttagtgtcctaaacttatcctctaaagttactctagaccaaaagagtaacatttgtttttgatacacccttctttgtgccagtgttctctaagtactttttggattctcgtgctagagaaaaagagctataagaaatgaaagataaacctaacctagggttttatctgttaccagaacagtatatatgttacaaatgacttataaaattacccaggcagtgggagcacttcctagccatttcctggtgtgctacctgtggccattctaagcattgactaaaaattattcacagaccttgattttattgctagtgatatatttacacatactatttagcccagattattcatatactacatatatgcctactagcccagtgcaagtaggtagtcacttgtttacctctcagaaacagcaagctgttatttttcctttttaaaaatttggctatatttgttttttggttgtaggaagaaaacttaacaagagatctaccctcttatcaaatctttaagtgcacaatacaatattgttaactataggcactatgccatacaatagatctctagaatttattcatcttgcacaaatgaaactttatacctgttgaacagcaactccccactcctccttctccccagaccctggcaaccaccattctactctgtttctgtgagtttaactattttaaatagctcataaacgtggaatcccgcagtatgagtctttgtgtgcctgtcttacttcacttagcatatgtctccaggttcaaccatgttgtcacatatggcaggatttctttctgtgtttaaggctgaatcatattccattgtacgtacataccacattttctccatttactctattcattcactgatggacatttggattatttccctatcttggctgttgtgaataatgctgcagtgaacatgggagtgcagatatcaatttgagatcctgctgtcaattcttttttttgttttttttgttttgagacagagtctcgctctgtcacccatgctggagtgcagtggcgtgatctcggttcactgtaacctccacctcctgagttcaagcaattctcctgcctcagcctcctgagtagctgggattacaggcacgtgccaccacgcccggctcattttttgtatctttagtagagacggggtttcaccatgttagccaggatggtcttgatctcctgacctcgtgatccgcctgccttgacctcccaaagttttgggattacaggcatgagccaccgcgcccggcctcaattctttcggacatatccccagaagagggattactggatcttctggtaagtctgtttttaattttttgaggaagcttcatactcttttccataatggctgcatcattttacattcccactaacagttgtataagggttccaatttcttcacatccttaacagtgcttgttaccttttcacatccttaacaatgccttttacattttttttttgttgttaaatagtagacatcctaactggggtgaggtgacatctcattgtagtttttgatttgcatttccttgattagtgatgttgagcatcttttcacatacctgttggccatttgtatgtctactttggagaaatgtctattcaaaacctttccttattttttaaactggctatttgggagcttttttgttttttattttgttttgtttcattttgtttttgagatggcgtttcgcccttgttacccaagctggagtgcaatggcacaatcttggctcaccacaacctccacctcccgggttcaagcgattcttctgcctcagcctcccgagtagctgggattacaggcctgcaccaccatgcctagttaattttgtatttttattagagatggggtttctccatgttggtcaggctggtcttgaactcccaacctcaggtgatctgcctgcctcggcctcccaaagtgctgaaattacaggcatgagccaccatacccagctgttttgtttttttgatcttgagttatttgagttccttacgtatttgacacattttgcatagttagccctttatcagatatgcagctagcaaatattttctctcatttttgtaaattgccttttcattttgattgcttgctgtacagaagctttttagttttatgtaatctcactgtgtttttgcttttgctgcttatgcttttggtgtcatatccaagaaatcattgcccagaccaataccatgatgcttttcccctttgttttcttcaaggagttttgtaggtttaggtcttacgtttaaatctttaacccatttttagttgatttttatatataatgtgggatgaaggtccaatttcattcttttgcatgtccatatccaattttcccactaccatttgttgaagagactttccttttctcattctgtgttcttggcaccccatacaaagatcagttgaccatatatgcatggatatatttctaggctctctattctgtttccttggtctacatgtctgtttttatgtcagtcccatattttttaaattgctgaaggtttgtaatatattttaaaataaggaagtgtggcgaatccagctatgttcttctttctcaagatttctttggctattcatgctcttttgtagttatgaattttacgatgggtttttctatttctctgaaaaatgccattgggacatttaaagggattgcattgaatctatagattatcttaagtagtatggacattttaacaatattaagtctttcactgaatatcttttcatttatatatgttgtctttaatttgtttcatcaacgttatgtagttttcgccgtacaagtctttcacctccttggttaaatgtattcctaagtatttcattctttgtgatactatgcaaatgggattgctttctcagttttgttttcagtactttattgttaatgtacagaaatgcaattgatttttgtatgttgattttgtatcgtgcaactttgctgaattttttaattagttttaacagttttttgtggaatatttagggttttctctatgtaagatcacgtgtcggcaaacagagatagttttacttcttttttttttcctcccaattttaatgtcttttatttttctttttcttgtctagttgctccagctagagcttccagtactatcttgaatataaatggtgagggtgggcattctttccatttcctgatatgagaagaaaaactttgtgttttatcattagtttgatattagcagtgggcttttcatatatggccttaattgtgttgaggtaaattccttgtatgtctaatttattgatagtgtttatcatggaaaggtgttgaattttttcaaatgctttttctgcatctattgggatgattgtgtgatttttatccttcattctattaatgtggtgtagcacattaattgatttgcatatgttcaagccatcctcacatattagggataagtcccatttgatcatgatgtatgattttttagaacttagtgttgaattcggtttgctaatattttcttgggaattttcacatctgttttcatcgaagatactggtctgtagttttcttgtagtgtctgtgactttgtattagggtaatactggcttgattgaatgagtttcgaagtctactctcttaaagtctttaaaaagtgttggggttaattcttcattaaatatttgataaaattcaccactgacaccatctaatgctggatttttctttttgcagagggttttgattactgattcagtctccttgtttgttattggtctgtttagattttccatttcatcatgatttacccttggtaggttgtatatttctgtgaatataaccattgcttcgagattatccaatttgttggtgtataattcttcatagtagtctcttctgatcctgtttatttctgtggcatcagttctaatgtctcatctttcatttctgattttgaatcttttttttttttttagtataaggatttttccattttgtttatattttcagaaaaaaacaattttctgtttcactgattttttttctactgcttttctgttctctatttcatttattttgactctagtctttgttatttccttgcttctgctaatgttgggcttctcctaaatttgttctttttctggctccttgaggtataacattagattgtttatttgagatctttctacttttttaatgtaggcattttatcaccataaatatccctcttagaattgcttttgctctatctcgtaagttttgttatgttgtattttcatttttgcatgtcttaagatattttctaattttttttttaatttcttcattggcccattggtttttaaagagtgtgttgtttcatttccacatatttgtaaattatccaattttccttctgctattaatttctagtttcattccactatagtcagaaaagatactgtgtaggatttcagtcttaaattcgttgagactttttttgtgacttaacacgtgatatattctggagaatgttccatgtgtgcatgagaagaatgtgtatttcacaactgttggttgaaatgtcttctgtatgtcttttagttcctcttgctcttagtgttgttcaagtctattgtttccttattgatttttttttttgcctggatgttctattcattatcaaaagtgggatatgaattatcttaccaataccatagtgctgtctgtttcctacttcagatctgtcagtgtttactttgtatatttagatgctctaatatttggtgtatatatggatttataattgttatatcttcctgatgaattgctttcattattatgtaatgacctttttcgcctctatgtcggtttttgacttatagtctattttgtgtcacataaagtatagccactcctgctctcttttggttaccatttgtgtggaatatctttttctgtctctttactttcaggctatgtgtgtcctcaaagctaagtgttgtctcttataggtagcatataattagatattgtttatttatctattctgccactctgtgtcttttgtttggggagtttaatccatttgcatttatttatttattttattttttttgagacagagtcttgttctgttgcccaggctggagtgcagtggtgcgatctcggctcatggcagcctccgcctcctgggttcaagtgattctcctgtctcagcctcccaagtagctgggactacaggcgtgcaccaccacacccggctaatttttgtatttttagtacagacagggtttcaccatgttgcccaggatggtctcgatctcctgacctcatgatccacccaaagtgctgggattacaggcgtgagccaccgcaccaggcctccatttacatttcaagtaattattgatagggaaggacttactattgcccttttgttgattgttttctgtttcatagtctttttgtccctgttttcctctcttgctatcttcttttgtgatttgttgattttttgtagtgatatgctttggttccttcttctatttcttttgtgtatcttctatagttaatttctttatgattaccatgaagcttgcatagattgtcttacagttacagcagttctatattaagctgctgacaacttaactgcactcacatacaaaaaccttccacttttacttctccctcaccatactctgttattgatgtcatagtttaaatctttttatattgtgtatccattaacaaatttgtgtagttataatcttaatatttttgtcttttaactttaatagtagagtttaaagttatttacagtccaccattattgtagtatccgggctgggcacagtggcttctaatcccagcacttcaggaggccaaagtgggcaaattcattgagtctaggaattcaagaccagcctgggcaacatggcaaaaccctgtctctattaaaaatgcaaaaaattagccaggcatggtggtgcacaattatattcccagcttctcaggaagctgaggtgggagaatcagccgaggctgcagtgagctgtgatcatgccactgcagtctagcctaggcaataggaatgagaccctgtctcaaaaaaaattatctatgtctatatctatattatatatatatagtattctgtgtttgtctgtatgcttgcccataccagtgtgttgtattctttcatatgcttttgtgttactgttttagcatctgttcatttctactggaagaactcccgttagcatcatgtctagtggtgatgaactcccgtgccttttgtttggaaaagtctttatctcaccttcacttttgaaggacaattttgccagatatagtattcttgattggcatttttttttctttcaacactttgaatattataagctcactgccttctggtctgcaaggtttctgctaagaaatccactgatagtcttattgaggactcactttacatcacgagtcacttttctcttgctcctttaaaatttttctttgactttgtgcaatttgattatattgtatctcagtgtagacttctttgggtttgtctaatttggcattctttgggcttcatgaatctggatatccatttccttgcccagatttgaaatgttttcctccatgagttctttatataagctttttcccctgactatctctcttctcctttgagattcccataatgaatgtattggtctgcttgatgatgttcagtaagtagcttaggctttcttcattctttatcattctttgctttttgctcctctggctacataatttggatgacttgtcttcagtttcactgattccttctgcttaatcaagtctgctgtttaatcactgtagtgatttttcagttcagtcactgaaccagaatttctgtttggttatttttatttatttatttatttatttattcatttatttattcatttatttattgagacggagtttcactcttgttgcccaggctggagtgcaatggcacaatctcggctcactgcaacctctgcctcccgggttcaagctattctcctgcctcagcctcctgagtagctgggattacaggcatgcgccaccatgcctggctaattttttatttttagtagagacggggtttctccatgttagtcaggctggtctcaaactcccaacctcaggtgatctgcctgcctcagcctcccaaactgctgggattacaggcgtgagccaccgcacccggcctggttatttttttttaaataatttctacctctgttagggccagatgtggtggctcatgtctgtaatccagcactttgggaggccaaggcaggtggatcacttgaggtcaggagatcgagaccagcctggccaacgtgatgagacaccatctctactaaaaaaaaaaattacaaaaattagccagttgtggttgcacatacctgtaatcccagctactggggaggctgaggcaggagaatctcttgagcctgggaggcaaaggttgcaatgagcccgagattgtgccactgcactctagtctgggtgacagagtgggactccatctcaaaaaaaaagaaaaaggcaactcaaacaacaacaaaaaaaccagcctgagctgggcatggtggctcacacctgtaatcccagcactttgggagtctgagatgcgtgaatcacttgaggtcaggagtttgagaccagcctggccaacatagggaaaccccatctctacttgaaaaacatatttatatatatgtatgtatatatttgtgtgtatatatatatatttatatatatgtatatatttgtgtgtgtgtatatatgtatacacacacacacacagaaaaattagccgggcatggtgtcccatgtctgtagtcccagctactcgggatgctgaggcaggagaatctctttaaccagggaggcggaggttgcagtgagctgagattgtgctgctgcacttcagcctgggcaacagagcgagactctgtctcaataaataaataaatacatacataatttctacctctgttgacattctcattttgttgctgaattattttcttaatgttgttcagttgtctatattctcttgtaactcactgagcttccttaagatgattattttgaaatctttgttagcctattcatagatctccatttctttagagttgtgtattacgatttaatttgttcctttagtgtaatgtttcactgatttttcttgtttcttatacttttgcactggtgtctgcacatttgaggaagcagccacccttcccattctttctggacttgtttagacatggaaagagcttaaccaattcactaggctagagattctaggagcctctcaaaccttttctatgaatgtgtcttctctggatttgtgtgggaggattcctaattagatggatttacccctagcacaattcatagagccatgctaatgtcttctgaggcaggacagaatccagcccgaccctggtggttcactgaggccagattgttgggaacatgttccatttctctcctatcacagtggaagaagcatcaggctctgtgccttctctcaatcttgtagagctatgctcaccacagtaagctgcctgccctttttcctttgttcttaattgccctgaaacatccaagctatttcttttctatcagtgtcccatgtgaggtgagatagaaactagcccttcaggcagtgcaccaaaaggctggtacattggaagcattctctactctgtattttcccctgagaaagaaactgtgggccaaagtgatatttttcagtgctgagctgtgatggcttgggggaaggggctaatactagtaaagtgaaattgctccttactcatttcagtagagttttttcagttttgtgtttctctggtgtactgcaacctcttaaaaggattctggtcttctcataaaggtattgtggtctacattgttaagttggtgtttctatgggagaacaagagatggaactttctatttcaccattttgatgatatcagcaagctattatttaaatgagaagtttcctttacttagatgagcaatataatttaatgcaagtttgtctatggatttctccttgagtgactacattacaaaaggccatctggaattccctttctacacatcactgttaaagcaaaaaactatatttaagtggtaccaaggtatcaggattccctgcagacagtttgagatctaatataaaatcaaaaaccccttataggccactggtctaaatgatgacagtaaaaaattcccaagactattaagttttattaatgaatatgatggaaaataagatcttggaatgtgaattaaatgtttttaaggtgatgagtgggtaagaaagagaggtgataaaagtttttgaaaacttgttttcaaagcaatactattacatattaaatatacagtttaaacttttctcatcctgctgacaaatacatacctgagccaagattactgttttgtttcattttaaccattcccctacatggtaatatctatagtgaatgaccatttctggagagttttactttgatatgttagcacatcattacctgttaggtagccccaaaatgtaaataaattatacctcattccatattgtcaaaacatagaaacagcaacaaagatacctaaatgaaagaagctgtgattgtttttcaaaaccaaagaagagaagtgtaagaaaagcattgaatttaaggggcagaaactatcccagaaagttactgctagaattcaaatactaaagaaagtaatagaattatacctttataaagatcaagggtaacaaatttgaattggtaccttttttttttttttttttttttttgagaaggagtttcgctctcgttgcccaggctggagtgcaatggcgcgatcttggctcaccacaacctccatctcccgggctcaagagattctcctccctcagccttctgagtagctgggattacaggcatgtgccaccacgcccagctaattttgtatttttagtagagacagggtttctccatgttagtcaggctggtctcaaactcctgacctcaggtgatccacccacctcggcctcccaaagtgctgggattacaggcgtgagccaccacgcccagcaagtaccattttcattcttaaatttgttcatatgttaaaaaaaaagaaaacataagcatgctttagttttccatcttcacattaggtaacacaatgaatgaatgaatatagttattttctaatactctcacacagattggttcttccatgggtaaatagttctctgtagccctgaattagattttttttttttttttttttccgagacggagttttgctcttgtcaccaaggggggagtgccatagcactcaccatgtctcaccatgttggccaggctagtctcgaactcctgacctcaggtgatccgcccacatcggcctcccaaagtgctgggattataggcatgagccactgcacccagccatgaattagattttgattgatgaaaagggagataataattccaataatcttatgttccataaatgaaattttaaaactgatacatttttatatttaaaaacttcaaaataaatagaaaaatacaactttgagttgtagttttttttagtggtcaatctgatgagcttgggcccgtataaggtatgttggacaagaaaacactatcctaatcaatgttgacttaactgaattcattcagataagtggaaatattgttagatttgttgactggaaggaagtctgagtttgattagtccaaaggtgatttgaggaaaggtggtaagctgaacatgacctcccctgagtattactgaaaggaaggagaatttgaaccaaattttaagatttggccaggaccaaataagatatcattgcagaaaatctgtgctatatgtcaatgacccttcagaaaataaaaagtaaagataaaatggagttggcactccatctctggcctgtgtgtgctgcccccacccccacgcctcccttctgtctctcaagttttgagatcacccctgttaacctcctcttctcttccctggctcagccaatttgtaagctctgatcacatttttttttttttttaccacattctctttgtaccctatcttttgctttcttatagttgcttaatattgtgtaacggaggccaggcacagtggctcatgtctgtaatcccagcactttaggaggccgagtttggcggattacttgaggttaggagttacagaccagcctggccaacatgatgaaaccccatctctactaagaatacaaaaattagcgaggtatattggcacatggctttaatcccagctacttgggaggctgcagcaggagaattgcttgaacccgggagttggaggttgcagtgagccaatatcatgccactggtatattggaagcattctctactctgtcttttcccctaagaaagaaattgcgggccaaagtgtgtaagggaagggttaaaatgagtgagtgagtctctctctctatatgtatatatatatcatataacagtctttttctaattccaaggaatagaggcatgctaaagtttttaaaggtaatatagggttaagaaaatatgaggaagaaatatcacagtggtctcccagccatggctcatcaaaactagaatgttctgactacaacagtggctctggaagtctgacagcacctctgacatattgaccaccctgctggtagtcttcctttaggagcaggtttgtgcttgattccagttgtaacttactaatccttctattcttatgatttgccattatggtgtctcagctactgcatttttatttttctgtctatctaattcttcttttatttccttaacaatgaatgaactctctgttctcctttctatatcagggtatctgcttatttatggtttctactgccatgtggcttttaacatcctctctctcttagcttctgcttctgcctaacatacatatccgtttctgcatgtgtctcattaagttaccccaagaaaaatttggtttgtttggttcagagcagagattttctgctggaaaaatctctcatggcaatctatagatagttttctttggtacgtactcattatctaatctcttatgattggggtcatacgaaaccaaacattgtgacctatatgtaaagtacctctttagcaggagactctaaggtatctcagaagagagtagtacaacagagatattatttacagaatattctgtatattgagcccttacatcaggagacttgaggtactagatgtttacttttactatatatcattgaatcaaagatagtatcaatcataagatattacattaatttatttaccattgagaaaggaaaagatgctgccaatgaaatcacagcacaccaatgattgttagatgcatctcagtctcagagatgttaaaatgtgaaaaaagtacatttttaaaagatgtaatgtggtgtcagtagcatatctgagattgtctgaggatcaaagcaggtatagtgaacccccagagaagttccctgaggactgactcctagagtggggtaaatgctaaaggttacaggttggattactaatctgacagaccagagggtagtgtctagagactagatagccagctatctgtctgcaagtggagaggaggccagtcactggtccagagtgtggtttgcctcagggacttggcagatatcagaaggtagatccaaggagaaggtgaattattcctgtattgatttaaatgacatgaatatattgggaatttctgtttctcttaattcctcatttgtgttctgggatcaattcagttgtgtctcttatcttctagaatatctccttgtttattacttgtacattaactatatctctggatgtagggtcattttataaaccaaatgctgtattttgtccatgaggcacctaaaatagcacagccagggatagctaagcttacagttgtgatacattaatgaataacctctggttgttgactccctttttgttattgggagagttaatgtagcttttttcaaatttttagattcagcgggtacatgtgcaggtttgttgcataggtatattgaatggtgagatttgggcttctagtgtacttgtcactcaaatagtgaccattgtacttaatagatttggagatttctcagagaactaaaaatagacctaccattcagccctgcagtcccactattgggcatctacccaaagggaaagaaatcattctatgaaaaagacacctgtactcatatgtttattgcagtactactcacaatagcaaagtcatggaatcaacctaaatatccatcaacagttgattggataaagaaaatatggtatatgtacaccatggaatactatgcagccataaaaaagataactttaattataattatgaatcaacatgtctttctttccatttctactatgtaaatagagcagaaatcccacattaatgtgattagcatagaagaaagtcctcactgaattccccttgctctcttaccaactggctggacatggcataggtggttatctaagaatactcccatgaatcttcacagcattcagagatcagtttactctgggtttgttagatatgcgatatgggctagctgtttgttagaaccacatttcccaatgtgtttccactgaacacttattttttctgatgttgctacatgtcttgtgtaaaaagcattgggtaaaagtgctgggtaagttaaagggctctgataactctatataatgtatgtagatttctggctgaatctttgggtgtttactgctcatgggttccactgctattacagcccaacacagctggtatgatttgcaggttggtctcttggggccctttcaccttctgagctctgaaagcctaagataagcaatttttcctttgtccttcaagatgactgtggtctcagcttagactcaagagaactcgtttgaaattgaacaagagcaagcctagctcaagaggatagcaaagtgcctagttttatttgtcactgcactagaaacttcctaaggaataatttttaaaagggggccagttttgtttctgagactcaactagactttcactcatgctctgggggaaggaattcaagtctccaacattgtccttattgtacacctgtagggccagactgattatcctaaattttacatagcctaagaatgagcttagatttcaaaataaaaagctttctctgcttttgcgtagaacatttctatctattatttcagttaatttatccttgttatcaatattgaagtaccgcttgctatacatattctagacatgggtaacaatgtctagaagtacactctgatttcacaacagccattcaaggagatatatatatatatatatatatatatatatatatatatatccttgcaagtgcattctagggctgctgggacatgtgttcttaaatcctcctttgccagttctccaaatatgccaaattgttttgaaatggcattcttgtcttgtcttgttgaatctacacttctattccttccttttgctttttattccaaccttccattttctatcctttaattaaaaagatggctaatatatgggagatgttgtagtccgttgttgtctaaaatgaatttagcagacactcccccaccattccccctccccaagttcagcatcaggaataaaagtctcatcagtccttttggcagcatttaagtgaatggcccccagtggctttatgcttgctaatttgagtactctttttacgtacagagctagtcagattgacagaccacactgtacgaagatatatactagtctttgagtcatagattttgtaaataaactgagaacagtggctgaaaatcagattacctgaaagtctggaaggaaaaaggcatagaatgacctcatctagtctcttttcaaaagcactatatatatttcaaattttagagtttctagagacaattagcaggcagtagttgcaagaataggcagaacccctgtgagatgtataagctgtatgatcttcattaacttatatctaaaagtttaacaaacatatactgacattatttttaaaagacaagtatgttaaggaatttgtcttctacatagtgacaggtatcaaagtgaagaatatggccttttgtttttttcttactatatactaaaatgttgctttatattaaaagatcgtaatttatttccatgaatcaaattctgtacttaaaactgacttctgtttatttatatactgttgtgtgatagaaattctcttgggggaggcaatagaaatattacatgccttttaataaagcgggcttttaaaataatttaattcaacttttcacctcttatgaaatttttgaaaagatattttctaatttattttattttattattttttatttttgagacagagtctcactctgttgcccaggctggagtgcagcatcgtgatctcggctcactgcaacttccgcctcctgggttcaagcaattctcctgcctcagcctcccgagtagctgggattactggcatccaccaccaagcccaactaatttttgtctctttagtagagacagggtttcgccatgttggccaggctggtcccaaactcctgacctcaggtgatccacccaccttggcctcccaaagtgctgggattacaagcgtgagccatcgtgtccagccttatttttttttattttaaatagagctctccaaataatgtctgttttgtattgaaatgaatgaattcatgaacttgctttcttcgcagcatgagggactaacagctagaataaaaataatcaacctaatatttcttgttgctggaaaataattatgagaatattacacagaggaagccatgcttaaaataaaggcttcatattgcatttaaaactcaggcgggactttcaaggattctgtttagtagaataatatattgatgaacccttggagaaccaattatgttgtttcacatgaattacaaatgcatcatttagctgtattatagtcttacatgtgtcctttacaattaatcaccattaaatgttagaaatgtaaaatttaagaggcaaagaaagcatacttctttaacaaagtggcccaaacaaataccagtattttaatttgaggtctgtaacaggtctacagattttattttctcattttgcaagatcagtgtatgaatctgagttcttttaatagatttttcttgcaaaatcttattgttaattgcaaatgtaagttgtgacagtaatttttagtataccactttagacttacttctggaatttgagcaacagaaacatattattagaactttttattatttctgtagctatcttttcaaatatttccaaaacgtatggctttttaagcctttgcctctgcaagtcacaatttcaagtaggcgctgaaattctagtaacgtgagcagtgcaacagtacattgagtcttaccagtaagttttagtgaattatttaggaagtgaacgttgattcccttatgagtcagtccagcctctttctgaaaatagtgttgttcccattatgtgtaccattttgcaggaaaatattgtattccaaggaactgggtgttatcagtaattaagtaggcagaacccatagatattgaatagtttaagttgtaaatgtgataaacttctataatacaaatatttgtggacagaaaatgctgtgagatatggaagcacaaagtagaagtagcatttatgaactgttactaagttccagacattttactaagtgctgaggatactgagataaataagaaataatccctttcctcgggaaattataccagtggtagaaatactccaaagggccaacagtgaaggaatcacaatgaattgacatattatgtactaaatagatctgctcacatcctgaggtctccaggcaaggtttacatgcacttgaactgccctgcataattgctattctgctgacaaaagtataggtgtggtatggtagagctcaaaggactctgagaagtcatatagtccaaatccttcattttccagaagaggagaaccaggcccagagagggtgaagggattttctccaggtcatgtagcaaactaacgacagttgggactataatgcagatttcttgatcctcagtccaatctttcaagtggagataacctcaaacctttttgtttccccattctctactttaagcaatggcacaagaagtccatgggaaaatgaaattccctaaatggggaaaagaggaccttgatagaacgctcatgagatcaataaagaaattaaaggacagggtgaaaaaatgtttaaaagtatgtagggagcacatatagaccagaaagaaaattaagaaaatcccagtggcaaaaataagagaattgcaaagaaagggctgaaataattatccaaaaacaattctttttatgggtaaacaggctaaaatgccataggtctaattttatgcattcaacctgcttcagaattttttttcaaactaaatagtcagctatgttaagtagcctcacattaaatggaagaactctctattatttagcacatttgtatagttgcaacgtagtgatgagtgatgtgtctaatgatggccccaagacagtgtaatgccccaatgtaccttttgagctattgaaaaatatttctattatgttcagcctagttttatttttaactatatttaatattcaaaatcttggaaatgggagctatgtttataatatctctggcaattatctataaatacatctaagttgatcgcagcacttcatatcttagataggctgtatagtagagactttactgtaacgagaaagatcctgaattgttaccctacttgtcttcccagatgttttctttgttaggctttttgggatttctgatttttcttgctctttttcttataaaatgtgaaatatatagcctgtgataatgcttggctgccctgcccaattattgaccaatgtcgatccaattatgcttttaaaagtatatattatgtaaatagattattttaccttctgctgccttataaatctttttttgtacagcagcaagggaagattataatgtcattggctgtcaaaatgcccttttcatgtaagtcagctgccaggcaaggatcctacatctgttttctagcatccatataaatgtctgtgataaataagtcattgctcactggagctgcctttgtgaagcagatcctgtacttactgtttctttcacatgcaaaatgacagcagtcaacctaattgactattacttggtcagtttctgtgtcagaagtgatgccaggtaagtaggagaaatccaaacttaatgcatttctgtttaaacccagaaagatttagtaatagaaaaaacagcaccaatttcaggtttttcagagatgagtgtgttcccaaaggatgaacttgacactactgcattctttctcacaacctaaactggattcttctatgaatctctgagtgaattcttagtagacacattgacatggtataaaatacatcacacggctgtaataaacataggttagaattgtggttcagttttcagccaaatgccaggataccattttcatatgtagtctttcctaattggaaatctagaggatggggtacaaaatagtcatcctaatctgttcaaacatcaatggacaattatgtctctaaaattctcaatactttgcaattaaagagtttttgattcctacattgcagagcaggcctcttcttctgtgactgatgctgccctctcttttctatgtcatctctgctttggaatcatcatcattacggggcatgataccagtcatgttaggccatgctgctgacaatggttactttcaacaagggggagtaaccagggaaaggacatccatcattatgtaatgtaggggaaaaaacccaaagactcagaagccatgttaacaaacacagctggaagcaaggaggcatttgagtaggattacaaacatcttagattgtgcagattagtactagatttagggaaaacatgaattgaacaacctcttttgcacaaatgagcaacctggagtttgcagtaatggagccaatagcctcatcacattttgaatccatttggatgtcatgtaaagaatgaacatatgcagtacttaataaagaaaggtcaattctgccatggtgatcactgaagcataatgcagcaaatgaggtagggcttttttttttttttaactcatcaatcctagaacatttaaatttatcttttcagtaagttgagggatttttttaaatctcctgcatctgttataacctaaatgaacagcagttcaaagccaactccacacctgtactgacatactaaaaatgtcaaataatttgtataaaaatgctgagatgcagtttcactaacagtctgttttgtcagtgtcctccctatttatcagattctaagaggattgttgggttgatgtggctctgtatatttccaattccctcctatttttggattgtactgctttgattatagttaacaaccaaccttgcaagaattcaagatttgtcatagctacaatactttttccacctcatagctttaacagtggcatttgtatgttacccaaaccaaaccactgagttcatcattttcatccaaagaagagtagcttccttgattttcagcataatgtttctggctatctagtgcctttttttttttttttttttttttttttttgagatggagtctcattctgtcgcccaggctggagtgcaatggcgccatcttggctcactgcaacctctgcctcccaggttcaagcaattctcctgtctcagcctccagggtagctgagactacaggcgcacgccatgaagcccggctaatttttgcattttttagtagagatggggtttcaccatattggtcaggctggtctggaactcctgacctcaggtgatccgcccaccttggcccccgaaagtgctgggattagaggcgtcagccaccatgcccagcccttttttttttttttttttttcagatggtaaactaaaaggaaataaaattgtaacctcagctggtgccataattctttcttggcttatagtttctgaaaggtgttgaaacgattacatatttatccatgagttccaaaattgcccctctaattcaagtcattagaaccttcttccacctacaactcatttgaactgtttttcattaaaagtcatgtccaagagtcagttcgagtgtcacgttatttggtcattccagctttcctcctgagtcttgtaaccctgactatcattagtgctgtatatagttctgtccacttgtctccttttcttatccagtagttcttggagggcatcaactatgctatctttgttgttttcacattgcttatacattgtggagattgaatacatttttgatttttaacaaacgttcaatgtgctcttactaaagcttggcaatgacctagatcaggggtttgccaactatggtcagtgggccaaatccagcccatggactagagctaaaatgttgtttatatctttaaagagttgtaaaaacaaagaagaatatacagcagacaccatatgtggcccacaaaggctaaaatatttgccatctggcccttcacaaggaaaatgttgctggcctttcttccagatgctgaggatacaccagtgaacaaaaccgacaaaaaaaaaaaaaaaaaaaaaaaaatccctaccttcagagagcataaattctatttttttacaacaattttatgcagaatacgcatcttatttttgtaaatatgcacaatatttacatatagtacatactcaatatttgtgaaatgaatgaataagtcatagagtccatcatccaatattatataatattggcaaatatttccatatgatgtaataaaatgttgcattttttaaatctttatatgaagaatttttccctagataatttttagaccaaaaactcaaacactacttacttgtcaagacattttattctggtacttagtaatgatttcccatcttaatgtaacttttattcatgatgaggtcctgattatctagcctccttatgagaggtaatcataattatatttgattctgaaagctttctgaaatggtgattctttcataagagatcattttgtatacgtgacagttaaaacaatgagttagtttttcagagtttctatccttgaattctacaagtttgtgatgtttatagcttgaattcagataaaaccattttgctccacatttgaaacgacaaatcttttgcattagactcagagttgactaaaactatggcagcttttcataaagtcaggctatagatgtccctaattcccccacagagcccacagccctttgaaagtgatgatagaatactggggatggatcagagagtgctgagaggagagtggaagggaagaagggacaaagggaaaggaatccagagtgggaagagttggattcgtagagccagcagatggtgttggtgataaagaagattacgtgactcatttctgtaacccatgagtgtcaaagttctccactcagtgccatgtctccatcccattacccccacctaaataagttatctgttctaacacccatctgtccccacaccaaaccatcattaccagcaagcaatttcttgtactgtcctttatcttttaaatattaaaaattagaagtaaatgagatgtgagatctaaaaaaaaaatgacatgaccttttatttatttccactggtcttttaatctaggctgcccttactcctcatagactatacactgcctcttagatactacactgctattagtctaaatactttgctttattatggaactgctcatttcttattccttgcatagatttagggttgataaactgagagtttaaaatgcagtaatggagaatcttaattataaatgaaggaaattgaaacatactactgtatgtgctgatttactttcagattcttgacctttgtcaagactaatgagattacacatctagtatagagaatggatagaaattttaatagacctgcctaatttacattgttaggaattctgtaaaactgagagttatgccagcaaacctacatgtgctgtctttttaattgcatttctccccaccaccagcccaccctcattccctaatatctgtggttagtacctatggagtcattacttacattatgaagtgacaaacataggaaagcatggctttgttctctgaatgcagataactcatatccatcaaagtttctaatttacagagctttcctttgaaggaggctagaatgctgagtaatgatgaaaaagcaacatttgttaaatctgatttggcgcaggacttctttttctacaaagcagtctttcataataccagcttgaatctaactatttctcttacgtagtatagggggaaagaaatatcttttcttcccatcttagattcatagctaggaccccttaacaacaacaataacaacaacaacaaaaaaaaaacagattacccgactaccaagagaaaagcatacaaagttatttatttatttatttatttatttatttatttatttatttattattttttgagatggagtctcgctctgtcgccgaggctggagtgcagtggtgcgatcttggctcactgcaacctccgcctcccaggttcaagcaattctcctgcctcagcctcctgagtagctgggattacagatgtgcaccaccatgcctggctaatttttgtatttttagtagagatggagtttcaccgtgttgacgaggctggtgttgaactcctgacctcaggtgatccacccaccttggcctcccaaagtgctgggattacaggcgtaagccactgtgcccagcccaaatttatttaatatacgtaaattttatgtgacacaggaaatttaattaggaaataaagacccaaagaaacaggaaaacctgtgtgttcttttttttttttttttaaattggcattcatgttgctttttttttttttttttttttttttttactattaggaacttttattattattatactttaagttttagggtacatgtgcacattgtgcaggttagttacatatgtatacatgtgccatgctggtgtgctgcacccattaactcgtcatttagcattaggtgtatctcctaatgctatccctccccactccccccaccccacaacagtccccagagtgtgatgttccccttcctgtgtccatgtgttctcgttgttcaattcccatctatgagtgagaacatgtggtgtttggttttttgtccttacgatagtttactgagaatgattatttccaatttcatccatgtccctaaaaaggacatgaactcatcattttttatggctgcatagtattccatggtgtatatgtgccacattttcttaatccagtctatcattgttagacatttgggttggttccaagtctttgctattgtgaatagtgccgcaataaacatacgtgtgcatgtgtctttatagcagcatgatttatagtcctttgggtatatacccagtaatgggttggctggatcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcaccattctaactggtgtgagatggtatctcattatggttttgatttgcatttctctgatggccagtgatgatgagcattttttcatgtgtcttttggctgcataaatgtcttcttttgagaagtgtctgttcatatcctttgcccactttttgatggtgttgtttgtttttttcttgtaaatttgtttgagttcattgtagattctggatattagccctttgtcagatgagtagattgcgaaaattttctcccattctgtaggttgcctgttcactctgaaggtggtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtttaaggtgtaaggaagggatgcagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattggtctatatctctgttttggtaccagtaccatgctgttttggttactgtagccttgtagtatagtttgaagtcaggtagcgtgatgcctccagctttgttcttttggcttaggattgtcttggcaatgtgggctcttttttggttccatatgaactttaaagtagttttttccaattctgtgaagaaagtcattggtagcttgatggggatggcattgaatctataaattaccttgggaagtatggccattttcacggtattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactgctgaagttgtttatcagcttgaggagattttgtgctgagacaatggggttttctagatatacaatcatgtcatctgcaaacagggacaacttgacttcctcttttcctaattgaataccctttatttccttctcctgcctaattgccctggccagaacttccaagactatgttgaataggagtggtgagagagggcatccctgtcttgtgccagttttcaaagggaatgcttccagtttttgcccatttagtatgatattggctgtgggtttgtcatagatagctcttattattttgaaatatgtcccatcaatacctaatttattgagagtttttagcatgaaaggttgttgaattttgtcaaaggccttttctgcatctattgagataatcatgtggtttttgtctttgactctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggattttggtctaaaattctcttttttggttgtgtctctgccaggctttggtatcaggacgatgctggcctcataaaatcagttagggaggattccctctttttctattgattggaatagtttcagaaggaatggtaccagttcctccttgtacctctggtagaattcggctgtgaatccatctggtcctggactctttttggttggtaagctattgattattgccacaatttcagagactcttattggtctactcagagattcaacttcttcctggtttagtcttgggagggtgtatatgtcaaggaatttatccatttcttcaagattttctagtttatttgcgtagaggtgtttgtagtattctctgatggtagtttgtatttctgtgggatcggtggtgatatcccctttatcattttttattgcgtctatttgattcttctctcttttcttctttattagtcttgctagtggtctatcaattttgttgatccttttaaaaaaccagctcctggattcattaattttttgaagggtttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgatgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagggctttacttccaagtatgtggtcaattttggaataggtgtggtgtggtgctgaaaaaaatgtatattctgttgatttggggtggacagttctgtagatgtctattaggtctgcttggtgcagagctgagttcaattcctgggtatccttgttgactttctgtctcgttgatctgtctaatgttgacagtggggtgttaaagtctcccattattaatgtgtgggattctaagtctctttgtaggtcactcaggacttgctttatgaatctgggtgctcctgtattgggtgcatatatatttaggatagttagctcttcttattgaattgatccctttaccattatgtaatggccttctttgtctcttttgatctttgttggtttaaagtctgttttatcagagactaggattgcaacccctgccttttgttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacatttaaagttaatagtgttatgtgtgaatttgatcctctcattatgatgttagctggttattttgctcgttagttgatgcagtttcttcctagtctcgatggtctttacattttagcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtatggtttctgccgagagatccgctgttagtctgatgggcttccctttgagggtaacccgacctttctctctggctgcccttaacattttttccttcatttcaactttggtgaatctgacaattatgtgtcttggagttgctcttctctaggagaatctttgtggcgttctctgtatttcctgaatctgaacgttggcctgccttgctagattggggaaattctcctggataatatcctgcagagtgttttccaacttggttccattctccccatcactttcaggtacaccaatcagacgtagatttggtcttttcacatagtcccatatttcttggaggctttgctcgtttctttttattcttttttctctaaactttccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggtttttctagttatacattcttctaaatttttttcaaagttttcaacttctttgcctttggtttgaatatcctcccgtagctcagagtaatttgatcgtctgaagccttcttctctcagcttgtcaaagtcattctccgtccagctttgttccgttgctggtgaggagctgcgttcctttggaggaggagaggcgctctgatttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgcagtgtgtggtgtcagtgtgcccctgctggagggtgcctcccagttaggctgctcgggggtcagaggtcagggacccacttgaggaggcagcctgcccgttctcagatctccagctgcatgttgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggtgggcgcccctcccccagcctcgctgctgccttgcagtttgatctcagactgctgtgctagcaatcagcgagattccgtgggcgtaggaccctccgagccaggtgcgggatataatctcgtggtgcaccgttttttaagcccgtcggaaaagcgcagtattcgggtgggagtgatccgattttccaggtgccgtccgtcacccctttctttgaccaggaaagggaactccctgaccccttgcgcttcctgagtgaggcaatgcctcgccctgcttcggcttgcgcacggtgcgcgcacccactgtcctgcgcccactgtctggcactccctagtgagatgaacccggtacctcagatggaaatgcagaaatcacctgtcttctgcgtcgctcacgctgggagctgtagaccagagctgttcctattcagccatcttggctcaggaacccaaacctgtgtattcttatgcttaggtttgatgaagaagtggagggtagtggagaaatatgactggacaaaggggatatgatctaataataataaagtgtgggggacttaacaaggcctgtgttttctgattcttttctgtgtccttgtatcttcagagataaggatgttcctttcctctgaatgtggggtttgggggtacctctggaatgaaggttttatggcctgcttcaagagagaagggcaaggggaaggtgagagtgaccttgcttctgctattttatcaaatgccaaggtgacatactgttggtagcgggtcttgaaccccatcagtagcaaaacaagggacttctcactctgaaaagctggtagattagtgaattctacatctgaaggattatactcataataataaacatataaaataagccataaggccgggcaccgtggctcatgcctgtaatcctagcacaccgggaggcggaggcgggcggatcatgaggtcaggagttcgagatcagcctggccagtatggtgaaaccccatctctactaaaaatacaaaaattagctgggtgtggtggcacacgcctactgtagtcccagctactcaagaggctgaggcaggagaatcgctggaacccggaaggtggaggttgcagtgagccgagatcgcgccactgcattccagcctcagcgacagagcgagacaccatctcaaaaaaaataataaataaaaaaaaagccataaggccatgaatgtactccatcaataggtatttactgaagaaatactatgtgcttagtactgtgggaaatataaatgtagaaagcttgctctgtttacttgggtaatcaagacttataaaaaataaaagaattatatgcaaaaacaaatatgtaccaaaatgatgttctataggtttcatatatcctagaattttcaaaataatcaaaattcattatcacatcacatgtttacatttttagtgcaaaaaataggctctgtggcaataggacctcagagaaggacaagatcactatagtttgtgatactccaaaaagtcttcacagaggaggcaacgcagcttgtttatcctacagatattgtgtcatctcttttcagataattgtctgattatacctgtggctatttccccctgaatttcttactagttggtttttggttttgtttctgtttttcaggataaggtcttgctctgttgtccaggctggagggcagtggtgcagtcatggttcactgcaaccttggctcaagtgatcctcctgcctcagcctcctgagtagctgggactacaggcatgcgccactgtatctggcctgtttttttcttttatcttcttttttactcattcataataatgcagaattagaagcaatcccatgtctttgttttatctttatcgaggtataattggcaaattatgtatattcaaggtgtacagcatgatatttttatatgcatatacattgtggaatgatttctacaatcaagctaattaacctgtcacctcacatagtgatggagtccatagtgatggacctcacaggtttttttcgagttaatttttgcattgcttcaacactgcttctaccagagtccccattcaaacacatatcactatggtagttcacagtaacatggaagaaatcattacagagcatttgaactggataattttatttattcattgtggtcagacagcaagtctaattctgttgtcatttttatacaggtgatggtttaagaaaaaaaattatttacagacctcaacagcctatctcgatttctgtatttttcttatcaatgaaataataaagatgagcgcttcaaactatgcctctcacaactttcacaaagcatggcaataatctataatttatgtcactctcacctgtaaggctgagaatcattgacagaacctaaagggagggaaaaaagtcatctttctagataaagtgatgatagtttttcccagcttttaaaaaaatatatgcaaggaatttgtggtgaaatacaatagcattttaataaattgttattaacttgtattactaataaaaatttaagcctattgatctcacctgagaagcttaaaacattgaccagctaaggctttagtcacacatattcttagagtttctgagaaaccaatagcttttatgattttaaaaaatctatttacaaacatcatcttcacattcctctagccctgctttttttaaaggaaaccctacaggcaaaaatgcaatttttccaaagttggacatatggctgatgtcagaaccagcaaaatcatgttatacaaagccaaacgctgagttaaacctcccaatgctgatgttcatcagaccccagaataggtgtctgttacaggatgagcaagatgttagtcatagaagtagaactctgtggagatataactactcacctgcaaaatcaggtggctctgaaaatgaatagcactgtagcgttgggccaattcctgctgcccttggcactgggaatgcaatcttgtatggcaaatcaaatgagcagaaggcttggggccagaatactatcaagctcttctcaaactttaaatggatgagaagtcctgctcactgccatggaacatggcatggattttaagtgcctagtaggccattttattttgttctgttctttcttatttttggtaagcagagctggcagtatgagataaacttacataaacagtgagttcttgatttttatatttctcatatagatccaaaatcagcagcttcatttacacgtagctgtaaaactagaggagataaagtaatagcgtaggattatgttgaaaaatcaggatggggaagaatccccagaagagcttgacattttattaatccctactgaaaaacatgttccaaaatttttaaaaatgtccttctaatagcatatatatatgtatgtatgtgtgtgtatgtgtgtatatatatatatgtgtgtgtatatatatgtttgtgtgtgtatatatatatgtgtgtatatatatatatagttttttccatctagttttctctcagtagtgtctatttaatctagaaagcttctcaagccatgaacttctctatggattagattctgtgtattagagcgcaagtgagtatagctttagtccttgaatgagcagggaaactcctcaatgagaaaatatgggattttccaagaaattcctccagggcccttcctattcttaatcttttctctgtagctgaggataatagctgcataccttctagctcccccaattctagaaacaagaataataaagccttgacaatccatgagaagactttaatctgccctcaggattcccgattccagctcagtttctaatgttcctggatggtgactcatatctcaaaggcaattttggatttaaaatggttttccaaatctacataaagaatttctggattgtttgctgttttaaattagccaaaccaccctttctctctaacagcctgtataattgagagttggctatacattgtttgatacctgtaaaaagtaattgaacattctgaatagtgtattttgatgactgcaatttcaggtgcccaagcttgaccaggttgcttcgtttttgctcacagtggtattcagatatgcccctatttaaacaacccaataaatgaaaataatattttacaagattgataaatgaaggtgatttttttcccctcagagatctcttacttttaaaagagattcattgtattgttagtcatgtcctccgttgcattgaaaacatctgtttcaaaaaaaattcacatttatgggttattttcctcaaattattattttcctcatattgtaagtcacctggatctacaaaaataggctaaaagacagttattaccacgtgtcatattcaccagttctctcttttctttaaaaatgcttagatgtctttaaaatggtttttaagtgtttaaaggaatagtagtccatgcatagccctcagtatacctaagaagatgaagtatacttgtgactctgattgataagaatgcctgtaattttcaacagaggttactgtttcagtggtggcccagatatccatctgtcagtctttgtcaaatagcttatttgttatttttctgtagtctcttaaactgttattttttatttatttttattttttatttttattttttttgagatggagtctcactctgtcacccaggctggagtgcagtggcgcgatctcggctcacctcctccccccagggtcaagcgattctcctgcctcagcctcccgagtagctggcattacaggcgcgctgtaatttttgtacttttagtagagacgggttttcaccatcttggccaggctggtcttgaactcctgacctcatgatccacccgcctcggcctcccaaagtgctgggattacaggcgtgagccacagcgtctggccccttaaactgtttttgttctttccatacattcattccctacccccctgctttttcccaatgttccattctaaaagtgaataaaaaaattcacctaccaaatctggataacaagaatgttatttcattttactttaatctttgctattcttagaccttcttttcttcttcatcttttccaattgaaataaaaaagatttttgatgtatgtacaggctatgtttttttaaaagaactgttaaaattgtgcaacttcaaagcgtttccaaatgttgcattttcaaaaatgttttatcatatttttctttaaatttcctgttgctgtgtagtctcaatgatggctgaaggcactgaattttacattctatattgctttttgtgttccacatctagttagtagttataacttctcccacacaataacagtgcttttgtggaaataattactcaaagatgatttatttctaatgattttttcatatcatgattttaaaatatcttctaatttccacttacataaatgttttccttctctatttagatagaacacagatacatgttgattacatcctaatctatccttcatctacttcccagaaagatttcaggtggtttttgcaacaaaggcccattaaagttaaattaaaagttagagggaaacttttacacaattattccaaatatgtaaattaaggctagttactattattgagcattaaatttagctctgagcttactggaagccaatacagaaaagaaaacatgttatgttttataattcttattatctgacgaaacacagacagtttaaaatggaagacgaagtacaacattgtctttggtaatagttttagagatgatccaagaacgttcttcatgatcacttgtttcatcaacgaaccactttcatactgcctttgtgttcatttatgaaacacaattaaatattgctgttttggtctaaatgtgtctccccagaatttgtatgttgaagtctaccctccattgtgattgtattagaaggtggggcctttgggagttgattaggtcatgaaggctctgccctcatgaatggaattagtgcccttacagaagaggcctgagggagcttgtttgccccttccaccatgtgagggcacagtgagaaggtgcagtctatgaggaagcagtccctcaccagacactgctggcaccatgatattattagacgtcccagctgccagaactgtgagaaataaatttccgttgtttacaagttacccagtctatggtattttgttatagcattccaaatgaactagacaattgcatttatggaatacaatttgcaacacattgtacaaaatgatgtatattctggaatgagtcctcttcccactccttactcccctttccttacatacacattccttgcctttcctcacccccaacaatagttctgggacaggaagattttcatttacttctaaggaggtataaaatcttgatatggtttggctgcccacatctcatcttgatttgtagttcccataatctccatgtgtggtgggagggacccagtgggaggtaattgaatcatggcggtggtttcctccatgctattctcaggatagtatgttctcaggagatctgatggttttataagaggcttcccccttggctctgttctcattctctctcctgctgccctttgaagaggtgccttagccacaattgtaagtctcctgaggcctccccagccttggggaactgtgaatcaattaaacctcttttctttataaattacccagtcttgggtatttcttcaaagcagcataggaatggactaatacaaatcttaattcttcttgtaaacatttattgaacaccaactttgtgcatctttctcttttcaaattataaattatttcaaatgtacagaaaatgttatccctagaactcttaccaaacagactttatagaagtttgtgattagtaactatctgccaatagaagtcatttgcacataggtcctagaatcatagaattttaaaggtgaaaatgaggttaaagaacattcgctaactccttccttttacataaacattaaggacttatataggttcttatacctagttagtagaaaagttgatgacagaacttacgtcctctagtactttttctactataccataatatagatttgctggattatatatacattcaaactgtgcttctattcctgtatgtgataaacccaagcctcgtgtgatcttgttactctctatacagaacttacatccttgattagtatgtagactatcagtttgtttatttttttaagagatggggtctcgctatgttgcccagcctggtctcaaacttctggactcaagcagtctgcctgcctggtcctcccacagtgctgggattataagcgtgagccaccacacatctggcccagactttcaagtttcatagtgaaagtgtctggcagattaatgagttgttgatgcattcagtcaagaaatacttctgaactatgaggttcataatttgaggtttatctggttaaaatcatgactgctttcattagtgctttaattagttgaattctgtatttcagagaggcaaaactaggaactgcattttactgataaaattgagttatactatgccttttaggcaaatggaaccctcatttttttttgtccttatggtcattattaatattttgtttgttcttatttttgcttggagaaggagaactatcattgcattactgcaaacagtatatttatttacctcctgcccatgaacacttctttccctatttggagaaataagatactgtttgttcacagacctccctagtggtctgtctgttaagcagcggcagtcctgaactaagggcacaagaaaatggagctggtaatcacaagcaaataatgcaagacttttaacactttacatgacagattcaggtggggcttgcctactttattatccaaggtgttgctatttcctttcatgcctttggagatcccagaagaaggggagctagctgagtcaaacctctgtctcacagggctttcatgaacaatgacaattcatttcagcctagaggcaaagagggtgccttttcttacgagacttttgttcttattgcctggtgaatttttaaatcaaattggtggaaaattggaatgttttcctctcttttgtccttttgcatctccatacctccctccctcccagtatttttgagaccagatagaagcagatagactcatgggggattcctttgtccctaactcctatctagagtacttccttttcctaatatatatagaaatgatttgaaagaattctaactaacctcagatatggagataatgaccacgattaaatggactgaacatctcattcttatcaattccaattcataatcctattttatttaagtggttatctttgtcctttggaattccaatcagccaaaggatgccagtactgttaataataccgtatgccaagggaaattatttcctctgcttccacgactaccagggttcactttgtggaagctgtgtgataacataatccctcttacccaccacctcttttgggcaatatttgaaaaatgaaaaagggaaaagagctgggggagaaatcattcaagtaaatttacgatagtttcaaaaccagatttgctcattaaaaatagtacttgaaatagatagcagctgtggtttccattttgtaatttttttatgatctatttcatttctgttttctaagctacttaaaactgttgtaagctattgataatataattttccccaaattatttggctcctcatttcattttccctgctgtgttttataaaatttcatatcagaaataagaattaactagatatttttgaaatcatgagtaatttttattcactgtagaattagatttcttttaagaaaaagaaagctagtacagtaaaaatcagcatttcagatgtgggtggcaagaattaactagattttagagtaaaccgtagaatagtaccctcctctttgctccttaccatactttgttttctgagcatttatcaccacccgtcatgtatttatttgttcatcatttgtcttctgctccccactgaaatgtaacctccatgagagaagatgctttaactcctctagttacccaaagactctccagtgcctagaacagtgtttggcaaatatttatagtagttgctcaatatttgttgtattagtgattagcctgcatgagctatctggcttgcccatttcaagtgctgtgatgaatattctatgccggagaaatcatcctccagactggatcgttaccattatcttcatttggcattttattaccaacaagatagtaccccaggtaccatagtaaaaatgacttaagtgctttccatgtccatgtgcctttatattttacttaacaacatatattcttcacattgacatacattcattcagtaaatatttgttgaaaacttacaatgagtcagacacttacttgcccagaaatagaggcatagataagatattgcacctttactgtaactctactagaacacaaccctagaaaaaattcagaatctgtcatctccatagttgtggatttctctacaaagttgaaatttattgttgtttttgtgacaacaacatacgtttcctgatttttctgataccttttgattcatcctcatcattgatgtttctttttctccttgtacattaaatgcttttgttcaccaaggttcaaccctcacactctacacaagaatctttctgtgtgatttcacccactctcatatttttaactgtctatatgcaaatcatttctaactccgtagctatagcctacagttcttcctggaacttaaggcttgcataatgaaatgcctgctggacaattctacctagatgttcaataggcaccttcagttcatgtcaaaatcttaactctgctttttcttctaaaatctattccgtttttgattctttgtaggcggcaccaccatccagctactcactctagcagggaactgggtgtgaaccttgattcttccttctctataaatctccacatctcacaatctctgtatcctgcccgttttccttcctaaatatttcttgaatgtgtcacctctgtggcttcctaactaccattgtcctattcccatgttttaccaactgttgctgagacaactgcagcaatcttctaaatggcattccagcttccagtcttgtcccccttcaaatccctgcattcttttataattttgcccactgtgtccccctgcctggactgccctcccttgttcttttcattggatgaactcctgctcatccttttaaaactcaattcggccccatcaccggggggctatgaatatactttctcagttcttgcatggtgctttcagcatgttgttcccactgaattcccacactgctttgtctttgtttctttacctgcctgtctttcctattagatagtgagctcattgggagcatgtcttatttatctttgtagatccggcattaagcatgtcattgggaacttaataggcccttcagacatttttgaataaatgagtagatgaatgaacaaaagaacaaacagcaaacaaagggtagccttgaggtacagtataagtatatcaaagaatacaatattcttttactttagatatcaaccttataatttattaggagaaataaaaacacaaaagggcagtaatataccagcccacatgtagtctcatattccagtacagttttatctgactttgcctttttgatactgatgacacagggagcatctggggctagataaactgctcatgctctgaactatatgttgaatattttgatagaaactctttttgcctgtggcttatttgtcatatgccgcttgagtgtgaacttaatttgcatgactgcaataaatgaaaagtgtttcttatttcctactttgagtacataaatttgaccttgatcaatgtcagcaaaccaggcctctggcaaccacttcacaattttgactatccagagaagttcatcatcatctttagacaactttaccctggaatggcaggtttagttagtatcagtggagtcttgtcagacgtgtttcctaacaaaaatgacctcaagcaggagtgtgtggttttctctgagaaagcttttcttcccctgagcagatcatagcctccacaaatgtctttgaaacaggcatgcaaagattgctctatacagaagattgtgacaccgaacatgaggttgcttcgaatggttatcctaaagtgacctgccaaactgaagggcaaaaatgccactgctcttgaagtcttaaaatagtatctcttcttgttgaatccatgggaatagaaaaaagaaattgtggtcaggccatatgagaaggaatgccaaaaaaaaaaaaaaaagtcaccaaatccatttagcacttggtaacaaaaggtaagaatagacattgaatactgtactatttttagtatccattccagcatagtgctaagtatgtcttgcctccaaagtgtgttactccttctaccttctccatctctaacagtaataagcccagtcacctaagttcaaactctgagtcaactttgactcaagcttctcattgattccctagaaccattggttaccaatttagatttcattatctcttgaaactgttgtacctccaagtactctaaaattctcttatttgaacatgtccacttccttccacctttcctagtccacacccactctgcttctgcttttccgtttggtattctacaagcctttttcccattcaacttttccatctatctcatttctgtccctacccaactatgactctgctgtccaacatgtcagtacgtactcaaaagcactcctcattcattctctacccaattctcagctgctcctagccccaaccctgcaaataaccattgtccattttctcctctactgttcccggactaattaatgctggtaggcaacgacatataatagtagcatgttgatcaggcccactgcaagcgaaagaaaaattctaaattcattagttagaattttgaaaacaaaacatctgtcctaatacatctacttggttctgaaaaactgtgattactgtagttattgagaggtttctgtaacccaaatacttaactgggtcgtacatgaaaattatttttaagattaaaagtagagcatatattgtactgacagaattttctttaggatttacatgagtctaatctgatagaatggaggaatgtaattgaaaactaggaagagaaatctaggcatggaacttcatcatccaaacatttttttccctgattaaaagcaacatatcagcgtgtgtttttcaaatacaggcagtccctatcttacaaatggctgtagacagatgtagggcatattattgtttgaatcctgattacccaagtgggaaaactttgctttagatgtcagttgtttggaatccagaaagcattttcctaccaaggcagtgttataaatggtggttgggctcccctaggatagccaataatgttactgaaatactatacatttgcagtgaaacagtagtgaacacatttatcatatactactaattaaacaaaagcaataacgttgaataagatcattttatattttgggcttcaatggtggtgcttgaggaaaaacaggtttaattataagaggatgaaaaagtagatggagactgtgtgaaatctcaaaatagggctcatgagcatttttgaagacttcaaatgacacgtgttctttatcaagtctaactgattttaaaacttgtgaacttttacttccctttttgtggttctaagtgttttgtagtacaactgttgtgctatgattctggtcagtttttgactagtgatgaaaataaaacaagggaagaggataaaggaagaggatatggtgccagaggaaaattttgagaagagggggcttatatgcaaatatgaggattaaaaaaacaactttatactttagcaccacaagcattccacaagcaccagcaaccaaaggaaaaggagttctttcttgcttagttcttaggccatcctatataaatgtcctaaatagagataaaagttgcaataagttaaagaggctaagttgagccacactataaggagatgatatgtaaaccgcaaagcttgcatgagctgaggtaggaagagagttatttatttgcttttgttgttgttatttgtttttttgtcttcagttgtgtcttaatctgtttagtgttgctataaaggaatacctgaggctgggtaatttataacgaaaggagatttatttggtttacggttctgcagactgcacaggaagcacagtgccagcgtctgcttctggtgagggctttaggttaattccatttatggcagaaggagaaggggagctggcatgtgcagagaccaaatgacaagaaagagagagggaagggagcttacaggtttttgtttttgtttttaaacaaccagctttctcaggaactaatggagcaagaactcactcattaccacaaggaggacatcaagtcattcatgagggatccacctccatgacccaaattcctcccatcgggccccacttccaacattggggatcaaatttcaacatgaggtttgggggataaacattcgaactatggaaagttgtatggactatatcttggaagacggaaggatatgttggaagtgtgctaccttctaagtgtcaaaggttgagtcagagaaacatagagaaaaaaaggccaaggtgggcagatcacaaggtcaggagaccagcttggccaacatggtgaaaccccatctctacaaaaatatatatatatatgctggacatggtggcacgtgtctgtaatctcagctactcaggagactgaggcaggataatcgcttgaatccgggaggcggaggttgcagtgagctgagatggcgccactgcactccagcctgggtgaaagagcaagacactgtatcaaaaaaaaaaaaagattttagttctgttgcacattataaatggaatcctcctttgatatccttggaaaggatttggtaactacttatattgtttttcagtcatgttttgtattcacattcatttttacttggatatgactctgtactggtagggaactatgaggcaacttggctttattcaagttatataggtgtgatagatttcccaagatcacattaattgagctgtcagtgggggacaaaagagtatgattactctaaagaggaagaatagaggaggtagaagaagacagatatagagccacatagttaattctctttgctgtttaccagctgatgaaccaacaattattcaacaattttttactgtgctgtgttctaggcaatgtgctaagtgcttagagatgcagtggcaaagtacttggaatacagtagtacacatgatattacatctgccctcatatgttttacagataaggggacggtacagataagtagataaggaattataatgaattatgttaagtgctaatgtggaggtactgttgggtattaagggcatatatagaaaaatcacctaaatctgactttcagaattagcacacatcctagagcattctaaactgatatagaaagatgtgtcagagtgaaacaggaaaacagaagttaggcaagaggcaaatattcctgaaagaagaaataatgtttaagattcaatcatacaacaagaagcctagagagagtactgggaaaaaaaaatagccaaagagagatttctacttctgaaaattgtatagtaacttgtggcagaacaatgctctgccaagaatatctacataagccagataacagacaaaaagtctgtttgaaggcattggaaagtagccaagacagccagggcttgagaagttaaaatctcaagcaaggaaaactacagagaaatgaggcatatttccttttggggcatttgccaattcttacagcatgatacagagaagtcaccagaagttccagctatcttataggcttagagagagaggaaaacattgagggctgtcaaggcagtcagtactgaagggggccaaaatcctgaagagagtggatgagtagagaaatgaacttgcactcagtagttttaacctccaggcatttgccaaatccttaagctgttcatgggatgaaaaagcctaacccgtcaagcagtaagtgactgaaaagcagagtggagctttcccactcatagtataaaagaaatagaaaataatgttcagggccctccacagaggagcagccccaagaaacaccccagcatttcatttgggactcttaaagaacctaccctttaggaattggtatgaactaaatatagactgaacttttgaaagactgcaacttcacctatttgttcgttgattccttgattagattaaggtgatctacctctactccagctgcctataaatgatagagagaaccctctctggaggaaaatatcatctagtggctccaagatttctgcaaacaaaatgtctatatttaatcatgcattaattggcttatgaagaaactgaaccaagggaaaaatcagacaatagaaatagacctaccaatgagtcagctgttgacattctcatagacttttaaattagcatgattttttaaattactatgattaataagtttgagaaaatagatgacagtattgagaatctctccaaggaactggaatccattaaaaaataataaagaggtaggaggacagtgacaattagtgaaaactgtttcaataaggaaagagtagctgatactgacttatactacagtgaggtcctttggatatagtaacaaggagcacaggtactaagaagtcctttgggtttcataggtagatcgttggtgagtgcaggttcagtggagtggtgggtaaagaggccatgatggtgataaggtcagatttgaggtgagtagggaaggtgactatggaaacatgaaaggtatgatgggcttaaaattttggtccattaatttgtagtgtcataaatctattatatacgactctttaattttctctagaaacactcatcgacttgattagaaataatagagataggttgtattgttctccttccgtcttccccctttcccattccttcctctcccttccccttccttcttccagtcgttttccatttttacttccttttccactactattttacattatttttctttattcttctttccttttcttcctttctttgttttctaatagaagaaatagaaataacatttgtagattgaggagagagagcttgtatattgagagacctcgttagactcaaagcatgccatcataaatctgagatatttagaatatgtattccagtaaaatcggctaactaacttaatttttacagacatagcatacatcacagttaaaatgccttttagaggcccattctgttttacaagaccaaaattaaatgtatatatgcttatatacatactaatgtttatctgttatgtgcacatatctgtgtgcatccatgtatgtaacaactcagtgttttactgaagtaaatttttaggattgaaagaaataggtttctctagttgtatagactgcttatgagaacattacaattcgatatgtagagagatgatgattacaatttattagtccatcaccatttggaacaatagatggccaaatgtaattaaccattgaaagaaatacattttacgtgtcctaaatttcatttctaattacttgtaactgaaactctctagaatcttaaaatccattttgtcttatgaaaggcttcattgcttatccctgttgttgcactattactttagattagagtaacttcattttaaaattacatgtcaaatataatttgctattagtaacgtggaatgtgtggcttcactctgagaaaaaagcctgttcagcattttttaatatcatatacctaaacagagcttccacgatgattagatcacatctggcacaatgtagatctatttgtacttgcataatgcatgtgcatgtacacactgtgatattttacgactatttgggtacattgatttttctataaagagaactattatccacatctttttgcacagaagtacacttaaatattggcataggtaaacaacttactaaaataaaactcgtgcttggcacaactattactggtgtcacagattttacaactataatatttctgaaaagctagcttgaacgctttggaacatttttttctgagtgaatgcagaggcagtttggtgagctgtaaaacttctacttttcattttgtattctagtctaggccaaatcttaagtgtcactaaatctgattctatcttgaattgtggcccagtgtcatccccagaaggaggcttctccccagcactggctaggtaagcagcctatgtgaaacaaaggaagcggctttgccagcaagcaactattaagaatgggaaagagtttgaaataggctaacgaaatgcaaaaaagtaaatccaaagtccaaaagtagaggcagctttaactctgcactatttttatcttgtgatcctgtttgaagaaatgtctcaattcattataactgaagtaaaagtcactagcataatatggaaacaatcttaaactggtaaatattccttctccttacttaacataaaataaaacccatattaagatattagttcctcctcgtcagcaggggaagtctctgtatagactgtctgaggacatggcagttgactgacactagagtgggcaatcccagagactggaaattgatgtcaaaaaatttggttttgcccgctctgtttaatctgtaattagtcaaatttaatcttagtggataaggtatctgaattgggttcccaaaactcatctttatttctatttttttttttacattttgcaataattatgaatattttgaatatttttgaattttgaacataaaagttgcaagaatagtacttggaaatccctgtataccctttgtgcagattcaccattttaaacatttagccacattcattttgttatgcctcttaaatttttaatacttcaattactgtttcctaagagcaagattattcttgtaggtaacaatagcaaagttaccaaattcaggaaatgtatcattaatgtaatacttccatctaatcaaccatccatgttccaatgatgttaactgtctcagtgataccttttatagcattttctcctccaatgcaagatccagtccagaatcacacattgcatcgagttgttatgtcttcttagtctcctttaatgtggaacagttcctcataccattgcatacactgttaaatatgaagaaaactggtcagttattttatagaagattcctcaatttgtatttacctcatgattagattcaggttatgtacttctgtcctaactactagataagcaaagtatgtccttatggttcacatctggaggcacaaaatgtctctctgtccctcactggtaatgttaacttcgatcatctggtcaatgtgttgcctgataccttcattttataggtattattttctctgtttcaactaataagcaatctgtggaaagacactttacgaccatgtaaatatattgctctacatcaaactccccctctagccttaactactattgatgattcattcctgaaccaatctttaccacaacagttgcatgtcatcttgtattaatttcttttggaatgagaagaaaaacaataatttactctggtaattttctgaagaataccgttgatttcctttgacaatgttctaataaaggaaattgctctctatggaatcgtagtgatctgtatcctctgagtagtttactcattctaactcaaccaaaatgagcagaaattaaaagcaaatgatttttgctctagaatcaatacttatgttcacagtcagtatatatgctctgcaacaagttgtactctgggtatacatatacaaaatttcagtgttgcttaaaaaaaaagcatttttattgacttaaatggaagaattctatagttttttaactactttagttttctggaatttgtttactttaaaacttttcagcctttgcttttccatctctttaacaaattatcacctcattcatttagtcatgttctatttaatttatatatttttattcttttgcctttccacattgcctaaatccttgtggctaggattacttaaatttttctacatggttttcattcacccccattcttataaattatgtgtatcatttatttactaaatatcttggtcatgttcaagaattgaagatgagagttttcagttatcacattgaaaaagattaaaatttattatatacatataaatattatactataaaaatccttatgtaagttctgcaaatcagtattttatatatttagtgaactgcacaaaaggcaacttctattcagtgtaataaccctaattttatttcttaattttaaaattttaatcttttctacttaacattctccataaatagcttattgtagtgttacaatgaaagaaaaattttaacatcctcatgaatcctgactacttagtatatacatatgtaaggtgaaataggttaaatagcttatgtgactattttctagttacttcattaagtctctaatgccttttggataaacaaaaatgatgaaaagtaggtcaattggctacctcagccaggtgatcaagatcaacatcattagagatagtgataagacaggtagataatatgttctcttcatgcaatgagaatggcattttgcctctgtcttccccgagaacatataaccccagtctaattatgcggaaattgtcagacaaacccaaattgagggacattctacaaaatacttgaccattactgctcaaaagtatcaaggtcatcagaaacaaggaaagtttaagaagctgtcacaatctagaggagcccaaagagatgtgatagctacatgtgatgctgtatactggctgagatcccgaaacagaaaaaggatagtatgtaaaaactaaggaaatttgcataaagtatggacttcagttaatgatgacttatcaatgttggtttatttgtttgacaaatgtagcacactagtataagatatttacaacaggggaaagtgggtacagagtttatgagcactcttatactatctctgcaatgtttctttaaacctaaaattattctaaaataaaattttattttaaaagatatgtgtattgggaaagttaaatgttatatgaacagtgatgttggattcttaaaatcagaaagtccctgaaagtataccataaaatgttttttttctaattgtatttatttatttttttgagacagagtctcactctatcgcccaggttggagtgcagtggcatgatctcggctcactgcaacctcagcctcctgggttcaagcgattctcctgcctcagcctctcaaatagatgggattgcaggcacgcgccaccacacccagctgatttttatatttttagtagagacggggtttcaccatgttggccaggctggtcgaactcctgacctcaagtgatccacctgcctccgcctcccaaagtgctgggattacaggcgtgagccactgcactcggccaaatggggtttttaaatacttggtaaagaatagatcatgcccaaggtcactatcatctagctttatattttttaaataacaaagtatacaaatatatactgattattgtttcaagtactatatgttatagagaataagaataggaagtgattaaaagactatggtcccagtacatggtaacattggtgaacacaatttatacaaacaacagagaatagagtcttcattccaaccttttacacatccttagggaaagtgctatgtaaatgatacaattgctttatacttcatagggataccacacaaagggaacacttttaatatcaaaggattctaagaatttcaagaagtttactaaatgaggaattagaggaagatgcaggtaagtatatcataaggaaatataattttaaaagcttatcagtgctaactcaggctcagctattataatatgtagcatcttatggacaaggacaaaataaatctcactgaaaacttaagaccatttttcaccttgaaaactcaatgtggaattttccatgaagagcccttgtcatcaaagcactcagatatagtattgaccatatgaagccacactagtacttctggctcattggaatgaaaatatcatatgagtcagcttttaaattttttaaaaattctattattctgatcttaacacattattactacatgaaatttatcctcaacattttgactagctctttttaagtagactattgtacaggtatgacaagtatattaaaatacacataacaatttcatatttgtatcagagtatatcaaattaccaatgtcttcaaatattccatgctagaaatacctgtttgtagaatttctgtactggatcacttacctcttctttctatagcattttggcttcacacctttctcccataaatccaacagttcagttacacttttttcaagtatgtttaaatattggattgaaaatcatgtaccctgaaacctcataaaactctgtcaccaaagagcatgtcatcagattgagtgggatacaatacagacctggattatataaaaattatacgaaattgtacacaagcaattaagtctaaaatacatttctttactgctgaattataagcacggtattgtgctaggtactgtaagggttgaaaataagctgaataaaccataatctctgttttcaaggaccatatagttcattggaggaagcaaacatatatattcacatatttttattacactatatattcatatttcacaatagaggtaaaactgaattatatggacatatggaggagagaaggattgaattttactagggacatctcagaagcattaagggcagaaaaagtatttgaattgggccctaaatgaatgcaggaaacgtcagtaggtaaaaatgggctaggaggatagggaggtatttcagatagagggggcataaagatggaaaagcatgcaatgtttacaagtagcccagtgcaactagagtgagaagtcagatcctggaaggccaaatatatgactggggagtttgaacatcattctgtattagaggtttttgagtggtagaatttcaaaatcctatcttatatttgaatgtctattgggcaatcatgatagacgggaagagacagaaaccacttaagtgatgctataataaggcttgagtttatttaagtagatacgttcacttaattttaacaggttagttaggtgtggtaaacagcctctaagatagttccgaatgattcctgcctcctggtattcatgttctttgagtttggggttggcctagtgactggcttctaacaatagaaggagaaattgatgggatgtcccctctgagattaggttataaaaagaatgtggttcccttccatcttctgtgctcactctctgtctcacagatcatgagcttccatgttgtgaggacacttaagcagtttatagagtgggccacatgtccaggaaaacctggttgccagcagccatgtgaatggacttagaagaaggtcttgccctggttgaaccttatttgaaatcgaagccttgatcagtggcttgactataacctcataatagaccttgtgccagatacactacttaagctaagactaaattcttttttttttttttttttgagacagtctcgttctgttgcccaggctggagtgcagtggtgcgatctcggctcactgcaagctccgcctcccgggttcacgccattctcctgcctcagcctccccagtagctgggactacaggcgcccgccaccgcacccagctaattttttgtatttttagtagagacggggtttcaccatgttagccaggatggtctcgatctcctgacctcgtgatctgcccgcctcggcctcccaaagtgctgggattacaggtgtgagccaccgcgcccagccaagactaaattcttgacatatagaaactgtgaggtaatacatatttattgttttaagccattaaattttgccataatttattaggcagcaatatgtcattaacagaagtcaaatccaatatctagcctggtttatctttgtactaaattattgaatattttatttctatcatttctatacataatatggcttaaagattactgaattataaataaaatctagaattttctccatattgcttagtataatcttaactattatattgtgaaagctttgtgatcccttgcatttacagcttttagagaaatgaaagatacaggatttatatgtaagagaggtcttagaaacctattttgaaattaaacatttttaatattttctgttaatcctttttaggaaaaaaaaatttgtttataaagtttttactaaagttaaagaacactaactttatggattcactgcagctttgataatgaaaaaactactggaaaagaattaaagaagttgctaatcagttcattaatcaagtgtatctgctgcacattatactgaaacaaattgaaaaggatgctgtgctagccagaaactccctctcaaataaagtcaaaagtgaagataaactaaattgacttttcgtttgtggttgatttctatctaagtagatccatctctaaaacactgaataaagaaagttgccccatacatagattcaagactccactaggattctgtatcttaatactactgagaataacttgaactatatttaatcagtctgtctttagtttttgtttttcgttttgttttcatttacaacccacagaccactttcatttttaaatgttaaatatacttagaaagaagaagaaaaaaacaacatcaccttgctcactgcattaagacaactggttttgtaacccgatcaaaagaattaaatagctttctatatagcttaccctcccacaaaatctttcaatgcacaaaatatttgtcagtggtcagaatgattccagtccatcccactctctgtggtgccttaactataaaaatggcagtgaggcattgcagcttgaaaaaaatacagtcagattttcaattatgattagagtagatctcccagagaggtctccacagaaggcccaaggttctctaaagggtaaaaggagtgacaaaattctgacataaaacaatgtagtctttcctctcttttcttgataccgaccttcaaatattttggggtttttaaaagccaaattctagaagaaattgaaggttcaaaattggaattcgcttgagtttcattaggtttaagccagataccagcctatgtcattttctaaaagcagaataatttagttttaaagcaatagtacaagacgaacaaacaggtacctggcaatcacattaagactcccttggtgtagacagatatgtataacttcttttgacaggttattttgtttattcattcatttaattttggcacttaattttaaaagagcttagaaatcatagtcttttgatagatataattggtatgaatctgaaatcagtaaactaagatgcataagaaatgtaattttctttattttcttgtaactgaattaattctatcttaagaccctattctactggaaggtaccatggaagataagaaaacaaaccacaaaaaaatacacaaatttatacttacttcacatactgtccccaccatgttataaggatataatactcatccattaagacatgagttgcatgtttaccccattatagattatttaggattatgctgaatttacaagtgaaggaaatgagcaaagaaatgccactggataaacagtgttttgctttccagaagcattaatttaagtgactggcccatgattatccatctgctctatcagtgaaagatccctaaagacaatgcttgtcttctatccttgtcatactcagtacactgttcacattagcaagtatttgcccaaaattgctcaatttgggatacagaatagaaatatatgtacagtagtgagtcactgataggatctgagtgaaaattttttacatttttttaaggcttagatgaatggacacagttttctattgttttgtttacctttgtctggtttcccttcccacccccatgcacgtgctcatgtgtgtttaattaaacaaagaagagttccaggaagttgggaatgtcaaatgggaacagacaccttcgcaggagctgagaaaatatgctatatcatttatccttgtggaaacatgcaaaccagatttgaatagtttttaattgatttgcaaactttgcagtagaattttctggtaattagcaacttgctgagattaagtgaagtcatagttagcttcacagtggtttaaatcatatttcattgttttgcatgttttaaaagtcatgttgtaaattaaaaacgcaaagaaaaaatcaccaacttattaatagagaattgatcattatgcaaccaattagaagatataaataaatatacaaatcaatcacgtataaaatggtaggtgctgcagaatgttaacactgtacaggcaagtgcttgacaaataataatgagctataaagatagactagaagcaaaacagtaatgtggcagctttgttggaaatattttctagaaatgaagatgcatgaccttccgtacctttgttaatcatcagttatagatagttaaaatgttatatttacaataattctgtgacttttaaagtaattgtttatacaactacattgagcttactagtggcagtatgttcatatgtacatgtgtctctcttgagctctcaggagagagaaaaaatctgaggaagtgctagcaagcataagcagggagataagaaaaataaactatcttataagtacaataaaaatcacccatgcctcatggataacctaacttcccaattaaacatgacgtttcctccaaaatattaagcgacaaactagaattctgtttcggaagccaaggaaattaaagaaaaatagagtcaagggttaagtagaagagaagagacttaattacatttagcaagggtcccaatccacttagatacttactagggtactcagcacttgttcactgcagcatttgcatttagcacttttaaaattgggatgaaatgagttttatagatactagaggaatcattatgagatcacaaagaagtactgtgataccataactgaagctaggagaagggaaagcaaattcatatcacagaggaaagcaaacttccatcctctcaagttatctttccagtcaacattgccgcatatcacatatggtgtgcaaaaggggacagattaatgaagtactcaacaggaaggtataacaatccaaaatatgtcctttgtgactctctatccatttctgccatattccaaggaaatgcagatgtatcttcatttctatgccatgatatacttgggctgggaatgggggacaaacccagagtgattgttctcttttcctgtgttcatagtgtatatgtgcacacacatgtgagggtgagcctacacctgttcataccccatggcagtctgacttcactgattactttctagaatcttttttcctttatgtgccctggacaagagagtggacaggaaacatggtaacaaaaacaaagataaacatccttctataattctaaagaagcatttttctgtttcctcctaggagaaataaaaatgtataatttaaattaccaattaggatcatgttgggctttaaaatttttggggggtaaattgtatgagggttgcaaaaaagtcatgcagagaaagatactgaaatctcctaatacaacatgttgagaagaaagttaatgatcagtttttctggtagtttttgcatataagcctacttggaagcactgtgtaggcctaactgacgttagtgaatcagcagagagctgatttgaaatgcattatccgataggcatgagattaagcagtttgataggcatcttagagctgtttccatggccttattaatttgtaacagttgtgtggtaagttatgtcaacctcccagtcagaaagtcttcagtaagtttttcaggctccaagttgagggatgggtaagaccctgggacaacaccctagtggaggcttataggagagtttaagcatttctgaatgcttaaattctggatgctacattctggatgctacaggcccagaattccacactaaagtatttgtttggagaactcaagtatattatgggtatcttatttgtattatgtgtaagtaaatatcaacataggtttgatcatttaatcccatatcctgattttgctctaagcgaaggcagttatttgagtgccagctcagaaaaggtaattcactattacctgttaagtgtgatgaaacaggacttctcagcatatctttcttgatggtattttaggttcaaagctgatggattagctttttgccctttcacacattctacctatcagtgacaccatggccaagggagacaatccaattcacttccctgacagaattgtgggtgatggttatatcattacgtatcctggaatgcaagactctgcttgtattgatcttaaacatataagctaaactcagtagcaaaaacataaccgatatatggtggggaaaacgacaagggagtgttttctaaacccaagaaatactcaataaataggctaagaccaagatgaaaagtgcaaagaaccaacaagacaagagtagaaagaatgcggggctcaataaatggtattattctcagaaagtatattccattatctgttgttgtagaacaaactacccaaaacttaatggcttaaaatcattgttcacgattctgcaatctgggctggcttcagcctggcagttcctgccactagtctcatctgaagtcactcacaaaactgcagcccattggtccagggtagtcccattcatatgtttggtggttagttggcaatgtcagcccagcatttcaaatttcatggcttctccagaagggagctcaggcttcttacatggcgcatgtaatgttccaagaagtcaagaatggagactacacagtctcttgagtcctaggtcagaagtcacacatcattacttgtactgcattctgttggtcaaaggagttcacaaggccagcccaggttaaaggggtaatgaaatggattccacctctacatggaagaaggtgcacatagtatgtgtccatatttaaaatgtcacagaatttacaggaatatgaaaataatcatggcaaatgtggtgcattcttaggaagaatttttttttcttttttctttttttgagacagagtctcactctgtcgaccctgggctggagtgcagtgatgcgatcttgactcactgcaacctccacctcccaggttcaagtgattcttctgcctcagcctctcgaatagctgggattacaggtgtgcaccaccacacccggctaattttttatatttttggtagagatggggtttcactatgttggccacgctggtctcaaactcctgacctcaagtgatccgcccacctcaacctcccaaagtgctggaattacaggcgtgagccaccatgcctgcccaggaggaactatttttaatgtccaccattgtatagtgctcccggtacagcctctatttaacaatttttaaaatgtctctacatattttgactctcttaaaagttaataataatgagaaatatttacattgtattcattcaataaacaagtactatgatttctctatcgcgctcagatctatcagaaaccttaaatgtaaatagatcgtttgatgctttattataataattgttaaacattcttcctaagtgcattattgaccattgatagaaaagaaattgcttcatgttatacttattcatcaaaagcacaagaagtgcccttccctgtcaaactccttcaattgtcaccccagcacttcactagagatacaaataatagcacatgaaattgtagctggaagggaaggggaagactggtaaggcttatttaaattgcattccaagcatagaaaacatatcttctttccaaaaaatgaaagctagtacaatattaaatcagtaatatacatacttaaaggcatattattttatgtgatatgttaaccatgacatagagtatctcaaaccaaagtgattcaattgtcattaccatcaacaaaatgaaacttataagtggattgttagcagcctctttttagtttgttgtagagtgttcctctaaagagaggagaggccagaaatcatctcagtacacagacacagtgttgctgcatctccatttttccacaccgattttagtcttgatattacttccctgtggaggctgtctgaaagctaaaagcctatacagaagtaacttaggccaggtcatttttacttactaaaagtcagttttcctataacatgtaccacaagatgttactttaacagttttggttcaagggtcaccagactgtacagactaccagagcttcagcagtggcattctttcaggtggcactctataagttgtctgaatcattgggttaacattctcttcatgttttcatcttagaaaggcaagttaacgtatttttaaagaggtttaagaaggcttaagaaaaagtaaactttttttaatgcattgaaaaaataattttacaatttattcaattcccagagtttttattacagacctactatgtacacaagcatggtgtacccggcagctgtgagaatagcaaagacacagcctcagcctcccaaagtgctgggattacaggtgtgagccaccgcactgggccccagtagatcttttctgtgtatattttcccctactcctctcatctaccctttactccatcctaagtgaatgatgcccttttctctgactatatcttacctttcctacctctatgtctttgttgatcactttcaccctagccactcttcaaggctcgtttcaaacacagatttcttcatgaagacttttctcctgaatacacacactgctacctcaaatccaaagctatttctccttgtttatctcccattgcaccttaattcctctttgggctagagttgtctctgtatcttgtctccaccatccaccaaattttaagacctgaaagtagagacatcattttgttctatctcctaacatactttgcagttaataagaggcaaaataactgtttagttgaattaaaaatgaatgtgaggaaatattgtggccatctgctaaaatgcataggtaacaatgttggaaaagaagtggctcttttttaagtttgatgaaaaaaaaaaaatatatatatatatatatatatatatattcttaaaaaattaatcacttgtccaagatttaacagctaaactaacatttactgtatgttcattattctgcataatatgtttctcatatatgtaaaagcacattatttagtcaaaactatcatattaaatttctcccgtaattcctaagggctgtcagctgctcattaaatcttgattttctgtcaggaggaattaataatcttgcctttgagtgaatttagaagcaatgagggattgagcaggaatatttgaataccctctcggtggtaaattggatatccaattttcaacttagtcttaatgggaaaaaaagaataaattgaattcagaagctgttctttactttttaatatttcctccccacttttaactgagttaaaatggaagggtatagttctttctcagtggtggggaaaatcaactttcattcacttagaaaagtttgtcaaattcgaatgagacttaatatatggacaatctatatgactaagtctataaggtgatcctttggaaatcataggaaaattcagtacaataacacaaaaattgatttgcatgaggtttaaatcgtgtttttctaaaagcaaggaatcctgctcctccctctccccaaatgaattttgttgtcaaatactggtactaacaattattgatatcacaactcagtctctaaaagcaaactgtcctattattaccagagaggtgctaactcacattaacctaataatatatagctcttaattttcagttttcatctttcatcattttttagctactcatgtcttagatttaaagtcccttaaaattataaaaggttgagagactgataaacaggcataaaaccttgtagatttttttcccctccactctttttttctaactaagctacacagtaccatcacgtaccatccatcagtacatttagctgtcatgacgctgccaatagaagttgtccatccactaggcagtataaaattacaatcacgatcttcgctgggagtggcagctcacgcctgtaatcctggcactttgggaggctaaggcaggtggatctcctgaggtcaggggttcaagaccagcctggccaacatggcaagacctcgtctctactaaaaatacaaaaattagctgggcgtggtggtgcatgcctgtaatcccagctactcgggaggctgaggtaggaaaatcactcgaacccaggaggcggaggttgcagtgagccaagatcgcgccattgccctccagcctcggcgacagagtgaggctctgtctcaaaaaaaaaaaagttacaatcatgttctcagtgaggcagtaaggtggaagagtgtatttctttctgtgtagtatgactatatgacctcatgtgtgtcactcacttgcacttattttcaaataccaggcagcagtttgcttgaagttaactatctgttttatcatgcaacttaagaagaagttgtaacacatgcaactccaaattattcttattcataactctgttctatagtaagcatttgaatatggatgcagctcatgtgatgagcatcattctacttgacatgaaggaatgagatccaactgcgaggaccccagtcagaaagagctgaaggcccattgatgcctcaccttttctccctgcttcccccactcttgctagggatcattggcaccaccactcagactgatggtaaaacaagaaattgtcttctgtctagctcagacacatcacttgtccaactcaacccctgctttgggtacaggaagttttaatctggttaagttgaatagagtttgtcttctagcttttgctgtgctaaagcaagagaagtacaaatgtcaacaagcagaataagaagagtataacaagaaatggtaagaagtcaaggccaaaatctagatactgacctgtggataattgagaggtgtcagcaactctcttctaacatcaaacagacataataaaaacctaacaaaagatgttgaagtctgaccagcatacctcttactttgcataggtgctgtttggatttctatgcaagcctgtgcttaaaatcagccttcagattgaatgttgataacctttccttttttacatgcctcatttcagtttatggcattccaaccttttctccctcgtgacgaacacttttttgtatcaatgtgaggcaagctctgtcaattcatctaatcctcaaagaatttttgcagaataagtatgattatccccattttatagatgaagaaatcaaggcccagagaagttcaattagttgcctaaggccatacatctggcaaatgatagagttaggagttgatcccagatctgcctgattctgaaccctttgtttgatctttgtgttgttccatatcatttccctatttaagaaactcatttatatttgcactccataaatatcaagcctgtcgggactaagttgtaatgagttcagcatcaattcctgtttactggtctgggctaaacagtgctgatagtaatgctcatgtgaccactgggaaaggtccaagttcatgctctaatatctgacaacagaaactactcccttctagagaaaagagcagacctgaggataccttgtgcaatccaaagtcaaattccctattcattcattcattcttattttgtgtgtgtctctctctttctctctcttgtgcacctatgcacacacaatttttggtcgatgcacaattttaaggtcatttttaatctaaagaatttgttcccctcttctttcctgattacatggccatacagcctgccccaaacagtatgactcactctccatgactcttctgcggctctttgttgtgagttttcattttgtgcctcatttctgaatatgctctaaagagcagggatggcctttggctagaaagaatggcatgtcaggagggttccacaagccatgttgcttttctgaatcatgaaaaggcatcagcactcagtgacatggcccagttttctaatctaatttaattgaatgtacaatgatgtgggcactggagattaaatacaaccccacttctctgcaaagttcacattgcctttaaagcaatgtaatatttttttcatttcttatgaatggttctgtgtatgtgtcatgtatacttttacttgtattctctgtgcaaagtgataccttaaaaattatctgtaaaaagtctaatataacttggtcttctggaatatggcctgatttaattaattgaccaatattactttaaaccattatattgcagtgaaagttttttcttgtcacagtaggaactagagacgtgtcctaacaaagtactaacttatttgcaactgatataaagtgaattaatatatttgttacttttaaaagagagtgtattttggaattttgcagttatttgtatattaaggcccacattaagggcctgcccatttataaaatgacgggtaattttcccaagtgctgataaaatattttatcatctaaatttgaaaagaaaaagaaactaattttaaaacatttctaatttataacattttgtgactaacttactttttatttaatttatttcctttcattcccctcactgtgatccaatttgtagacaggcaggcttgctaaatagcttcagcatttgggtttgatttactgtgaagtagatcttagaaattaaagtttcaggttgaaatttgcctttcagatctccttgcctaaatatacatgtaaatttgggagtaatctaacatgtgcataaacacattcaaactattttatagctttaaaaaaattatattgaaataattttagacctacagaaaagttacaaggttagtccagattttgatacccccttcacccagattccccaaatattaatgttttactgcatttcctttattaatcttttttctagaaacacatacacacattatttttttctgaatgtttcagaataaattgcaacatgatgccccttcacccctgaatacttaagtgtgtatttcttcaaaataagaacattcttttgtataatagtacatttatcaacattggtaaatcaacattgataaattaccacttaatctatagactttatttaaattttatcagttctcccactaatattctctatagtaagagaaaaaaaatcccagcccacatgttgcatttagttatcatggctcttcaacctcctttaatctggaacagttcccctgccaaaaatgcatatcctgaatctaatcatgaggaaacatcaagcaaatccgcattctacaagataatttacctgtactctttaaaaatattatagtttttagagctatagtacatctccaagtaagcacataggcatatctacatttttaattttctctaagaaagagcaacaattcaaaataatccccaagtatgttttaaaataaaggcttctttttgaaagtcaaagacaaatgctcttagcctaaggtttcatttaaacatagaatggctatttcaaaaaacagtattacataaaatatgggctgggtgcagtggctcacgcctgtaatcccaacactttgggaggccaagtcaggtggatcacctgaggtcaggagtttgagaccagcctggccaacacgatgaaaccttgtctctaccaaaaatacaaaaattacctgggtgtggtggcgggcgcctgtaatcccagctactccggaggcggaggcaggagaatcacttgaacccaggaggcggaggttacagtgggccgggatcctgccactgcactccagcctgggcaacaagagcgaaactctgtctcaaataaataaataaaaataaaatatgtattatataagttagggacaatctggtctttcatatatagacttcagacaattggttgttcattctggagttgagcactatttctctcatgggctcttaagctaagaacatttagctacatgtcgggtatgtttcttacattctgcctcatgaccatctcccactgccatgcatatgacaaagacacttaactctgagccccaaatctagaggagagatctaaatgtcacgtgaagttcttaaaaacctttcttctgaggagttaacaagggatattaggaagattcctctgcccaaaagacctcccaaataacctctgccaactcaggctgcattaagttaaaccagatctgtctgtaaaatagaaatgagaatagctaataatatcaatatttcatacctttattttaactactcttctctggctactttgtgggttgtgagggaatggaacattttactgaggagccaggtgaatgaaagaagacatgcagagcaagaggtctttggtgagagggcctgtttgagcccctactcaagggaattaggagtagcatgagggccctgtatatccacagaggacattcatttttaatttcctctaagaaagaggaacaattaaaaataatgcttaagtatgtttttaaaaagacttttttttttttgaaagtcaaagagaaacgttgttagcctaaatttttatgtaaacatagaaggtgattttaaaaagccattaaggaggcaggggagaggtatgaaaaaatagattgaaggccacctactttacaattttgcctggtaacaccaaactaggcagccaaagcctggcttcaggtttgtcacagctatcggttatgataaacaatattaccatcacttcctggttgtagtctgcatgaatttgaaaactaaaatttgcagtgttcgggagtggtggctcatgcctgtaatcccagcactttgggaggctgagacaggtggatcacctgagatgaggagttcgagaccagcctggccaacatggtgaaaacccatctctactaaaaatacaaaacttagctgggcgtggtggcgcacacctgtaaacccagctactcgggagattgagttgggagaattgcttgaacccgggaggtggaggttgtagtgagccgagatcgtgccgccattacactccagccagggcaacaagaacgagactccgttttttaaaaaaaaaaaaaaattaaaattaaatttaaaaattaaaattaaataaaatttgcactattatgattcagtaaagcaggaatgttataattggttgttttctccttttttcctctgtaatactatttttaggaggatctaggtagatatctcactctgattattcccgaagtatgaagtctcccatactggctatttacatataacttaattcataagacttttaagaaatctctttttgccttctccttattctccagactggcattgtgaagatgagagccaacaaattatacctcaaagtctggaaaattagtcaactgttccacagttgtgcatgaaacatttctgactttgtgatttgtgaaagtagcactgactcagctaaggatcatggaaagagcatagacttagatcagaagactcattctagctggtaactgtgtgatcgtgatctgatcactaagactctgcgagccttaggagtctccccttgcatgaaatgaagttggtgaactagatgatcttcgcattatctcctaagttgtaaactcaatgattttgagtataggaattaacaaagccacttaaggggaaaaaagttcccttcatttcttgatgaaatacttattgagctatgtaccatattccatagaaaggaaaaactagatatcttaaccctactaagttgtttagtgaaaagaacatgaaaagttcagatgaaaagtcaagaagtcaacataggaaaaaacagataaactaataaactgaataagtaagtaatacagcttcaattaagtactggacttccaaatggatggaatcatacctttcagggctaaattgtatttgagaatacctactctgaggaataggtttttatgctctggaatcaacacctcaaaattcaacatttaattcatttcactcttcactcattactcttttgtttttgaatatacacatttttcttttttttttttttcctttttttactataagataaaccaaaaataaatggctaggtagatggctggagtttgcttgtttgttttaatgatagtataactgcatatagaaaagcaatatatgtgttcctatatgaacaacccaaaagaaaaataacttttaagtcatagaactttgaaggtctgcaaatagttgttgacttagttattactacgtgtattagtttgctagggcagttacaataaatgccatagacttggtggcttaagctggataaattaatttcctcaaaattctggaggctagaagtccaaaatcaaagagtcagcaggtttggtttcttctgagccctctgtccttggcccttctcactgtgccctaatgtgactatccctctgtctctatgctctgtgtactaaggacaccagtcagatttaacttaattactactttaaaggccctatctgtaaatactgttatattctgaggtactgcaggttaggacttcaacatatgtatttggggaagacacagttcagcccataatactgcatttatctttataataaggaagaaggatttatattattctactgttttgtgtgctgaatgtatttttaactttggttgtacaatttcccttacacctgcatcagcttatcacattgtgccaaggatgtgaaatgaattgcttcaaaatacaccctaattaattaaatattcacaacatttttatagcatttgatttttttccttgttaaacataacagagaattggatgttgttcacataccacagataagccaataaaccagacattttgtcatactctgtattgataagaatttttttggcatggaaatgatgtattttattgcctttaacttctaatacccccttaattacaaacataatggatgttttactggggatattgtatatgcagcagttgtttaaacctgaaatagaaatgctaagagggaaaagtattcaagtccagtgtagcccaatgctgaaagataaaattgcagcttttgacattttaccaaattattgattgtgttctctggctggctttaaaaaacttaatgcagtgagtaggttaaaaaaaaaaaaaaaaaagaagaagaagaagaaaatggctgggaaagcataaaggcaaaacagttttaaaaaagtatgagaaagcttaaggcctaactcaaatgataagcagtagattttatggcaatggtgccagacagccggggtttgtatcttgactcttcctacttaataactcactatcaggcttgatgtgataataaaataattcatgtaaagcactcagcacatacctggtttatactaaactcaacaatttctagttatatacatagatagacatacactagtacatgtgtatatatgtatatgtaccttgtatatgtatgtgcatatattaatatatgtatgtatgtattcatatacataatatgtatacatattcacattcattttcatattctccagcctccgtttggtacactacaacagtgtgtgtagttgaactaacagctggttctgctgtcatgatggctagaacagcaaagtcagccagagaaaccagcctcaaatggtacatctttctgtaagcagatatatatgatctatagcagcacgtccagtgattgcctcacagatactacttctaacctatgggggaatttttgcatagaaatccaaatcccctcctacctctcctctcagtgcttgagcaatctcttgatacatataaagctttgtaactatccttaagtttttctctggtctacatatggcctttatgcttaactcattgttaaattctcacaggacaaaggctacatacattccatatataacttcagcagcatctgctataagctttcccataccttatacactgaataaatcatgaaggctgatggaatcctgaaatgaacccataatccaataaaatgagaaaggctaaagacctaacctgctctggactcacattagtctagaagcttcaggaactcactgaaaggcaagatagaataatggttagtatatggactacagattcaggaatacctacatttgaatcctggctttgcaacttatataacttgggcaaattatttgacctctctgtgcctcattttcctcatctgtaaaatgataatcagattatatgtttcccaaggttatgaagaataagcttattcatatttgttatgtgcttagattagttcctggtacaaagtaagtgatagcacttactataagtgtgtactacataaataaaataaaataatgcctggtgtctcaacgctggcccacaaactagtctactctacacaggtcttccagaccaagagtgactataaacctaatagacatctctcaacaaggcagctgtaggtctttactgttcatgttgggttttgccagcagaccaagtgttatgaattggctttagccaagggtttcctgaagagattaaaaaaaaaaaaaaacaggctggtggaacatttggtatgtgtgtttctttagtggtttacagtctgtgtttctagtgtctgcatcattaatatatttctctttctggatttagaccctgtcattactcatctgtgtctgttttgacttaaacccatcactggaagaaagaaagaatatgggtctcaatgagttctattgcttcattatggtgataactttagtgcccacaaggaaatagttgcatacccactggctgcaaactaggtctgcattcttcaggaaagatgttatatggcagcctttaagaaatgcagtcttcttttaccttcaactttgtgtcttatttcactctacagtttttaagtgaaggagataagaagaaagagctagctgcaaaggtgagagttgaaatatttttacagagacatcattataatgaacatgatggactgtagttgtaaatagggtgagtgggagaaaacttgaagaaagttagaaacagatgaagaaaaggatttcagataaaaatcagggaaatcaatgtcagtatgggaaaaaagatagtaaggtagaaaaggaacttttaaatgaaaagaatgagtaaaagatgattttatactgattttaaataaaactctgtgtcaaagccttttgtaaataataaggttatagatgattgtcatggtggttatgtttgtttagcaaagactacattaatgaaatggctaagaagcaaaatcttaccaggttttaaatatgagtacactgtgtctattgctctaatttttgttacaaacttaccctaaaataggtcttttaggcaacaacagtaatagcgccaatcgcagttactctaccattctaccacagaccggggaacattctcatgaggactccagcattagatggcccattttagggcacaacacttcagccaaaactttggtagagaagcagtttcagtgagtcattcatgatcctaaatcttttggctgtggcctcaagatctcccctctgttcccagtgggaattatggtagagagacacagttaattgcctgtggattttatgactgtccccttccctgcagccggaatcatcatggaattaaacatgcagggaggttatcaagggactctctcttatgcggactgagaaacttaggttagaccctttgaagaattcactggactgaacatagagtctctactgagtaaaaggatctcctctgttaagttgttcatcatccatttatttattcattcaataaaaatgtattgggtgctgtatgagtttcctagagctgctgtaatatattaccacgaactgtgtgacttaaaacaacagaaatttattctctcacatttctggaggctagaagtttaaaatcaagttgtcagcaggcttgatttcttctgagggcgctgaaggagaatctgttccatgtctctctcctctctcctatcttctgttggttcccaacaaaccttggcattccttgcattccaatttctacccccattgtcacatggccttcttacctctgtgtgccctctgtgtctccaaatctctctcccctaatgacaccagtcactggattaaacttatttccaaatatggctacattcataggtaacaggggtcaggacttcaacatgtattttcgggggacacagttcaacccacaacaggtaccttttttgtaccaaatacaatcctaaatgctggggatagaaagatgaataatacgcggtctctgaactcaaaaacgtcatttaaataggggtagacataaatatacaattatagtgtcacaaatattaaattatatgtctcaacaaaatgctatgggaacacagaaaaacagggcaactaacattgtctcaggaagcccaaaatgtttcactgtgaagctgccttttgagttatagggtaaaggatattggagttcatcgattaattcatagttgtgagtatgcaaagggcattgcagaggaatggaaaaatatgtataaaaacatggtatcatgaaaagactttgtatctttcaagatagggaaggagttggtgtaactggagtctagggttagttgtagggagcggcagaatacatagaagagaataaacaggagatggtagacggcagaggacctgtacaatttcatctcaaagaattggggctttaggccaggcacggtggctcacacctgtaatcccagcactttgggaggccgaagtgggcagatcacctgaggtcaggagttcaagaccagcctggccaacatggtgaaaccccatctctaccaaaaatacaaaaattagctgggtgtggtggcaggtgcctgtaatcccagctactcgggaggctgaggcaggagaatcacttgaacctgggaggcggaggttgcagtgagcagagatcgtgccactgcactccagtctgggcaacaagagcgaaagaattggggctttataacatagaatgtctctgccaagactcttggggatgtgttttaatccttaaagtaacaataaatgtatttaagtagtagtataaaacgaagtgaaacagtagttaataaagcatcttgcaaatttggaaaggccattttgattttgagaaaattatttgaattatagaataattttaaggaaatgctttttaatttatttttaggatgcataggagctcaaactaagttaacaagattcagtcatccaaaccattgcctagtaggtgtccttaaggacccagtcttaataaacaaatacagctaaattataattggcatatcaactgtatgtaaattgaagcttataaagtacttgaggggatttgacaagtttgttctcttaagcattttaaatattactcatgttagttatactatttattatctatggggaaggagtttgctaaaccaaggtaaatgtcaatgctagttcctagacaactatcatgaattctgaattagtcactttttatttattcaacaaatatatattacttaacatctacgaacgagattatgtcctaagtagcaggaattcaaagacatgacaagggcacattcatgtcctcttataactcacagtctagttggggagaccaagatggaaacaaagaaacacattaaagtttgttgagttagataatggtggtgcatacagggtgcttgggtgaatgcagtggaagacccaactctttgttgaagaaggctttatatttagcttgcgaactttgaaggataaaaagtggttttcctagaggacaaagaaactggacagtgtagtgaggatccaagggatcaggcacaatgctttaaaaagttaggagaaatgaaggctaagccaaagtcccagaactgcaaaaaattaagtccgtgtggttttggttaggatgagaggaggcaaggtaggagatgaggctggggggttggccagcagccagtaaggggtctcatacaaaggagttagaacttttatatgatgtacgatccactgatttaagcagaagagggccatgatgaaattgggttttagaaagagacctctgggaacaatttggaagaagaaattagagcagtggttttcaaacatttctctttttttttaacacagagaaaacttttctaaagaaaatcttacatctaaccaagatagataaaataagagtgatatttctttcaaataaatattatgcaaatgaaaacaggctacttcaaactcaaaagtgtcaaattgggggttatagactacagcacctgtgttatattagactcagtatcaaaattatatctgtacacagttagttaggaattatgatggttcaactatttttcaactttacaatggtgtgaaagcactatgcattcaagtagaaattgtacatctctcatcatgctgggtagcaacattgaggcttagctcccaatcagctacacattttcagcttctgttgggtttatcagggcgtaaccccattgtaagtcaaggagcatctgtatttattaccgtactatattgagacaattctgattttctgtaataagttgtaaacaataacggttcaaatgactctccctgtcatgtcatgaaacccttcagttgcattggtctagaaatataaaacagtccgggtcgggcatggtagctcattcctgtaatcccagcactttgggaggccaaggcaggtggatcataaggccaagagatcaagaccatcctggccaacacggtgaaaccctgtctctactaaaaacacaaaaattagctgggcgtggtggtgcgcgcctgtagacccagctactcgggaggctgaggcagaaaaatcgcttgaatccaggaggcggaggttacagtgagctgagatcatgccactgcgctccagcctggcgactgagtgagactccgtctcaaaaaaaaaaaaaaaaagtctgatagtgggaaaaaatccctaacaagagtcaccacaactcacagtctttactgtaaatataggcattcaaaactttcttaaaatgctaaaagcattcatagtgtagtcttacatgtctattttatgtgttcacttttcgtttctacgtacacggtagacatggtaaatatctgttgaattaaaatgatcaaaaacaaagtaaagatttaaccaaaaaaatacagacaatataaaaccatgaagattcaaagtcaaaagtagctatagtctctagcaaggcagatgttcactggcatttgtcctctggtctgacttccagccccaatttatataatcctgacctaccagaaattgggataggtatcacttcatggaaaaagacatcatgctttaagaaagaagagacacatataaacttgtatggggttagaggagctatgtccctctctagttccattagaaattgctgttaagaagggttgggagcaaacctcttccaatcctacccacgtctcaaggcctagatcaaatttcacggtctctgtgtgacacactgatatctcaacacttcctgaaggtgacccatatgccaggaacagcactagatccagagatacaagtattaaaaagatccctgccacctctcatctacatttctagcatctgtttttactcatttgccatttgatcatttcccatctgtatacaagactttaaggcccatgagagcaaagtttctgtaagtttaattcaacctactttttttggccacaagctttgtggcaggcgccatgttaggtattaagaaatacaaagatatagaatacaagtcctccagtagcttgcagtataccatgtataaacctcagatggctactaccgtatacccctcaacagccagttagctgtgagagtaaattgtaaattctttcatgctctggccagatttaaaaacatattaatgtgtatattcttttccaactgtgtcttcttttttttttagatggagtttcactcttgtcacccaggctggagtgcaatggctcagtctcggctcactgcagcctctacctcctgggtacaagctattctcctgcctcagcctcctgagtagctgggattacaggcacccgctaccaggcccagctagtttttgtatttttagtagagacgaggtttcgccatgttggccaggctggtcttcaactcctgacctcaggtgatccgcctgcctcggcctcccaaagtgctgggattataggcgtgagccaccgtgcccagcccaaatgtgtcattttagatttcactttcttcttgagaccatgatgatgccacatgagaaatccttaagtccagctccaattatactgcatatcctagaatggaccattacattaacaagaattttcatatgctaaccatgacatgtacttcatatcatgaatgtagatggctaattttcacacattaccatgcatttcagcattccctagagttatctgaagcatctggggggaagggggagagaacctttaagttttctgcttctgagactattttgttgttattggatatcgctttgacccccttcttttagtgcttatcactaggcatctgccgtatttaatgatgtgtgtcatttcatttagtatcactgacttggatcaattcctcttccaggtttctgtactgtcttgatacatgtatttgttttgctttgaaagaaaaatcaacaattgaattgccagtgatagacatatgagtaggaccattcttaatggatatgtagagataatttctcttcctttaatgtctgtgaattatcatccactgtgatgcatttaaaaatgcaactcaacaacagtagtctactgacaaacaggtgactgctgcctgtgatgtgttttcagttgttggcttttctaagtagttacttgtcagagagaaaggaaaaaggatgaaaatatccattttgacacctcttgaaatgtgtttgttgactgtctctcttttaaatcgccctgtacctatttggcatcactaatcacaatgctaagtgactttttactttactaggcattaaacttgtgctgcttaacctttgagcatcaaacaggcctttccccagcaccctgctgtatctttagtacaaaactcctgaatcattatccatcttgaggatctgccttgccttagaggtactctgacatttgctaagacttcccattggaccttgcagacatttccagatcatgacagtgtcatttgatattttggttttaaacatcatcagagtggcttgtgctgaagaaccagaactagaaagaaaatgtaaaatgaaaagaaggctattgcctctgtgctgattgttaagatggcattggaaacatttttgtttttactatggatatagtcataaaaccatgaatatttttcaaaggatcacagtatgaaatacagagccaacggtagaatatattaaattagcccatttgaaagagggtctatctgtaaataaaccttgcagttaagaaagccaattatgataaaactgtatagttacctggtaaactactgtttataaactactttaattttacaatatcttatttgaaccttacaagaaatgtgtgaacatagtaaggtagggttactctcctcattttgcaggtgaggagactgagaattagaaaggacatgtgatggccgggcgcggtggctcatgcctgtaatcccagcactttggtaggcggaggcaggcggatcacctgaggtcaggagttcaagaccagcctggccaatatggtgaaaccccatctctactaaaaatacaaaaaaaaaaaaaaattagctgggcatggtggcgtgcgcctgtagtcccagctactcgggaggctgaggcagaagaatcacttgaacctgggaggcggaggttgcagtgaaccgagatcgcgccactgcattccagctgagtcaagatcccgccactgcactccagcctgggtgacagagcaagactccctctcaaaaaaaaaattaagaaaggccatgtgacttactcctaatttcctggcttgcatgaggctgagccagaatttgagcctaaagcttctctgagtccaaatttggtgttctctccactatatcgtgctgcttctacttatgggattgggaaatattcgggaattttaattgacaaaagtgaactgtgttcaggacagaacttaaaactaaggtagatattaagggaacaccctatagttcaatgggtgtttttctaggctatagatgaggagaatgccaaggttattacctactccaacaccaccactttgtggtacaaattaacaaagataccccccaaatctatgtatggttggcttgcacaaattaactttgtatttggcaaaaataaaaagccctcaggataatatttcccttatgtagtaaaatagctataatagaatttcacaatctttgttattttctgttgaaatgtccacaggaaaattagaattctgctaattgattttttttctgtatttataataagccctcatacaattgaagcatatctgagaaaactagaaatctattttatttatcttgtaatctgaaaagggagtgttataaaaattaataaggtttcctagagtaggaaataaaaattttaaaaatgaagtaatgataaacattaggctctttaaatatatacgaggcatatagaattacaaatcaacctggagagaccaattggagggaatgatgacaatgaaagtagatgcattttaggatgtttggcagattaatccttcagttttatcccttcagaggtatgagaggtcagtagcatgtctaaatgtaggcttatgttatttacttttcatcatcactgtgaggaagggtgaattttttaataaaaagaaaaaaactatcatagcatggagcttgctttttttaattggcagataattttacacttaatatttctctctcagctccatacgttatcagtttaattactctgaggcctcaataaaaaaattaaggaaactaaagtaggagagtttgcagtttacactcagctgttctgagttcactgaaagtgaaatgccaagctgccagggatctactgcatgaagctctcgtgaggctcctgagtgggccgagaagtggcagatgagcttcgtgtggatacggtaaagcatttagtgaaaaatgaaagtgaaagaagctaggctgcattcacaggctggcaggctttgccttctcagtttcaaacttgaaaaagggatctaggagtgactggtaaccattctgtgaaaaaaaaaaaattagctcaggaaggtgttgtaatcacaatggtccacactctgcagatcagtctcaggaaagagattggcatcctaacagaagacattctacttccttagtacaagattagggtcctccagacaggatgaattattgcaagtaattctgattgctgcttctgtttaaaaacaggctgctgcatcaggctagagaaggccctttgtaatgaagtaaaaatgggtgaaaattccctgttatgaaagaccaaaacaattagtgctcttctcttggaaaatataatagttgagtgagaagcttcaaagagctgcctggcccttccactccttttgccatgtgaggacacaatgttcatccattctacagtgtaaggatgcagaggctatgctcagtgtttttgaaatcaagaaatcataaacatttggataggataaatgcaaacctatttaccaaacccaagcatgttgaaaccttaatctgttcaggctgctctacctgagactgggtaatttgtaaacgacagaaatttattgcttacatttctagaggctgggaagtccaggatcaaggtgctgtcagatttaatgtctgatgagtgtttgctctctgcttccaagatgacacttcttgctgtatcctcacattgtgaaatggacaaacgctgtgttctcgcatagcagaaggagtagaagggccagggagctctctaaggcctcttttgtaagggcattaatcccattcatgaggatagaacccttatgacttaatcacttctccaaaggtcccacctcttaatacagctacagtaagaattaagtttcaacataaattttagaggactacaaacactcaaaccatagtaaagggtatctttgaagcattgcagaaacaaatggggaaagggaagtaccatacatgactcacagaacaacttatcctggaagttctaaagaaatagcatgtttaaaaagtgaagtgattcaggtcaactcatgcactatagatacatggttgctttgtaagagaaaccaaggaggaaaagccatcctttctacaaagcatcccttggtgactcccaccaaaaatagaatcacaaggctaaattgatcatgaatttggtattcttcatggctttagttttaaaaatatttttaaagtattaaaaggattagtattgaagatagtaatactggtaatggtttgcaaagcttcttgttcttgtcctactttggactccacctgcatttacacaaagtaccttcctgtcaaagtcatggacctagaaatccaggcttagtgcttgtggatgccatctggtatgggggtcagcttacggactttgaaactccacagatgtccaccacttattaactacatgatcttatgcaagctttttaatttcttggaggcttactcttctcatttgtaaaatggttttataatacctatcatacgggatccttttaagaatgattgacgcaatatatgcaagtcacttaacacagtgcatggtatccactaaatgctaagtaaacagcagctcttactattgttgtgagctaagtgagctatttatacaaccctggattcaaaaagttgtaataaatatggtggataaggtgagcccacattttcctaataaaactttaaaaaagttttatgaccattttgagtgtagctggacttttagaaatgtagacgaaacagtgaaatgtgtagttatgaaatttaatttgtttagttatacagatatattcaaattgtagatgatgcagaataatctcttcaggtatgatactttgcttttcctccccactatctcattttgtaaaacaattctattgaaacttcacgcgtatctctgacattggtgtttctagaagcactggagctaatttttgtgtcatctaacagttttccagagcatattacattcatgtccacctaagtttttagagatacaacactttaatctgtgtatcagagtatcaatgtcaggctttttccgcaagccacaaatactcatttgcataccactaggtccattggcttttccattcatcttgcatgtgtatattggtgatcttcgttaggtatttactgcagggaaatcttaagtaatctttcaaaggcttgtttacaatgatctccaacacttagtactatgacgtcacaccctgtaaacaattaataggtctgtgttaaatttcattatcttaactgccttccccaattttgtacgtttacatcataagcatctaaaacccatattaagttgttccagactaatgcgtgttttccagagagtacattattaagaataatttggaaaatgtcccttggaattaagcacttgaatgtaagacatcttcctctttttttctgcgagataacttgtagggagcaacgggaaggtatgctttatatttgtgaggataggaatagagattttcttgaaatatttatccaattatatgactttaaaatcatgcaagtttcttatttttattcatcgtatatatgtattaaatgccaggatgatccaaacacatagaaggtgaagttcctgccattataggaatttttggaccttagagaatatccaattccagaacaatgcatggaatactttgtggaaagcatttgcagagagaaagctgtgagttgcagcccttgtcctcaacaactgacagcaaatttgtcaacaaatttaattatgtttatatcaggcagaatgtgtttgaagggcctgcacacgtttcacatagggaaaagaaagaggtgaagagagaaatgttacatgtaaaaaattttacatagtaaatcatcacatggaaaaacacatttttcactggcaagtaaagaaatacaacaacaaagtaacaggtagcgacatatatgtattgtgatggctaagcactaagtgaggtgttggagaagctgtagagaaacaggtacaatttcaaggtggtgccgttaggtgacaattcatggaaatgtatacataaaacaatgttaagtgaaagaattagatcacaaaagagtatataaacgctgattatatctataataatgtgtgtatgttgacatctattgaaagaggatttgaaagaatgtaagtttaatgttgatttgaattttctctctgtaacagtgatttaaatgcatactaatttgaaaagaatacaatgaaaaatgactccccatcacacccctaaaacacataataactacacacatcttggtaaatagattgtggtagaatatgatgttcattgtttgtgatgttgcaacattatctataaatcaaggacttaattgaagttgtacttcccttctttatctactgtaagtctgatgaagcattttttgatcactgtttattatagtaatgagaaaagaataaatcttttccttataaatcctgacaatctgcattttaaatccttgcacaacctgaattctttgtctccactaaatgaatacagaaagtttaagcctgtgattgccttatttattctgcctccctacctttcaatagctactcaatagctctttcttgacctttacctgtcagttaatagttggtacattgagatgtgtttattaagtccaggcagctaagattcagatttatatgcagctaatatgctgaatgaactgaagatctactatgtaccacagatctttgcctggtactctacaaaggggacttcacttgatcttggtagtaaccatctgaagtctgaactattatccctattctgatgtgacaaaactaagcatcagttcagcaggcagtcctcttccgagcccaggacagtggtccttcccttgttccattgtgccttttaagtggctagtctcagtgtgttatagagaatagtatagttttaaacatataaaataaatttgtaggaagcagcatatttttaaggaagatctttttaaaaagacaagtgtgttgcttttttcctcatttaaaaaactgtatattgttgctataaaatttatttataagagtggttggagggaggccgaggtgggcagatcacctgaggttgggagttcgagacaagcgtgaccaacatggtgaaaccccatctctactaaaaagtacaaaaattagccgggcatggtggtgcgtgcctgtaatcccagctactcaggaggctgaggcaggagaatcgcttgaacctgggaggcggaggttgcaatgagtggagattgcgccattgcatgccagcctgggcgacagaacgagactccatctcaaaaaaaaaaaaaaaaaaaaaaaagagtggttggaaattttgatacaaagcaattcaaaattatacaaacaatttgagtagaatccaaacatgaagcaagattttctactactttaataatttcaattaaataaaagttaggagctgataaaaccgtttgagggtttatttaaaggggagcatgttattggcatgctgaccaataacactgggaatgtaatgtatcatgacatgtcagataacacaaacaaggacagtttttggaaaatcataaataacaaaatagaaggagtgtaaaatggaagaagcatcaaggggtggttggtacaataagatattaactctgagaaagttttctaactcatcacttaacattatgaatactgaattgggatgaccacaatactagcttctgtatgactccttaaatattgatattggaaatgtgcaccacatgataaccaatattttaaggtgggggcaaaatagctgctggtatgaatctctagaaagattaacttgaaaactgtcttgtgtaacaaaaggaaaggagaacatctgggaggagaaaggaaatttcctagaaatgggaaatgtggccataatgtgatttctttctataacccatgtatgcaaaaacatttatctccttttactctagtcacactatgtttgtggcttgcatgagtaagaaagctagatgaggagataattgttcagcaaaagaattatagagttgaaatcagtgaagtgaatggtattttatagcaaagagatccctaaaagtaggtggcataaagaatagatgcaaaaaagtattgctttctcttcgagttctaaagacctctgttgatgacgttttgctcatttaaattccagagaataattggaaacagagactttatgcgacagagctttcatttaacttgttcacctgacagttggctttgaatgatattttattaccaatcaacctaaattaaaatacccagctcactgtaaaaccctgcagacagtgtctggaatgctaaaacacataccatatataaataaaattaaggtaaggacaaagattgacaaaagcaatgacagtgaacattaacatgatatcagcagctttgagcttctatcaacaatgtggaccatgatgaagttaccagagagggcagtatagatggattttctaacttgcatttatcagaagagattttcacttttcaatcttaactatgtcttataccttttaataaagatgtggtatcaaacatcgaacatatatgtctgtacctacatgtaaatatatatgcatgtgtgtatatgcatagccatagctatccatccatccatcccaaagttcatctctccaaggtgctagtccacataattgcgttcagttcttctctggtctttgtataaatgtgtacttaaggactttgtggatagtgcgtgatataaatatggttcaggcccatcaaaatgcagattataggatccggtgaacttttccttaccaaataactgaattcctgaatgttgtattattataaaattacaaaagtttcaaacttactgctattctctaattacttctatagagtgattattatatgggatcaccagatgatcatggtctgtcatgctattgctatctttcttcataaatatataatttatcaaagcttaattatattattatccaataaatgaatgatagaataattatggttatgtggttcattacgttatgtcccattctctgactgaagcctctcagtttcatatctttgttgtgtagactatttatgacaagttaaatctgttctctggaacttagtgtcatcgtctattaaaatgaagggttggatttcaattaaataattcataaatttcctgtcagctctaaaattctatgttccattgattatcctcaaactattatacaagttcataaggccttctaatatatatatatatatatatatatatatatatatatatatatatatattagaagatagatagatagatagatagatagatagatagatatactagaaggccttatgattagaaggccatatgtgtatatgtatatatacacacacacacatatatatatgtatgtatagtgttcagttcttctctggtctttgtataaatatgttttatatatatattttaaaacactatattaatgtgcatgaattgagaactgctgtggtatctaaactcctttctgcttgactctatgatgagagatgaatgaatttggaaatatttagtccaagaaaagaaaaagtgtggggataatcagtcttcaggtttatgatgaattgtgactagctttcactctcttgtaaatgatagacaaagagagaacaaactgtaccaaatctcagaatgcataatgtgatagtgcattaaaaaatgctgtagaagctggagatacttagggaaggtagtcatttgatgcaaaatatcagttaatctcctctctagtgtgctttaaagccagggaatctaaaatgggggaagccaaggaggagtagagttgtttctcactgttcaacaggaaggcactttatgtattttcttatatattaattatttctgagctatttctcctaagagaaaacccttagatttggcctacagaagatgtacttatcattggcctttaatgatacagacattgccattgctaccaaagttagtttatatgtacaaggttatatttaattagcttatgtagatcaaaatgcaaggacagaacctaatccctcctcttcctctgtactaatcaatttataatctgaatgtgtcagaattcagattatgaattatgttgtatctattaatccttgtaaccacagcacattttataaaaatatacatactttgattctaaatgataatatagtgcacgttcaaaaccgagtaagtcacagttggtgggcacagagacattggtaataatgggatcctccagctagcaccaagtctctgttttttctttaatgttatatgatgaaggtaataataggtggccagtaaggataaaaagccacccaagaaagaaccagtcttaaacttggctcttttgcttttttcaagttttctcataatatattcaattccatgtaaatattgcaaacagctgaattgcacacattaacctaaacatgaataaaaaatgttgatattttatttaacctaaaaatagtagttatggataggctgcttttatgattatcgtctttaaaatatatcattttacattgggaatatagggaggattgtcaccgttattgtataataagaaaatttgttttgagtacattaaaaatacagtagatgattattgcaatataaggggaaaagttgtttgcttttgacagtctgtcagatgtagcctaggaagacaagtatggtagctgctttatataaaacagtaggagaaggacacaagctcaaagaaattttacctagctgctgttattaaagaaattcttttatagaatagaggctggttttttttttcatctttccgtttttgcttccatctctgaatcctttgctttcatatggcatgcaaagcgtctgtgcatggcagcctgtaacttctgttatttaaactgccaactgttaaaatggattgagttgaaccagaggaggaaaatagccccactgaggcaaatgcatttttacacccttctttaataaaatattgtaaggtatagctagaaagtttccccttggactttcatctaaaactgttagattgtagctttgtgaaagaatcattgttgactcctgtcagacagttttggagaggaggtgaagaggcttgtcttctgactttctgtgcactttgtcaaatcaggtactttgagcagaagtacgaagtgaaggctgatgtcagagaatgccttgaagcaggaacttgtgctagtctcctgtgacttcctttttttttttttttaaggaatcagattggattgtaaaatgatgggaatatgactggacataaacacgttcattgcaggctcagcagccgttacatatcattagtgaagggaggcaaggggcaagggggaccattttgatgtcagtttcattctttttaaagacaaatgcattcactgatgagaagtaaaccagcatctgtaaaattttacagacaagtaatattttaatgccttcttttcctgtagataaacgtataacttttcaataatcattaatataaactgaaataatgagtaattgtgttaaatacccataatgttggagctgcttttaaggaaaccagttatgaagcaactgtaacatcaagatcagtatatttctgttccaaaatagtctgtttcatagactcagtacatagcttgctgttatgccacttcggccacagttaatgccaaaatctaaaattttaaaggtgataatgctttttaataagaaatataatttggccttaactttccccttataaaaggccatattccatacacatcaactcaaaagtttgtcccattttctgacttttctttttctttatttgccaaagaatctctgtaattggcttgctctgcaaagcattttatttgcccttctgaacattaactattttaaagatccgagtgtattatggcagggaacacaagattttacttcaaccccttctatgccctcctctctactaaattaattatttctgttttgagtgttccagggaaagagtaaaattgttaaggtataacaggtaccaacgagtcatccaaacagaagtgccattccaggaaagtacagtatctgtgtgcccagcatggatcttggccctgccctacttttaagcttctaacatatcttcgtagtcatttcttctgtattgtgatttttttttaagtgagcacttttagatgtcccatatggtttaaaccaaatcagaaattcatgtccttaatgtttcgttagtcagaataattaagttgatagttcggggagcagttgaagcaaaataatggggtcattgaagcagtcaagctctaatgggaacctgagctcattcagataccaaatctaataattgttctacacctgtatgcccagtcccattgagcaaattcacattaaaggtttagtggaacagtttcaatgctgtggtccaaagggacttgctactgttttcacaagaaagcactgaatattttttggcaatatatatatatattttttgtgatgtgttaactaagctctgtgcatgtatgttggtgccctatccctacctagagaggaagaaaagggagagatgtattttcaggaatgtttttcttaccatttagggttaataaagatactctcaagcatttgccacctggaagcaataatatgagatgattaaactcactggatagtttggggagagggggagtttggttaatctatgcaaccaactagaaatgaagttcacttaaccctttttcttcataaaataaaatggtatcaaggtatcaagcatgtttttttggggtttttttgtttttttttttgtttttttttgaggtggagtttcactcttattgcccaggctggagtgcaatggtgcgatcttggctcactgcaacctctgcctcctgggttcaagcgattctccagcctcagcctcccaagtagatgggattataggtgaccgccaccacaccctgctactttctgtattttcagtacagacagggtttcaccatgttggccaggctggtctcgaactcctgacctcaggtgatccacccacctcggcctcccaaagtgctggaattacaggcatgagccaccgtgcccggccatcaagcatgattttggttattgaagtagaaagtagcaattaagcattgtgtagtaatgcactgtttcatttctcctgtgtcactatatgactgtaacaacaaactgactgcctttgattctcctgtaagatatctaaagagagttgacaaacctaaaaaaattaaaggtctaaagagtggaactatgaatttaattctgccgtaaactgaccattgaactgacctatctccaatagaactccctcattggaggattcaaagcacacaggaaaattaaacgatttgcaatttacctttaacaactatgaaatacagatctgaccagctttctttatcaaaaaaggcaatcaaagctgaattcacttacctaaagaatagttctaatacacatgaaggtattcattcaaatgactcttgtgctctaatatttttatttcctttggggaattcaaaaatcatttaccaaatgtctcttatattacaggtaccaaaaaaaaaaagatttaaattgcagttgctgcctttccagagctcacgataaaatgggggaagatagatcgcacagggacaatcacagtataaagctcaagctgaatcttaacagatgagtaggagtttcttgggtaggaaaagaaaaaggaagagaagcatgatccaagaaagggaacagcatttatggaggcaataggagaacacagtatattcaaggaagagccaactgttaacattgctggaacataggtatgagaggctggaaagatgaatagtcatgataggccatgtataattagttcgattattttactacatgggtgataaggagccatttcaggcttagacttatggtagcatggctagatatacattgtagaatgattatcttctaacgatatagaaggctgatagggtaagggtgaggctagagacaggagaaattcaatagggatctattataagagcctaagcaacagaagcataaggcctgcactagagcagtgacagtggagataatgcagaataaatagatgcaaaaatgattcaggggttagaattgactgaacttattgagcaactggatatgaggataaaaaagggaaggattctcggatgatttattgatttattttatgattgctatatgatagctgtagtaattttattagggctgctgtgacaaagcaccacaaactgagtggcttaagccacagaaatgtattgtctcatagttctagaggctacaaatccaagatcaatgaatgggttggctgtgccacgctccctgtgaaggtgttagggaaggatatggcccaggcctctctcctagctcctggtggttttctggcaatctttggcattctttggctggtagaagcatcacgttgatctctgctttcattttcacatggcatcctctcttggtgtgtgtttgtctccaaatgtttcctttttctagggacactagtcataagggattagagcccaccccaatgacttcattttaacttggttacctccataaagaccctatctccaaataaggttacctcattctgctgtactggagcttcagagatccaatatatgaattaagggggacacaatttaacttataagatggctctaatcatcaaagttaggatatataaaaaggagggaataggatgaaaggaaatgaaatcagtttaatttggatctgcagtgtgaggtagctttggaacaatcaggagaaatattgagaaggtgattgaagctgtagcttagagcctgagaaatgcagagttgagatccattagcatgcaggagatagaatagttagagcagttaagtttggcaattggatgagcatacccctgggaagtagctcatggaaagtatagagttaaaatatgggaaagggcaaagaataaagtgctgaaaattactaacacgttgtgaccaaaccaaactgtgtctgtctgcacacaagcaatggaaagccaaacaccaaagcactgtgtttttgcagtgagaaagtttattgccaggcagccaagcaaggcgataggagtcaggttcaaagctgtctcccatactagccttgcagccatggatggatttaagggagagattttgaggctgggatctgggggctggacagtgattgactgtaaggaaaagggggttggaaattcccttgggcatgagctattgaccatgcacgcttcttcatgggtcttatgttcagaaaatgatctgagggtggagattttggccctctgacatcaaaaggtcactcaccaggcaagcaagtctattctgtgcagactgcagtcagacacattaatgggttccaacttgtcccagactgtaagccagttttgttgcaaactaagggaattgtaacaaagtgttttgttctctgttctcctgcaagacaagctcaagaaattttgctacttaccaaattctcaaggaaaaggatagtagcatagaaacagagaaagattaaagaaataatttgagaatgaagaaagaataataatatacaagctaaaagaaaagagagtttcatggaaagaataattgtcaacagtgtcatgtgctacagagaggtcaaggaaaatgaagactgaaagaaaaaaatgttaatactgactgcagaatgtgatattgattcaggataggccaattcataaacaaagtaatcatggaacataccctgtattttcaatagaatttcactctacttgttactagagaaaagaatgaatttatttatatagtataaaatttttatacttataaaaattatattttttctagatcatgtagtttttctaatccataagaaagtcatatctcctattttactgtctttcaaaaggtagttaaataatcctgacaaagggaatcgtttagaaacaatacatacaaattctgccttggtcttgaaattttgatatttatggttatggtattttgcgactaatgttcagaataggataaaatagggcatctcagaataagattataatgtggttggtcagaagaaagtcttctaaggaagtatctttcacttcaagtcattgtctgttttttatgtagttaatgctggagctctcagggctgctaaatgtcattttatgtactacttcacaatctaaccatacatattaaccttttccttcaacacccctaagaacagaaagctgtctctagaaccagctttaaagattcacagttagacccagagtaaaagaacagattgaaaagatagtttgtaaactatttattgtcctgcacgaatatgtatatatgggaacaaatgacatatttctatgtctataaatccttgtaaaagttttattcagagaaagaatcagcatgtatttactacatggctatttaatatcgagaaagctaataaagaggtagaagaggctcattctctgccatcccagaactctcctcttagaaaggcaatatctgaaatgatagtgagcagtacgaaattggctataattgaaagctgaattgtgtgaaacaagctaagtttgtgctattggagtcgagaggagagaaagatcagcgaaggctagagggatcgggaaggtgggatttgagttgggctttgaaggataagtagtcttgaatggaggggaaggagaaggcaaagtgggtacataagcacaaatctggaagatatatagatgtgtttgtggaacagttgtgaagccaacctaactagattcaagggggaatagtagagaatgggagaaaatctgattggatagagtgggatctgtgtaaaaacaaacaatttttaaaaacccagaaaatatgtactccatgaatctctcctgtacttttttagctgccacaaattttggggccaaatttattacacatgtattctaatctgccgaagctacatcctttagtgtgaatctgttcacttttatcttcatatgtcttctcttgcagtgaattttaatctgagtccctgaaagttaacttgttaccatttttattgttgtttttgtcttttcttcaccacttcaaattaggattgaaccagattagtcttgttttaaatccactgcagccttttgagctggggagtacggtctctttgagaaaactgttttctttctttttttttttttttttagaactaagcatttgttgcagtttattggcactgcatatttttatttttatttatttttatttatttttattattatactttaagttttagggtacatgtgcacattgtgcaggttagttacatacgtatacatgtgccgtgctggtgtgctgcacccactaactcgtcatctagcattaggtatatctcccaatgctatccctccccgctccccccaccccacaacagtccccagagtgtgatgttccccttcctgtgtccatgtcatctcattgttcaattcccacctatgagtgagaatatgcggtgtttggttttttgctcttgcgatagtttactgagaatgatggtttccaatttcatccatgtccctacaaaggacatgaactcatcattttttatggctgcatagtattccatggtgtatatgtgccacattttcttaatccagtctatcattgttagacatttgggttggttccaagtctttgctattgtgaataatgctgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgagtgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcacatgagtaggttgcgaaatttttctcccattttgtaggttgcctgttcactctgatggtagtttcttttgctgtgcagaatctctttagtttaattagatgccatttgtcaattttgtcttttgttgccattgcttttggtgttttagacatgaagtccttgcccatgcctatgtcctgaatggtaatgcctaggttttcttgtagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttttctcaggtttgtcaaagatcagatagttgtagataggcggcgttatttctgagggctctgttctgttccattgatctatatctctgttttggtaccagtaccatgctgttttggttactgtagccttgtagtatagtttgaagtcaggtagtgtgttgcctccagctttgttcttttggcttaggattgtcttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctaaccatgagcatggaatgttcttccatttgtttgtatcctcttttatttccttgagcagcggtttgtagttctccttgaagaggtccttcacatcccttgtaagttggattcctagctattttcttctctttgaggcaattgtgaatgggagttcactcatgatttggctctctgtttgtctgttgttggtgtataggaatgcttgtgatttttgcacattgattttgtatcctgagactttgctgaagttgcctgtcagcttaaggagattttgagctgagacagtggggttttctagatatacaatcatgtcatctgcaaacagggacaatttgacttcctcttttcctacttgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaaaggttgttgaattttgtcaaaggccttttctgcatctattgagataatcatgtggtttttgtctttgactctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatactggcctcataaaatgagttagggaggattccctctttttctattgattggaatagtttcagaaggaatggtaccagttcctccttgtacctctggtagaattcggctgtgaatccatctgatcctggactctttttggttggtaagctattgattattgccacaatttcagatcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtggtgatatcccctttatcattttttattgcgtctatttgattcttctctctttttttctttattagtcttgctagaggtctgtcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttggtgctataaatttccctctacacactgctttgaatgcgtcccagagattctggtatgatgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagggctttacttccaagtatgtggtcaattttggaataggtgtggtgtggtgctgaaaaaaatgtatattctgttgatttggggtggacagttctgtagatgtctattaggtctgcttggtgcagagctgagttcaattcctgggtatccttgttgactttctgtctcgttgatctgtctaatgttgacagtggggtgttaaagtctcccattattaatgtgtgggattctaagtctctttgtaggtcactcaggacttgctttatgaatctgggtgctcctgtattgggtgcatatatatttaggatagttagctcttcttattgaattgatccctttaccattatgtaatggccttctttgtctcttttgatctttgttggtttaaagtctgttttatcagagactaggattgcaacccctgccttttgttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacatttaaagttaatagtgttatgtgtgaatttgatcctctcattatgatgttagctggttattttgctcgttagttgatgcagtttcttcctagtctcgatggtctttacattttagcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttctttaagaatgttgaatactggcccccactctcttctggcttgtagggtttctgccgagagatccgctgttagtctgatgggcttccctttgagggtaacccgacctttctctctggctgcccttaacattttttccttcatttcagctttggtgaatctgacaattatgtgtcttggagttgctcttctcgaggagtatctttgtggcgttctctgtatttcctgaatctgaacgttggcctgccttgctagattggggaaattctcctggataatatcctgcagagtgttttccaacttggttccattctccccatcatttcaggtacaccaatcagacgtagatttggtcttttcacatagtcccatatttcttggaggctttgctcgtttctttttattcttttttctctaaactttccttctcgcttcatttcattcatttcatcttccattgctgataccctttcttccagttgatcgcatcggctcctgaggcttctgcattcttcacatagttctcgagctttggtcttcagctccatcagctcctttaagcacttctctgtattggttattctagttatacattcttctaaatttttttcaaagttttcaacttctttgcctttggtttgaatatcctcccgtagctcagagtaatttgatcgtctgaagtcttcttctctcagctcgtcgaagtcattctctgtccagctttgttctgctgctggtgaggagctgcgttcctttggaggaggagaggcgctctgatttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgcagtgtgaggtgtcagtgtgcccctgctggagggtgcctcccagttaggctgctcgggggtcaggggtcagggacccacttgaggaggcagtctgcccgttctcagatctccagctgcatgttgggagaaccactgctttcttcaaagctgtcagactgggatatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcgggcgcccctcccccagcctcgctgccgccttgcagtttgatctcagactgctgtgctagcaatcagcgagactcggtggggtagggccctccgagccaggtgcgggatataatctcgtggtgcgccattttttaagcccttcggaaaagcgcagtattcgggtgggagtgacccgattttccaggtgccgtccgtcacccctttctttgattaggaaagggagctccctgaccccttgggcttcccgagtgaggcaatgcctcgccctgctttggctcgcgcacggtgcgtgcacccactgacctgcgcccactgtctggcactccctagtgagatgaacccggtacctcagatggaaatgcagaaatcacctgtgttctgcgtcgctcaggctgggagctgtagaccggagctgttcatattcggccatcttcgagaagactgttttcaaagctggattagagattgactagaaaggaagaaagcctgagtatagtgattagtctacccaatgcattgtttctcaaattttaggtgtagtaaaagggatctgtggatacattttaatgagaacctaataattttgggtccccagtaatcgacttagacttacttttaatatattgttgcttaaatataaaaataggcataaactctatatgctttaagaattttaataaaacagataaaactaaaattaatgttcacttaatgtgcctactgattctagatttaatagtagagcttcagatccacttatacctttttttgaccttatcattacaaatgcagaacatccctgttgtataagtaggctgaacaaagtggtactagtaccatcagtcaacattttgtgatagaattcagggtcatcagactccataccaaatgaaaattttggtagagagcaactctcaaattccagttttaataggatgtctgctccagaaccttgtaaagttgtgttgctcacatgaagagaaggctaggattggaatataacatgggtatttaatccatttactgctggaatcaggaagcaaaaaagtattcagtacatatttaccactcaatttttagatagtgaacaattgcaagttggtccacaaggattacatccgtataatacaactgatcatgtcctgaagacggtactgactgttatgtcacagttctcatatgtccagcttgcctagactgttgtgtgaaagagcattgcaccctgtgatgactcaagtctctgaaaaattttctctcttcaaattatcatgaaaccttcattagtacagtgcacaataatgttgcttggcttttacgtaatataaaagcaaatatatataagcctttttgtatatcagtgatcagtacactagtcactcataaggtgatgatgcagggtatccttatgtaaacactttttactgtaccataaagtgaaaacacaaaactgtaaatataccctgttttaagaaataatgccctagtgagctccactgactttttttttttttttttaatgaaattggctgcaacattgggaattacatcatgtaattaatatctttgttacattgggctcttttagaacagaaacttactctggaccccttaagaaacaaaatgaattttacttccttctgtgtgtctgttcttttctatttatctttcaactggcttactgccctattgagtagtgcctttcatcacaaatcatgccatgtgttacctatgaattggctgcccctgaaggaaactgatgtccataatggtcccttcattggccactgttgagggggaaaaagcctatttagtactgctttcctaagtaaaaaaaaaaaaaaactattgagggtgatggtttcagctagaagtggtgttgggtacatcgggcacaatgacctgaggcaactgtttgcactctaagaaaatatcacccctttcagggtcatgggaaatccaagtgtaagttatattcattgcctccacttactcctcaaccttctgcaatctggcttctgctccccttatttcgaactgaaattgctctcattaaggtctctaatgacctccatatttctaaatctgatagtttgtctttattttactgcatctttctacaacatatgatattattgcttattccatttttcaaaatatctactcccctgaattccataacgtgtactgtaatggttctttctatgcctctctgaatatttgctgttttgtttcatggactcttcttcctatacttatctcttaaatgtcactgtttcccaggatttgatcattagcccactgcttttctcactttacgtacattcctgaatgatggctttgataaccatctaccatctattacccaaatctctctcactcttttcaggcctctcccctgaaccttggtcttgtaatatttgtaacggcctgctgggcaggtccactcagatgttttaaaggcatacaaattgacaaatccctaactgaactcatcatcacctggaatgcacctttttctcctatatattcttagatgatggaaccaccattctcccaaacatataggctggaaattttagagtgatcttggactccttttctttaattttagagtgatcttggactccttttctttcctacatgtccaatgaatccctaattattgtcttgtgcttattaagttcacctactgcatgatcaccaaactgaactgtcttaccacttcactccctattgcatatctgaagttcaagagccttaaaatgacacataagcccaatctgtgttctaaccatcatcccctgcttttaatcaatactgattttgtttgtcatcttcacacacactttttttacctcatattttctcttcctttcctcacagcatctccttttcctggaatatacttttcttccaggataattcatccatatcctttaagaatctacaacaatattgccttctctagaaagtcttcccaaagatgcttcccctaaggcttggctgagtatttaatttctgtactcctgaacagtatacccctcatcatagcacacactataactctcttctcattatctttgtatgctaaccgcatttgagagagaacaccatgaggcaaagggctgagacatttcattttggtatcaggggatccaatataatctaagttctcaaactgactcactgagaactatataacagagtaaagagaaagccttaatacatttccattagactaatttttaaaccaaaatgccacaatcactacatagtacctgccttgaaagactggctcatttatctctgtatccctctagcactgtgccaggcacatagtcaatgttcaagaaaagatggttgaaataaattgcaggccagtttttggacagagggaaatatgcctgacattggaacagactctgcttatgacagcaaggctcctcctctttcgagtgcataagtctactcaggaaaccgaattgaatttcagcaggttgcctggtaaatctgctgtcctagaaaaaaaaaaaaaaatgagtgaccggttttgctagatgcatcattcaagccaggctggaatctctagaaataatctctttctaccctaaaggacaaatctgtccagacaactggaatcctaaagcagcgaagtaatagaaagcagtctggcaacatttctatacccactggatgacaataagaaaaataagtaaatagttatgaaagattttcattgcttctcaagggcataaaaaaaataccctcgcctatgatgacttgtgaaatagagttagaaccttgataaattctgacttctggctgatctttttaagtctttgttttaataggctaatctgaaaaatacttctataaacatctgtttgcatctaatctcattgtcccaaaagtgactaaaaaatgtcatagtaccataatgaggctgtctagactttgaaaagtgtaatatgatcgtgatgctaaaatctttggaatttggctctcacaatatctaatatttaaaatgttcagctttttctctgtatcgggtgccattctggtcattttactttattgtttcattactaaagtctttgtaactgccctgttaggtgggtctttaatattatttttatgttcacaaggggaaattaaaatgagaaaaacatagctcttaagtggcagaacaaagatgtgaacccatatgtatggccatacactgagaactttgacctgtcacgctaaattgtgactatccattgtaagtagaaacagttttttgcttgaggcttgtttattgatttgtgtgcatgctcttcacatccatcagaagattagtatgggccaggtactagattacctcatttagttctgttaatactcttcagtgtaagtaccattattatccccatcttacgaataaggaaactgctgtttagaaaggttcattttgcgaatgcataaacgcaaagtgggcctaattggttaggaaacaaatgagtctagtagtctacattaataagttcaaagactacacatagcagttagctttactttgctccattgttataagtggtaagaaagaatataatgcttagtgctaagacttccctttccaccccacactgcctgcactaggaagggaaaattaacccggaatgcatgctttactaaacatcggtcagtaccttttaccatcaaaggacagactttttttttttttgaagtctcatgtgatttttatcattgaagtaaaactctctccaggtgatgtaatgacatacctcctattttttctggatttttacccatctgtttggagagagtcaatcttttagagagaatgactttttaagactttaacttttagaatttataatctaagatacgtgaaatacctttataaatgataactgtgtggacacaaatttattcatgttctaaaatttgtaagccatgactttcccatcagggaacattccacggcccttactgaaacagggcagaaaactggcacctgttttatatcctttttttctttccattatagtatacttagtgatggtataatcaacaaggaattagtttagagattattggatcctatgctactctttcttaaaattgaaaacaatatgtactttgtagctaaagactgagaatttaacatcctatctagattttgttctctagtttgacaaattaatcatgctcaatgccaaaaattcagatattatagaaatatatatatatatatatatatatatatataaaagaatcagatggttgcggtggctcatgcctgtaatcctagcactttgggaggctgaggtgggtggctcacctgaggtcaagagttcaagaccaacctggccaacatggtgaaaccccatctctactaaaatacaaaaattagctgggcatgatgacgggtgcctgtaatcccagctactcgggaggctgaaacagaagaatcgcttgaacccaggagacggtggttgcagtgagccaagctcgcaccactgcactccagcctgcacggccgagagagactccatctcaaaaaaaaaaaaaaaaaaaaaagagtcatcccaccattcatagatagccactattttttattggtgtatatccctctaaactttaaaaattataatattataaattatatttttttcaaaaagcagattatgacatactcttataacttgcctttttcaccttatcatatggacctctttttatcaagtacatgtagatctatgtaatagtttagattgactgcatagtatcccaatgtttgtaggttccctgttttgtctaatcccatgatggacatattggttatttatgatattcattagtataaacaatgctgcaaagaacatcagtgtatgatgatctagctttatacatttatccgataatgtgaggactggctttgtcccaatagatgtaaatgtcaggaatgattctttgagacatcttatatgagaagcaagttgctaggttagtagccatttttattcatgtataggctcagcctggcactcaggttgtgcatggattgtgttagacactagaaatataaaggaacttgtgccaattatgaatatggaatcaagaagctgtgttttaactgtgtcctaattgttcatatttaaaacaacttttgactggcttctaccttaagggacaatttgtattttaaaacaatggcaccgacagctgttaaagtgtgtgtgatattaaccatacaggttgcctttgttcatacaactggttaagtaattaagcacaggctagcatggggaacattgctaatgggaagcacctgtttatagactcttgcattgtaagctgtaggttaagtatcttttatcaaaatcataggcagtggtatatttctgtgatctggttctttgggaaatggagacatcatgcagggtgaatgaacgactgccatttctgcctcactgctgaaactagcgagcctgcatatcaagggtacctgggcttacttaagctggggagttggactgactaccctaaaacttccatcatcagcaagaaatacgtagcccagacccaagagatgggttgcacatgttaaaaacaaaaagagtagatacatggtcttagagtgattcagaaacaaaggcagatgacaggtaagtgtattctaagtcagcatatcagcaacaaagttcaggcagatcacaaacaactgcctcagaaaatgacagaggattgtccatcatgtgctcaaagttagagaaatggctgatgcctactattcttagtcataggcatatatgccacacatggagtagaaaggcacagagatgacaggtgatagtaatgaattgaccttgtagccaccatgccgtttaacagctagtttattctccaccaacccaaatggctgcttgagctctcaccctgccaaacactcctggcccaggttattgcaatctatgccttcatcggcttttctactgtcactcttgatactatctaggatatctaggcttcaacaatagaacctcttcggaagatttcagagagcccatttctgctcactttttaaagcagaactcctgttttctatgtaaatgcttcaagactgtttttttaaaaaaatagaattaaaattaaaattacatgtttattgaaacagctgtcactgtcttagttctaataactacaagtccagtcagtatattttatttcattattttcttccttagaaaataaaggttaaatatgtatagacattctggttcttcctttatacattcattgcttttcataccctctttgcaaataggaaacatttagtcattaaatagcaatattcgagaactagaattccctttttctgctaatcaaaaattaacagctatctttctgtttcttcttgttgaaatccccctatcttttaaggcttaactgggaagaagttgtccctgactcccagctcctgtactcaagggatatgatttttctccactttgaacctccattgtacttaaaatgtaatagatgctacaagagacaatatagttagtttcatgttctagttgttggtacatttatcctttctaccctcataatgtgcaagggtgcctgttaaggtaccctgcagatagcttatgcagtaacaacgtgtggatagacagacagaagaaagcctttcctttccttgtattaatgtcaaaatacattccctctgtgaaagcagcagagctgaaggtgaattcaaggatcagtttctgatttgatgctaatgattggatgattatttaatcaacagacaagtttctagaaactactatgtataagccactatcatagacaccttgagcatctctgttgtagtttgtgtggtttctgttagcttgctcttcaatatgtttcacatatataacttccttggaagctttaccagctattgcctaactttcttcatatatttatttgtcacctttttctgtattttctagatatgcaggcatcctcatcagactttgaacatcatagagagaaaatctgtcttacgacccaattgcattctctagtaaagaagcaaacataatgcatggctcatatacaaaaccaaggacatttaaaaaaatctattcactagctttgacattgagtccaaagataatcaatggcaaggtctgtggcagttgaaatactgaacaatatactgatgtaattttttcttaaccatacttttctaagatttcttgaaatgcccatgttatcaattatgtaaatgccagtcattcagaatcccaagagattggctgtacatgttataaaaatatcatgtttatggtagataaaagtaagtattgcatattttctacatttgtagtttaatgtggatacatttttaatgccttgaattaatattattgtactatgtgattttacttttatcaggtatttcaatcttcctaaagttactataattgagtttgtttgataatgtacctttacattagtacgagacttgatagtttgcaaaatatgaggttcataatagagatggagagtagagttactacctggcagggaggataagaagaaagtgaaatatagaaaagtgatttaatctcactactgcagttttgtaaaatctaatttgtttttcccctagcacagcagagtttcatgttgataacaagctactgaattaataaatccattgcaactattgagatttttcctttaataacataacgaatgctgagcattaagaaaaggaaaggcgttctttgcacagaagttacctctagcagatctacatccctatgcataggaacaataccaacatcataccgtgaacaatatcaatgtgaaagtaatttgtgcatctcaattagaatactgtattttctacacaaaagcactctgtttcatggaacacatttgcttattttccaattggaaagacatttgggggtctattttgttatcattacatgtgcttaactccaattacagttaatgggagtcgtgtgtctatagtcacagtagcctctgaactattttaacattattgctttccattaccatcctcgttaaaataactttcatctcttctaccaacctgaactaccacagtaatctaggtttctgttttctttgcacggatttatttgcatgtaatgaaggatacagattacacaacatgacctgtttctagtttgcacattataatgtcattgagattagaataggtctagaactatttaattgctaagtggaggtaatcgattggcttctagacgagtacccattgggtttgtttatctagctgtgttatttttaagttgttttgggattatagcatgtagagttctaaaatgtgtcctaaaaaatacatagtttaaatgaaaatatgagtaatggaggtttaactccaccagatattaaaacatctcatgaggctgaaataatgaaatcaggagctattggcacaaaaatatggaataatctcaatgtcaatggaacagaaacccgagtatagcaatttatatttgataaaggaggtaacatgaatcattatagaaattcatgattattcaacaaatagtgcaggaacagcccatctcctctttgtaagaaaaaaaagaaacaaactggtgtggaaacttacctgacattgtacaacaaaatgaattatagataatttaaatagttacatgtaaaaaaaaaaaacaagttaaaccttaaagagcaagaactcatatagttgaatgtttgtcacatgtctctggctagagaaggactttctaagcttaaaaacaaagaaacaaatcacagtgtaaaagattgatagatttagtttcataaaaacagcaaaaaatgaaaccatatattcctaaaaacctacaacacaaaataaataacaatcaacaagcaatcaacaaacaaaggaaaatatttctaataaatatttcaattgtttagtatccctaacatgtaccatttaaaataaaaacaaaagcagaaacctaagatcccaatagataaatgggcaaaagacatgatcagtatagaaaggaagacatatgaaacgttccacctaattagtatttgaataaatgcaaaaagaatgaatcagatgcaattttttcactttttatattagcacatttttaaaaagattaatacctaacaaagagataagatacacaaattcatatactgccaattggatttaaattaatacaactattctggaatacatttggacttacttttgcataccctaacaatgccacttctacatatggcatatgtaaagatgtaactgtcatgttccagaagtttaatgacatggaaaatttctacaatacaatattaaatgaaaaggtagaacaccaaactgcatatgtagtttgagctcagtatatatatatatatacgtacacatacacaaaagacactattctggtcacagtgaggagaaagaatctggtcaactagtagagcaattggctgtcccccacaaagagattaggctcaagcctaatttggctgccaccttgcagtcatttctggtgagtaaaaaactatttccaagtcaggatttctaaaatcacagagaaaagcataaataaaaccattttggacacaagggggaaaaaatgtaagtccatatgagatgatttcagtataacagtccaaaataaatcatctttctctcatcagtgcttgggatgcaaatagctactctatggacatttttggaagcaacataaaaagttttcttggtttccttagcctaagctgcaatagacccagacctctacttgctctctttgccagaaacaatgcctgaccactgatggtaaatctgccacattgtcactttcaaagggctttggagaaagcaaagctcattgtaaattacagagggtttcttttactttgttttctagcctactaattggcattaaaatgggatattttgtaacactatgtatataagggtcatagacttcgtttatgttatcctgctgtgagggactagtatataatgttaggtcaacactggtatctctacatgcctatgaagcaccatagggaaagaaacagccttcccctaggcaacaacagatggacgcctaaccttgtggggaatgaataatggacgtggcccttttataacagtttttttcaatcccaagtttaccgcctcatgccatattcaagatacagccttgtacttttggcactcgctcactgtgttagaggattgtttgcacactcccaggttacataatgcagctcgagtcctccagtctatctcatgtcacattgtgtttaagctttatctgtattgtgcttattccccagttatttcacttgacaaagtcttcggtaagaaggaaattaatgatgtagatttaggtgtggatctgaaactttgtgacatccaggtattttgtggatgatgtgctttgtacatagttgctgaataaatgattgcatgaatgaattctgaagcaatactataatgggtttagtccatttactgcaggactcagttaagaaggttttgagatgaatgccaaatcaatttatgcttagaaaaggcataaagcttcttactcatatgacagcagggaaagccttgacatctgtttgagctggttaacctgatattcagaagctgcagaaccatgtttaagctgggccatggttttatattcctttttagtgaaagatttgaatattacttttgttttggccacgctttctccataggatgcacattttcttttctttctttctttttcctctctttctttctttctttctctttctttcttttctctttcttcctttttcttttctttttcttttttcttttttgagacagagtttcactcttgttgcccaggctggcaatggcacgatctctgctcaccacaacctctgcctcccagatttaagtgattctcctgcctcagcctcccgagtagctgggattacaggcatgcgccaccatgcccggctaattttgtatttttagtagagatggggtttctccatgttggtcaggctggtctcaaactcccgacctcaggtgatctgcccacctcggccacccaaagtgctgggattacaggcgtgagccaccgcgcctgacccaggatgcacattttcatataactatgttcctgtcttcaaccttatgctttaaccaggtcactcttcatagtatcagaatctattcaccttcacatggggcacatttcaaagcctttgatgaacaaaaagaatctgttagcgcatgcatagccggctctggtagatttggaaggtccattttgggattgatttctcaggcttattgctgcattaaggctcatgtttacaaacattagaatcccttaatgaattcttagaccataatgtgttagtctatgaattaagaaaaatgaagcagatgaagaatatgacaaatcatgttaccccatcctccaatcaagcgtgtttttctgtatttcattgcacaatgtccccaacaagcatatatacacagacagaccctcctcttccatttttctctctttgatttccaaaaagataacaggcagattggaagggataccactacttgttaacaaagccctccatataatctcaggtaaatacatgtgttgtcaactattgactttttgaaggagaagcctgtatttttttcacttaaactatactagtattaggagaatgagactagttagaaaagtgaattggattcaggctgggtctcatggagctctcagatcatatcacatgagcacccagtttctccacctgtttccaaagaggacatacaatcatggccactatcacccaaattaatgtatatcacctctggcagcaatcatatctaacatttgtcctttcctcataaatgtgatgccaactatgagtcctgaccttataagggccaggccactgctttttccccattcgtttttaatactataaatataaaagttgtatttcaaacaattgagtgattttcaatctctgcttaaaaaacatgactccaaacgtggaagtcgtcatcattagattgctagccactagaatgtgaagataaatgaaatcaaatttacacacacacacaaacatgcagagtataagagtatatatatgtatatatatttgttggtttttaaactaaattagttttaacataaatacagagagttggaaataaaagatccagatcagccattgctgctattgtttctaatgatatttttttcataaacgttgtaggttgacattgtgaaaatgtaagtggcaacttttacagaattgcttcttataattatctcattaatattgggacaaattaggcatccagagaggtgtgggaggtggaggcaaagaaggaaaggagaaaggaataaagggagggagaaaatctagaataattctgttttgtgcatgtcaaaagctggatttaggccctgaactcaatgtttatcctgccttgcaaaagcttccatgtcttttcgtcagtttgttttgacccgaaactttgttttctcacaccagatgacaccagtaagttgcaggttgatgtgaagccttacatcccatcatttattgctgcaaagctgggtttttggatgtggtacttgtcttggacccagtgggtagtgagtgatggtgtggggtgccagtagcattactgaagtgaagtgtggatgcctgttgaccttagtgtgtaggaccaccaaggcacaagccttttttcaagtcagcatgatcctctgggaatgctaccgtcattctcacgtctggtagctttaacactgaatactttcatgctagcaatgcggtgggaaccattgtattgtaatctcatttttaaatgttttctaagaagtagaaaaccaatctgtatgcaaaccagtgacatctaagtaataagtcctttattcgggaatgttatcttcacatttttagctgaattgtgatccatatctcaaactaaataatggattttttaatggtatcttcaaaaggacacccaaataatccatcactcagatatatctctgagtagagaaaatgcctctttctttctcacctctcagtgatattattgcatcatgaagcactcagtatgctttaagtttatggctggttggctcaggacacataccgtggtgttaatgaggctggggtcatggaggcccgttagctttgctctgtttgctgaccacagactaccgggaaatcagtcaagagatgctagcacagacaagaacggcaccatggcaaaacctcagtagttctcagtttttcctccccatacaacaggcaggatgtgttagttgggcgtcatcatctcaaggaggaaatgagtagcagcttgggaggccccaacctttaactctgaacaaagcaggcctgacatttaggcattaactttgcattataatcccccatcataccattgatttgctgtgtaaccttcatcactaaagcagagataataggatagaatgaaatgggcttacctcccggagatgttgtgtgaattagcaaattaacgagtgtaaagtgttagcatttatgtaagtgctggtggttgtcattatttctagggacctagtctcattctaaatagagaatctaagtatattatgcttttgtcagaaagggattttcaccccacatcaattgcatttaagctgagcataaaacagaggtgataataacatagtagtgatcattgcaatgcagagctgtaaaccttttccctattaaagctagaactattttcagcaactttcaatgcttttaaactttgttttccaagttttgttatctctataataattattcttcctgtgatgggtggtgggaatgggacctggaataggtcctattcattattcattcccatgatgactatataatatattgaatttttttacatcatacaatcaagcaaatttggtagctagtgtgattgccacatattgcaatcattgtaaaaaataaaaactcttttctgctctgcctatgctggtgtcctctagaggtagccaacatacagattgaaaactcatggggaattgaagtgctttccaacaaaaggtgctgtatatagatcttttcaatttaacatctttaccaaagaattttgttgttgcctgctatttccaaggggactgtgcttgagagactgcttccatttcttttatcactctgacttcgcttaccaagaaaagtcatttattgctgattgcagaactcttgaactcagccgggcagctgccgcatgaactcctcagatctgagttccttgttacttatttacattttcatttgaagtgatttttcaggactatttgaaaacctttctcaacctaacatcatgtaatagcaaagatctaaaacttaccatgcttttggtcctttttctgtttgtcttacagataacagacgagtacctttggaaaggtcacgctctcgccacaatggagctatctcatctaagtgattcctgatgccaaagaatatgaaaatatttaagtaaaaacaaaatgatgcattttgagaagaacaaagtgtgcactcagcggctggaaaggaaataagtgcatttctgcaaagatcaagataagctggatgaagtagtgtgcatttgtaatactattgcaagactcctcccacaattattctaatctgaacacagttatcaggattacaaaatgtgttccattttagtgtaaagatgtgtatcatttgtaattgtgtgtgacctgactgtgatgatggaagtgtaagaaattgaagagttctaaggctttcaaaaacactcagtcaaaaatttaaaatcttaaatgtgtaagtcacccccaccaaaaacaaaagagaagaaaaagaatagaaagaattatccagtgtcagcttccaatccctagtacatatataatagaaaagggccaagaaaaatatgcatcttgatttggagagaggctaatattatgcacactgtaagagaagccattttggaaattcacgaaagtactgctccaccccagttgagttatttagaattttatctcaagtgaaagctgatggattcatctgctttggctgaaattaaacttatcattagtctagctagcatttcagcatgatattgcaagcacttctcattgctaaaaataaataaaccaaagtttaaccgaatcagttagggaaagtgatttaaactttatttaaagaggtattttctaattatgcacagatatctactttatacaaatactttatatggctatttttgagaaaaccctcacattttaatgtttatgctagggatgaacctgaaaattctattacgtttatttagatttcaaaggcaaatattgattcctatgctctgtggtttatttcttttttctattgcttctttctcccttgagtcccttgaaggcagggaatagacttctagaaaacctgagaggaaaaagaattctttttacaggaggcagcagaaaactgtctgaaaggtcaattgttttatctccctttccactctctttccaatttcactttggtggtctgaagaagaaaaagaaattttatgtatgtatgtgtaaatatgtgtatatatttctatctcttgctacaataattccaactaagtgaacttctcaattatcatcatacttacttaccttatattaacaaattaagatgatgctgccaaaacaagtctagcagggaaaacaggttctacatttttcttaaataaattagggagtaaaagtta

SEQ ID NO: 2416 - DNA, 785177 bp, Homo sapiens
gctcggctgcgggagtaggaagcagctttgcgcgcccgggcggccgatgcgggcactttgaagaatcacgtgtgttgaggccctcttaaagagataggcacctacttttccctccaccctaaacaccgccctgagggcggcggcgaccgtggtaattgcaactgctcaggggcagggcttgccccagcgccgagtagtggcaacggcgtggttgcgtcgggggtgcctgggagcctggagtcccgggggcctgaaatcggcagcttcccgggcagacactctctccctcaggaagaggtgccgccgagtcagcgcggggcagtgtgagcgccccgaggtgctttctcagttgaggagaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattggtgagtgctcccgcagcccccgccggccttagggacagggagagccccgggatcctcctgccattgaacacgggggcacccggggccccctcccaaggatgaccgcgacctcgctgtgcaactcggggagccgctaaaggagtggccacgccgaggcgcggagacggcgtgggggcggaagagcacccccttctctacttaacccctttctcactcttgtcagcccgggaggcggtgcgggaaggagaaaggcccagccccaacttggggacaccccgagtactgggtagggctgttgtttgtctaacttgtgggcgcaaacctttgcgcgattccattctcctcccacttcttgttagttgctgttttgcctcctaacgcgtagggtccggggcaggggaacctccctcctttttattccaagtccttgggagcccacctacagcttcgcaaatcaagaagaacactatttatgctcccagtctttctactttaccagaaatctcaggaagaggcgcctacgtgcctttttcctcctccttgcctctctccatgtgctctcccaagaaatgtttctttggaagggtgggggcgcgtgggagtttgaggctgggtgaggtaccaccaactgtcgagtgtgtgtaataggcatagtcatacagtacttccacttagttgattaagaacgctcaaaagcagtaggcacaaactgtgcaaatctcaccgtgctgatagtgtgaaccgatggtagcagtccatttcctgccactgaatgtgcagaggaatgaaatcgatgaggcctggtattgcattgggaaatactggagtttcctcagctcatcagaagggttccgctttttgtaaactttctaatttgggtggtgtgaggggaaagggttttcctgtacaaattcagcagatactccttagagctgtattcttagtccagatccgaagcacaagccacatgttgaatgtatagatttcagctttaactaccaacttgattataatagacaaggagagggtgacatataaataaagccgtttcttatggcatctggccatttggtttggatccagtacaaaactgtggtttaatcagtgattaaaaatttaagtaaaaagttaactgatagtttccacaaatggtttggtacgtctagcaagaatctgccacttttaagaagtatgctttcgagaaaaaaaaaaacacttatctctgttagtagtaacaccttgattatattcttctcttccctttagccatttgtcctgattcatcttttatgttttacttgctttgacaaggtaactagatagttatgagatcgtatcattttcagttcctagctaacttcactgttccggttcctagctaacttcactgttccgtgttgaacatagcttgatacggtagaacaagatttgaatccaagagtttgttaatattaacatgaattttctttttttgctcaaacataacttttgagccttacgtgattttacaagcagatgtgtcagagttaacaaaaacaaatttaggaagacattgtggcacattttaaggcaagcaagttgaccaaacagtaagatttagtaagcttttcaggaaagaattcatctgggattcttagaagtttgctagtaagatacaactttacttagatgaaatttttttattttgagtattatgttaataatctctgaactagtccttaatttgtgtgtgtatatgagtgtaaaggagttgtggtatgggattataaaagagagccatatggtgatagaaattatttgtgtaggtgatcttggggcataggggttcttaaactcctgaaattgtatgaaaatatttgagtgtatatgggtacatttatttttctgggccccatggctttcatcagtttttcaaaggcatccattacctatagaagagtaagaactatggcattacaaaagatagaaagtaaaggaaagaatagttgattccactctaagttactgagtagggaagaaggggaaatggcattgaccacacaggtgattgatattgaaacgaattcttctagtggtaaaaaagaagttaactactcaatgtctacatagattaaaatttccgctacagaggaaaattaattcagtcgctccagtataatggattcataaggtataaggcttgtgtagtttggttgttttcatttagttcctcagaattctggaaaaatggaaatggaacacatattttcttttctttttttttttttgggacgaagtctcgctctgttgccatggctggagtccagtggcgcgatcttggctcactgcaacctctgcctcccgggttcaagtgattctcctgcctcagcctcctgagtagctgggattacaggcacgtgccaccacacccagctaatttttgtatttttagtagagacgggatttcaccatgttggtcagcctggaaagcagattttctatagagaggaactgctttcatttatatcctcaactttttaatgagtattagtgagaaatttttcagagtggcatttcaacactataatgatttctatttaagattacttaaataaaaatttaatggaattcacttcagtttttttcatataagcatcctcataatgacccttttgttttgattcttttaaaataaggcattcctgtcttggactcatcacattttgaataatgcattagtagtagagttttggattttatgtaactattttggttaggcccagattgcaacatgtcatcaaacagcatgaatcttagattaatttgtaatttgatgtcaaccatggaatgcattttgttaaattgagtagaagagaaagctctataaatgttgtgaaggaactacatcttgaatcctacttatttaaggcagtgacttaaccattaagagaggccaatgttgatgcagaacaccgcaccccacaccacacggtagtgtagagtgacctaacagtatttgatgtttttgcatttttgactttgtgttcctgcataatttctgaagcctttggttcttcaaacagtaaagtcaaattagttaatttttctggttattatgtaacttcctatttggttatttgtttacaactggataaattatgtttttatttatttatttattttgagacggagtctcgctctgttgcccaggctggagtgcagtggtgtgatctcggcccactgcaacctctgcctcctgggtgcaagcgattctcctgcctcagcctccctagcagctgggattacaggtgtgcaccaccaggcccagctaatcttttttgtatttttgtagagacggggtttcaccatattggccaggctggtcttgaattcttgacctcaagtgatccacccacctccacctcccaaagtgctaggattacaggcttgagccactgcacccagtcttgatttttaatgataaggtatgagcaacaatgatttcatttatgcaatacaggtttactgagtacctactgtgtgctaggcataattctaagggttggtgatacaaagatacttgtagtctactgagacagacagggaagttaattaatgcttaaaatgcaatgtgagccagacgtggtagcttgtgcctataatcccagctacacaggctgctaaggcaggaggatttcttgagctcaggagtttgaagctgcagtgagctgtgactataccactgtattacagccttggcgacagagaacccatctctttaaggaaaaaaaaaaaagcagtgtgataagttgctataggaatatgcatggttgggggtggtcatggagaggcatctacgtagaattgcatgcttgagtaagaaaaggcttatcgcagtaggtgacatttgcagctgaaggctgaagaaaataggtgagggaaaggcattctaggttgaaaaaacaacatatacaaaggtaaacagataagggagcatatccaataaagaaagttcacttagatgaatatggctgaaacaaagggtacacatggtagacttgctagaaaagagacggggtccggatcatgatggatcttgtatgccatgttagagtttcaacttctttctgaaagtaggggtaacccattaaagagattaaggcggagaatgacctgatcagatttgggtttcagaaaaaaaagtactttggagaatttcttggaaaagcatgctagaatggaggcaggaagaccatttagaaggagcagagtagcataaaagagtttttgatatttggagacctggattccagttgcagcttatccattcattcatttaccagctcatccatttactaggtgtttttctctgcacctcagtttccttctgccacctcccttgcctctccttagtaccacacaccctgaacatccccaccaaatctgaaatggccacccctttctcttttataactttcaccccctttcacagcccagctcatgtctcaatattctctcactcttccattaaacaccgattacttcagtttagtgagggctttccttcttctggactcaataactgtcatgagtctgaatgttacatgctgatcttgtctctgcaaatattttaaactgcctctgggaatgggtcccattttatgtctattcttgaaaacctggcaggccggtgcttgggtgcaaaactattcagtaaataattattagctggggatttttttcccctatataccaggtattttgagagtgtaaattggtgaaaagaggctttttaaaaaaatgtttatttgtatgtgccttttttttttttaaagtatatgtactccatcaattgaacctatccatacattcctctttgtcttttctccaattttgaaactcagtaaacttcttcagggctgtgagaactcttctacccccagcttgtttgaattcttgtgatgtcagagcctaaacttccaagcatggaaacagtaccaacaacgatgagccaagtaacattttactcttattagcaggagacttcatattattggcaaaagaatatggaacggagagccaaaagacctgggttccagtgtcccatctgtcttttatttgcttgtgatttctgatgagccatttagcaccagaagtttgagctctttgattaatgtttgccagttggggataatgctgcctgcctgatttgcttcacaaggtgttttagataaaatacagtaaggaatgagaaagcattaggaaattctatattgttatacaaatatagagcatttttattaaccccttatattacttgaatcaaatatgattatggttggatggtttaatgtctttcttgcattttgacagcactaatgttattattgtataaagtaccataatatggttatatgttgaaagattccttattctctccccaataccatttgtccctttggaggaatatgcattctatccttttactaagatttcattctgttgaatgaatataagatgtgagtctaatttttttccatgataattttttggaggactagtctacccttttctttcattgtgtcaatttgaggcattaaaatttttttaaacaaaacttccatttgatatctgtgacattatgccttgtcaggcagcttactgcctttgtacaaataaagaaactgagtcactgaaatgttaagaggactgctttagagataagtttaaaagctacctcctctattgtagaaattatccgtagcactgagtcattgtgcttcagggactctgaaggtgaaaaagttattcaatttttcttcttttgttcctttttggaacaattctaattgtaatccacctagatattattaagctctggcagtagcaacatgttactgaagtgaaatcatgttcttttccaacctgctttcaaagaacactgtaaataacagcatacataatatatgctaatttatataaatcagcacatctggttaaatgttactgggtaccactagcactacaggggttattgttgaagacccaactccagtctaccatgcagaagaaaccggttccttctgctggatttggggtgtttgatacatttttttcccctcaagacaggagaaactatgatgatgtccaggtaacttaaaatatagttattagcttgatatccaagtgggcatgttgtggaagacacccattgtgggatacagctcaaaactgatgcatttaaagaaagattaagatatattttcacatagctatttattgtgaatgtcagtaatggagagaaattaactcatactgatttaaaacttattttcctcatcaggttgagtctgtttccaaataatatactctggctgtagcttaaacagacaactgaattctggtatttaactgactttgtgtgaggttacctggcagggaaaggtattggtccctttctcatgaaagaatgtagaaaacaaaattcttacttatcaccatttgcacagtctttggtttactgaagattttactgtattgctttaaggagagtaagctacattgctacaaatacataccagcatattggccaccagctgtatacagtgtggcctatgaatgagtgagaagcttctaggtagctattaaggcaggcctaggtaggaatccaacactttattaggaaggaattattccgaaatggctgttgactcaatcacctggcagttctggcactcacccaagggagaagagattttgggtacaatcctttttaaaaaatctatttgttgttctgtgatatcatagacatccaggctttaaaaagaaagatctgctcaaaattaagaggaattttaacctacccttaattcgttggtctgttattaagctaaaagtaaaagaaataaacttttaaacttcataatatgagccagttaatgagacttttttacaaaacttaaacaaattttcaaacgtgctaaaaagtagaatagtacaatgaaccaccaccatctatccattgcccagatataagttatctacattttgcaacatttgcttgatccatcctttatttttcccttgctaaagtattttagtgcaaatctcagatatcttgtcattttactcctacatactgtcacgtctttaaaaattaaaattaacatattccttggtatcatccagcattcattccataatcaaatattaccaattgcctaaaaaaattagatttttgatctaaggtgtacctaattgatatacatgtcactgaactccttaaacaaatacagctttaaattactggtaaaatcttattcagagttactccacataaagtgctatcataaagcctcagcccaaattaagttcacttctgtctttaattctgtagaagtatctggaaaggttgactatacaagggtggatagactccttggaacagctgttatgtaccatcaaaaatagaacaaattagttttggctttactcactggttgggcaatcactaattcttcattttgcaatttgtgaagtggggtggggcttatgtgtaagaattttcctttcagggaaatgctgtagatagttaggcaaaggaaaattattcttcatttctctagataaagcgttcatatgactctttgacattcacaccccaccacaacaactaagtttatgttactggctctagttttatttcaaaacaaatgccggtttggtctatctttgtttttcagcccctttgatatagtctaggttgctgaatctggataattgggtgagtaaacctttacatagaagttattcttattgagatgtttgtgggcttacaattgaaaatcagactacactaatgaggtgatggagctggggatgggtggagtaggtaaatatgagaaatcaacttgggcaaatggcctagactccacacagatttgctaaagaaattgtgtaactattactttccagacagcagtttagtgctgttattgtgctgagaggcaataggcaaataatttcactagctgtagactcaagtagatttaggctagtaatctgtctccactctgcaacttctagactgaccatttactaacccagtcagttgggtagttttcctcaaaacagatagatgagtgataattgttggagccagagagctggcattttcttcttttgtttggcccgggagggaaaactatggaggtggtgttttatgtgctctgaaatcaatcactgataaagtcttaaatgcttagtagtctattgtgctggctgaaactgtttacaaagattctatatgtagataggaagaccttgtataggctgtacacttgcattgtgagctttaataatgtatacgtataacagagaccaggtcggtatgtatgggtgggccctgaccaagggtgtgagaccacagaggtcacaccacttaccaaatcatgtgccagttacaagactatgtcttcctggggctgcgttttctgattcacacagaggcaccatatgggctagctaatacatttaaagccagatggattttagtctcatacctgataagaaattcagcaaggattccgggcatggtggctcacgcctgtagtcccaggactttgggaggctgaggcgggtggatcacctgaggtcagaagtttgagaccagcctggccaacatggtgaaaccccatctctactaaaaatacaaaaattagctgtgcatgatgggagacgcctgtaatcccagctactcgggaggctgaggcagaagaattgcttgaacccagaaggcagaggttgcagtgagccaagattgcaccattgtactctagcatgggcaacaagagtgaaacttcattttgagtagggatttcttatttgtcattggttctgagaaaagaatgtaagatgtatatttatgtaatatcctacacctgattacttttgcttttgaattattgaaatcttcaaatgtagatggctgtgcccttgagggcctaggttatagttcagtatgttcattatcttccccaacttaagggttgagttctgttatagctaattgtagatcaattagcttaaggctcctccctttctgcactcctttcagcaattttcttgacataattgtttcacagagttttatatggttacgcattatctaggctgcattttttttttttttagatggagtctcactctgtcacccaggctggagtgcagtggcctgatctctgcttactgcaacctccgcctcccgggttcaagcgattcttctgcctcagcctcccgagtacctgggattacaagcatgcaccaccacgcccagctaatttttgtatttttagtagagatggggtttcccaatgtttcccaggctagtctcaaactcctgacctcaagtgatccgccctcctgggcctcccaaagtgctgggattacaggcatgagctaccgcgcctggctgcattgttttttgaagtttgtaccatgcttatttccactttcattgctcacgatacagggcagaacatatagaaagttaagatgggttaaaacaaatttggcagaagcatttcctctgataatatgctctgcaatctagtacctcacattacaaaatcaacgtttttcagaagagtcagtgtgtacataaaatatttgtgagtgaaaataaacttcttagggtgccctcagcttgtttttcattgacattgcattagtttacattatctacctccccacccccactttggttgactagctaatggtcttttttttttttttttttgagacagagtctcgctctgtcgcccgggctgaagcacagtggcatgatttcggctcactgcaacctccacttcttgggttcaaaagattctcctgcctcagcctcctgagtagctggtatcacaggtgtacatcaccccacccggctaattttttgtgtgtttttagtagagacagggttttgccattttggccaggctggtcctgaactcctggcctcaagtgatatgcctgcctcggcctcccaaagtgctggagttacaggtatgagccacaacgcctggcgctaatggtctttaaacaagctgttacagggaagaataagtttatgattcaaaaatggcctggattttatccatgctggcagtttagattttcacgtgtttgttttacgaaagtagggcttccctgtattctcttatctcaaattcttaggcttcttcattacagcctatacttgcttcatcaaactgcattcagatggtcttgtaagttcccatgagagcaaaatcctacattttaatataagctgagttggtctgggacaaaatactagattttaaatggccattatctctgtataaaatggagctgaggtattagttgcactttacagtaggaactgtgtagggctctgggcccaatttttcacattcttcctatgggttctgttatagctaattgtagatcaagatatgttacaaatccctactttcaacctcctctctcctccttaaataatgttactacttgcatgtttataactctgaagggcatcttatttcttgttgtttttactgatttctgtgactattatcaatggtgtatcctattgtctgaccacggagataacaggcagaaggatggccattggatgttaaatcgattactgaacatgacagagatttattttaaagcatttcctatcctcactcatcaccacgtagttatgaactagtcaaaacttcattttgatcttagcaccaccacttcatgtttttcaagatgcctacattgtattttatggaatctaaatgtatttaatatgctatacagagttgaaataagctaaataggatatttgatcctattaagtgttttttaggagtttgtttctggttatttaaaaaggttgggctgggtgcagtggctgatgcctataatcctagcactttgggaggccaaggcaggaggattgcttgagcccaggaggttgaggctgcagtgagctgtgatcgtaccactgcattccagcctgggtgacagagtgagaccctgactctaaaagaaaagaaaaattttaaaaaaagatcctgtagagataagccgactactttttaaaaatgtgactctggacaagtcttttatttttcttctctctgggtgtcagtgtattctgtaaaataagggaatcgaaatagatgatctacaaagttccatttagctctggcatactgggagtcaaagtttattgaaagctgtaatacatctaccctaacataaatacaagacctctggattccagttagacaaaaagttggaattaggctgaatgctaaagagtgaatatcccagttaactttattgtcctgtttctggagtctaggttagcctagtctagtgaaggccacatcaacgtttctttttaactatgaattgtacggaaggtaatggtctgagccctagggaatgctggcttcctctgcgtcatcctgattcttgggaggatgctttggttcagtgaccaagtacagtatgcaagccttcccagagatgattctcaatagtacacaatatcataggtaccagtttttgttctaagtgctttgcgtgtatttgttaagaactgtgcaaggtctgggattttcccttacttacctacctgttaactgtttaatggatgattgcagaagacccaaaggacaaaagacagtttattattcattgcaaaagcagtagccagaatgtcagcatgacatgctggttcactatgaccataagtcccatcgtgggtagaccagcatgatggccacaaacggagtcagtgacattgcaggagaggaactctgagcttgggggtttgctacttttatagcattaagaagtcagcttgatctttggggtggggagatatcacctcatcctcaaggttgtttgctacaaacacagccatgggaaatggccccagtaaaatgctgtcagtgccttttagtcttggcatagccagcaagaatgggcaggggatgctcagggattcatggcagattgcctccttcatcagttttaactaatttcatcctcacagcaatcattttgtaggtgaagaaaacgtctccaagcagatgagtaactggcccgaggacatgcaaaggtgaatttagaattgaagaccaatgtggggccagatgtggtggctcacacctgtaatcccagcactttgggcggccgaggcaggtggatcaccagaggtcaggagttcaagaccagcctggccaacatggtggaaccctgtctctactgaaaatacaaaaattagccaggcatggtggcatgtacctgtaatcccagctacctgggaggccgaggcaggagaattgcttgatcccgggaggcagaggttgcagtgagccgagatccgccactgcacttcagcctgggcaacagagcgagactctgtctcaaaaaaataaaatatttttaaaaataaaatagaattcaagaccaatgtgactgtaaaatgtatgttttacaccacgattttctatactgcctgagaacctcaaggtagctctaaattgaagacctagtggttctctagactggtgatggtgggacctagcctagatttgcactctgcttatgtataatttagaagacagagttcaggggccattcgttttagtgccattgtcaaaaaaaaaaaaattctttgaatcactgccatgaagtaatgggtcagaaatgtgaccactaagaaaaagccaagaggacaaaagtgatatggctgtggattttaaggctacttgaacacagttcttaaaaataccagcctgtgatagcccaccactggggaaaaaaaaaatacctgtctagcagtctggcctttattaactaattgcatggccagcagaaggcctgtgtactttactactgttgcatattgcatatgattttcttgttgtttgtacgtcagccttgcagagactagcttctgaagaggttacattgcaagttatactgcctacttcatgttttagcttctctctctcctctattgcccacttcctttctgtttgtgatcttttgcatgaagtaaaagtgctttggaaaaattaatgctatctcctgttaaacaagtacacgatatgcattgtttcttgtttaggggagtgccaagaaccacctaccctctcctgctgcttcctgcgtgtgctttgcctaaagattggctgctataaaagtgtggtatattcagccaagtgctatctttttaattagtttgcagaaagtgttgtgacaaactatttttgtgttgacttgtgacgagtaatagacccctaaactacgggcgttaagtgccagacaatatggaagtgcataatgtagtttgagttctagtccccttagtttgatccatcatccttccccaaagaaaaagcccctaatttttaaaaatgtgacaggtaaaatagattacgaatataccagtatgtgtctggagcctgaaattggcctatttcttataattactaatcttaaacttttttttttttttttttaagagatgaggtcttgctctgttgcccagactggaatgcagtggcatgatcatagctcactgcaaactcaaactcctgggttcaggttatcctcctcccttagcatcccaagtagctggtactacaggcatgtgccaccatgccccactaaattttttttttttttcagtagagacagcattttgctgtgttgcccaggctggtctggaactcctggcctcaagtgatcctcctgcctcaactcagcctctcacttggattataggaatgagccaccacacctggcttgattaccaatgttaatgagctaatatttccatattggttctgttcatacaactgtgtacaacacagcatgaaactagaaagtgaaggatatcttaagctctcataatgatagagacataactgggaaagctgataattaagcagactaagaatcttagtaaatttttgtttttcaaatacttcttatcaatttttacaaattcatattttctctaaatatagtcctggttgttgatgttcttttgtttttcactccatctaacccaaagggcttcgtgttacggataaatatgtaaggaaggatatagcattcccatgtcccaaaaactgtgttgttctttttatttagaccagtgattttcagtgggggctaattttacctcccagggaacatttggtaatgtctggagacatttttggttctcacaactgggggagggtgctacactggcatctagtgaatagaggcctgggttgctgttctctatcctacaatcataggacattctctccagcacaaagaattattcagtctaaaatgtcaaggttaagaaactctgctttagaccctataacattttgtatatttagtgtgaaaaactttttgtatatttagtgtgaaaaatttctgtggctcctcagctgttctttactttccattctctcctttcctctctattcagacagggtcagctaatccctgtcttcatggaagcatggtttgtttcattgattcccgccaattttatttgcattttcttcttttctgctactggaaatctggtggactgcactgttgtgaactttttagttgtcaactataccttttatcacttacctcatttctgacatctaaggaaaatattcattttcatcgtagtgagtttaaaaggctctttttccatctgtggattctttgatacttcaacaacttttgatgctggtgacttttaactcatcatctatatgaattttatttatttatatatcattttgagacagggtctccctctactgcccaggctagagtgcagtggcgcaatcatggctcactgcagcctcgacctccctggctcaagccatcctcccacctcagcctcctgagtagctgggactacaggcacatgccatcatgctcagctaatttttgtatttttcatagagatgtggtttcgccatgttgcccaggctggtcttgaacccctgggttcaagcgatccacccgtctcagcctcccaaagtgattacaggcctgagccatgcatctggcctgaattttagattctatggtacagtcttctctgacaacttctgcctcttgatttgctgactgctaaagtgccagctttgtttgccttccatctcaaaacttctcactgttatctgttcttctccacatacaattgcaggcaatcatatgcctcttcaaataccacctggatgcagatgcagatgcagatgatgccaaacttttctatctactttgacatctaagtttgatactttgtcatcatttgctgagaggcatctcctgactgtgttgcagttctactaaaaactgcataacacctcaaatacttcatagtggtgtttttaatatttttcctttttacaggaaaaataaaaattaacttgatgctctcaacacacatacatacacatacacagacacacatggacacacacacactgtttatcaggtttaccttttcaagctaaggtttacttgcttcacttatcaccagactgtattattctgttgttagtcactgactgacctttatgatttctggtccagttgaatgaaggttaacttccctatttgaccagtgaaagtcagtgactccttctcattcaactcatcaggtcccactgtatttttacatttagggctactattaggcacctaattgtatcttcttccttttttaatttgctccccttttaaaagttgaagccgttaggtgtattgtctcatatgcctgaaataacctcttcttttttctgttctcagtgaatcctaagtactttctttctagttctttatataactcttaaaccctttattgcctacttgaaggtgacatgatcatttcattccccttcaatttcccatagagagccagttcatttctgcagcatgcatggccatattaacaattgtccttattataaatgtatgttatagtgttcattccagacacatcaaatctttgttatgtatggggcatcatgctgagggtataaacataagtatatacaggtcttactcttgaggagctcatggcctaatgagaaaaggacagatacatataaagtagtaaattctataataaataggtatgaggagaacgctcttgggaatgccgcatactgtgcttggtagggagaggaaagacttcacagaggtaacatttgatttgggtcttagggatgaagaacagctttgtaagattaaaaggcaagtttttttttttaagactagtcgagtgcagtagtgagaagtggggaaagagtagaacaaggagttagatctgtaactgactgtgaacaatcattcgagataacttactaccttcagaccagccaaggcaagccattcttaatagtgggattatcatgtatgcaagtttagagttatgtaaaggcacatatttgttttaagtgtcattgattttaaaatattaagatcttagagagaaggttgtgactgaacttgttttatgactgaacgtaggtgatcataggaaatatttttcaccaactcagaagtgggatagagagagggaactaacgtttagtgagcacctacagtatttcaggtgttgttctaggagctttacatcaccatcttaattttttattataaacacgtaggcatagttatttcccacatttaacaaatatgggaaacgagtctcagagaggttaattgattctgattccaaaatacatgatattttatgatagcattctgtcttcttcttacaagtaacaggctatatttaaaatctagaaatgagctgtaattttctattttttacataaatatgttttatttttctcctatcgcagatcctattaggagtctaataaatgtattttaacacatttcctttttgttggattacattagttgagaaataatagagcttgagaaattggctgggaattgtccacaaacatctaatttgtagctgtatctggttagttttattactgatgatttgggcaagctcctcagttggtaatattctacctctgaaattcttcatgttcaatagttaatctaatttaataaatgttttggagaagctcacctcagtgctgcggtaagcattatcagggttaaagtaaagaactcctacccactagaaacatagagttggagaatctgatgtatacaaacctgtggtgctgggtggaatgtgataagtgctactgtagaaggaaaaagtgctatgggagcacaaatcgtgttaattccaaatgaagtattagggatgacttcatggaaagataggcaatagaagagagtcttaaagtgcagagattttttttaaaacagttattgtgatagaatggagaaagggcattgtctgtagtgagaaaaatatgcatatctcagtcagcacaggctgctatagcaaattcccatagactaggtggcatatgaacaacagaaatttattacacacagttgtggagactggaagtccaagatcagggtaccagcttgatagagttctggtaagggccctcttccgagttgcaaactgctgacttcttgtggtatcctcacatggtggagaatggagagcgaaagcaaactctcttgtgagttttacagagtcactaatcccattcatgaaggttctaccttcatgacctcatctaatccttattacctcccagagacctcacctcctactaccatcacatggggtgggggttcagtttcacggtatacattttagggggaaacagacattcagtccatgacaacgcataactgcaagagagctaggaagttagggcatgtttgaggaaaaatatgagttagtctagtaaagcccagatgtatgtatgagagtggtggaggtcagtctggatggagagactgcagcttgattacataagcattcagtgctcaccataaacaatttggaattcattctataacccatgtagagtatttgagcaggagattgatgtgatcagagcttacaatcatatcttactttagacattttacagttggaaatatgaagtctaaaatcttatgtccaaactttctggtaattggcctgtttgtagtataaatataaagatatttattaattctgataccttttggcatgctttaatttgacagctttgaacttgcaaaattaaacatgtactgtaaatagtgtgtactttgataacttactgttttacagcaacttaattggcccttgctcccagcctactattctgtagatctgtgcctctaagtctaaagatcttgttgttgtttttttcctccacaaatagatcctactctaaaggtcaggtagcttagattacaaggctgctgctgtcaaactgaatgtgttgggtctaggctgaattacagtcttatagtccctggaatattccaagagaagctgcaagatttatgacatacaaaactaggtaaagttatcctcactagataaagttgtcctcaatcaagtgttatcatgaattttttttccgtttgcatatatcaatcccctatgacaaaatgagaagagatacattgcttacaactgtggcaaagtagtcttagggctatgatttgaactcaagtcccctacttaagataattcacttaaataagtggaatttttattaagagactccctccctccttttcttttcttttctgttttgagacagggtcttgctctgtcatcaggctggaatgcaatgttgtgatcatggcttactgctgcctcggactgttgggctcaagggatccccccaccttagcctcctgagcagctaggactacaggcatgtgtcaccatgcctggctttttttatgcagtgggttgtagctatagaaagaggacattatttcacaaggtataggctgggaaaatgttcaggttccttgtggggttacaaaattattttaaaaagatataggtctttaggacatgaatcatcttttggtagactactttctcatgagggatttgtgatcctggcaaaatcccttttgagcctttgaaacatgaagagcattaactacaaatgaagaagacaggaacttcctgagttataaatacctggccatatgaaaggcccttgggcaggggctcccctggtatgttgagtcaaaatattgcctggcctttttctcccccttgctactgatgttgccttgggaatttgagacccagtcacatcagagtactctttgtttatttctttctcagtgaccttcataaatgtgatagtgctgggaacaatcttctgaagcatctctcttacttgccctaccatatgatttttttgccaaaaaggttggggctgataggagcttttactctgctactggtctctcctccatttttgcttagtagtgtggagcacattttcccatgaacattattcctgtatttgatatgtattgtagtatagttcagtttcctaatatgtttagtgcttaaagatataggtcatgagatacaggtacttgttatcaaggaatttacaatattataaggaaaacagctgtatataacctcagtattcggtaagttccatatgaatgattcagatttaggaacaggaaagattaataatttggattaaaatagactaggaactgagtcactgggaacttctcttcctccctccacgtacttactccaagggaagaatgcattcagagttcaaaacagagggttttttttttttttttttttgaggtggagtcttgctctgttgcccaggctggagtgcagtggtgcgatcttggttcactacaacctccacctcccaggtacaagcaattctcctgcctcagcctcttgagtagctgggattacaggcacatgccactacgcccggctaatttttgtatttttagtcgagacagggtttcaccatgttggtcaggctggtcttgaactgacctcatgatccgcccgcctcggccttccaaagtgctgggattacaggcgtgagccactgtgcctggccaaaaccgagttttgaggctgcagtgagctatgatcgtgccactgcattccagcctgggctacatagtgagacctcaactctaaaaaataaaaattaaaagaaaaaagaagtttgtggcataggtatttcttgttttaagaaaatatatcagcaggaaatttgaattaaggaagcagacaattaatgggcaatgattgcttttacaagagttaatacagggttaccgcagccaactcctttcttcttttaaaatgttttatatgccaaaaataaatactacttttaaaataattttttaaataaacaaaatgtttatgatttttttagaagaccaccttatattttaatgctaattataaccatctccacactattgatctgaaatgtgcagtacattgaaaaacgtaaaagtattttcaatgcattagaaacatagtttccattttcccaagcttctcattccccttaatcctgtagattccctttctcacagattaaagtagcattagaatcacttgcctcaaggccactgggaaagcttgcaaaaaatatagatacaggagtcccaatggacctattgaaacagaatcctttgagtgcaggccctgggaatctgcattaataagctgcctgcatgattttgtactctaaagttggagaaccactaaacttgtgcacagtttgcaaaatggcagccctgcaagtcatacctggcccatagatttgtttggtttggctttcagtattagcaatgtggtttttaaaatttgatttgtttgctaactcttaagaattgggagtttgtacacataaatctaaattcctggcttctcttgaaacatcagagtaatttttacagtactaggctcatgttctcacatggctggcagcaatccactgtgtctgaataagatctgtcttatttgaataggccatgtgctcttgaattggccacagaccaccctcctgcatttcacctggggtccagtgttaattgacatttatttttctatagctggcctgcatcactcaattatatcccctgcttagaatccatatacatttgagtttttgactctggatctagaggttaagaactacacagaaactatgggaaagaagtgagactggaagctgggagaccagagagattataatagtggagataagaaatgaaccatggaactacggcagtggtactagggatggagaagaggaggaagattaggatttagaagctactaattgagttgggttggggatctggatgggagaaggaagaatgagtgtggtggagttgggagagatgaaagtaggtgggaagatgaatttgtttctggatacagtcacttgaggtgatcgtgggacatcattgcgaggtactgaagtatagcttgctatggagcagagactctacagtgttggagaggatgactcctggatggagcatatgacagactcctgggtgtatgtgtagactgagaaagcatattcagaagcctaccatcttttcctaatgcaagctgaaaaaaagtagagatctatatgtaccctataaacatgtatgaatattacatatcagtgaatgtagagatctacaaaattgtggctagcataaatagcatatcctcaactttaactaaagtagaaacacacacagaatctttgggtggaggtatatccaaatctctggaggataggagattcttatccaaattgtcaaagattattaaaggttgacacattgcaggtgggcacggtgactcaagcctgtaatcccagcactttgggaggctgaggcaggcagatcacttgaggtcaggggtttgagaccagcctggccaacatgatgaaaccctgtctctactttttgattgattgattgatggattgattgactgatggattgattgatttagagacagagtctcgctcagttgcccaggctggagtgcagtggcgtgatctcggctcactgcaacctctgcctccggggctcaagcgattctcatgcctcagtctcccaagtagctgggattacaggtgtccgccaccatgcccagctaacgtttttgtatttttagtagagacggggtttcaccatgttggccaggccggtcttgaactcctggtctcaggtgatctacctgcctcggcctcccaaagtgctgggattataggtgtgagccaccatgcctggccttagtaattttaatttttagtacaaaaattaacctgatatggtggcatatgcctgtaatcccagctactctggaggttgaggcaggagaatcacttgaacctgggaggtggaggttgcagtgagccaagatcacgccattgcactccagcctgggagacagagtgagactctgtctcaaaaaaataaataagtaaaagaatacatatgtactcgtctcaaaagaaaaaaaaatgcttggcacattgctgtagggtatcaccaagacacaatgatttaatgacaaccacttctttcttgcaagtggtaattttggtttctttctccctttatctcttctgcattttaaattttgctctgtgagtattctttagttctgcggatgctaggagcatgctgtattctaaaaagtgtttgcaaggcatttttctttttttatatctccaagaaaatgtttctttgggaacatgttatgaatggaggttaggttcccagggtagctcatctttttcaaatcccacttaatctacattgcagatgagctgttctattaatagcatgtgtctgagctctgggagcagacatgtgccatgtggtatagaaacattgaagaaagtctcttcctcttttctgaccataggctaaatttggaaactggtaaattttatctttgggatgctccaaatccctttctgtacctcttttccatataattgtacccctcccctcaggtgacacccatcctcctgtgactcttccccaccccccacccagatcattttttttttttttttgaggtggagtctgctctgttgccaggctggagtgcagtggcgtgatcttggctcactgcaacctccgcctcccgggttcaagcaattctctgcctcagcctcccaaatagctgggattacaggcgcctgccaccgcgcctggctaatttttgtatttttagtagagatagggtttcaccatcttggccaggctggtcttgaactcctgaccttgtgatccacctgcctcagtctcccaaagtgctgggattagaggcgtgagccaccgtgcccgtcccccaccccctgcgacatctttcccattcctcagtgtacctacctcttcccaaacttgatttctgtcacatctctgctgagtgttagaatgaactaagttatgcaattatttttgaatgtactttattgtgatttaaaaaatgattattaacatccattaattgcttggtgaaatatctgtcaagtagcacaataaagtgaataaagcctggcagtgcagtagaatgttctggggaggtaggtaatcatataagcagtcttgctttgaggttctcccctagggataattgtttctacttttcaagtcttgccttcattcacatataagcctatttttcagaagttctcttttttcatgactgcctctatgagagcagcagagaggcttccggggttgagggtaggcaaatagggcaagaagagtggctgtatgggatgggacttccgtaagtctaggactgcccatatggccttttgaatgaagggaatattccataatggcttattttaagcagtaattaacaaatgaaaaaaatttcatatttcttcccataaatggtaacatgtaatttgtaagcttagacaatttgatcactgaggtaaatgatgaatatcattaaaagcattggttcctaataatttgtaaagtacttcgtttctgtttgttaatttgcttaccaaatctgtctatcagtcacttgcatttgttcccaaacctatatatgccagtggtaattgctattgtaactatattatttaattaaacatgcaatttgatgaaatgtgtgaggcaaaagaaatctttctatgaaaattgagaagtcttttgcataaattgataaaggcgctaaaaggattgctactgaattaagcataggtgaggtaactgaaagcctaggaaaaaaataacaagtccaaaaggattcatatggctttgcaggtgtctccagtttctatcttctaaagaaaatgaaactacatatagtagagaatgcattaagggatggtttatgaaaggaagatgctctgatgtagctctacatcaaaatattgataaatgtgtattttgatgtcataaattaaaatgttgaaggtaatgtttgcttttaatgattcctccattaccaactttaaaaaaattaaccacacactggaccttatcatgtctgtataatactttacagtaaaagctcgttttccatgctatgaaatgacgttctagttaacatttcccttctttgccatttctaggtgtagtgaaggaccagcataccttcgaatcaaagtttgttgaatgatcatcgtagtcaaacagattttattctaattatttagaatttactaatcacaaattgttgctttgttataacattctttccatgacagataaaggcatttattgaatatggtaattttattttgtgaacatgataaagtagggaatgatttcagtatatagtgactgagtccttgccattaaagattttttcaagtacggtacttatccagggacatactttctggaacatttgtggttcctcttaggtaatcttgaggaattctatatatttgtaccttgacattatcttagtactcctgctgtttttagtaggatttttgtttgggaggttgctaagtattatttagaagtgaaatctgataaggggattctaaaacctttctcctaccacaatagttcttttcaaatgcagataaactgtcattcagtgagactacctaggctcagccttcagggtaggatgaataaagcaatatatttgctggattgactttttgtccaggctgtatcgaaaaaataatgtacttagccactgaccatttatgtctttttaatgattgtatgtatagtagtcaaatggttagaatttatatgcagaaggatataccatatcacattttcattgtaaattgctgctttactctcctgtctgccacattctttctggtgattctatatttgtgttgattgcttttcatggataataaagaaatttacatttttctctttttactttgtgtggattaatgctctagatttgaatgcctaatgctagtcaatctttggatcacatatgtaatactcctccataatagcacccccctccactcccaccatatgatgaggagggaaaattttttctaaatattttatttttatttcagtagttttgggggaacggggggtttttggttacatggataagttctttagtggtgatttctgagattttggtgcacttgtcacctgagcagtttacactgtacccaatgtgtagtcttttatccctcaccctccctcctgaaaattcattgcatcattctcatacctttgcatcctcatagcttagcacccacttatgagtgagaataaatgatgtttggttttacattgctgagttacttcacttagaataattgtctccaacactccactcaggttgctgcaaatgccattatttcattcctttttatggctgagtagtattccatgttgtatacataacacatttgctttatccacttgctggctgatgggcatttaggctggtttcatatttttgcagttgctaattgttctgctataaacatgcatgtgcaagtgtccttttcatataatgacttcttttcctttgggtagtgggattgctggattaaatggtagatctacttttagttctttaaggaatctccatactgttttccatagtggttgtactagtttacattcccaccagcagtatgtgaaagtgttcccttttcaccacatccatgccaacatctattattttttgatttttagattatggccattcttgcaggagtaaggtggtatcgcattgtgggtttaatttgcacttccttgataattagtgatgttgagcattttttcatgtttgttggccatttgcatatcttcttttgagaattgtctatttatgtcctttgcccactttttgatgggattatttgtttttttcttgctgatttgagttccttgtagatgctggatgtcctttgtcagatgcatgggaggaaaattaacaactggttagagtaatagttttagaatttgtgtatatagattgctggtacaaaatgattgaatgcctatgtgttatcctggctgtatagtgaatcaaatgggtaaactattagagatagtatatgaggtaaagacaacttttttttttactttttttcattttcagaaataacttgctttttcttttagctctgctgttgctgtgtttatctatattagtttttagatgtaacagtctattcaaatgtcataatatttgttagaattttctgttcttgcacagggtggactttctgtagacagtaggtctgtggtaaaaaataaatttaaaaacccctgaacttctaaatgggtgatatccttggcaaactaaagtaatcacatggctagatattgaatttttagaatattgaactgtactaaataagcagatttattacaaagaggttgtaaaggtagagttaggttctaatcttaactcctctgtggctttagctacatcactatgctggctcttcttcatgtttgtatctgtcatcttctctgtcatcatcatatattgttctccccagttgtgtttcatttgacttcatcacgcctgccaaccaggtccctaatgttatttttcagatgttttattctctgaaaaacgttgttgctccttcttttgtggattttttatataattttttcatccttttttttctagagctctaccagcttggcttttacttccccttttataatttttcttaaaaagatctttatttttatcaaagtaccatatgtacataattaaagttaggcatacagagggcttgccataaaaagtaacaactgatgccccaccctttcctattcctaatgttgctcaccctgtggcaaccctgttaactcttttgttttgtctggtagttttctccttatttctaaataatatgcttataatgttatgtattaccttatctattttagatattatctattgcctgcctgctatgatagaagaagattaatctcacatcaatcttcatcaccctgtccttatcatcaacaatacagttatgatttttagtttctctcgtctaaagtaaaccttctttgatcttttttacataatctatgaagaataatacctgtagtccatctagatttgtttgttgcaaattttatgcatagatcctctggtcactttctgatcattgatttgaaaaattaagttctatttatttttttccacactggcgaaagttctcagggaactcaaagatagttaaacattttaactatccctcttgatactctctgcttttgaatttaccaagcagaggagagagcaggagtctcaatttttagtggttccctattttcttatgctattcgatcccactcatgatttgtcttggaattggtctggctatctactatgaagagtggtatggtgtatgtgcacagatgtgcacatacacacttatgtgcacaaggcacgtactagtacatatttccaaactcatgcatgtaaaagagatgataaaggggacctggattaactcacagcctgaacttgagcttgttttcttgtgtacctttgttcctaatttttaaaaaatttcctttatcttgagaatgtcttcccgaggttttgcaatcagtgatctttgtagcagtgtcaacctaacctcctgcctcaaggattgtgtgtgtgtgttagtgtgttttattttttttaagatgaactctattttttacagcagttttaggtgcacagcaaaatcaagcagaaagcagagttctcatattccctctattcccacacacccacaggttacctgctattgacatcctacaccacagtgatacatttgttgcagtcaaggaacttatgttgacacatcattcacccagagtccatagttcaggttcactcttggtgtgccttgtgtgattttaggcaaatacataatggcatggatttaccattatagtagaacatacagagtaattccactgccataaaaatcctctattcaccacctgtttattcttccctccctttaactcctggcaaccactgatcttttcctgtctctatagttttgccttttccagaatgacatatagttggaatgatagagtatgtagccttttcagactggcttctttcacttagtaatatgcatctaaggttccaccatgtttttttcatggctggatagctcatttctttgtagcactgtatgatattccattgtctgaatgtaccactgtttatccgttcacctactgaaggacattttggttgtttctaaattacagcaattatgaataaagctgctataaacatccaagtgcaggtttttatgtggacataagttttaactcatttgggtaaatgagtgctattgctggatcctttggtaagagtatgtttagttttctaagacactgccaaactgtgttccaaagtagatatatcaaggatttttgcataggttgttcctacagcctccacttttttttctaattagactatactcttccttaggacttctcagctcagcaatctctcattacctcattgatttagtaactacctgccattatatgcattcatggcacatgtattgcttctttatagcacgtatcataagtttgtgtgtgtgttttttttttttttttttgagatggagttttgctcgttgcccaggctggagtgcagtggtgtgacctcggctcaccgcaacctacacctcccaggttcaagccattcttctgcctcagcctcccgagtagctgggattacaggcatgcgccaccacacccggctaattttgtatttttagtagagactgggtttctccatgttggtcaggttggtctcgaactcctgacctcgggtcatccatctgcctcagcctcccaaagtgctgggattacaggcatgagccatcgcgcctggcctgtgtgtaatatgttaatgtctagcttcctcattagtttgtaagctctatgaaagcatggatcatgtttcatttgttgctcagcattttacctctagcacttagcctggtgtctggcattttagcaagtatttattaaatatatgttaaatgagtgaatgaatgagtaaataaataaatcaataaattgtatcaatgttctttttttccatagtgattgataactatgttttgatttggcaagtttattttgcttggagaattttacctataagatagcagaaaagctgggcaaaatcacttgaaacttcatatcagaagagactagacacaaaagtttttcaaaccccattttttgtatatatgtgtctgtgtgtgtacatatgattgtgtatgtttaagtattaaaaatggtgtgttttcaagtgaattaatttgtgatagctattgacctggcaaggaaaacattaggtaactttttaaaaattgttattattaagcaagggacatttcttgacttctcttaaatgccatgaatgattaaatagtgaattagagagttctgtatcttttaaaaaattactacactaaaactttgcttgcattcttataggataaatgtatattgcacacaaaatcacatgtatgatttaaatcttagtgaagacttgcatgcagcttatttctgataatcatttgattactcctcagtccaaataaaaaaaaatctaggtagcaaggcatttattcacatcattcatttttgtgcaacaaaatagtcttgcagttgacagtgaacttcagaatgcaggttttcaactcagggcaataattattaacatgaatattcaccttatgaatattgactatatgaatatgcaagctattaatggagtcaaatgtctttgaaagtcacactctagggacacttgttgcaattcttcactctttatggctggattatatatgctttcccgtggcagtattgattacacagtgaagatttattctctttcaccattggagttacatagtcctagtgaagaggaagtggggcacatgcaagatgtaatgtgctgctttgcctcatctttatttctattttaagcttcaatgacctagactagagtattttacaagaaattttatgtgtgattaagagtgagtcttttcatgtttgtttaatgatgagaaacgattagggtttgagggagtgactgctacccagtatgtatttaaacatagccaaaagtagcagtcttatcatagaaatattttcatagacgtaatagcatgagaataagatgcatttgttgtcttctttgcttttggtttaatctttttttttttttttcttcttgtcttgcagtatccttccaaaacaaaaggcataacctaacacttttattgtgctttgagtacctctcctctggaccaggtcaaccatacaactctttcagtcatctggttaggatagaaaacttattttgccttagtgttaacacatctcagatgacaacggataaactgagcctttaatataataagtgcacaacattttgcagatatgtttaatcattgtcccttcaataggggtttggttttgattttgttctgatgctgctaccattttaaaaaatgcctttaggattgtttgggaactgtattcagaattaattttgtaagaaacatgagaaagctattcttatggtcacattagttttgagtctaggatatacttgagagcctgcaatagtaatcagagtttattgtttttgaaaaggagcaagtgatttgagtatgtacattctagtgtattaaagaatgaattcaatccttatattattttcataccttataatggagataagttagttactgatgtatagtctcttatgtattgtttatttcagcagctttattatttaaatataattgacatacagtaagctgcacatacttaatgtgtacagtttactaaactttgcgtatgtgaaaaccaccctcacaatcaagacagtgaacatattcatcaccctcaaaggggttatacctcttggttacctcccgtccctctcttccatccccaaactgagaattagtttgcatttttgtcagttttctggaagagttgccgtagaattgatgtttactagaacaccccagtaaagccatagtgttgggtcttctctcattgtttatcagttttatggatcttcaaagaagcaacttttggttttatttttctatattttgatatttcatgatttaaattttgacccattatttcttttagcttgcttactttgagtttcatttgcttttctttttctatttgcctaaggtgacagcgaaggtcattgatttgagtacttaagagcttattttataatataggcattcattgttagaaatttctccccaattactgctttttggtgtcccacaaatccttatattttgtgattttaattttacttagtttaaatattttctaatttctcttctgatttcttcttctaccgatcgtttacttagaagtgcattgtttattttccaattatttggggattttgtagaaatcttttggttttgatttctaaagactgctgtggtcagaaaatatactttgtatgacttgaatacttttacatttattgagactttgttttatggtaaatgttccatgtgcacttgacaaaaaatatgtagtcttctgttgttgggtcgagtcttgttcggggcctccatatccctgctgattttctgtctgcttgttctatcaattattgagagaagagcactgaagtctgactgttactgtggatttgtctgtttctccttgtagttttctgtttctgcttcgtgtattttgaagctctgttattacaggcataactgtttaggactgtatatcctcccgataattgacccctttgtcattatgaaatgaccctttttataccaggtgatttttttttttttttgctgtgaaatccactttgcctgatattaatacagccactctaaccttcttttgactagtgttagcatggtttatcttttatccttttatataacatgtctttcccccacccgctctggctgcttttaatatttgctctttatcacactggctttcagtaacttaagatgtgccttggtgtacttttcttcatatttcttgtgctggggttctttgggcttttgggaatcactggtttatatgttttttaatttttgtgggtatatagtatatatatatatatatatatatatatatatatatatatatattcacatgagatattttgatacaggcatacaatgtataataatcacattgggggaaatgggctaaccatcacctcaaacatcctttggtacaaacaatccaattatactcttttggtttttaaaaaatatacaataaacttgttgactgtagtcacttgattgtgctatcaaatactagatcttaattattcaatctaactttatttttgtaccaattaaccatccccacacctcactctccaacttcccagcctctggtaaacatcattctactgtctatctccatgagttcaattgttataatttttttagatcccacaaataagtgaaaacatgcaacgtttgcctttctgtgcctggcttttttttcacttaacatgtcctttagttccatctgtgctgttataaatgacaagatcttgttcttttttatggctggatagtactccattgtatatatgtaccacattttctttgttttttttttttttttttttttttttttttttttttttatggtgtctcattctgttgcctaagctggagtgcagtggcatgatctcagctaactgcaacctctgcctcccacgttcaagcgattctcctgcctcagcctcccaagtagctgggactataggcgcgtgccatcatacccagctaatttttgtatttttagtaaagatggggtttcaccatgttggccaggctggtcttgaactcctgacctcaggtaatccacccgcctcagcctcccaaaatgctgggattacaggcgtgagccactgtgcccagccaccacgttttctttatccattcatctgtttatggatacttaggttgcttccaaatcttggctgttatgaatagtgccacaataaacatgagagagcagatatctcttttaatatacttattttctttcttttgggtatatactcagctgtggcattgctggatcatatggtacttctatttttagtttcttgagaaactgctaaattattctccgtagcggttgtactgatttacattcccaccgacagtgtacgaggaatccctcttttccacatccttgccagcatttgttattgcctgtcttttggataaaagcaattttaactgggggtaacatgatacctctgtaattttgatttgcatttccgtgatcaatgatgttaagcaccttttcatatacctgtttgccatttgtatgtcttcttttgagaaaagtctattcagatcttttgtccattttaaaattggattattagatttttttctctatatagagttgtttgagctacttatatattctggttattaatcccttgtcagatgggtagtttgcaaatattttctcctatactgtgggttatctcttcactttgttgattgtttcctttgctgtgcagaagattttttaatttgatgtgatcttatgtgtccatttttggtttggttgcctgtgcttgtggaatattatgcaagtaatctttgcccggtccaatgtcctagaggaccttccccaatgttttcttgtaacagtttcataatttgaggtcttagatttaagtcttgaatccactttgatttcatttttgtatatggagagacacaggggtctagtttctttcttctgcatatggagatctagttttctcattacatttattgaagaaactgtcctttacccgatgtatgttcttggcacctttgttgaaaatgagttcactgtagatttatggacttatttctgtgttctctattccgttccattggtctctgtgtctgtttttatgccagtaccatgctgttttggttactatagctctatagtataattcgaagtcaggtaatctgatgctttcggttttgttctttttttctcagcatagctttggctattctgtatcttttgtggttctgtataacagttaccatttaaaaaaaatttctgtgaagaatgtcattggtattttgatagggatgcatcaaaaacaaaaacaaaagtaaaaaatgaaaacacaaaaaccagtttgtgacatggttaattaaagtgatcgggatttttacaattctctttcacttttctacccttctacctgagcatctggttaatcatggctgaacgttaaccaaccccttccaactttcttgcttagactccaggtataacctcttggattcgggtcaaaattgcttactcaataattatcttaacctcaatctgacagtctccttttattttgcttaatagttatttggcaattcctttactgaacttcattagtccttaaaaactgtgtacatatagcttctttcagtttccaaacatttttccttctaattattgtttctctggtcatgtgatgtatcttttccttgcctgttgtttattacaaaaatctctccagccttggtcaaaattctatccttctgggctcacataccacaggctccagctcaggcacatattgtatttttattaaaaatatagcatagatacagaattttggtactaacaagaacaatacagtttattacttacactcgaagagattgagagcatacttctcagtctctcttctaggttttgccttgtcacatgatgcttaaggtattttcacccttgattattggaaaaattcagcaaaaccttattagaatactttaaatatatataatacagtttggggattattttattagcataactttgtatgttctttaagctagaacattctcattggtcatgctggcagggaaaagagaagccagaagaaaattcaagtcactgttccgtaagaacaaatgttaacatttgggctggatggtcacatcaacatggattttgacagaaaatgtcctgtcaatttgatggattttacttgtgataaatatacttccagagagcttgcaacaaaccactcggttataaatgggtatttctgaagtaatcctttctgatttgttttcagttctagtccctccccaataaaactgtaccctagaatgatgtaattaaaacatatgagatgtagagactaggaaactttttagtaacatgttatacatgtgacctcattgtatactggttttccttgtcctgattccattcagtaggactcttaggcctgtggttctaccttcttactggaactggagggaagcttctgtttgaccaagctaggtcaaagaaaatgaatttttttgctgttggctgtctccagagtttatcttgaaatcatcaagtacctgagggattaagttaatatactcattttgcatgttgctggaactaaaattaggtagaagaaagcagaaactgggaagtttttatgtttgtttaaagatttattatgtattatgggtgtatctaatcttcttgtcatgtaatttaaataaataggataaatatttttaatgcaaatccaaactgaaaattcactttgcagagatcattaacatttatttcatgtcattgtccttctatagttttaaaatgcaaataccatgggaaaatcttctggtatatgctcatgagagtgcatttgttgcttactgactgttttatattttacagttggctagtcaagtgctgactaatgaacacaaagcctgtgtttgaaaataaatttaacagctttatacacaagctaagtttatgtaaagtgatctaggagacacatgacctttgtgctccatagcccttgctcaaattctgaaagtaaactatgtaaatgatctaacatgtcaggtcaaacagtttcagtggttttcagccaagggaactattgaatatgttgaggtgcttccctctactatgatgggtcatgcatcataccatagtactctgtttgctgtttaccttgtgaaggtgtatttgctgctggaaccatgatgctgcatacaggacagagaacattatatggttctgtttttacctcagtatgccttggtttcctaatcagaaaaacgggaataataataatagctacattacaggtttgttttaggaattaattaaatcagagaactaaaaacaatgcctggcacatagaaggtgctcagtgaatcataaatagtagtactaatagtagtgatgctctctctttaggtctagcttttcttttttctttttaatatacaaattataaattaacaatttccttttaggtattcatgtctacaatttggcatttaaagagactcttggccgggcacagtggctcatgcctgtaatcccagcactttgggaggccaaggagggcggatcacctggggtcaggagtttgagaccagtctggccaacatggtgaaagcctgtctctactaaaagtacaaaaaattagccgggcgtggtggtgggcgcctgtgatctcagctacttgggaggctgaggcaggagaattgcttgaacctgggaggtggaggttgcagtgagttgagattgcaccactgcactccaacctgggcagcagagcgagactccgtcttagaaaaaaaaaaagagagactctcattcattcattcgttccctccttctctcctctttctctcttcccttgtccctgtttccttcccttcctctactgtatttccttgacttgttgctgtctagctgcagcagtgtaggcaaaccaggcaggctctaatggctaaaaattggtttgtttgggctacatttaaaataattggatatgtagcaatttgaggtgggctttgagctaatgggtcttatgctgctgtgaagaagtaaacaacataaggccaatatacagaggccatctttaacccatttatgtaatatatacaaaactatataagacccacctcctgccttaggaaattcatacattctagtgagaaattatcgcactatgataaatgctaaaatcaaagtttgaactaagaccttgggagtaataaaaaattccacttttgtggtgtttccaggttttttcaagcatattgtagctcaggaagcactctacattgttggctactggcgactgacattgcatcataacttttaagttttaaaactgtgtcaccctttcaatatctgtgggttacgtgttcatattcagttatgtttgtagctttgagtctacatacagtctcatttctgcatttcatgtgaaagaaaatgccagtcttagcacattctcttatgctattaatggagaggggaagaagccattctagttccttcctaaaaaaagtgatcactgtttaaagctcaagtaggtgggtgcttgtgtatagttcatgaaatttgggatactcagagctcagtgaatacctgaaaatgaagagaccttttaacctggtgggtcaagtttgacttaagttcttgaacaaattcactgtaagtactctagaggcagtgtttatgagggaatttagatgccaggataatttttttaaatagaaggaataaattgccccttgtttcccaattaagacacctaagaagcttgatctgtaatcatgtcttctgtggttactctctgaagtcttatgttgaaataagtggctgtctctcttctgtccctttatgtaccatcactggtatagccagtcctgcctatagaaaggaaaaatcaagttttttacacctcgtgttagaatgggtattttctacagaaactgtttcaaaggagaatggagttggaatactacttactaccagtgtgactctgaaggtgtattatagatttttataggattttaataaggttttttaaagctgatttgcgaattcaaccatcattgagaactttgtttctgtaagaaaatgtagtcgcagaactaactccatatgtttcatcagggctacgaagggcccatgtatgtagaaaacttcagtagtattgattatggctactaaataggtaattttgttgaaaataagtttaacattattagcaaatagaatggtaattgaagagaagttaatttaggaattttgtaaaaaacttggctatgattatggtactgacacagtaatgtggggccagaacttatggtaaccccataagagtgattctataatttttttttttttttttttttttttgagactgagtctcattctgttgcccgggctggagtgcagtggtgcgatctcggctcactgcaaccactgcctcctgggtttaagtgattctcctgcctcggcctcccaagtagcttggattacaggcgcccaccaccacgcatggctaatttttttgtatttttagcagagacggggtttcactatgttggtcaggctggtcttgaactcctgacctcaagtgatccgcccgcctccgccttccaaagtgtcgggattacaggcgtgagccaccacgcttggctaattctataaatttttaagcgtatctttatttgtttttcagtgatctactgactgtaaatcattctgtcagcttcatagtaacatttaatttcaacctacccagtccctaattggccaaactgttataaaaccaaattacgcagcagtgaggaaaatagaaacttgaatgaatgctattaaaataagtttagaccatctcaaatttatcctcataattcagactttctctgttttcaaagaagacgtctcatacacactgagtgttattggcagatttgacatggctggagtcttatgtgcagaaatataatatgtatctgtcagtggttttcaggagcccctatgaaagggcttgattttgctggtttgaagcctttgttggcatcagcaaagtcaaagagttgtaggcaaggttaacagccacttcatatttaatgggtttatgcaaaccgtgatctatatattgattatataaaatacatcactgttgtcttaacatccagatgaaaaggaaaaaaatgttttctacatcaaaatctttagacttaaaaatctctgtgattcataatattaattaaaagagaaaataaaaatctgaataatttgctttgacctgtgtatgtataagggtcattataagggttagtgcttgggttgcttgtgagttttcaggcaaagggacatacagctcatcttttttatattgcaactgatcagtgattaatacttaagaggcttcaggggctaagtatagttgctgatttatttgcagctcttactccacttcaattatttaaatacagcgaagagtccgtcgtgagaaacacaacagagtaggagaaatttgagatctatcagcataaacagatacaagtgttgctttgccccaaatcataaaaagtaaaaaaattaaaactacctgttaattcattgtgatattatttgtaaaacacagtgacataaatgatattttcctacaatgtgttatttattattttgacaatttctgtcactatgttgagaaagaatctcttatccaaattaaaactaagtaaaaaactatttaaggaacattatgagacaaaaggttttttcagttatcactactcagcatagaatctgaagcccattgggggaaaaatgaagtttataaaattgagtaatttataatattaaatttttccaaaaacactttttaaattttctgaaaattattttttgttcaccatataatcacattctgtttaagcttctacgttttaaatatttgatataatatttagtgatttttaaagttcttcctgtgtgagtaaatgagctgtttttgttttccatgtagagaagtttgtctgctttcactctggaaatgatttcttatgggttaacgcctttggatacatgtgttccaagagctaaacaactgctatacaagtgaattttgagacatggcccattcctgaattggggattgtttgcaaattcaagaccatcagttaaaagtactaatagtgaagttaacttaaatcactgtatgacttttatgtattttttcctacaaaaaatataataataccttattcacaactcaggtataattttcagtttttggcaatttatactcttgaatttttaaagcagtgaatcattttgttttgtcagattaattttgcaactacatcagaaaactaaatgatgtggttatttgtaaaagctgcttgaagtagacagatagcaagtcattgtgaggtgaagtatctccagagtgataatcatagccatttagaggttatttttgcattataaagatagtaatcataacaacagatatttaaattactctatttaatacaaacagcaatcatatgtctgggtacattgcttcaataacaagcgttattttaaacaaaattatatatactaactgccttatctatttatattgctcccatcctaggctaagcttttatcatcttgcaactggatcacattctctctctgtcgctctcttcctctgtctctctcctcccccagccccaattctgtcaatcatcacaggtttgagtacttactatgtgctagaaatagtgcaaaaacctgaggacacagtgggaatcgagaaaaacctggtccttactacattgagtttacagtattgcacagaagactgatattgataggtaattaggatttgatacgtggaatgtgttgcagaaggaaccatgggagactataacaggatcaactgtatccttagctgagagcagaacagttgagtagaagatggctagatgattaagaaagaggtgaggtgggatggagcgggtgctgtaagcagagcaaagagcacctggaaaggccgagactgaaaaagagctggagctctaaccagtattgttatactgatgaagactgttgcacacagatttcagaatatagatagatgttctagagtgtgtgttctagtcagacctgaatgctaatctggactgtgtaatttattatctttgtgatttaggcaaatgacttaatgactgtaaaccttgatttcctgatgagtaaaacaagacagtaccttcttgtacataggattattgtgaggatttaaacaaggcaatgcctgtaaagctcttagcatagtgcctataaatgctcagtaaatggtagctattagttaggtagaatagaccaaacttgctgatctctgcaagccgcctttttagcctttgattccttctttagtttattctcaatattacaggtccataacccttttctgaaattctgaaatatgaatgctctgaaaacactcttatcatttggccacaagccccaaccttcttaaggccgtataggtactctttatttatcctgttttgtgaaatatccatgttttccttttaaacttgaatacatttgagttaatgtgttaccccagatcctgcttagtgtgttttgtaagatatgatacacctagcatattcctttctaaaacatgaaacatgctgagttccaagacgtgtttggcttgaaaggtttcaaataaaagattgtacacgtgtgccaacccaaagtcagctttctaaaataccattttctccatgtctgtcttcaaatcagaaaatcataagaacgcctagtggttttccagtttagttttgactattccttgtggttttcaagactgcctctaatccaccctacatattcaaaatttaatacccttgtacttgaaccatttgtttcataagtctgttctcttcaacttccctgaagtaaaatgttaatgctgctccttttgtctgacttccctctctttctctctttgtggctcttcagatccctacccaacaattaggccacaattctttgtagtttctcaatgaagctatatttatctatttcttctctgaattcttattgtgcttaaatgaatttatttaacagtatttgagcagatattatgtgccagctactgttctaagtgtcagagatctgaaagtgaataagacagttaaggtctctactgttagggaacttgttttctagaaagtagaagacaacctgtaatcccagcactttgggaggctgaggtggatggatcacgaggtcagaagttcgagaccagcctggccaagatgatgaaacctgatctctactaaaaatacaaaaattagccgggcatgatggcgggcacctgtatccaagctactcgggaggctgaggcagggaattgcttgaatccgggaggtggaggttgcagtgagccgagatcgtgccactgcactccagcctgggtgacagagggagactccgtctcaaaaaaaaaaaaagaaaaaaaaaagtagaacacaaataagtgaacaatatcatttcagataacagttaatgctgtcaagataagacaggaggatagtgccttgggagaagcgacatacctgagaaactcatagtttcgcatttagttatttttgtttttatatggttagttttttttttttggtttgacggagtcccactctctcgcccaggctggaatgtaatggcatgatctcggttcactgcaacctctgccttccaggttcaagcaattctcctgcctcagtctcccaagtagctgggattacaggtgcccaccactacacccagctaatttttgtatttttagtagagacgggggtttcaccatgttggtcaggctggtctcgaattcctgacctgaggtgacccacccgccttggcctcccaaagtgctggtagtacaggtgtgagccaccaagcccagcctatatggttagtttttactccctggttagactgtaaatgccttaagggaagaatccttaaacttctatgtgccataaagtgttgggtataaaatgggtgcttgattaaggtttggttgagaaatttgtccttttttgacagagaaggtaaaaatctatttattaaatataaagcactacttggctaaatcattgatctaagagtatctgttatgtacaaagtactgtgttggttttgaaatttttgtatttgtctaaatctagctttttcatttctattgctttttattcatagtctaagaaagaagaactttcatgtctacacaacttttttttcccatttgaaatgctttaatattgtgaaccccataaatttgagacaggtctcagtttagaaagtttattttgccaaggttgacaatgcgcttgtgacacagcctcaggaagtcctgatgacatgtgcccaaggtggtcagtgcacagcttgcttttatacatgttagggagacatgagacatcaatcaatatgtaagaagtacattagttccatccagaaatgtggagacaactcaaagtaaggcctccctactgggggcttccaggtcacaggtaggtgagagtcagatggttacattcttttgagtttctggtaagtcttttcaaaagaggcaatcagaatatgcatttgtctctgtgagcagagggatgactttgaatagaataagaggcggttcccagcttgaagaggcccaagatattttcctttcacagtataaagcaaacaaacattctttctatacctgtagaggatgctactactctaaaagctggattattcctgcaattgtttctgcttaattcaggcactaagtgacttcctccaattcattagtgtgaacattcttaaagacctaagtggcagacatatttcctgaaccatttacccttagtcctgaagctgatcaggtttgtcacacacagactgctatagtcacccctcctggcagttcaagattgagctttatggcaagacaattcatttaagattgagcataacttgttatgacagatttatcaaaattatccagtgaagtaacatagacttctgctttgtgaagaaaactgaaaccctatactgtgatgtcatatttgttctcttatagataaatattttgttctttataaattgaaagagcatcttgagaagagaatctcaaaaggatttttttcttgtcataaaaatggtggaatgaattttgatttgtaatagcaaagaactctggtgggttaaaatttgaggcttttgaattgactgtacttctgagatggtgtgcttatggtcacaaaaatacaaaagtattgctctactaaaatgatgaaatggacagttcaagatgttaacaatggcaaagtaaggtggagaactggaacttcatatctgtaacttcatcttctcaactactaggcttttgagctttgagggcagggccatatctctctaaatccccagtgcctcacacaccaccacttgatctagcatctattcttaagtgctaatggtgatagaggactacagtgcctaagatgaagtgtaggtggctgaaaatgactcttacttttagaaaggagatgaaagaatgattgggagtaattttaagtacacgcagtaaatagttcagtgattgcaaaaggaaaaatttgttttctaaaaggtcatcttagactcaagcctgtactttgagcttagttctaaaaataaaattagacattgctttcttggtgaaattaaacacaactgagaggtactcaactaacagaaaatctttataataaagcatttgaatgcctgaacagaatgttcagcttggttaccaggtgattggccttgagttgtttggattggccttactggtttttaaagttcaggagtgagtatagggtctgaaaagttggaaggcaggcctttgaatagtaactacttccctctgtgactgctgcttatctgaatagggattgggcagggatgtcgtccagagaaatcaaaccctgaatcattggttgatgttgattacctttctcaaggtccattctgacttggaaaatatatggagattataatagagtattaccatatcagaactctcagaagctttatattgtgattgttctttcattcttctgatcttcaactagagtgtaacctccttaaaggaagacagcatgcttaccttgtttaccactgtattcccagtgcccagtactgaacagtttcacttatgtcactcgtgtccatgtgaagagaccaccaaacaggctttgtgtgagcaacaaggctgtttatttcacctgggcgcaggcgggctgagtccgaaaagagagtcagtgaagggaggtaggggtggggccgttttataggatttgggtaggtaaaggaaaactacagtcaaagggggttctctggcgggcaggagtgggagtcacaaggtgctcagtgggggaactttttgagccaggatgagccaggagaaggaatttcacaaggtaatgtcatcagttaaggcaaggaccagccattttcacttcttttgtggtggaatgtcatcagttaaggcaggaacaggccattttcacttcttttgtgattcttcagttacttcgggccatcggggtgtataggtgcaggtcacaggggatgctatggcttagcttgggtccagaggcctgacaaacagatgcatagtagatgcttaaatatttgttcagctgaagtgaaggttgttttttgtgtcctattgtacctgccattcttggaacgcaagaaacttaaggaaggtaaagagttgacccttcatctctattgtaatggccaacttaattcattttctttaagagagaagaaaatagtcaaatagtgcgaatacgtttttgagttggtggtgagacttttgaattatatgcaacttagttgtccaatttctgtggtagtagagtaattgcacgatgtttataaaacattgtattaccatgtaacattagctataagagagttgaatctttacatcttgctctttttgttaatttctgcctgattgagaaaattaaaacttaattttcttacaataatgactcttgcattgcaatcacaacttcagcattagagtttataagtaagtcagtcatttctcttagtcttaaggggttgagactctggagtgatacttttatagttacacaatattcatataatactgtgctaagttatatttaatatagctgatcataaatgaagtttaataaactctgattgcttgactaatgcacagtcttattgcttttccagagttgattttaatgaaaatatatggtcactatatttattggtacaatatgccctcattgtaatgagcatgatcattagatttgcataataaaaacttacaaaaatgactttaatcagtgcttttaattcaggggtatgactctaataaagatttttgggggggtcatttttgtttctgactttttttaactccatagtagctctgtagtttgtacacaggaatgaaatccatgtttacttgcatgtggtgtgagacagatgcacccatccacataaatgaattttgagagcttgtcccagaagaccatcattataaatgaaaaaaatttttttggtgtttctgttgttattctcaagtccttttatacctttcttttttgactaatatagaaagataattgtgtagcagaaatgatttcgttttgtttgcagatcatttaattgtaacttatacaatgatttcaatgcatgtttaatgtacagtggctaaaaattaccccttctgaaattcagcccttcatatctgcttaaagattttccttttcgatagaccatatttgttcttttttctgaacagttataacgaagagctttaaatagtattatatttatgaaagcagatttttacatgagggaaatctgagaaaatattcgtattaaatgtatgtggttatacaggatatccactctagttgaatgaaatttacaaatcaagaaatcaggagtggggtgtttttctttatgtttctctatcacacgtaattaggataattttttacataagtataatttcctatgtgccttcgggtactctatcattcttgtagatgcctgtcaggaaaaaagaaaattctttaagaataaaacaaagcacagtccttctccagtattatttttgaccaggggtccacatttggtttatcaacaactaaactttcaattcaagggcagctctagaattagaaatgtatatagcagaatggacattccaaatcaaagggaacagtaggggcacaaagaggacatcatgggagtatgcattgggaagaggattttaatttttgttttctgtagaatagggatcataagagaagaagtagaagatagcccagggctgaatcatacagggctttgaattccatattaaggatattcatctttattctataggtcatcaggaggcattgaatatttatgaacaggagggagtatgatagtcattcatactctttattgagcctcaatgtgccaaacactgctttaggcgttagggttacatccctaaaccagatgggcaaaaatccctgtccttgtggagcttatattttttgttggaaaaacagaccaagataatgataattaagtaaattatagactatgttagaacgtgctaaatcttgttcaggagtgccaggaatatgtggagggaggcagatgtttccatttgaaataggatggccagggtaggcctcactgagcaaaaccttgaaagcaggaagagggagtaagccatatgggccatggagaaagagcattccaggcagagagaagagccagtgcatgtggcttattgcctcattggggagccgtgaagtggtcagtgtgactggagctgggggaatgaagggagagtagtaggagatgaggtcagagggatatggagagtgtatagatcagtagggccttgtaggtcattgtaataactttgacttgcactaggagggaaaatagcccttggaaagtgttgagccaaggagtgacatgacgtgacttcagttttcacagtatcactttgtcagctgtgttcaaaattaactgtaggagagcaaaggtggaagcaaggagatagattaggaagtcactacagaaatttagttaagagctgatggtggcttgaaccacatctttgcaaatggcagaatgattatcatgggactggatagctgcttggctattggaaatgaaggagaggaaggagaacaagatttggaaatcttaaacctagacaagtggaatgcaggtggagccactaacaaatgttaccctcttgtttgtaaaatgagaggctttgactagattatcttgaattccatctaacttgaatagtttctacctctatactctgtggtttactatagataaaaagtatgttaattccaaagaagagtactgaggggaagggaagacttcagtctcgtcccataggaccaagtgaaaatattgctagcaatgctttttttcttgtgtctgtctcccatgattaaactgtcaacatgtattcaattgagatacagatttgaaacattttaaacatatgtgtaccttaatttagataatttgactaaagcaaaaagtattttcccttcatttacattcttgctttggagatatagatgggtttccagcctggagtttataaccccaaaagatgggaagagaaggaaagcagtagttgcatgaagaactgtataatctgtctcaaaaacacatgtggacaagcgcacatagggatggtagcagaattagttcaggcacttttgatactttgtcattttctctctgatttggtattgcaggaaatcatgaaattggccattgtgtttaaaacagttttctataacccactagaaaaattaaggagaaaatacctggtagagagagttgcagggtgaattcatccttcttaaagtggtttcagttctgatataaataattcccacttttttcctaggcagtaaagattgattggggtttgtgtcagcaggatgtgatgaagacatggtatagagattagaagtttagatccctgagggaatcagtggattaaaagtagaaaagaaaagagttatacatagaatagtatatttgccccagctgatctggggaggatggtctttaacagcattggattggtggtatttgaagacaattttctgagatccaagcaattttcattcacttaaaactcataatggaatcctccccactgtgagaagaccctattttttttttagtgtgcatgaccaagttgatatacattattcagcttctgttgtaagaaataaatgtataggatctggcagaacatttaattcaatttctaacagacaattaaaaaaaatctggttctttcctaatcacacccctaattggcacttcaacatatttataataaaaactatatttcatgcttatcatacattattgtaaggtcttgaactatcccgtgaatcatggaacataactacattattaggtattgctttagtattgctgtacttaaattcttcaaataatgttgctcatatatgttcaattttatgttcaaataagttcaattttatttagaatattttaaaaatatttctaatttatttataaggatagtttttaaaaataagttcaattttatttagcatatttataaaagtgtcctttaaatatccatcaggaataacacagttcttaggccaagctgtttcattatatttcattcttgttaaatgtgacatttttcctattgtacgtggtgttgttttttaaatttaggtatcttagcttgaggattcatttccaaacttatatatagcatgccagggcttatgattttgttgtatcttttctcacatttcagcactgtggtagtgacgtctgatttagatctgatttgggacattgggagccgtatttaaaaacaaatatatacacctttgccaaaccttcatttttaatcattaaaaagatttttttctttaaagaatgtattgtttatatgtttgaactttctgattctttttgactgtttacagttaataaaaatgaaaattattaaattattttattgtttgatctatgagtttctcttatctgatgggttttttttgtttgtttctttttggttttaatagaacattcaaataaaaactttggcagatgatgtggtaaggtggtcttagcatgttattacattacttatgcatgttgccttttaattaaaatgggtggacataaaagcattgatatatgtaagatacaaaatgtctggatatttacaaagtatagtagaatggaataattgtcaattcagtgacttccttttcgaatattaacacaaacaattatatgagatcccaacagaattttcatatcatcctaatatttaccttaaccaaatgttttttaaaatcttgtgaatctagactctggaaaacacagatgcttccttttttgatggccaaataaattgtgaatgtattaaacattaatattggaggaaattaatttccattagaaaggaaattaagttcactgttagtcagatgtgtgctactaaatttaaaaaccagtattttaaagctgaatttgtcatagtatatctttttaaaagttatgggctcaaaatgtaaatatacccttttatagctaaactataaaaaatggtattttaagccttgtcagttttttttttcctatgtgaaattacctatttacaaataatttaaagtagtgatagtgctcaaaggagatgaaggtatgtggcttaactacattttctttttgagacagagtctcgccctgtcacccaggctggagtgcagtggcgcgatctcggctcactgcaacctcgcctcactgcaacctccacttccctggttcaagcaattcccctgcctcaccctcccaagtagctgggattacaggtgcccaccaccacgcctggccaaattttgtatttttagtagagatggggtttcaccgtcttagccagactggtctcaaacttttcctggtgatccacccacctcagtttcccaaagtgctgggattacaggcgtgagccaccgcacccagccaactacattttcttaccaaggtatagctgaaatcaaaagctaattttctagataaactgaaagacacagtggaatatcaaatatatatgttattaatgctactcagtaaaaaggctagtactggaaaagtaaatattaagtgatatgaagggaaaggagaagagatatgttgatttaatggtcagttgcatatttaaatgctttcatgtccaccatatttttagtgaaatttgactattggatatatcctcagcttattttggattacttaacttttttcttgagttgtttgaagatatactatataactaaaccaacttaatttccctcaaaaagttaaaagaaaatgtgaaaatatagttcaagatgattagaagaaatgaatcttaagttaatgtgaagactgggataggaaccaggggctgttggatttaggaaaatcaccttctctgtgaaatgaggggattggtttagattatttttcaagtttcttctcagctctaaaatactatgatttatataatgtctttgtcagcaactgtgtactcaaattgcttttgtaatcctaaataagctgcttaaaactgctcatatttctttcaaagtatactttttggttttaaaaaagtgttctttgaatttaaaataaaagttatgctcattaatgaggagttcacataattttacataagctatggtaataacttctgtgatgctctttgtattgttgaagtaattatataaggattctggttacatggcggtgaagatatattctcctgatatttaacatatctgcttgtttaatgtgagcttgatggtatgcatgtgcttcctaacagaaaccataataaaactgagttgcattcagttttatgcacattactaacttttgatgtcccatgttttgtggtttaaaatagaatatcctatttacatgcaactgaagtcattaactcactttatgtgaaatagcaagctaattattagagattttacatggaatcagtggttcgaagtcaatatccgtaaaatagcaagtttttcttaatgatatttgtaggaataagaaatttctgtttgttacatttccagtaaatggaaaagccgatgtttttatctttgttttgcttcctcattggcccaacattttagggaagaaaatgctgggggaaaataataatagtaacaacaataataaatagcagctaagtgcaataaacatattaacttatttaaatttcacagtaaccctatggtgtaagtaatatcattatccctatttcagagatgaggaaacagagagagaccaagtaaactttcacaaggttactcagctagtaaatggcagagcttggactgaaacccaagtaatctgtcttgagtccacgctcttaaccattctactgctacactgacacattattcatttatacttgtcacaatttttgcaactttgaaggagaaaaacattaccataattttctcttagaattggaaatcagtagctctttttcagtttctttctcttttttcatagttctaaagttgccaccaaagacacactctcccagaaacaaccaacaggactttgatccgagactttttttttcacttatttactgtgcaaaacagaaatgacaagggactaagttttacttttgaagaatacttttcacccccagagttctgaggctgaagagtacttcaaggtttcaaaatagtacaatctctaactggagcttgctgcttaaaatagtattttgtcagaagacaataatgatatgtattatactaagtgccgttttgatgtttcaattcttcatgttagtagttcttgatctttttctcagggctttttatttatttatttttgtttgcagcgtgaccgaattacaagttttagaaaatctactgtcaaaaaagaaaaacctcttattcaacatcctattgattctcaagtcgcgatgagtgagtttcctgcagctcagccattatatgatgaacgatctttgaatttgtcagaaaaggaagtattggatctctttgaaaaaatgatggtaagttatacccctaattttgatgtaattttaaaatgtgtgtgcccagaatagcactgagttttaaggaggtgtgtttgtatggacagtgtttatatcacataaagaagagaccagaaacttgatataacaaaactatttgcaaaagtatcctttttttttcttttttcttggcaaaaatgtccttacctgtctatctcttccactgtgagctcctaaaagtagaggcagttttatttatctttgttttctactatttagtagtctctaggacatcgagtcagtttttcagttaactgatttgtgtgtctgtttctacaaagcaaaagaggcctaggtcctctgctgaaaacatcacaaggtctcttgttgggtatatgaaatagacttgggagggtagagagtaacaatagaagggacagagaaattaattcatccaagtttgttctattagcaacattcacacaacctacattttctagcatgtttcctgtgttttatagcttgtggcctaaatcactgcctatattagataatgaataccatattttgagtattcagaagtttatggcaggagaggggagagatgaggaattaaaccgtattacattgttaatttgaccagagaagaactagagatcttgatttgtgattcattcattcaaaattatatcccacatgttactgtacattttttgtggttgtctatttacctgtagttgtccacaggagtttcaaaggtcgccttacaccaaaataaaaggttaaggatcagtgaaatctagaccctactgtgcccactgtggaacatcttgtcatcacctctcctgctaccctcatgtttatttctctcctgcacctagaagagttagtaggccttgaataaatatttgttggtagctgttgaatgaatccaaacaaaatttccctttaaaattttccttgactattccttccatctagccacaactggcattttgggtattcccctgaaacgagtcctgacacttttaccctttttcactcttcttcctgcttctgtggtgcaccctttttcctgctgctcctttcgtgctatcttctttaaaccatctttcaacaaccttttctcttttgaagtctgttattgctgaccttccttgatgatagcacctggctatgcttttgtcctttacccttgctactcattttggtgatttcaactattacgctaatagccttcaatacattttttgctcttagttccttgtttgctaaactctgacttttgcatttatatatttagctaattataggtatgactgtaccttggactgtgtcatcctttagaataattccacctctaagagctttaactctaaaattttccttagaagctaaacaatttacactacctttccaagacccttaattttatagagcatgtattgtgtagtggttaaaaacctggactttggggtcattcagaatgtttgtagtgtttctttcctttatcaaataagctctgttgtgtctttaattgctagtattttctgattacctagatacccctcagtttatcaccctggtgtccttaatcactgaaaacaatgatgacagcaacaaacacagaaacattccttgatactattaacactttttatctttttaaatctttcttctctttaaataaaaattatactcattgctttaagctgctgacaatttggttactaccttttgcagtattgaaatagttctccgagttcatcagtggcattgctgtattcagtttttctacactgagcattacagggctatcttcccttcattgattatctcattcacttctaatttcttgccaaatcccattggttttgcttttgtaataactgttacatttgtgtcctcagatgtcctccagctgttcttgccctactttagatgataaccctctctagttgtttctcatggctattaaaatagcctcccaactggtcttcctcccatcctccaggttttgcctattccaatccagtattgccctatgatttggacacagagttcttttctgaagccccaggtgggcctttatgttttcagagaatcagtttatatgtccctactccgttccctcaactatgcccctagatgcctttcacacctttgcttttctgctccaacctcagagctcttccccatctttattctctgctgatgaccttgctgcttaatttacgagtaaattgaagcattcagaagagaacttccacaggctccccccaccacatttaccttttagtatctgcattcatgtatctgtcttgctacctatcaccatagatgaaattttcatgtccgcattcttctgcttgtgtataaattttcattcctttcagctactcacagatattgcttcaataattttttcttctctctcctaccattctgagcagcatgtaaacatgcggtcccatttttcaaaagccttcttttgaccctttctctgttgctagctatcactccatttatttactctccttggaagcaaagcacctcacaatataattttattcatatgcactgcttccagttttaatcctctcactttctcttctaaactcactccaaccaggtttccatcccaccattctatcaaaactgctcttatcaatgtcaccagatatcttcatgctgccaaatcccatggtcaattctcagttctcatcttaatttttttttttttttttttgagacaggatctcactctttcacccaggctggagtgcagtggcataattatggcttactgcagcctcaatctcctgggctcaggtgatcctcccaccttaacctcccaagtaactgggaccacaggcatgcagtgcaccaccatacccagctaatcattttgtattttttggtagagaccaggtcttgctacattgtccaggctggtcttggactcctgagctcatgtgatctgcctgccttggcctcccaaagtgctgggattacaggcatgagccaccatgcccagtctctcatcttaattgacctatcagtagcattctgtgcagttgattattctctccaatttgaaacactttttatttttttgtctcctcaacattcatcttgttttcctcctacctctcaggccactccttttcagtcttctttgctcattcctctttatgtcctgaacctctaaatcaaatttacattcaacttagtcctcacatttgaactccagactcatatattaaacttcataaccaacatctttccttggatgcacaatagatctctcaaaataacacaaccaaaactgaactgctaatattcccctccagacctgctcctacaaaagtcttccctttctcagttgacggtatctccatccgtccacctaggccaaaaactttggatttgtccttcactacccttttctcacattctacagtcaaaccattagaaaatctcattagcttttccttcaaagtaaggcactttcaacagctgaccatttcttacccacctccactgataccacactagttgaagtctcagctggaccactataataatggtaggattattaggattaccacaacccctaattgatcttcctgctttcactcatgaccctctattcttagcacagaaagattattcatttaaaatatgaacatcatgtcacttggctcctcaaatctccaccatggttctcatgtcactcagtgaataaaagccgatgtacttgcagtagcttataagatcctatatgttttgacacccaccacaccttacctttttgatatcttcctctactattctctttccgctagctcacagcttcagttgcactcatgccttttattttattgtagctctaaggaacaatgattcctgttagtttttctttcttttttttttttttgagatggagtctcactctgtcatccaggctggagtgcagtggcgtgatcttggctcactgcaacctctgcctcccaggttcaaacgattctcgtgcctcagcttcccaagtagctgggattacaggtgcatgccaccatgcctgacttatttttgtatttttagtagagacggggtttcaccgtggccaagctggtctcgaactcctgacctctggtgatccgcctgccttggcctcccaaagcgttgggattacaggcatgagccactgtgcccagccgattcctgttagtttttaatttttaaatttatgtacaacatttacagtgtttttaaacttcgtacatttctattttgtggtttgaatatcataatgtttcatcagaaaattactatttcctctttatgattttttttaaaaaaggatttgcttgttggattcataaatgtgatttaaagaactgtacaactttgtgccacattttctcaaatgggaattttttcttccatgggaattttgaaataggatattaagaaaatatgtttttcaggtactatcatattgtgttataattttatttgatggatctcttttatgttatgtgacccacataatcattatagacttgtatatgcagatattaaaatcctgtttatatctagtagtggaattgctggatcatatggtagttctgtttttaatttttaaaggaaccttcatactatttatcatagtagctgtactaatttacatttttaccaacagtgtatacaagtccccttttctccacatcctggtcaacagttgttatcttttgtcttcagtaatagccattctaaaagatgtgaagtcatatctcattggtgtcttaatttgcattatgttaagtgaaataggctaggcatagaaagacaaatagcacatgatctcattcctatgtgaaatctaaaaatgttgatttcatagaagtcgagagtagaatggtggttaccaggggctagggtaattgggcagtggggagaggggtaggttgaggagatagtggtcaaaggatacaaaatttcagttagatagaggaataacttcaagagatctattatacaacatggtgactattgtatttttgaaaaatgctaagagtagatgtaaagtgttctcaccacaaaaatcacaaccatgtgaggtaatgcacatattaattagctagatttagtcatcccacagtgagtatatacttcaaaacattgtgctgtacatgctaaatgcatacaattttatctgtcaattaaaaaaacttatttataaatggacatatattatttttaaataacagtataatataataggatatcagagaaatatggtttgattaaaagtaacaaccaaaagttaaactgaaaactttaaagattatctctctactttgagagaagtctacttataccctgaatattgcgtattttctatattagtttgacggtaataaccttacagtgaacaaattattttatgaataactatagttttcatctactgtatacttatgcctaaggcatgaaactaaaacatttaagtgtattatttcaattgatccttatgacagtgccacaaagtaagtaagattgttataccccattttcagatgaggaaagtgaagcttagagagaggcaagaaaattggttcattaacttgactaagctagtaagtagctgagccgaaacttaaatttaggtacataaaaatctaaaacattgactttttgtaacatctgcctttaataatgcttcatttaaactaaatataaaattagtacattttccttgcacacatagtgaggagaagtagaaggcaaatcagaggtacattagagtggtaggtaaagccagcctgggatggattatttcctactgataatggaacattgtctgtaattgctttttatggagcatcaattgagaagaatgagtccaaaaatctagcaatggaaaactgttaaaaatgtcattatcacagttgattgggagaaagcacttaagtcattctgtttctaaaacacggaagtagacttccagatatgaaatttatctttttttatttcactccttgtgggtgtctttccttgtacaaataacgtaaaaggtgttcttgtcgtatttgatggctcttatgacaatcttccttcttctgggtcttttgatggtagctttattgtgctgtttctcttgattggcttttctgactttagagaactacaaaggtttagaccatttggtttcaatactatatatgtattttaggataacatactttgaggtgtaaaacttttttttttttttttgagatggagttttgctcttgttgcccaggctggagtgcaatggcgcgatcttggttcattgcaacctccacctcctgggttgaagcgattctcctgtctcagcctcccgagtaggtgggattacaggcacgcgccaccatgcctggctaattttggatttttattagagacgggttttctccatgttggtaaggctgatcttgaactcctgacctcaggtgatctgccagcctcagcctcccaaagtgctgggattacaggcatgagccaccgtgcccagccaaaacgttttaaataattgcagcacatagcatgagattatgcacagtaataatatatgagacacttgacaagaaataaattaccttacaatttactatttagaatttctgggtaatgatgtattggtgaaacttttggttaaaaacttaacaaaagataatattcaaatataatcctttcttactctgaaaattgaaactcttgttatacctgaggatcacatctatcaacagcagttctcattggataggcttgtagatgtagataattgagctaaatctaaaattactgcaggatatgttttttctaaaagaaggtagctgtttttacttaattactaatagatcatttcacaaatcacttgattcttcatagctaagaaaaattgtgaaatgagtccagttaactgaaagatctgagtagtctggttttactagtgtattagtagactactaatgtctcattgactctggcatctattctgtgcattggtgcatcacttttcatattgtgcttattcaatgatgcaattttaaagggactttctaagtaatggtatcaatggctattgctggcaagtttaaagttccaaatttgaaataaatatttatttatttttttgtttagagacaggaccttgctctgttgtccaggttgtatcatgggtcacagcagcctcaaactcctcggctcaagccctcctcccacttgagcctcccaagtatctgggactacaggcatgtgccaaataaacgtgatttttttgtttattttttgtggagatgaggttttgccatgttgcccaagctggtctccaactcctaggctcaagacatcctcctgccttggcctccaaagtgctgggattataggtatgagccacggcacctggctttgaaatttcttgatgattgtttattttatagaatataagctctttattaagagagtgtctttcatagtttgtaaaagtgaattttgtatttagagtatggttaccaactactaactgaaaattgagaagtggttcttttactaaagttttcaagaattaaaaccactgcttttataagattgataaaattacctgcatggggtaaatcacacttgctctttaagattcttgtctccctcccatacccagagtcatgttttcaaatcttccacaagtgggtaaaggtagtaggatgaaaacaatactccttccatgttattattattggtaactttttttttcttttgttttttttgtttgtttgttttttcgagatggagtcttgctgtgtccattaggctgtagtgcagtggtgtgatcatggctcactgtggccttgaccttctgggatcacacaatcctcccacctcagcatcctgagtagctgagactgtatgcacgtgccaccatgcctgcctaattgttttgtagagtgtgggtcttgctattttgcccaggctgatcttgaactcctgggctcaagcattcctactgacttggcctcccaaagtgctgggggttacactgtacccagcctatatttagtgacttttaaagatgactgaactaaagcggttcatattcgtaactcttctcatattgatcagaagcattttatattgcctctaattaggattggatgaaatatctcctcaattccactttaaatgtaaggaaattaataatgctgtaattgagtaactcttcaatattttaagttgtcataacctttgagcttgctgagaataactgatctggtttttgtacattgagtatactgcttagggactgttaaatgcttattagtgttttcatctagactgaattatgcaattagagttctttttggggagaggggtgttgggagaggggagattttcattttaagattaaaaaagtaaacccatagaaatttcttgggagttcatgttggaatttgatttctattagcagcacaaggaactcccaagtggaggttcaggttgcattggcaacatatagatacgtcaataaggactgtgttctgatataggtaattaaatagtttgtcttatgcaaaagatgaggctagtaatgatttatgattaacctctagccatatttcatttcaacctaatttgttaaaggtaatgtttaatatatgattatacatgcaaatttgatgttttacactcttttctattcagcaatttatattaatatactttgcatttttgtcataatttaatgataatagttatatgcaataaatactaaattattccatctgctagaactctcataagtaatcccaaaccttttaatttttgttctctcacttttctctttcattaatttagagagaatagttgtgcttgaacaccaggtgttatacattaacccaagcatccttgttctccactgactgctattataggtttctttctcacccaaccctagtcttttagaagttagttagcttggatgaatcttttcatgccctcagaataagtaattttaattaatagtttaaggtagcacaaaataaattattggtaaactaggtcttaaaatctataataagccatggaaatagttgtcagaaatgattagaatctcagaaattgtctagacagcataatatccataggttatatttacattttcaatatccttactccatatcattagacggagataatgccagaagcatttctagacaacatgttttattttcttataaaactcctatgacgagcttataaaagaggagcaaaacttacccagtaaacagatctaaaaggtaactaaatctgggtcaatttttaattttattgccgagcatgattttttaaaaacttggctctgttcttgatttgtacagagaaatgctttcaaaaatatttcttctgttttgaaggattctactagtatttatttgcatgagtgtatttaagcaactatttattcatatgtgcaatgtgccaggtaggatgctacatgttggaagtgtaaagatgaatgcaacacctcccttaccctcagagagctcagtgtttactcagggagaaaagtacataaattatttccatagcactaggatagctgtgaataggctactgtgggaacttagccctgtgtaggggctcaggatggaagcagagaacaccacctaaatacactgtgaaacccagtgttacttctgaattatccgtctttattttttggcataaatgttctcaaaatttgaacagtttagttcatcaaagtcccatgccttccatatgcccaatactgttttaaggtctgagaagagagcagtgaacaacttaaagaaaatccctgccatcaaggagcttatgttctggcaagggtgatatactggaacataaggtggagttataaaagaaaaggaaaagacaaatatctgtgtcatggtgaagtttatttgacaactctctactgaatgccagatactttgttaggtacagcagacataaagatgtcaaaggtactatccctgccacaaggtttttattttgtatatcctgctgactaagaatggttttatatttttaaattgttacccaaaaaaagactgtttcagggcacatgaaagttatatgaatttcagtgtccacaaataaagttttgctgaatgtatccacgcccatttgtttatgtattgtctatagctcctttgtgctacagtagagttgagtagttgagacaaagattatatagtttgcaaaacctaaaatatttactgtctggcaatttacagaaaaagtttgccaacctctggactagtccaagagtctctaaaccttttatttcctaccccatcagaaaaaaaaaaaaaaaaaatatatatatatatatatatatgtttgagtaagtagccctaatatattttaaacattatatacatgcatgtatgtactaatattaatatgtacattacaaaatatacacagtaaaaatgagaaaaacatgaacaagattttaaaatgatttaaaattagtttatttcttaatcatacagaagtctttgctgtcatgattaataactttttagtgagaacagtgtcactatgtcatttttttatgtcttgcttaaaaataggcggtaattagaaagtttagctccaagttcattttattttgatatttggtttaatttctctcataattgaaacataaatctgacaaagatttgtaggtccaaatcgaacaaatgcaccattagcaacttactaaattgtagtattaacttttatcagaccaatccatgaatcaagcaaagatttcctgctgaaccatgactagtaaattcctgtcttacttgatgacagccagttattcttgcaactaatctggggtgttgcatttttatatttctaaataaatgggtttaaattggactttaataaatgggtcttcaacaagtgccattgggaagatgggctctttccattttttcttctacattattaatgtgtagaccctcatcctcatgtttgtgtactcatgcctgttccagacagtacatctaacaccaggaagaaagaggaagtaattcaagcaagggtgaaggggactgacttggaagttgagtctgttgggactgacttggaagctgggtctgtctgtgtggcttttccagtaaagtaggtttgaaaaggagttactttcttactaattgttaaaacgtcaaggaatttcttcactttttgtaaatgaaaaatgcctaactcatgctatatttcaagttttttttttttttttttttttttgagatggaaactcactctgtcacccaggctggagtgcagctgcgcgatctctgctcactgcaccctttgcctcctgggttcaagcgattctcttgcctcagcctcctacgcctggctaatgtttgtatttttagtagagatggggttttgccatgtcggccaggctggtctcgaactcctgacctcaggtgatccgcccgccttggcctcccaaagtgctgggattacaggcatgacactgtgcctggctaatttcgacagttttaaaatactttatcttgaaataaccagaaatatctctggttttcatgttaacttcctatttcatttcaaaatattgtaaatattttattgtatttgaaatatcttgcttttatttaaagaagaacaatcttcttgactctgtagtattctgtatacttcagtttcaacttcttgcaatggccttgaattttacgtgtaggtttacctgactcaggaatccttccctcatagtttttccacaaaacctctttttattaaataaatcatttattttggttatgtgttttctctgttaaattgttctaacggtgacacaaagaaaagtagtttatatatgtcattatggaaacaatctagcaaatactataaggtgaggtgtttttaaaaaggttatatttttatccaactgtatagtaaacctcctacactaattgcttaaatacttgctttagcaaattttcagtaatgatctatacgtgtcttctgatacgtcagtatttgctgacaaagaaatgtacttcagcttcctgccatgttgttttgcatggattgtttcagctgcttttaccaagtgtttctctaatgccatggtaccttttgtcagttgttattaaagaaaattcatgagaagcttctaaacacatatcattaagtttacaaagtatcactaaggtactggatttgagtataacattctaattattgcggagaaaaatgacgaatgactgagaattgaagaatgaatgaatgagaatacaaatgaatgaataggcagctggttcaacttttgaccttctcatttgatcctattcttatggcttctcagtaatagctttaagaatataatgtttgctgaagtgaaggaatttgtctataataggaaattgtatcatggcatatgagaagcataaaaaaatggtttagtatttacaaatgtggctttaaaaacattataggctgggcgcggtggctcaagtctgtaattccagcactttgggaggccgaggcaggcggatcacgaggtcaggagatcgagaccatcctggctaacacggtgaaacccagtctctactaaaaatacaaaaaattagccgagcgtggtggtgggcgcctgtagtctcagctactcgggaggctgaggcaggagaatggcgtgaacccgggaggcggagcttgcagtgagcctagatctcgacactgcactccagcctgggtggaagagcgagactctgtctcaaaaaaaataataataataataaagaaaaaataataaaaataacattataaatggtcaactagacttcagtgttttgtttttttttttttttttttgagacgaagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacagggtttcaccgttttagccgggatggtctcgatctcctgacctcgtgatccgcccgcctcggcctcccaaagtgctggtattacaggcgtgagccaccgcgcccggccgacttcagtgttttttaaaatcacaaaatactacattttttctcatgtattatagatatatcaaatgttaaacatgctaaaagcttgcttttgttttgaataccataagaaatcagtatgtttagaaatagtttcatattcaattacgctgtttagagttaatattgaattatgaatattgctctatttagctttattattgtattatggatctggagttaatgatttggaagtgttagctgcctaattagtagaatgtatcttatttctatagaataaaatgagtcattatggtcttttcacatgaatgatactcatttccaatcaacctatgcagcaaatttataagtataaaaaactgttgctgattctaaagcaagttaatatatttaaagaaaaggtcttaaatatcacattggttcaacaaatatttattaaatgtttactgcattccaggaattatgctctttgctaggagtacaaagataagtaagttcctattttcagcttcgagtttagaagagatagatttatcacataatttcaatgtaagtgacacataaggaattaatatggaagactaggataagggtaattattttcaaatcaggtgctttaggagaagtcttcctgaaaaattagtggttgagcacagtcttgaagtataatagccagatgtgaatttggagggggcaaggatgggcattaacagatggagaggatggtaaagatgaccacatttcaggcagggagaacagcgcatcatgagcaaaataatgagtgtgtaacaacacagtttatgtagcaaaactacaaacaacctaacattattaaaacataaggggtaagatgaaaagcggttaaaaggctgaggttgggaggtgataacgctaatagctagcattctttgaaagctagttaatatacaccaggcttgtcatgcatgatcacacccagtcttgacaacattcctctgaggtgtataatcttacattgctcttattgtcctgcctgcctccctacaaaataattctgtgatggcgtgatatcagcagtgtgtgccattaaaaactgaatgggtacacggtaatgtagaaatgtcactggaagcagagaaactctctacctagagactgccaaaggtgacgccaccacactcttaggccaggctgtgaagtatacaaatacagacacttaatcttgtcactgttccagagttgattctacttggaggttgcggattgatgataaccacatttacaggagactgaaatttaaccagaatttttttaggcaatagagacatagcccagcatatgtgagcagaacatagggattttgatgaaaacaaaaacaatatgagtcagcagaatgatgtacttggccagtaagataataaaatcaagagggtgaattaacagaggtgtaagtatttcaaggtgagggaggtggacattctttcctaccttgcatttgttaaaccacagagtatttgagagagagagagatgtggacaccaacccatgttacatgaagataagttgagtactttagcctgaaagaaggaatgtggtcttcaaataacatttatgtggctcttgaattaatttccttctgtccaatctgagttttcttcttagttcgactcttatctctagtcacttaaattacttcagcccaaattattgaacataagaaaaatccactctggcaggtttaaatagaatataattttagaggatattacgtagtcttgaattaacagagttgcagaaacaggctctagataacattataggactaacttccagaaccacacaactgaaatacagttccaattaaggagctcttatcccagaactatttgatcaaaatgtcttaatgaaaaagacacagttaatgccatcagttctgtaacaacatcacctctgttgccacctacatcagcaaaatgaatggcctattcgtggcctgcttcctcacatagttcacttctaaatctacacctcctatgcatgcattttattggtggagactaagccacatgcctgcactctagttaaaagggagactgacaaatgtagtttttatggattctacctttgtcaggtgggactgacaatgtgaggatgtattaaattgtagagggtatgttcaagtgatgttgagcagcaaaaaatgacacatgaccgctagagtttcctgaccggtctccttccttccagtcagatttttttcatcctttgagacccacaacctggtgaagacttctctgacctttccatctgccctgtgtttccaaagaatctgatacatgcctcagttagaattatttgttactactggaccataaattatttattcaacaaacatatatagcatttactaagtatcaggcattgttctaagtgctttataaataatatgtaatttgagtataaaaacagtctaccagattagacagcctagcatagtttctggtgtgtagtatgtgttcagtaaataagtgattcagaattttaaaagagaagaaaaaaggtcatgccacccaccttaacacacattattttgttgtacatatttcatgtccaatcattgaaggaaaaatttggcaaaaattaaactaccctaagatgagtggggctgtctgaggacgtagggagtacactgtcagttgaaatagatacatatgctgggtgtggtggctcacgcttgtaatcccagcactttgggaggccgaggcgggtggatcacttgaggccaggagtttgagaccaccccagccaacctggcaaagctctgtctctaaaaatacaaaaaaattagctgggtgtggtggtgcgtgcctgtaatcccagctacttgggaggctgaggcaggagaatcgcttgaacttgggaagcggaggttgcagtgagccaagatcaggccactgcactccagcctgggcaacagagcaagtctccacctcaaaaaaaaaaaaaaaaaaaaaaaaaaaaaggaaatagatacagaacatagatgagcatctgtggaccacattatgagtgctatccaacctagtttctgtgattctactgtgattcaacaatgccagagcctatgagagagagatgaaaaagatgtcttctgccttctagtaagtcattaacaagtaaaatatccaaatgagaaataacattagatagaaaagtggggatagggacagtgatccagataattaggaagaaaggtcatgtatatatacacaaaatttataggtattgactatgaatgaatcatcataggagttgctgcagtggttgcaaatatagatttttgctgtcaacaaagttattattcaatagatagatgcaatttgtctacttttgaggattgtcttccacattctcacatatgcatctttaaaataactttgatgccaggcgtggtggctcacgcctgtaatcccagcactttgggaggtcgaggtgggtggatcatgagatcaggagatcgagatcatcctggctaatgcagtgaaaccctgtctctactaaaaatacaaaaaattagccgggcatggtggcgggcgcctgtagtcccagctactcgggaggctgagggaggagaatcacttgaacttgggaggtggagcttgcagtgagccgagatcgcgccactgcactccagcctgggcgacagagggaaactccatctcaaaaagtaaaataaaataaaataacattgatactgttcttcgccaattagtttatttactttatcaaaaaaaaaaatagaatgctcagaatttctgtaagagtaaagggataaaaatactgatttgttttcttaaaaaatttagatatgattcacataccataaaattcacccttttacaatgtgctcttttttttgctttttctttctttcttccttttttttttttggagacagggtcttgctcagatttccaggctggagtgcagtgacaggaacacagctcactgcaacctctacctcctggtctcaagcgaccctcctgcctcagtctcccaagtagctgggactgctggtgcacaccaccatgtccaggtaattttttaaaagtttttatagaagcgaggtcttgctatgttgcccaggctggtctcaaactcctgggcccaagtgatcctccttcttgggcctcccaaagtgctaggactttggcgtgagccactgtgcgtggccaaattcataattttttttttgtatattcaaagagtgtgaaactagcacaacaactttgagaacagttgtatcaccccataaagaaacaccatacccataatcagtcagaatccaaactccctcctcttctcccctggccctggcaacctctaatttattttttgtccctataaatttgcctatttgggacatttaatatgaatagaatcatagaatatatggtcttttataatgcttctttcacttagcataatgtgatttcaagattcatccaggttatagcatgtatcagtacttcattcctttttagagctgaataatatttcattgtatgatatgccacattttgtttatccattcgtcaattgatggatgtttggattgtttctactccttggctattatcaataatgctgctatgaacattcgtgtgcaagtttttgtatggacatatgttttcattttgcttaggtatgtaagctgggtcatatggtagataaatctgtttaacttttggaggaactgccagactgttttccaaagtggttgtatcatttctctttcccaccagcaatgtgtgagggttccaattttttcaattcgttgccaacatttattattttcctctttttttctagttatcctagtagaagtgaagtagtatctcactgtggttttgatttgcatttccccacagattaatgatgttgaatatcttttcctgtgcttattggccatttatatatcttttttttttttttttttttttttgagatggagtcttgctctgtcacccaggctggagtgcagtggtgtgatctcagctcactgcaagctctgcctcctgggtttgcgccattctcctgcctcagcttcctgagaagctgggactacaggcacccgccaccacgcctggctaattttttgtatttttagtagagatggggtttcaccgtgttagccaggatggtctcgatctcctgacctcgtgatccacccgccttggcctcccaaagtgctgggattacaggtgtgagccaccgtgcctggcctgtatatcttctttagaaaaatgcctattcaagtgttttgctcatttgttactggactcttgtctttttattattgagttgtaaaagttctttgtatatctgggtacacatctatatcagacatatgatttgtaaccattttcacctattctgtagattgacttttcatttggtgttgcattttgaggcacagccatttccaacttggttttgtgaccctgtcaagggtgtcttcatatgtcacaaggattaccatgaatttcaaaatgaagaaaaacaatttgtctaatcaaagtgttataagtgtatatatcacaaaataaaggtagatttccaactgaattaaagtttattgaacctcaaaacaatgtgttcttgtaactgaatacttttccttctaatgagtgacatttattaccgcaataccgctgtttctgcttttttttcttttccaaatccaacaacttcttgtgaactttcttcagtgacatattatagatatatagaccctgacaatttgcaaattgtatttgctttcccaggtaataatgatcctaagggagcatatgccaaacagcattttgtgtgtgtatttgctatcaagataaataaagagctttgttagcatagataccatgtatatctatgttataaactgccaatttattctgtggaatagttttaaaaatatttttttctttctgctcagtagttggctaggtagagatgtgaaccgtgaatacatggtagaatttacacaaaactgtggtatctagagtgaaaaataatagcgaagtatcccaaaaaaggatttttgacattagtcaccacatgaattagtattttaagacatagaaattattaatgtttactaatcacttttgaagctcttaagtggaaatttatcaatgcccacagtaaatgttatctcttacaggaggacatgaaccttaacgaagagaaaaaagctcctttacgaaacaaagactttaccaccaaacgtgagatggttgtccagtatatttctgccactgccaaatctgtaagtagggagatttttctagctccaacagaatgagcaatgagcttagcatcattttgcttaaaaataaacaaacctcagctcttcagattacctcattgtactcatatagactgttcagaagacaatttatatatgttatacatttagtattaagtatatatttttaaactattcatcattagaaatgggacgtttccattattacaagcaagacaaaggatacaaagctctgaggtaatccagtccagtcctgagcttttgtgtacatactaaaaatcgactgcattttgcagatattccaccaaaatgtggtttgttagatgaaaatttcggattttgaagaaggtacaacttagtatagtcacagcttaagtttacattaaagctacatgtctggtgtctacttgcatgaaacttttagccatattttttaattcgcagttagcttttttcataattttatatgatgcaaactaagctgcctcataattgctattgtatagcttcatttaatgtaaaggatgtcacctaataggagctttaatcaaatctgtttgtgagtcccaagacttgaaagtaaagttcattgaaaggacttgttgttattaggaaactgtgtgttttagtggagtattttgctctgttctcttcctaatgcacttccaaatatagtcttaagctttgatttttttttttttggtaagaaaaaattgtatttttgaaatagcaaaatgcatcttttacatttctgtaaagaaaaagcttttaatacctagagttcataaaatcactgtatgtgtgtatatgtgtgtatatatatgtatacacacacagtgatattttgtgtgtatacatatgcatgtacacacacatacactatttaggtcatgtgttttaaatttcataagttgaccattgcagaaaacaagtcttcattgaaaaaatatattctaaagttatttggctatcctattaatgctatttcagtacagcaattccagtggcaattactaatgcattttgccatgaattctacgattgtattgattctatattgtacttgaaacaagctaaatctgaatgctgagctatttaaacataacacattgcagctccgccatagcagagcaacagcatgtttttaaatttgcttctggtatccaagggcagaaatatgtttcaagtgataagtgaaatttgccatgagcgtcgttttcaatagaattaggtgatgcatagggttttactttgaaattctgatgaatctcttctcatttttgcactcaagttattgttcaccataaaatgctttaggaaatgcaggatgtacattcaatgttatttttcaaagacctaaaggctgatacactagtaaatctatatgactgaatctgagtgcaaagtacagataataacatatgaataatcatgtggtggttttaatgataagattttgttagagtctctggctcatttgttgttgtttgtgtaagtgggactgaatataatgattatatgaaactcttattccttgaccttttgagtattacatgatttctgtgcagaacttgttttcatttattctcatattatttcctcttcaagtgaccaaagaaatgcacacttcaagttatatactgatttttcagattaaaatgcaaaaaattggataaatattagatgagctcacttgaactgcattattcaaaagatggaaattcaatgttcctcaaaagacatgaaaattctatgtttaaggcattagcctcaaaatcagaactacttaagggcccttatttgtttcattcagtgtacatatgagcacctgaaatatgcacagcactctgataagatttccaggattatacatatttttgctaatatttttcgtgggccagatactatgatggaagaaagcctgttgacaagcatttttgaagctttctcatcttggaaagacgttaattagtactatgttttctatcattaaaaccacaaaaattagttatgtaatttccttttgaaggtgagagggttggccttcagtgacaaacaataatctaacctttttaccttttcattatcacagcactaaagtttgcatttagagtagacatgatagttaccactactttatgaaaatgctttctagttagtcacagctttcatcttgaggtagcaaagttaagagctagagtccctggtggagaaatgttttatagtcacatgtaaaacatgtgagaattgtagtgaaatttaaacgtaaatcatacattttccccgtttaacacctgcattaatcattttgtatgggatctaaaaccagattttagatagaaatgtctatcatgctcctgggttcttgagtaaggacataaaagtaaaatgaagctatacaccaatatgtggtcaaaactcgtttctaaagcaaacaagagtcttttgtcgtataattaactttgctaaaattagcatggaaaaggagactataaaggaaaccataagataataataaaaactattgcttagttttttcttctcgaagtcccataatagagaatgttaaattgtgtgaatgttaaaggaaaaagtttgaataactctgtccatgatgaatgaactttaaatagagggatggagaagaaccttctttctgcattttatcctccattgttcattgtaggaagcgtagttatggatctgacgtagggtaataggaatatgtagataatttgaccacaaataacctggaagagtctatattttcaaaacaccagcatatgttttcagaaaatggaaaaccaagctttgttaatattgcaaaagttgtcctaccgattggtaatcctgaaacaatatgttggtaatttagaggggatctcacgggcacttaacagcacatatagacatttatgaggaaaagttattcaccgaagtcccaacgttagtttgtcaaatgccagtgtcattcctagaatgttaagggattggtttattttgaatttaaatcataatctttgaaattttaaaatatgtaaagttatattttttaagacatgtgaaccattgagaggcagcattggtttttttttttttaatctcagtaggaaataatttaaaatagtggtgctagctacatctgcagatttgttagactgacctgtataatgagtagttaaaagttgcagtatatctatatgtgtatgtgtatacatgtattatggttttgcttttgtcattatcagatactctttcagctcttttccaggtatgatctggatatgatcaaacagttgaacccagacatggccaaaatattttctcttagcttctgttgggtactaaatcttatctattgccgtttgtgctttagctaaatgcagttattttgcaatgcaaatgaatcattaaatgggccatattctggttgtttcactgagtatagacctgctttaattgttaacgcaggctcacattcttttgttagtctcatgtctgtgctaaataaacaagggacaaatacgacctctgtcttttcggtgggaggaaataattgaggtcaatagcatatcttttaattcagaagactgttaatggcaccaaagaggcttttattcaactaaataatcactgcttgtaaatagtctactgaatgaatatttaagaaagctgcttctgtattctgagattcatggattcttctgaaataatttacttggaaactgtcattatctttttgtattttatgatatccttttcaacataggattcttactggggtttcagttaaatttgatttttatttttaaagcactagctgaaaaatagaacacattttgataataactgctatcggattaatggttttgtattgtggcttagctgttttttggacactgcttgatattcaagtgtgggaatctgataacagtgatttgatttatatttggatttttggataaaattatgtttaggactatgagtttacttcctgctttcttaaacacaattctgcctctcagaaattcttttatcacttatccattaggaaagctcagttggagctgcaatttttgaactatttcctccttctgaacatgtgcatgtttagatgtaaaatgcttctttgtcttcacattatgtagaaaattctgatcttataatagaaatgctaggattacctagaaaactagaataataagtaatctatcttttttataattttcaagtataatataaaacagtatcgtacaccttaaatttataacaataaaaaatatttgttttcaacctaaagtttacttctgaacttaatgcatgactttaaatgtaacatttatatactaaaataccttaatagtatacctgccataagaaggtgtactatttcaaccttgatagtatacctgccataagaaggaaagaaaagaaaaggcaatattggaaaaaacaaaatttctattgataattttttcagggactatgagctggtaaaaaaatctgatgcctgattacacttaacattgcataacttgatatttagattatactatatgagaagcccattatagtacattaaaaaaatcctcaaatagtaattatcacttatttgagaatccttattctgtagactttacacatttttgaaacatagtagaaattaatattgatgtatctattttagcctgtatatctaaagtatcaaaaatataaatagggttagctatttactaatttactaaacacttaacctctgtgaaaagcttctgactactaatattgttgctgtttgttttttttttacaccataaccactcttcgttgaccactgcatgcagatagttggaagtaaagttacggtgagtacaaaagatgtgttttacccttagatatgaatttgtggttttgtaaattgtgatttttgcttgtagtattttatatgtttggttcttttggtatatattttaccaaagcaatgagatgaatattatgatcaggtgattagaatttagcctggacaagtattttttctgtggtttttgggagatgttttagaactagaatatgcttgtatattttatcttagaagttttcacctttttttttgtttttggaattatgcctgtgtcagtctttatgattctgatgaaattgtatgttttacctcaatttatcaggaggagaatcctaaaatgttggtttatgctaacaggaattcttattaaaatatgtcactttgatttcagtatgattgagcacatagagtaatgaaaacaaccctttccatgcagtcgggaggcctgggtgcttgtctttgttgtatgctactaatcagcttttgctactttgggcaagtcatgtaatttctctggggctcaattattaaatggataaattgaaatgattagctgaaattatcttttaaggttctttccatggctgtcatttaaaggttttatattcaaggcactatatttcagtgctataattacatgatacactattatataacacgcccaaagtggcccgtactgtgattgagagctgtttgtaattaccttatcttcatgactaagcactccctagagaacagggtggtaggaaacattatctttaacatcaccgagtactgaggtatctagaatagtggatttatttgttcattttgcttttaaaaattgattccttcttttcattatcttactcttcttttttttttttttaaattcacgagacatctagggggaaaagccatcatcctttcaggataattttaaaaatcgaatatttatttagtgcttattatatgccaagaattattctaggtgcactgatgactggaaaataagaatgagataggacctagttgatatgtgttgaaataatcaaaccttaaattatgcatgctgactataaatgtaataggaattcataagtaggagagagaagtaaggttggagtaattagagaaaaatctgtgtaaatttctgcacttaaattgggctttcagggaataattagttatgatggctggtgtttggctagggaggagagactgtggagaagctctcagattctggaagtaatattaaatgcaaaggcctgaagagaaccaaaccatgtgtgtggaggcagagaagaaggaagtgagagatgaggttgactttgttgaaacaaagaatgtatattggaaagagtaaaaaatcaagttgaaggatggtcttgaagtccaggcggcaaattataaattagtttgagcaaggaggtaacatgatggaagcagtgtttaagaaaaataaattcgataggtggataggctggattaggctaatggttctcaaactggaaagtacatgaaaatgcaaattttgtcctgctccaggaagattgtgattcaggtggcctgggatatggccaagaaatttgcatttttatctagcacctccagagattctgctaaggtagtctgagaagtatacttcacactttaagaagtactggattctgatagacttattcgggaagctacctaggagatttttgagtgattcagtgaggacttgtattaaagtcctcactttgaggctaggtggggttaaataacgagtttggggagataagagatttttagcttattttaataagggctggaagcagcctgtatttctagtcttggtaccaactctctcccctaattacccacactgttacttccttagttcagactgtcatcatttaacacccctgtgattgctgtagcctaccaagcagtctccttgtcttcagtctctcacccacccatgcatattctacactgttaccagttatcttgctccagcagtaccctcttatctgtggtttcattttctgtttcagttacctgaggtgcagcacaataatacattttgagagagagagaccatattcacatgttttttttttttttttttttttgagaaagggtctcactctgttgcccaggctggagtgcagtggcatgatcttggctcactgcatccttgatctcccgggctcaagccatcctcccaccttagcctccagaatagctgggactacaggtgtgcaccaccatgcccagctaatttttgtatttttttgtagagatggggttttgccatgttgcccaggctggtctcaaagtcctgagctcaagcgatccgcctgccctggcctcttaaagtgctgagattacaggcgtgagccaccacgtccggtccacataattctattatagtatattgttataatttttctattttattagctattgttaatttcttactgtgcctaatttataaattaagtgttataggtttatatgcataggaaaaagcatactatatttagagtttcaaaactatccacagttttaggcatccactgggtgtcttggggcgtacctcctgtggataaagagagactactatatttccctcctcaaaacattcaaatggctccctgttgtcctttgtgatctcatccctgcctgcttctctagtttcatctccagcttcgttcttactggtacctgtcttctatctgcataggaacacttggcaattccttcatgccttattctttaatacctttaaatcaagcatgttctatttttttgagctggaatgccgttttcttctttagtgtgtccgccaagctcctaaatatccatcaagattaagcttcctgtcagtcttagaagaagctgtcctaggtaactccttccttcccatagcaccatgtttatagctctattgttatatttaacatattttattataataagtcatttatatgttctttttccacaatgtacacagcttctgtgttcaagaaactaggtctaacggggaagacagacaggtaaacagaataaagataggacctgaagatgcaatatggtaaaatggcaggccagcaggctatatgtagtgtatatatatatatatacacatatatatatatttcccagagtgttttgaaaaacagtataatgaggtacgtgttttgatccacaatgtaaactatttcatacccattgtcttatctgtgacctcctcacatttgagtttgcaaatcctgctataaagggaagaaactataggaattagcttctagaggaaatgattaggggtttgttctagagtttaggtgggatggttgtcttaaggaagaaatttttttgtttgtttttttttctgcaactaaagggaataagaaaacaatatgtaagatcactggtgaaaaccaggtacaaaagggcttttgcatcatggtctcaatcttcaacagatggagaggtttattcattgataaaaagggcaggtaggaaatttatagaggtgtttcaaaaagaaattctagaataatcactttaagtattgcatttgcccagagattacgtacattggtccaaaaatgagtgatacgaaagctagactgaaatccaacagatggaatatgtaatgaactaggaggtcggcatgggcctgttttgcgtttgtctaaccaatgttgattagaagcagaaatggaggcatttgaggccctcctgatcttgagctaccatcagtctttacttttcactatcctatataaattgtactttaaaagtcaagccaggaaactgcctgttacctgaacaaaaccacccccttagcctcaggcagtattgcttctgactttgctcaagggatcttttttgtatagaatgttttctttcctttgtcaacattctagccatcctccacagctcttccatgaagcctgtcttgatcttgatccgctctcccatttccacctacagtaatatatctgaactcctatagcactttatttttaactcttagggagtcactcttaactttatcttatagttcctatttctttatatattccttaagggctttcagaatactcctattttactttatgcctgtagtaatttatatccttaaataatactgtctcacatactatgagtctttgtatatccacgatacagactctatgaaggaaggcaaattttagtagcaatcatgggtttagaggcaaatggacctggtttcagattctgtctctgctatccaaggtcacatactagctgtgtgaccttggataatttacttctctgaatctcagtcttttcattgataaaatgaagagaataatactaaatttgtgatatttttgaagtatattgtttatgtttaatatatttaacatgtaaagaatcttgcaaatagtaggtctgaattacatttttgttaaatgtcttgaattctacaaaatgcttgatatgaaagacataaaacataaagactacatggtaaaatgagataagactgagctgccttttttgttgttgttcagtgttcaagatgtttgctatttgaagatttaaagggaaaaatgggatttattctgggtcaagaatggtgggaaggattcagctggatgctggaaggagaatgttttgcctgtttattggaagctatttgttatgtggtgtggattattgctgggctttgaggaaaaaagtaaaatcatatatgatctcaagttaatattgacaagattattttaaagatttaataaaatagttgaggatttggtatagatactgtctgtgatgggaaatgataaaatatctttctggtagatctctagaaatagcaaacagaatttggagtagggaagagataaaactgaattacttttttcaatggcttctcgttctaaataactgttgcagaattttgtgaagcaaaataaattgtttttattatttagtaacaatgcatgaaacagatttagaaaacagctaaaatgattgattttatttcactacaagccaggaataatttatccacaggtagaaaaataagcattcttctgtgacaaaaagtaagaattgatatgattacatatgatagttggaaaatagcaaacattgtaatgaccagaccttataattttaaataagaggtaatttaataagttggcagcagcaacggctttttgggaaagcatttgtctcgtcatcagaagagtctgagtttgaatcctgattcactactcattcattccctgtgagcttgtaaacctctctagactcagtttcattcctttcttgaacacaaagttactgggtacttattagtgccaggcattattccaggtgctggaatgatgaaccatacagataatgtcttcatggaacttacattcaagatggggaaacagacaatatgacacatataaaatataatgacaggtaagcgctattagagaaagcagagagtgatcagggtgtggtattttagataggcgagctctttgggcaaatgacatttgaaaggagacctgaatgaaaatgggaagagccatgcaaatatctagggaagagagaacatcaagtgcgaaggccttgaggcaggagtgtgcttggagtatctgaaggaatagcagaggtcactgtgcatggagtggggtgaacaagggaaagtatgggggtgtttaatcccaagagttagggtgactaaaaacatatgttaagcatagttagtgggttgttaatttggaaaggtaagttcaggtcattttaggagagatattttgaagaattgtcactttaatagccagccaggagccctggaagggtttgagccgtggaacgacaaaatccaaggtgtatttggggaagagaaaggtagcagtggaaattggagaggttagacataagggcaaggagatcaagttgggggttgttgctgtagtttaagtaataagggtgctgaactggagtgtggttagtaggaactaaatggaggatatagatgagagacagagactgtggaagtaaaatatcccagcctcagcaaatgattttaaaagggcagaagagatgtatgaatcaataatgactgaaatttcaagcatgggtgaccaaaatgacttgagcattcatagagtagtcagggacgagaccgagtttggagtaaaagaagattgagttcagttagatatgttaatcagggagaaattactagaatcacaatagcaggagtaaaggtatcaccatgcaagaacatttatttagctcttacagcattagcagtataattttataatttggttctctgtttcaaactactgcttttaccattttaaatgtactctctgtatattgctgctgagactatgttgctgatcattctaataacatttacctgcttaaaagctgaagcctgaatatctttactaggtattgaaggccaagtatacttgtagatgattcagtggaccaagacagagaagagtgaatcattttggtggcttgtagtatcatttaccagataaacaatctgacataaaattaagaggtcatatttgtaccttttgcaatgttcctaataatctcagtcaaaaaaacaagcccataatagtgaaggtcagatacaaatgcatgcttctttgccctaatggagcatgggaatcatgagcactaactgaatgactgttgcaagagttttctcaaaatagagccaaatgaactcccacccgccagccggccctcttccaggctgacaatgaaggtaatactgagagtaagtttctgttaaaagtataaacatggctgggcgccgtggctcacgcttgtaaccccagcactttgggaggctgaggtgggtggatcacttgaggtcaggagttcaagaccagcctggccaacatggtaaaacaccatttctactaaaactacaaaaattagctgggcctggtggcaggcccctgtaatcccagctactagggaggctgaggcaggagaattgcttgaacccgggaggcagaggttgcagtgagccgagatggtgccactgcaccccagcctgggtgacagagcgagactgtgtctcaaaaaaaaaaaaaaaggataaacatatgatcaggcttaaaataataaatttagtgttatctatgtattacttactataagctgcctgatagtaatatacctaaaataccaccaagtgtggcagcatgctttgtaggctgttaagctgctactacattaataaattgaagttttattagtttatttatagaatagtatttgataattacctcacgtaatattacacttgtgtcaggccaattatttgaatatgttctgtgaaaaaagattaaatcttatttttccttttttctcctttttataattgtgtagtccagaagggggagacaaaacattgattattggaggttgaagtagctgcttcgtgatgataaaacattgtgttcttgtattccaatttgatttttttaaatgggtttagaaattgtaggatagttgctactgtaaaatatttagttttatggtggtgataattttgttaaaaatctaaattcagtcagaataaaaataatgccattattttaaactagcatatataaaatagaaaaactcatttggtgatcagatgaaaataagacctgaaactatttaatgatggtatattataagtgatcttttaaaaatagcacaaacactattaaagtaccaatttcagtcttttctaatttcacattcattatatgcaacgagtagctactttcccatttcctaatgttttaacactgcaagctaacttgtacattatacttattttggataggggtatctgtatatgttttgaaaggttttgttatttgaatttcccttcatttttggaacactatcgtatcagttccttcccttcccgtgcattgtcataaattgcattatttcatcatgccagattaaattcattgttcaatgaatgctgaaatatagattatgaaatattaacaagtcatcttaccttgggcatttggaaatgtctaaaagacagcatgaatgttagtattatgtttagacatgtattttgaaaattgattatattaatatttatgaataggggtcattatgttttataatctatcctgatattagaaatgaaaagatgtatatttcatgtatgattttgcatcacaaattcattagctgtgcattttgattgtgatcatgttggatatttctattgaggatatttttctgtgtgtataatcaggtaaaagaatcaatttaaaatctgatgcttgatataagacatttaagactagtatagccattattttttgtactggattggtttattttactaacaatggaaaaaattttgatcatctatgtagaatgaggtaattatatgatgtctttttttgtgtgtttttgttgttaagtaatatagtctctacaatatatatcctttaaaagctctgtataaaatttgctgttgccattataaaacttaaagtggcataacagagggattttttttatgaggcaatgcttcctctatccagatagccttgtcggcaggggaaaaagaggaaacaatcagattacaatcaatgtttagaagttaccttaggctagatgtagttggctcatgcctgtaatcccagcactttaggagggtgagatgggaggatcacttgagcccaggagttcaagatcagcctgggcaacatggcaagaccctgtctctacaaaaaaataaaacaattagctgggtgtggtggcacactcctgtagtccaatctcctagggaggttgaggtaggagaatctcttgagcctggaagtcaaggctgcagtgagccgagatggcgccactgccctcaagcctgggtgacacagttgagaccctgtctcaaaaaaaaaaagttagcttagctactgtatataaaattttgggcccttttctcatatatttgattccatttttcattttagttaatcaagtttcttctgtctgtttatctgttcggaaaggactgtttggttgaacaaacattagttcctttgaataagtagaataagataatcttaaaaagaaaaaggccgccttagatttatgaagtgtttcagagtgtttaaagcccttcatgtatttcctcacttaagctacgtgttatatgtatttctgtaggttcgtgcatcagtttttcagaagacattgcctccatctccaaattcttggaggctagttagagtctggccttatcccatggagatttttttggctgaaagctatatggacagtcttttgagtagtttgtactgaccaaggtatttcctgtcagtggtccactgatattcataacatttaaaaatgatacatgatattcataacttgtattaatatctagtttatatgcttgtatgaaatgctttctgggtctgcattgctaaataatggtgatgtgaccagtgacatttagagtaattttttgtactgtggtcaccataattcggataccatgattattacattaattgcatgtgcttttatagttgcagccataattacctattaaaacaatatagaaaaaaatgaactttaacagcatcaaagatattaaaagcatttgggttcattttttatgctgatctgtttgtaaatttttagtaacctgtcatggttcttttctttaatgaatttgtgatctaaggagaaaataactgcttgtgcaatgtaactcttgtgcttggagaacataactgctttgtatatttctggtaaatcatttatttttattgatgattatgatgcttttttggcagagtgcttatccactcaaagagctgttctacgaagtgtgattggtgtctgtatccaagatataacatgtattctatgtgtttatatatgtctctctatatctatttatccatctttctgtctatcctcccaaagttaaatgagcttaaataggttgcctctgtgttagaaagcagagaagtattactagagaactgaggctcttccccaaaattatttcagattttcttattgtgtggagtggttttgcttggaatgagaaaagctatgtgttaccggctgaattgtttccccccccctcccgccctccccaaatttgtatgttgaaaccctaacatatcagaatgtgactgtgtttagagatagggcttttaaagtgttaagttaaaaaaaaaaagatgcctttagtgtgagccctaatccagtctgactggtgtcctggtaagaggacatttggacacacagagaggtgccagggttgtgtgcagacacagaggaaaggccatttgaagacagagagaaaagatgaccatctgtaagccaaggagggaggcctcagaagaaaccaaacttactgacactttggtcttggacttttaatgtcaagaatggggagaggggccgggtgatgtggctcatgcctgtaatcaccaacactttgggaggccgaggcaggcggatcacttgaggtcaggagtttgagaccagcctgggcagcgtggcaaaaccccatctctactaataatatcaaaattagctgggtgtggtggcacatgcctatagttccagctactcagcaggctggggcacgagaatcactggaaccaaggcagaggttgcagtgagctgagatcgcgcctctgcactccaacctgggcaacagagtaagactctgtctcaaaaaacaaacaaacaaaacacaaaacaaaacaaaaaaataaagggacaacaaatttacaaaaataaacaaaacaacaaatttctgttgtttgtgttccagtctgtggtattttattatggcagccctagcaaactaatacagtatgtaacagtcattttgttgtatttaacactgaataatagtgaacttttagagaacactaagtgccaagaaccgtgctaggcaagcttcatgtaaaacctaatttaatcctcataagaattatcacccccattttatagattaggaaagtgtggcttagaaaagtaggtacattgtttggggttacatagtaagtaagtgggagagctgggatttgaatccagtcaggctgacttcagagcttggcctcttaaccaataactaagtaagatttggtggatttcaggcagttgtggataataattgacaccacaggtgttcatcctctctaacactgttaatatttagtctttcaccatgtgctagtaggcaattcttattttctgccaactggagaatacctacagtcatacctacaacacagagagaaccttgcccatggaaaagctgctacattacagagaattaaagacctctgtgcacgtgttgctcaatgggccaaaaatgactctgccgatatggtctttgtggctttcatagcagatgttcacgaacaggtaacatcaatgcagataaaccatatactcagcaatttaaatgtgaggaaaaagatacataaatattagaaagaatcccatttttagcaatggcctataattctaagccatttttcctgtgtctgaaatagattaaccattgtgcctcttcgagttttttttctatctgtgtgttcacctttcttatgcacgcttgccttttataattaatttcaattaaacattagttttgtttaaataatactgtgtaattaaaatgcttatgtgctctcagagggcaaggaccatgtcttaatacactttagacatttttaaatacactaggctataacagcaataaaataattaaacatcgttttgttcaatctctacatattcacaattcctctgacactgaactgtgtataaactaaaatcagaaagctgctagttattttataatgcttctcaaaacagaagtcctcttccattggaaatgcagtctagcatcttaaaatctttttttttctttcaagaataaaactaaatttcttctattgtaatttaggtcccttgcctcttggtaagttttctatttctgctgaggaccgttgttcatcatcacccatgcaatctctcttagagtactcataggtttaagtggtccctcagctgctgcttctcccacttcctttaatttttccatataatactgccttctttttaattgcttttagagtgtctacagtttggggcctcagaagtggaaatgctacttgataatacacccaatctaaatgttcattcttattttactcaacgtgtgcttgtgtgtgtgtgtgtgtgtgtgtgtgtgtgtgtgtgtgtatacttcctcagttttggtggtgcctcttctattgatggtgattgttatttttttgttatacagatgtgactaaaattgagagttttttctccccgttctcttcgcattatctaggaaactccaaagatagctcttcatcataccaactagaaacatcttgagtgttcacctggagtttttctccagttgttttcgcttatagcttggtgtgcgaagttaatcatacccgtaggaaaaccaccacatgaaatggatgcttagagcgtacgttaaaacacagtgaaaatcataatatttgggctttgaagacctgggggtttaggtcatggctctctctcttaatggctaagtgattgggggtaaaacacactcaacctttctggagcctaagtctctttatctgtacttactctgtcatcctaatagagttactgaatactttgtaaactgtaaaacacagtacacatttaaatcattatagtaatcagttaaggaagtgattctcatggtaattcctaatatatatatttttgaagaatgtgttgatcacaactactgccaccttttagtgacacatacatcaatgcatttgttcctttattactcagtgttagtttagaagccagttatagttataaactttgtaaaagctgacgtcttctaaggtagcccctaggctacagactacatgtaaagttaccctttttatgaaaagccacaagcaactgtgaagattatccctaatcttccatctaaatatgaaaatatttgcattttaagctgcataaccatggtatccttttcttcttttcttttcttttctttctgtgtttttgagacagagtctcactctgtcacccaggctggagtgcagtggcgcaatccctgctcactgcaccctctgcctcctgggttcaagtgattctcttgtgtcagcctcctgagtagctgggactacaggtgtgcgccaccacacctggctaatttttgtatttttagtagagacggggtttcaccatatcggccaggctggtctcgaactcctgacctcaagtgatccgcctgccttggcctcccaacgtgctgggattacaggtgtgagtcaccatgcctggctgcttttcttatttcatttgaactcttttctccaggtatattatatatactgtataaatattattaaattaaatattattatatatagtatataaatttggggtttaatgactgtttctaaactaagatcacatgaactcagaaatggtaaagtagtactttgagatttgtggtagtaaagaatttgactttttttcctcctaagtttactaaatatttcaatacaaaagcccatatttccttaaaagatatgatgtaaaccaactatgcaatttaaagcaaatcatttttcaagtttgctattctcattataagaagagttcaatacattttagaaaatgtgagaatgcagttaaggagaaggaatcaaaacaattgcctataaactttacataaactattgttagtaatttggtatgtttatatttaatcgtttgtcagctgtgtagttaaacttttagaattctttctaccactttttgtagctatacttccctttcagaaatgaattcctattttattataaggtacactgatacagataattttggtagatgatagcttctaatagcaaagtagtattttaataaatcctggcaccctcacttcatttaattatagtctggttactggaaattcagtatctagaagcattttatgccttgaatagttgtggcataattttatctttagtcatgtttgagtatgtcagtagtcataggccatttttatgtgttttgctggatagctttaaaaacctaatgaaaaatgtttatgatttatccctttatcggattaaaattatacacaatttgctatcaagatgtaaaacaacagaatctcagttttctcagattagtaattataatgatacatttttcttatttttgagatgggaataatttggaaaaaatctagaggtgtagagtggatatgtagtactagaaacatatcaacaagtttcaggaaatcttgtaaacctctattttcattattttgggatgggggggttctattgaattaccattgcaaatgaagcaagatcttcatttggaaaatttacttgtattaaacagatgactgggctgaaatggctgctaaaacaatttcatgcttttgtttttaatgtagtccagttataaaatgtcacatcagattgtgtgtgagtacacaaatgcataattttaattttatttctgagttatcacattttaggaagttgattaaaatcacccagaattttttctaagctttttatatataacaaattaactatttgaaatgagttaaaacaagattgatattttggcagtaatacctttattaaagaaattgatcaattcttcagtagttacccattttgtccttttttaaattttattattattatactttaagttttagggtacatgtgcacagtgtgcaggtttgttacatatgtatacatgtgccatgttggtgtgctgcacccattaacttgtcatttagcattaggtatatctcctaatgctatccctcccccctccccccacctcacaacagtccccagtgtgtgatgttccccttcctgtgtccatgtgttctcattgttcaattcccacctatgagtgagaacatgtggtgtctggttttttgtccttgcgatagtttgctgagaatgatggtttccagctttatccatgtccctacaaaggacgtgaactcatcattttccattttgtccttttatttttgaatatgtaactcactgccaaattttatttgctctaatttcttattttagaaatgtcaagcctacagaatcattgtaagaatattacaatgaatagccatagacctttcacccatattttaaaattgttaacattatgttatatttgctttatcattctcttttaaaattttttttctttttttgccttttctgagccttagttgcctatttgtaacactttactcctaaatacttaagcatgtctctcttacgaacagggactttctcctatataaacatagtttaattactaaatcaggaaattcatcactattataatgttgttgcctaatatagagcccgtattcaaatttctccaactatcccaataatgccctttataacttcttgttttctagaatctaatcaaggattgcacattacatttatttgtcatatcttcctaatcttctgtagaacaagtcctagacttaaaaaaaaatttcatttcattaacattttcaagagaccaagacacttattttgcaaaatgtttctcagtggattggtttcattgtttccccatgattagattcagggtaaacattgtgggcaaggatgctacacaggtgatgttcttcctcagtacatcacatcaggaggcacagggatatcagtttgctccattattgatgatgttacatgtgatcatttggttggagaagtatcttccctatttgtctttgtaattaataagtgatatgtaggataatactttgagatcatgtaaataacctatttctctgaaacatttcacatggttttaaaatctgttgatgagattcttgcctgaatgaattataactaggattgctacaaaatagtgatttttctaattcattgttacttctgtatttatcatctggtattcttctgtaaagtagaactttcccttacctctttaaccttctttgactttttaaaagaaatatcagcatggactcacagattctttatttaaattcaattaactaccctaccttattgatagaaactctataaaatccattcaattgtttactgaaaataacacataaaataaagaaatcaaacaattaacatctgttggtttttactttatgaggtaactatacccatactaactcattaagtctcatctagaagcagttctacttttccccctagaagaaaacattagacaggtgcagtggaatttgaagtaatgaaatgtctgatgtgatacatttattcactgcatttgttatatttaggccttacttatattcattgctgcataatccttctgaatatcttaaacattaaaatctacttttctatcttatcagatacaagtcttacttcagattgctatttgaattagaatgcctttagccatcttcattttcaggcttccattgtttaaaaagtcatgatggcttatccttaactgttatcaagcatgaatctataaatacctacaaatgtgttttctaaaaacaaaaaaattatggtgtttacatatagaaatgtatgttgccatagtgttcaataatccagagcaatgcttttcagcctatcttccttgtaaaaagctgttcaccttaggcttttgtagcggtgctttgtaagttctacgtttttttccgattctgttttagaactctatttattttaaaaatttacaaaaatagcacccatgttcaaagacctcaaaattagtaacttgtaagaccagatgaattcatttttgtgtacaccccagaatgtagtttatctttgcatctttaatggcaaggtattctaagactgcaagagatgctattttaactgttaagatttgtagatacttatttgtgaaaatctggattttctttgtatgatacaactaaaacaaaatgtgtaaatcatctggatgttttgtttaataggactgtagctcttctataaaatgcctggtgttagatgttaatgtttattcaaatagtctcattgttcttttcgattaacttataaatcaatccccactaatggaacactactttaatatgcttgaaaaaatgtttagtcttggggaaaaaagctttaaaactactgatcttacagaaaatgtccatttcaatatgtaaatttagtatacccattatttaaaatgtgtgtgtgtgtgcgtgacacttttaaatgcatttgtatttgctatcatgggacattgaatcagggttttatttttttattttttgttttttatttttaattttgagatggagtcttgctctgttgcccaggctggagtgcagtggcacgatctaagctcactgcaacctctgccttctgggttcaagcgattctcctgcctcagcctcccaagtaactgggactataagtgtgtgccaccatgcctggctaatttttttgtatttttagtagagacggggtttcaccatgttagccaggatagtctcgatctcctgacctcgtgatccgcccgcctcagcctcccaaagtgctgggattacaggcgtgagccaccatgccctgtcgagtcaggattttaaaactagctctccctgatctttttttttttcgatgaagtctcgctttgcacccccaggctggagtgcagtggctcgatctcactcactgcaacctccgcctcctgggatcaagcaattctcctacctcagtgtcctgagtagctaggattataggcgcccaccaccacacccgactaatttttgtatttttagtagagacggggttttgccatgttggtcaagctggtctcaaactgccgacctcaggcgatctgcctgcctctggcctcccaaagtgctgggattacaggagtgagccaccgtgccgggcctctgatctttataaaaataagataaatggtgaaaattgggaattcttactgctcttatgtaaaaacaagaataattttagtggtctgaattgaagggtcatgagaagcagcaggtatactaagctgtaaatctgtgggactaaactataaatcgtggacaagtggtcaagcagcctttaggaaggcaacaatatcatggcaatactctatttctgagctgatgttagagtttgtattgtcaataagatcatggtaaagtttaaccacaagttttgcagcctttcatgtttcctccatactcgtggaatattacccttccaacacagacatttcccttttaatagagggttatccttattacctccaccacattcactatccattttatatccatatcttgatttctgcccttctaattagtctactttgagtaattaggataaagcatttctgaaatttcattatataagcattaattactgtctcttaggtctaaaataatttttcggtcacattttctaattgccaaaattattccttggatcgacattcatactatttttctacaaacattatattacataaataaaaagaaaaagtttatatatatatataagtattttatggatgaaggtaaaacatgagataatttccttatgtatggaacaactaatattaaattaattctttaaggttgtatttatagctctcttatgcaaggagaataacttaagcaaaatagtacaccagataactgttatgtggtaatagagagattgaattaacactaaaatgtgttaaaacacatatatttataaaatagacttaaatttcaagaaataaaattaatactgttgaaagaagtgtagaaatcatatagtgactttaaaagtacacaagttcccctcatttcaaaggtgtgaatcttttgtgacttttatactagtatttaatactatataaacctcactgtttattctaaatattttattttattttattttattgtagagacaatgtctcactatgtcactcaggctggagtgcaatggcacagtcttggtcactgcaacctccacctcctgggctcaagctgccctctcatctcagcctcctgagtagctgggactacaggtgcatgccaccacacccggccaattgttttgtatttttgtttgtttgtttgtttgtttgtttgttttgagacggagtctcgctctgtcacccaggctagatggggtgcagtggcgcgatctcggctcactgcaagctccgcctccggggttcacgccattctcctgcctcagcctcccgagtagctgggactacaggtgctcaccaccacacccggctaattttttgtatttttttagtagagacggggtttcaccgtgttataaccaggatggtcttgatctcctgacctcgtgatccgcccgcctcggcctcccaaagtgctgggattacaggcgtgagccaccgcgcccggccttgttttgtgtgttttgtagagatggggtttcgccatgttgcccaggctggtctccaactcctgggctcaagcgatctgccctcctccgcctcccaaagtactgaggttacagacatgagctgctactcctggccaatatttcttatttatttatttaaaatatttagtgagtgcttacagaacgtgccggctacttttctaggtactggggtgggggcagggagaaaaagacccctggggtatatagtctacttgggttagtgttagagtagaccattgataaatgtatttgttttgtaaggggatgggggaagccacattttctagttttcaatatacctttataaatggagcatttgctttgataaaattgcaattctgttaacgtctcttaaagtattttgtttctccacaagggattattcagtattaatcattcaatgcgtacgatcagtgaaatcttagcaggccaaggataactcttgtgatactcgtaaaacaaccagaacagataccactttacaaataaaggacggtgtggggatctactgtggtggttagaaaagccctgaatatctgatttgtgactaaaatgtggagagggaggggaagaaaaaagggagaacatgagggccagccagagttaaagaagactctggaattacatttttaattgttaagtcattggtttaacgacaagagaaaaaggcatgttctggctggtaactgacttcagaagcctagggcttcttggacagaagatacaaaggaaaaaactaagagaccaagaaggaagagagtgaacatgatcgttcatagtggtaacatcgatggcttgtagatattaaagccatcactggcagatgcaaactagagatggtggtaacaattttctgatggactttaggagtagtgaccaagctagttggatggagataaatgtaatgaagacatatgtagaagagctctttatttcagcaggtcaaggagtaaccaggcccaaagggcaaggtcacaaggcattgcctctgtgagttttcaacatgcagatgagtgatgtcaccagtttgagaagcctactcaccctcctcccagtcttgattctgaggacagatacttgtaacttgaaaaagttctctcccttcctcctttgggaatcactcctctattctgtgggttttctgactgtatagaaaaatctgctggtatcttaaaataactgctaaggatattgtgtgaatgtagaacctgtaacacacactgttcggtcatttggccctagttaccatccatctgcatctgaatatcccaggcatatctatagcagattgtaacatgttcagatcactgggaggtataatagtacattgtagacagacagagacatattttaacctaaaatcttaaaaatagatgcattggaatggatactctgatctccccagaatattttattttcctaaaatgcctcattcttttccgatctttaggtaaggaggtattttgctttatcaatctgctttccagctgtttgggatttaatattccacatagatgcatgcattttctttgtaaataatgacaaagacagattacataattacaggcataaaattatctcatcttgctaaaaataatacagtaacaggattagtatgtgtatcatctgtatgaattaaccatttatttttattaaaatactaagatccatattatgaccacccttatgtgttcattgtctacttgtttgaatcaagaaacattctggcctttgatttcttgtagttatagatatatggaattggtaatgttgattgaaatataacatagtccctttagcttcagtactttaggaaaaggttcctctgtccactataacatttctcaaacccatgtaaaaacagtagtgtaaatataagcatacacaattaaatgagtgaagtaaaactcattggtgtgactatcagggctttaaaaaagtgtgcagtttgaaaaaaaatgaaggtgattatatagtaaaacaaacatctgtctctttcctactatccctgcactatgtataggacttgcttaattagaaagaagaagacatgatggaatatggtccaaaagtttgaagaacagtgaggggcatcagggcctggatgataaagctggacttcagtggattctgtgttaactgtctagatactgaattattgtgtagtaaatcatcaatgcagagtggaaaccttggaaatgttggctggaccttgactacagttggagaatagcaatttctgtaaggctggctgaatcatagtcagatcatctcagaaaagatgagcagcagtggttaagaaggcaatctctggagtctgtctgcccaggtctgaatcgtggcaggctgtctaatcttgcttttctcatttataaaatgagatgacaaaaatagtatttatttccaaggtatgttgtgaggattaaatgtcagccattgctattgttgttgttaggaggggagttaaatggattttggttttggacagaaaaaatggatttggtttgtaaaagtaatcaaatataagcagaaatatctgctaagctattggagagactgaatagatactaggtgaaagggaagagtaagagttgttattttgtgagtccttgtttttgtttgtggttctatcacagaatacctgaggctgggtaatgtataaagaacagaaatgtattttctcacagttctggaggctaggaagtccaagatgaaggtgatggaatttcgtgagggctctcttgctgcatcctctggagggtgccacggacaatgccatgtcctcaacatggtgaaaggtggaagggtaaagagacaaaaggtggccaaacttgccttttttttttttttttttttttggagacagagtttcgctcttgttgcccaggcacgatcttggctcactgcaatctgcgctcgcctcctgggttcaagcgattctcctgcctcagcctcctgagtagctggcattacaggtgcctgccaccatgccctgctagttttttttttgtatttttagtagagatggggtttcatcatgttgcccaggctggtctcgaactcctgacctcaggtgatccacccgccttggcctcccaaagtgctgggattacaggcataagccaccactcccggccccgaatttgcccttatataatgggattagcctacccagtgggacatagcacccagagccgtatcacctcccaaagttcctacctcctaataccgccacaatggcaaccaaatttcaacatgagctttggaggggactaacattcaaactgtagcagtccttatataggagccacaacccaaaccttagaaaattttgagctccctggagcaaatggaagagcagaggagaatgtccttgaggactacagggaacaagtagatgagtagggtcaagtagaaactttcacaaggttaaggacacctgtgtatgtttgaaggtagagttggagaaaccaagggaggtaatccaaaatgtgattatacccacaggcccttttccacagaaaggtactgagagtcccctgttgccatcagtgaaactttacactattatgtagtattaaagttatttagtgcagtagtagtcaagaatttggcagctgaaatgagctaaatgcccccttgataacctgtgaagatgttactatcctactgtaagtgctcatctgattaccagggagtcatgaaggtactgtggagaaaggggcttcaggtaattagaacttggaagtagccatgtctgttgtgaagagctgggattgtaaacacattttgcaacagtataaaaactgataacaaatataatttagttattctaaatgtaattgttactacagcggagataacagatgtatttagatcagcttctgtttgtgtaaagaaaaatgtaaactattgattccaatttaatgagcactcacaatggttatagctgtgttatttacatagctatgtaacagaggaaacaaatacctagagaagataaatgagagaaccccaaactgaaacacctctcactgggctttactttcactgctgatgacactaatccttttactttactccagcaataatttaatgttttgttttgcatactagaatccttctagtattaggaagaattcaaaaggtaagggagaacccttgtcaatactatataggtaattgctagtaaattttcttttaatattgcctatgccaaattttagaaaatgtaataatcgaagctagtatgcaagcagtagcttctgtaataaaataactttatattatgtaccgtgatgtaaaccttattgcttgctttgatttatatgcaaatatttctttttcttatagtttatactgctttcagctgctatcttagtttttgtgctctagacagtctccattttttccgtgattaccacaataaaataggcaagcaggaaaaattatggctacttcctgtctaattttgtgtatttgtttcagtagcagtaccaatcttttaggcaaccagtgttgtcgatgccatgaatttacagtaaacctgtggaattcacgtatataaaacatagatgtcatgctggtgaattcaacttacaaggcatggaatagaactcttgcagtgaggctattagtttcaggtaatttaaatctcagtgggaaccaataaatggattttgaactaatatatttttgaagtcttcaaagataggagaagattgtaatattctgagtaaagaaaaaaatcatgggtgatttttttaaggtaaagaggtttaaatttaatgaagtgattaaaagtaatttcaagctttattttccctctataaacattgtttttagttgatttaaaggaaattggttaaaaaattaggcttcttttcaatataatgccaaatagaactaaacatatctttcaatgttgagaactttttctaatgggaggaatgtgaaatgacatatttctgaggacctacacagagcctaatgtaatttattcaccaatcccattgttgattaggatggtagacattactcttttctcttttttttttttttttttttttgagacagagtctcactctgtccctcagactggagtacagtggcatgatcttggcttactgcaacctccgcctcccgggttcaaacgattctcatgcctcagtctcctgagtagctgggattataggcacctgccactacgcccagctaatttttttcttttttttttttattttttatttttagtagagacgggtttctccatgttggccaggctggtctcgaactcctgacctcaggtgatctgcccaccttggcctcccaaaatgttgggattacagacataagccaccatgcccggccctagaaattagttttaaaggatattttacactagtttttcatcaggaaaagtatatcttgataaaatgtttttctaattttagaacttaaagggaaatgtataactacattaaagtataggtagtagtaataatcttatagctaattttaagactctgccactaaggtgttataattcttagctccttctcacacatttgttttctaacataaatgatgtgtaacggcagagatcatgagttacatgttcctcatttgccttgtcatatcacctagtgcaaacttctcacacctgtaacctggaatgataataatttatttacttctttgtctcttttaggacactgtgggatatttgaaggttagagcttggtttctatttctatgccagacaaatcttacatagggtttgatacttagttgttagccagtaaaaatctaggacggctcctacaagaaacatttaaagggtttggcaagacctagggccaaccacctcccaacccgtccccaccctccaaaatgttttgaggaaaattaacacccctattattattagggaagcatgcaaattgtgtaagtaaaattataagtcagagaaaatcgaaatgtccatgtggaatagttaacatctttttgtttctgttatttcagggactgtcatatccaagaggataatttgttactgtgtgcatgttctattagtactgtaagcccctttatacaaaggatgcgtttaatttttatattcccattatgtctgttacctagcattgccaagaatacaatagaggctcattaaaatcttgaatgtatgatcagtgtatgttgttgccagcacaccctcccaactctcccattagatgacaagcaatttgaggggagcacccaagtatttgtcatttttaaattcttctctctttcacactcaacacagtgccacaggtatagtaggcgtgtgtgttgaaggtttttaagagcattcccactttgggggatttgttagaaggactcacaggactcagaatatcatttcactaatggcgaagatttattacagtgacatagtagagatgcacagccagatcataggggaaaagatacaggcggagtttggaggaatctactggtgggctgccttatgctgtgtccctcccacgaggggtcacatagaacactcttttccttcagcagtgaaaatgcagcaatatatgtgtgatgcacctgcccaaggaagcccattagagagtcagtgcccaaggtttttattgggggccggttatgtagacacactctgtttagcatgtaccaagatttcagactccccaaagtaaagcagatattcaatatagactgcattgtttgtacaaacaggcatagtaaaccatccttatcagctaaggagcagtggggacactccccaaaatccaggttcccagataccagccaagggccaactttgcatgcaagcctttctataaatagcagtagtaggcttgctatgtccacttttctgcatagcatggctttgtatgaatactgctttaggcgggagaaggaaactgtatggcatttctttcagtacttagtcttaggctcaatttgttagggagattaaggtttcttttctttgttagaggtgcttctaatgtcttggttgttttaagtgcctgttcgtcgacttgcatcattgctgaattccttttttgaactttatgaatgtaccaaacatacctgatccccactcccccaactagagcttgaaagcttgctgaaagtacagggcttaaactccacgtctccttgcaaatacagtatctaggcatattctctgttgattcctggtttcaggtagttgtttgagttccatataatattatgttggcttttattcagatcgtgcaattttctttattttggttggtgggctggggtattcatagtgcaggacctaagaaagcagtaaagcaaagaaaaaagtgagaattccagaaaatctgggtatattattatagtatcacatgtcctaaaatgttcaaaatttaatttcttttttgttttttgtttttttttttttgagacagagtttcgctcttgttgcccaggctggagtgcaatggtgcgatcccggctcactgcaacctccgcctcctgggttctagtgattctcctgcctcagcctcctgagtagctgggattacaggcatgtgccaccacgcccagctaattttttgtatttttagtagagacagggtttctctatgttggtcaggctggtctcaaactcccaacctcaggtgatccgcctgcctcggcctcccaaagtgctggaattacaggcatgagccaccatgcctggcttcaaaatttaattgctgagctgtttagatgaatccctgatagcatctccatggtgattgttagaaaatcatctttgattactgcttcatgtgtttttctgtaataacacattttctgattgtaaaggtttctatcaattggtcattaccttgttgcttttggaagaacaattatggctgttttatattcaacagaggcccccttatcagaaacagtattgtcttcactttgcaaataattgcagtattgtcttcatttttgcaaataaagagggaaaaaaaatcctatgtatcttagagaattgtgggtgtcaactcaggttctcacccagttaattgtacgttttgaaaatttaaaaaaaatgaaagggctattgacagtgagatgtgacagctaacaggagaaggaggaactataaaaatatagtagtcttcagttgtttcacagagaggaaaacaggcccaggctcttcagtggttttggagggcagtgctgtatgattgcgcagaatagaaattgatcttgatgaggtattatcaagaggagattcaatgtactcctcatcagtgctgtctgtgtgtaatattttcaaaaagttttcatcgggaatggttagctttctccccccttttagttgttatacttaaagagatatctttgacgtacacagcacacattcatggatcactgattatgcctgataaaggactcattgtattttgctctctttatgaaaactcatggaaaaaaataggtatctataacttatttagcacttagtataatcaacaatgttatgggtacaacaacagagaactacaccaaatgaaagagggagtttccagaaatatttagtaaagtttggagcatgtttttcatgctcaccatttccccacattaatatttctgagattaatttccaaagaaaataattggtcaccaaatatattgttttaaaaaatgtttcatgtttttgctgaggcaaagaagtcttaacactttgtggagaaagggaaggcaattaatcattgaaataagataaaagatacttcagccacttgggaggctgaggcatgaggattgcttgaacccaggaattggaggctgcagggagctatgatcatgccactgtcccccagcttgggtgacagtgagactccttttttttttttttttgagactccttaaaaaaaaggattaaagatgcttgaaccttggtgccatcccatggggaggaaaaaacccctatttttcagatttctgcagtgcagttctttggctagctggtagttgtacttgattaagtagaagagggatgatgctggttttattacataatggtctatttctgtcctagcatgttcggtaggcaagcctccaataacgtttactgaccacttactgtgcttgccaggcaatgtgataaatgtttttttttggatgacctcatttaattctcaccgtaatcctttggggagatcatttttatctccagtttaggaggcggctgaaattcagagaagttaactaacttacccagggttagttgtgcctgatgctcaaccctgatgtcttaattgctatactgtgctgcttcctacccaaatgtgctctttgagtttcatgatatggtatttagtaggtttgccccagtctctacagggaaacagggaagattgtagacgtaagaatatacaagaaatgctaagtggctctttattcttctgagagtttctagtaggggaatttacctataataaatgaaatatagacctatcattccttacttttatgttccaaattgtgaaacagaatgttgttttatgatatttacagatctctatatggttttgtacagttatacttcctggattgttttgatactttcttacaagcagtccttgattgctccttttatagacggtttatgtaacctcctgaacaagaatgcatggccaccataatgctggagctctcctttgttgtttttagtgtcctagtgctaccaaagctggaatggtggtcctctgctcctgacaaacaactccattttcagggtttcctcttgcctccatccttccctgccagcagttgcaaggggattcagagcttagtacttttattattatgggagtatttttcaggatagctttactgcttaagcattttatttaaacttacttttcttgtgaaatatgtcccagagggttttattttttattttttgccaactgatttacaaatagactttagaatacaaaccacttataaattgggactgcttgtataacacatagaggtttgaggatactttttctatcagattagattgaatattcttattaatttgaatcctgtgataaatatgatattgtgtatgctgcagttagtttaacacttcagttgctataaaagcataatttcaatagtatgtaaatttaatgtaactttggagacttagagttggtttgttcattttgatgttaatttatttaaattttagatattttaaaataagtttgtgtaggcctggtaatgtattttattccaatgtcattatattttgaaattaaagttactttaaaataggctccaaggaggtgttagttaaattactagtaatgcatttggatgctctgaaaaaagtatacttgtcaaggaataaacataatgggatggcagtagaatccctttataatgctgctgttacatggacactatctgttatgaggactgattttgctatatcattttactatatagagtaataatttcaagagcaataagttttttaattttttattttttgagacagggtctcactctgtcgcccaggctagagtgcagtggcgtgacctcggctcactgtatcctctgtctcccgggttcaagcgattctcctgcctcagcctcctgagtagctgagtagctgggattacgggcatgcgccaccacacctggctaatttttgtatttttagtagagactgggtttcgccatgctggccagcgtcgtctccagctcctgatcacaggtgatctgcccacctcagcctcccacagtgctgggattacaggcacaagtgaccgtgcccggcccccttccactttttaaacaacagaaatgaaacttattaagtaggggccttcgatctggaggctgggaagtccaaggtctatgtgctagcatattccttttttggtgagggcccttttcctggctttcagactgttcccttctcactgtatcctcacatattaggaagaggaagctttggtgtttcttcctcttataagggtgctaatcctatctggggtttccaccctcatgatgtcatctaaacctaattacttcccaaagatcccacctcctaatacaatcacattgcaggttggacttcaacatttattttgcgggggacataaacatagtccataattggtgttttcataaaaagaccatatatcaaacagtagtgtggtgcacagtaaataagtgccatgggcgttcagattagagaaaaactattgaggtgagacagctagtaaggtagaaagacagacaatgtgttgttcatttatgtatctggcttaatctgttcaggctgctataacaaaataccatacgtggattagcttatacacaacagaaatttattgctcaaagttctggaggccaggaagtccaagatcaggatactaacagatttgatgtatggtgaggacttactctatgcttcatagatggcaccatcttacaaccttcttacctgacaaaaggggcaaacaagttcctttgggtctcattatgtggcactaattccattcatgaaggttccatcctcatgaaatagttgcctccccaacggccctaactcttaatactattacattgggattaggtttcaaaataaattttggggagacataaacattcagaccatagtagtattcttagtgccgagtacaatgcctgaaacaaagtaggcattcaagaaaggtatgctaaattgaagaattaaaaatcatggaaatagatattttgaattggcaggcatcttacaaatcaggtagtccaagttgcccagaccatttcaactccgctaggaacattaaaataacacaaagccattttacactcattaaattgccaaaaaaaaaaaaaaagtctgataataccagctctcattttctgctcatgagactgtaaataggtaaaatcatgttggagagcaaattggcatcattaactgaagttaaagataactctatcctgtgatataacaaatctcatttaatatacagactctagagaatgtctcacctatgtgattgattgtattagttttctggggctgccataacaaactaacataaactcggttgcttaaaagcttagaaattcattgtctcatagtcctggaacccagaaatctgaaattaaggtatcagcttccctccctgtgatggctctaagaaagaattcttccttacctctttcagctttggatggatccagagattccttggcttctggctgcataactccaatcttttcttccaaattcgtgtcatcttctgcttttcctagtgtaactcttctctgtatgtcttttataagtttatttgtcattggatttagagcccattcagataatctaggattgatctcattttgagatccttaattatatttgcaaagatcctttttccaagaaaagtcacattcacaggttccatgagtttgaatatggacattttttttggtggccaccattcaacccactatttcagcaaatatttaaagcagtggtctgtaccaaaactaactatgacctccctgtcatttgttctggtcttctagttccttgtaggtcacaggttatctcactgcaacttcagtaataaaaaaatttgagggaaaagtgatagtagctttatttcattacttatatatttcttgagactagttttatggcctggcatatagtctattctggttaatgttccaggttaatgttccagttatgcttgaaaaaaaaggtatagtctatatttggttaaagcatttcataaacatcatttagatcaagtcagttggtagtgatgttcaagtctcctatttttttaaaaactattttctgtctacttattctaccaattattgaagaggcacagcgaaatccccaattataattatggatttatctatttttagttctatcagtacatttgcttcttgatttttgaaacaccattattatatacacattgaagattatgtcttctttattaaatgatcattacataatcatagattgtacttctttatctttggtcatattcgttgtcctgactctgttgtgtaattatttacctactctagcttttttattattatgatttgtgtgatatatcattttgtatccttttacatttaacccatttttatctttatattaaagtgagtcaggtagacagcatatatttgggtaattttttaatgctttgtgaaaatgtctgccttttaattgatatggttaatgcatttacatttcatgcagtgggccctttgtgtctgcagttttcacatctggagacacaaccaacggagaaatagtggatgcagaacctgtggatatggagggctgaccatgagggacttgagcatgtgtggattttggtatccaagaggggtcctggaacaaagcccccatggatacctagggataactgtataattattaatatgactgtatttatttctaatttcctttttttgttttttatttttttatttttagttttgttttgttttgttttgttttgagacggagtctcactgtatcactcaggctggagtgcagtggcgtgatctcagctcactgtatcctctgtctcccgggttcaagtgattcccctgcctcagcctcccgagtagctgggattacaggtgcatgccactgcacctggctaatttttgtatttttagtagagacggggttgcaccatgttggctggaatggtctcaaactcctgacctcaggtgatccacctgcctgggcctcccaaagtgctgggattacaggcgtgagccaccacgctggcctcttatttgttttctatcctatctgtcctttgttcctttaactctttttttgccacatttggattgtgtgtcattttaactattccacttgatctcatgtattggcatattagatatggctctttgtttagttttcagtggttactatagaatttatattatgcatcttaacttatgacagtctagctttatatagtattgtatactttttctataagcaccttgcaatagcatccttatgtttgcacccccatcttttttattcttctcagacattttacttgtatatatgttataggtctgaccatacatcatattaattttttctttaaataatttgttttggggaaaaatagactgtaaacaatctcttatatattctcacactctatttcacacacatttctggcactcttcattcctttatgtagatctcagtttctatctgatattaattttctttagcctgaagaattttctttaagtatttcttatagtgcaggttttcttgcattggattttgcactgtatattttcagattatgtttgtctataaatgtatttatttcaccttcattttggaaagacattttcacaggttgcagatttctaagatgacagatttctctttttttttggtttgttttctttcagaaatttaaagatttcatccattgtcttctgagttccattttttttttcatttagaaaagacatttgggccaggtgcagtggctcacgcctgtaatcccagcactttgggaggccgaggcaggtggatcaccgggggtcaggaattcgagagtagcctgactaatatggtgaaaccccgtctctactaaaaatacaaaaattagcaaggcatggtagcacatgcctgtaatcccagctactagggaggctgaggcaggagaatcgcttgaactcgggagccagaggttgcagtgagcagagatcatgccactgcattccagcctgggcaacagagcaagactctgtctcaaaagaaaaaaataaaaagaggtttaattggctctgcagaatgtataagaagcatagatacttctgcttctgtgggggtcccaggaaactttcaatcatggcagaaggcaaaggagaagcaggtacttcttacatggaaggagcaggagcaagagacggagggggaggtgccacacactttaaaaaaatttacaacagtcttttttctttttcttcaatttttaagttaaagggtagatgtacaggatgtgcaggattgttacataggtaaatgtggagttgcattgtttttgataagaagtcaccaatcattttaaactctgttcccctctttgtaacatgtctgtctttctgactgctattaatattgttttatcattaggttttgacaaagtgattatgatgtacttttgaggtgtttttaatttttacaaatgtttatagtcagctctctgtatctgcatctgtggggtattggtgcaggaccccctgcaaataccaaattctgcagatactcaagtctcttacataaaatggtgtggtacatttggctctccatatctgcgggttttgatctgtagttggttgaatctgtggctgtgaaacctgcagatatagggagccgactgtatctcgtttgggattctttccgttcttaaattcgttggttagtagttttcatcaaatctggaaaattatgggccattatttcttcaactatttgttttgatctatcccttcaacattttggaaattttttctgtagtagatcactttatattgtccatatgtcactgaggctctgatagtttttttagcctttttttccctctctgtgcttcagattggtagttctttttaccattatcttaatttcactcatcttttctattgaagtgtctaatctgctggtaagccatacagtgaaaatttcatttcagatatggtatttttttcagttctcgagtctcatttgatttctttttttttgtagtttcatttctcttatttatgttaatgttttgctttatatcttgtatataatactaatatctgttttaaagtgcttacctgctattcccatcatctctgtcatgtctagatttatttccagtaagcaatctttttctgcttcttcaattacctagtaattttttgataggatgctagttattagaatgcgacattgttgaatgttggaatttggttgtcttaaaagagtattaggctttgttctagcaggtagttaacttacatgcaaatcaacttgatcatattaagacttgtttttaaactttgcatgaatctaaagtagcatttactctggatatggtttagtcctacttctaacatgtgtcctttttctgatttccaaatgctcaatgaagtctctcccctctgactgatcagaactcaaatgtctctcggtcctgtgtgatcttcagtgggtatttattcttctctggtagttcttctgatagttgttctgtgcccattctcgtggagtctcctctaaacttgtacggattgatattcagccagactcaactagactccactgcagatatctggaactgtttttttttttttctgtggggattcctcttctctggtaatgtgccctataaatccaagctgccactgccttcctgatctcccatctctcttttttcagttctgtaagcctgcagtactctgcatggtttgtcccctccctgcactgtaatgtgtacttccacacacaaaggctgggtggctatagggctcacttaatttgtttcctttctctcagggatcacagccctttgcagcctgttgcccaatgtctaaaaacagttgtttcatatattttgtctgattttctagttgtttacagatggaggtctagtctagtaccagttacttctttatggccagaagcagaaatctctaaatgtagcttttatagatggatgaggtgtgttcggttgtctttctttagttaataggcccttgaatttgtattcatttttatcttgggcactgcattttaaaagtaacctttcttggccgggcgcagtggctcacgcctataatcccagcactttgggaggctgaggcaggcggatcacgagcttagaagttcgagaccagcctggctagcatggtgaaaccccgtctctattaaaaatacaaaaattagccgggcatcgtggcgcgtgcctgtagacccagctactcgggaggccaaggcaggagaatcacttgaacccaggaggcagaggttgcagtgagctgagattgcgccattgcactccagcctgggtgacagagtgagactccatctcaaaaataaaataaaatgaaataaacctttcttaattctagaaaattttacatatattattatatataagattatatataaaatatataaattaccatgggttaatcctataagtttaatcagtaatgtagtgatccttgttgtttctacaaaataattcttatatgtgtgagagacatttacatgctgaattcgtaggtagtctgtttcaagtaaaagaaaaccattacaattgtgacctacttttttccatttgattttattcactaatagccatgtgttttgatagtgtataaagcaacattttattagtttctcaaatcccttgctatgctcttttgcagaatgaaatttttcactatttatgtcatactggagaatatagaatgtgaaaatataattgtccacttctcttaactgcaattatagtcgaatagtctcacaagatacatttttttttccccagatgtaagtgaagcctcttttgagttcagagctaaaattaaggactattttagattgagtccccaggacactcagtttttcattctaggtagcactatctcatttttacatttcctgtgttgtctctgtagatggttagaaaagcatacttcatcagaacgatgggttactgccagcacccctctgtgagatggttattaaaagcatgtcctttcctctccaattcagagtgcaaggttttcactgatgttatatacttgagctcttctgacacaagggagaggatagctaaaacagctctcaaagctgggtttatagcctttcctatcatttggcatttcactgaactaggtgaggtggttcttaatctttctctacctctctatcattaacatggttgatcgtcagtgagagctgcagtcaaacaaaaatggaaactttgtaatttatgtatagctttaaaaaggcaaagaaatgaaggattattgcagttggtgcaatccccgatacaattaatatcaaatgcatataaatcctattagagatctgtcatgggtgaaaaaggaatatgaaaaatgcgtgacctatctttattagattcagttagagagagaccatacagagctaaggagctttacgaactgcatattaatcataaccagtcttctgagataaacctatttcttgtaacttatcaaagccatacagaagattagtcattccctttggtaaaggaatgttttacatattgttctgagttttgaacatcacagctttaaaagctgattaacagatattttaatactaaaatatatctcattgaattatatagcttaggcagctattatcctgtaatgctacctcaatagggagatgggctctttgtcaaaacctctgcatcattgttttgttgcatattgaacaagacactctagggagttgtattagagaccagacaaaagaactttgctacagcaagcaatcattaaatcatgcagaaatatttctttcttaaatctttactttaagcaacaattggtagatgccagcaccattttttaaatgtcactttcaattcctgaagtcttttatctctttgagaaggaggggaattagcttaaggggacggttaagaccatcatgttaatacacggtattactaaagataggggatgtattaacagctctaatctgacaaagataattaagattgtattttaaaaatgtgagagagggtttcataagattatgaaacttttagataaaacataaagactaacaggtataaaatggattttgtattactgtctcacaaaacttagagatgttgagtgatataagcatttagtttctgacctcctgttaccacttcagtgcccagaatttatgtcatgtcaataaaaatacagaaccatctcatgatgaagatttctatacttgataatatataccattttatatatttgtttttatatttctaaaataataatcttgtttaaaaagctaaaaaatactgaagtatatgcattagaaataaaatctccccaccctacatggtagaggtactactattaataatttggtatataatccttctaaatattttttaaaatacatttattgaagggatacatacacagaaaagtacacaaaccataatattacagctcagtgagttatctcaaagtgaatgcacacatataaccaatacccagttcaagaaatagaacaatactgtctcttcccaattcctactgtccttgtcctccctaaagacttccagtaatttgacttggaacagtacagtttatttctgcctattttttgagttttacataaaataaatcacagagtatctacttctacctatctggcttctttcacccaatcccatgtttgtgagaatcattcacaggcctgagtataactatagttttaaattttgttcttctgtagctggggttgggcaccttattctaataagccgtaaatattttaggctttgtgggtcatatggtccctgacacagctttcgtaaaacaaaaacatcaatagatgatatgcaaatgaatgtgattttgctctattaaaactttatttgtaaaaataggcttcaggctagatttggcctatggactgtagtttgccatacatgcaataaataaatagaatactctagtatactgtagtatttcattgtatgaatatatcacaattagctgagccattcaaatattagcagacatttgtgtttttggtatgaatgcccttggaatgtggttttgtataaatatgcatgcatttctgtttggtatatggaattgcctcatgatagggtatatatatagggtaaacttaagtagtattgccaaatggttttccaaggtggttgtattagtcagcgttctccagagggacagaactaataggataggtgtatacatgaaggggagtttattaaggagtattgacccacatgatcacaaggtgaagtcccgcaataggccatctgcaagctgaggggcaaggaagccagtcggagtcccaaaacctttaaagtctggaagctgacagtgcggccttcagtctatggctgaaggcctgggggctgctggcaaatcactagtgtaagtgcaagagtccaaaagctgaagagcttggagtcttacattccagggcagggagcatccagcacaggagacagatgatggccggacgactccgccagtctactcattccaccttcctctgcctgcttctatcctagccacactggcagctgattagatggtgcccacccagattgagggtgggtctgcctctcccagtccactgactcaaatgttaatctcctttggcagcaccctcacagacacacccaggaacagtactttgcatccttcaatccaatcaagctgacactcaatattaaccatcataatggtagattaatttacacccctaccagtagttatactcatcatcacttgatattgtcaatcttattaaaagatgttttctttactaacttagattatacataataaatgataattttatttttaaaattaaagaatgagagaccctatatatcaatttatgtttgcctgctcagaaaaattcatacagaaaatctgatatgttagcccctaatttaaccaatatgttaaatcttaactagcctttaatcttaaaatgataaagaatctccacagcgtatattatgtaatttatatactgaactgattttcattctcaacagttgcctagtagtaacattagtgtagctatgcagaacaaagaaagaatacctaagccctagataacaatttctgcacacatactctattaatagcactttccaaaattatctacgatctttttcttagaactcaaatccaaagtccttttttcaaatgtaatcttcaaacttgttttggcatttgataccacctactacccattctttcataaaattcctgtgctggctgggtgcggtggctcacgcctgtaatcccagcactttgggaggctgaggcgggcagatcacaaggtcaggagtccgagactagcctgaccaacatggtgaaaccccgtctctactaaaaatacaaaaaattagccgggcacggtggcacgcgcctgtaatcccagctactcaggaggctgaggcaggagaatcgcttgaaccctgcaggcggaggttgcagtgaaccgagattgcgccactgcactccagcctaggtgaccgaaaaaaaaatttcctgtgctttctacttatctgtaccctgcttctctgttgtctgtgtcctagtatctcatctccctgaccggaataattttgtctgtttcctgagtttttgttcaaggctgtttgttcttctcctattaaaatttgcctggcatcttgagttcatattatcagccttatttggatgctcctaaatttacatcttcaatccagacttctcacctgcctaatggccttatattttcagatacctagaaggtatcaccttttatctcattttctcaaatttaaatatccaaagtaaaactcaaaatgttgatattcattttctctctctgcctctgccatcctctctaccaccctaaagtcccaacattccccattctccatttagcaaataaagatagtagaaagaagtgttttattaagcattgataagtagcaaaagatagaataatttctattgttggttaaatgaaagataagggaaggaatgacacattttatataacgcttattaggaaagaaatgtgctgtagtccaagtaatatgaaatattattaattttaatattcattcaccaaacaccaatcattttacagtgataatttgggatagttaggcaagttaattttggaaaatagtgcaaaagtagagctagatcattctaattgaacaatgataatagttcagttcttttagtgttccaaaaataaaataataaatatatgctaaaatttaaaaataatttattcagcataaataaatgataactatcatcttgaaaaagtaattgctctgggtagtaacaaaaagcctgtctttccagtgaggcactaatgtcctctgaatctaaatggagttattttcaaacttttgagaaaagcatataatttatcagggtgtcatttttaaatgtggaagcccttaatctcataaggaatgaggagagccactgaaattctttaatattctctaacatgcaaacaaaaagtagggtaatactgaggtgagttccctggtgataaccctggcaacttattagggtttaatataggcaaaataatgggaatgcctagatgttccaggcattattctagcagattatcagtacattctagtaggacagattaaaaaaatgtatgtattcatgcatacatccatatacatacacatatatatttatacacacacacacatacacacacatatatatacacatacatatataatcataggtgtaagtgctatcccgaaaagaaatagagcagagtaaggagtaccatggggtgggtgttgcaattttaagtaggatgatcagggtgggccttgtggagaatgtgatacttgagcaaagatgggaacaaggcaaggtagtgagccaagaagatatctggtatggttatatttagtaggtttttttttacttgtttctcactttactcctgaaaggattcagtgcctgcattatttaggtggtcaaaactaaataaaaacttgatatattaacattttattcctttggtaatatagggggaccatgctaaagagaacttagtccactctggggaagtgctacgtcaaacttttgtttgactgtcagagctctcactggggtacctaccatgctgccacggggtggagtatttcactgtaatgtttctataccttatgaaattgacttagattgaaaatatcccaccactttagcccctgagcctgattctttttaagtgcagattttctaatctaaaaatcaaataagagagaatatgagaaggttcaatggaaaatcctaggtaatgtatagctgtgtaacagtgactctttggaaacgtttcttctgatgttattatctattgagtggaataatgctgattatttctggttagataaaggggaaggcagataagaccttagggtagcccataaatcacatagtataggaaattaccttttccaattatgtagaagctgcccttgttgctgactttccccattattcaccatcactataattgggaaaaccagaaagcttggcaagagaaatttgaatagcgagctcttagtttgttatgttgctgctatcactggtataaacacaggtgtagttttacaggatgtttggtgattattctatgcagaaacctaatagtcgtgtcacaaatttctacctcagtatccagaatcctataatctgttttgggaattttccttttacttatatgtaattttacagataaatcctcagttttctagtatggcatttcaccactgatgctgaaattagaacattgagggcttgtaatttgaaaatgtaaagattagaaattatatttcatagtcgggtgtggtggctcatgcctgtaatcccagcactttgggaggctgaggtgggcagataacctgaggtcgggagtttgagaccagcctgactaacatggagaaaccctgtctctactaaaaatacaaaattagctgggagtggtggcgcatgcctgtaatctcagctacttgggaggctgaggcaggagaatcactgaaacctgggaggcggaggttgcagtgagctgagattgtgccattgcactccagcctgggcaacagtagtgaaactccatctcaaaaaaaaaaaaaaaaaagaaacaaagaaattatatttcatttgtcctgtctatatatgatccaatgtacttttgctttctggcttctggtttctgcattttttttttttttgagacggagtctcgctcggtcatccaggctggagtgcagtggcgtgagctcagctcactgcaagctccgcctcccgggttcacgccattctcctgcctcggcctcccgagtagctgggactacaggcgcccgacaccacgcccatctaattttttgtattttcttagtagagacggggtttcaccatgttagccagggtggtctcgatctcctgacctggggatccacccgcctcagcctcctgaagtgtagggattacaggcgtgagccaccgcgcctggccctggtttctgttaaactggacatgccactttaacattagctcattctttatttgcttagccaattatatacatttttacccttgcaacaaagaaggataggcatagatgttctggacttattgttgaaggagaatccaggttaataatctgactaggctagtggacaaatttaagtaaggaaaggaacatagttaactatcataggtctgatacacacgtttcagtgttaaagaggaatcactaatagtctattattcacagataaactgaggtacatgaaaatgttaaagagtttattttagcaaataaactcttgaatccagcaatcccagatgataagtggctcaggagttccacccaagaaacatgaggtgaagacttttgtcagatgaatacagaagcaaggcaaagaaaatagtttgattggctaacgtggagcggtagccttatttggatcattcaaatgaaaagtccccagttagagattagtttcgaattgattacacttaattttcgttttcctaaaatgtgattgttacactgagttgggtttcagtttgcttacataggatcccaggatgctgggtcccctcagtcttatggcctcctgattaattaattttaacactaggaaactgggaaacagaatctgggactgaagaagagggtctgagctaagaaaaaagtcctaaacagaggtcagagacactaggcaaaggaaaaagtgtgccaggaattcaataaacttggtgtggagctaaagcctttacaattatgggctttcctactgataagagtagatcactgcaggaaggacactcagaggacacctggtctatgaggctattggggaggatggaactccatctaccacaagtgagatttggtattgtagaaatagcaaaaaaaaaaaaaaaaaaaaaaaaaaaaaaaaaaaaaaagtctccttgtgatccttaaaaaaagatttgagccctgtttgaggttgatcttttatatgaattaaaagtaattatatctcaaagaatcagtgtaaaatgtatgtattgtttggtttcatgaccctttgttattacttaccactctaccactgcagttcctaggtactttaattcagttgccatccttcccactctctctgagctccataatagtgctgatttaacaaatactcactaaatagacaaaaccctacttaccattaattatgaactgaaatgaagcataaatgtggaataaataaaggatataatgagaaaatgtacaaaatgcttcaaatgcaccagtacccattatatatcactctaaaaattaatcattatattaaagttatagtgacaaaatgttttttactaagcagaagtaaaatttttgtgcattctttctctatcccacctcatattttgaatatatctgcaaagctggtttaaatcttgcttaaaattttatgttaaaaaatgtatgcacatcacataaacatggtaatgctcaattgtccattaaggaagacatttcacattttcaacatgaatgcttttctattctaaacatttttattaagccatttattcaaccagaggcctgcacagtaagcaatagtgtagttgtttttcaactagtactctgtcaggaacttagatagaaataccacattgagaaaaaaagtctttaacagaaatctaaaaacaatcattggtgttggactgtaaaattagtttagagttggattttatgactttttaaggatactacctgtaagttcttttactatttttaccatttctcttaaattttcttctattgatggttgttttaaattacgtgatgccagagattgtatttgtatcctttttctccactcggaaatgctttttatactgccttgaatagtaccatgtatttatgtattttaaaggtgttttaagacatgcttggtaaagatgttattaattgcttatgcatatttcactgattgacatatacaataaaatagtaaattattaaactttttaaacacccagccacaaatattgtttccttgatattgcatgacaactttgcatagtgctctattaagtatttaatataaacaagatatctctctctccacccacttttcctctccgtcttctctccattgcaacttttctggaaacttcttcctagtccagtagtagctggaagagaattcctcttattccaaaaaagtaatctccctatttcaaagtacaaataaatcaatatgtttgcagatcccagcttcatattgtatggcggtctttaaaaaaaaaatgtggttaaaaaaaaaaaaacataacctgagatctaccctcttaagaattttttaagtgaatagtacaatattgttaacgacagatataatgttgtataacaaatctccagaacatttacatcttgcatgactgaaactttatgcccattgcaccacaactctttttttttctttctttctttctttttttttttaatcatactttaagttctagggtacatgtgcacaacgtgcaggtttgttacacaggtatacatgtgccatgttggtttgctgcacccattaactcatcatttacattaggtatttctcctaatgctatagctccccctgctccccaccccatgacaggccccagtgtgtgatgtgccccaccctgtgtccaagtgttctcattgttcaattcccacctatcagtgagaacatgcagtgtttggttttctgtccttgtgattgtttgctcagaatgatggtttccagcttcatccatgtccctgcaaagaagatgaactcatcattttttatggctgcatagtattccatggtgtatatgtgccacattttcttaatccaatctatcacagatggacatttgggttggttccaagtctttgctattgtgaatagtgccacaataaacatacatgtgcatgtgtctttatagtagcatgatttataatcctttgggtatatacccagtaatgggatggctgggtcaaatggtatttctagttctagatccttaaggaattgccacactgtcttccacaacggttgaactagtttacactcccatcaacagtgtaaaagtgttcctatttctccacatcctctctagcatctgttgtttcctgactttttaatgattgccgttctaactggtgtgagatggtatctcattgtggttttgatttgcatttctctgatgaccagtgatgatgagcattttttcatgtgtctgttggctgcataaatgtcttcttttgagaagtgtctgttcatatctttcacccactttttgatggggttgtttgtttttttcttgtaaatttgtttgagttctttgtagattctggatattaaccctttgtcagatgggtagattacaaaaattttctcccatcctgtaggttgcctgttcactctgatgggagtttcttttgctgtgcagaagctctttagtttaattagatcccatttgtcaattttggcttttgttgccattgcttttggtgttttagtcatgaggtccttgcccatgcctatgtcctgaatggtattgcctaggttttcttctagggtttttatggttttaggtctaacgtttaagtctttaatccatcttgaattaatttttgtataaggtgtaaggggggaatccagtttcagctttctacatatggctagccagttttcccagcaccatttattaaatagggaatcctttccccatttcttgtttttgtcaggtttgtcaaagatcagatggttgcagatgtgtggtgttatttctgaggcttctgttctgttccactggtctgtttctctgttttggtaccagtaccatgctgttttggttactgtagccttgtagtatagtttgaagtcaggtagtgtgatgcctccagctttgttcttttggcttaggattgtcttgacaatgtgggctcttttttggttccatatgaactttaaagtagtatttccaattctgtgaaaaaagtcattggtagcttgatggagatggctttgaatctataaattaccttgggcagtatggccattttcatgatattgattcttcctatccatgagcatggaatgttcttccatttctttgtgtcctcttttatttcattgagcggtggttggagttctccttgaagaggtccttcacatcccttgtaagttggattcctaggtattttattctctttgaagcaattgtgaatgggagttcactcatgatttggctctctgtttgtctgtttttggtatatagaaatgcttgtgatttttgtacattgattttgtatcctgagactttgctgaagttgcttatcagcttaaggagattttaggctgagacagtggggttttctaaatatacaatcatgtcatctgcaaacagggacaatttgatttcctcttttccttattgaataccctttatttctttctcctgcctaattgttgtcctggccagaacttccaacactatgttgaataggagtggtgagagagggcatccctgtcttgtgccagttttcaaagggaatgcttccagtttttgcccattcagtatgatattggctgtgggtttctcataaatagctcttatgattttgagatacattctgtcaatatctagtttattgagaggttttaggatgaagggctgttgaattttgtcaaaggtcttttctgcatgtattgagataaccatgtggtttttgtctttggttctgtttatatgctggattacgtttattgattttcgtatgttgaaccagccttgcatcccaggatgaagcccacttgatcatggtggataagctttttgatgtgcagctggattcggtttgccagtattttattgaggatttttgcatcgatgttcatcagggatattggtctaaaattctctttttttgttgtgtctctgccaggctttggtatcaggatgatgctggcgtcataaaatgagttagggaggattccctctgtttctattgattggaatagtttcagaaggaatggtaccagctcctccttgtacctctggtagaattcggctgtgaatccatctgatcctggactttttttggttggtaagctattaattattgcctcaatttcagagcctgttattggtctattcagggattcaacttcttcctggtttagtcttgggagggtgtatgtgttgaggaatttatccatttgttttagattttctagtttatttgcatagaggtgtttatagtattctctgattatagtttgtatttctgtgggattggtgctgatatcccctttatcattttttattgcatctattcaattcttctctcttttcttctttattagtcttgctagtggtctatcagttttgttgatcttttcaaaaaccatctcttggattcactgatttttttgaagggtattttgtgtctttatctccttcagttgtgttctgatcttagttatttcttgccctctgctagcttttgaatttgtttactctcgcttctctagttcttttaattgtgatattagggtgtcaattttagatctttcctgctttctcttgtgggcatttagtgctataaatttccctctacacactgcattaaatgtgtcatagagattctggtacactgtgtctttgttcttattggtttcaaagaacatctttttctctgccttcattttgttatgtacccagtagtcattcaggagcaggttgttcagtttccatgtagttgtgtggttttgagtgagtttcttaatcctgtgtcctaatttgattgcactgtggtcggagagacagtttgttgtgatttctgttcttttacatttgctgaggagtgctttacttccaactatgtggtcaattttggaataagtgtgatgtggtgctgagaagaatgtgtattctgttgatttggggtggagagttctgtagatgtctattaggtctgcttggtgcagagctgagtttaagtgctggatatccttgttaacctgctgtctcattgatctgtctaatgttgacaggggggtgttaaaatatcccattattattgtgtgggagtctaagtctctttgtaagtctctgaggactagctttatgaatgtgggtgctcctgtattgggcgcatatatatttaggatagttagctcttcttgttgaattgatccctttaccattatataatggccttctttgtctcttttgatctttgttggtttaaagtctgttttatcagagactaggattgcaactcctctttttttttttgctttccatttgcttggtagatcttcctctgtccctttattttaagcctatgtgtgtctctgcacgtgagatgggtttcctgaatacagcacactgatgggtcttgactctttatccaatttgccagtctgtgtcttttaattggagcatttagcccatttacatttaaggttattattgttatgtgtgaatttgatcctgtcattaagatgttaggtggttattttgcccattagttgatgcagtttcttcctaccatcgatggtctttacaatttggcatgtttttgcagtggctggtactggttgttcctttccatgcttagtgcttccttcaggagctcttgtaaggcaggcctggtggtgacaaaatccctcagcatttgcttgtctgtaaaggattttatttgtccttcacttatgaagcttagttcggctggatatgaaattctgggttgaaaattcttttctttaagacttttgaatattggccccctctctcttctgtcttgtaggatttctgctgaaagatccactgtcagtctgatgggcttccctttgtgggtaacccaacctttctctctggctgcccttagccttttttccttcatttcaaccttggtgaatctgacaattatgtgtcttggggttgctcttctcaaggagtatctttgtggtgttctctgtgtttcctgaatttgaatgttggcctgacttgctagtttggggaagttctcctggataatatccttcagagtgttttccaacttggttccattctccctgtcactttcaggtaccccaaacaaacgtagatttggtcttttcacatattcccatatttcttggaggctttgttcatttctttttactcttttttctctaaacttctcctctcgctttatttcattgatttgatcttcaatcactgataccctttcttccccttgatcgaatcatgtgttgaagcttgtgcacgcgtcacgtagttcttgtgccatggttttcagctccatcaggtcatttaaggtcttctctacactgtttattctagtcagccatttgtctaatcttttttctaggtttttagcttccttgcaatgggttcaaacatcttcctttagctcggagaagttggttattaccgaccttctgaagcctacttctgtcagctcgtcaaagtcattctccatccagttttgttccgttgctgtctaggagctgcaattccttgcaggagaagaagcgctctggtttttagaatttgcagcttttctgctctgatttcttctcatctttgtggttttatctacctttggtctttgaaatgggtgacctccagatggggttttggtgtggatatcctttttgttgatgttgatgctattcctttctttttgttagttttccttctaacagtcaggtccctcagatgcaggtctgttggtgtttgctggaggtccactgcacaccctgtttgcctgggtatcaccagcggagactgcagaacagccaatattgctgcctgatccttcgtctggaagctttgtcctggagggtcacccgcctgtattaggtgtcagttggcccctactcggagctgtctcccagttaggctacacgggggtcagggacccacttgaggaggcagtctgtctgttctcagagttcaaacctccgtgctgggagaaccactgctctcttcagagctgtcagacagggatgtttaagtctgtagaagtttctgctgccttttgttcagctatgccctgccccccgaggtgggggtctacagaggcagtgggccttgccgagctgcagtgggctctgcccagtttgagcttccccagccgctctgtttacctactcaagcctcagcaatggtggatgcctctccccctgccaggctgctgcctcgcaggtcgatctgtgctagcagtgagcaaggctccatggacgtgggacccaccgagccaggcgcgggatataatcttctcgtgtgctgtttgctaagaccattgggaaagcacagtatttgggccagagtgtcccgtttttttaggtatagtctgtcacagcttcccttggctaggaattggaaatccccctaccccttgcacttcccaggtgaggcgatgtcccgccctgcttcgtctcgccctccgtgggctgcacccactgcccaagcagtcccaatgagatgaaccaggtacctcagttagaaatgcagaaatcactgtcctctgtgtcgatcatgctgggagctgcagaccggagctgttcctattcggccatcttggagagctctctgtttttttcttttttttgagacagagtctctctgtcgccaggctggagtgcagtggcactatctgggttcactgcttcctcctcctcccacgttcaagcaattctcctgcctcagcctcccaagtagctgggactacaggtgcacgctgccacatccggctatttttttttgttgtattttagtggagacagggtttcaccacgttgcccaggctggtcttggaactcctgagctcaggcaatgcgcccaccttggcctccagtagtgctaggattacaggcgtgagccaccgcgcctggcctgaacaacaactcttgtatttctctctcaccccatcacctgtcgacaaccactttgagttttttttgatgagtttgactacttgaggtataaatggactcatgcagtatttgtccttaagtgactagcttattttaattaccataaagttagctatgttcactcatgctttagcatatgatagagcttccttattttttatgactcaataatattccaccgtatgtatgtatgtatgttttctttatccactcatccatctatggacatttagcttgttttctcctcttggctacaatgaataatgctgcaatgaacatgggagtgcagatatcatttggagatactgacataaattcttttggatcaatacctagaagtgggtataaggataaaagggtcaccatcttgctgttgtcattcccttatttgtctgtcttttgcatcagtatatgaagtaatagaaaattaattgaagaaggagagagatgcatatgaaaagatgctcaacatcattgatcatcagagaaatacatattaaaattacaatgaggtatcatctcacccaagttaaaatggcttttgtctaaaagacaggcaataacaaatgctggtgatgatatggagaaaagggaaccctcatgcactgttggtgggaatgtaaatcaatacaaccactatggaaagcagtttggatgttcctccaaaaatttaaaattgagctaccatatgatccagcagtcccactgctgggtatatacccaaaagaaaggaaatcagtatattgaagggatatgtgcactcctatgtttgttgaagcactatttacaatagtgaagatttggaagcaacataagtgttcatgaacagatgaatgcataaagaaaatgtggtacatatacacaatggagtactattcagccataaaaagaatgaaatcctgtcatttgcaacaacatggcaagaactggaggacattatgttaagtgaaataagccaggcacagatagacaaacttcccatgttctcacttatttgtgggagctaaaaaatcaaagcatttggactcaaggatatggagaatagaatgatgattatcagtggctgggaagcgtagtgatggggaagtggggatggttaatgtgtacaaaaaaatagaatgaataagacctagtatttgctagcacaatagggtggctatagtaaaaaataatttaattgtacattttaaaataactaaactaactaaacgtgtataattggattgtttgtaacacaaaagataaatgcttgaggggatagctaacccatttaccatgatgtgattattatgcactgcacgcccgtatcaccatatctcatgtagctcataaatatatacacctactatgtacccacagaaattaaaaattgaaaaataggcacacttccaggatcaaaaaaagaaggaaaaagatggcttaattattgtgagtttccaaatcatcagataaatatgccatatttaaatgcaaacaatgtcatattaactttttatatattggaggctattttctttcgggctgctataacaaagttatgttaatatgtcacccaccatagactgggtggcatatttaacaaaagaaatttatttctcacggttctggaggctggaagtctgagatcagagtgccaaggtggtcgggttctggtggtctgggttgcagactgctgacttctctttatattttcacatggtagaaggagggcgagagaactctctggggtccctaataggggcgctaattctattcatgaggtctctccacccttgtgacctcattacctctcaaagttccccccaatcacattgggggttaggatttcatcataaggatttgggggcacacaggcatttagcatttttgtaacaaaggaaaactatatactgtattcccctctgaaaattagtgaagtgtgttagctgttgaaacttctaagaagtctttggtttaactttctttcttttttttttttttgctttttttgagacggagtctcgctctgtcgcccaggctggagtgcagtggcgcgatctcggctcactgcaagctccgcctcggttcacgccattctcctgcctcagcctcccgagtagctgggacggcaggtgcccgccaaaacgcccggctaaattttttgtatttttagtagagacggggtttcaccgtgttggccgggatggtcacgatctcctgaccttgtgatcagcccacctcggcctcccaaagtgttgggattacaggtgtgagccgcggtgcctggtcagtttaactttctttaaacccagcatttcttaaatctctaggatgatgcaaaagtaattgtggtttttgccattaatggcaaaaccattacccagcaacctcttttggggttacccaggaacctcttttggggttgggggaatagtatccactaagtatccacttgtcttctgaggcaaggcactgcttttctactgcctacagttaggttagtgctgaatggtatatttaagtataaagtaaccccaggtcacatatggctacttaaatttaattaaaattgattaaaattattcagatcatcagtcacattagccacatttgaagtgctcagtagctgcaagtggctagcgactatttttattggacatatccataagaaagacacatattgggatccgttttgtcacctaacatccctacccccaaagaatttactgatttgttatttgtttttgtgattttacattaactgaataatgttacaaaactagtcttaaaaaaaatctgttgctgctttcaatataacaatgttgtatagcaatggtcccccaactttttggcaccagtggccgattttgtggaagacaattttaccacgggacgggcggggtgcggggatgtggggatcgttacaggatgtaattgttccacctcagatcatcaggcattagttagattctcataaggagtgcacaacctagatactttgcatgtgcagttcacaataggatttatgctcctatgagaatctaatgctggtctgacaggaggtggagctcagagagtaatgctcattggcccgctgctcacctcctgctgtgaggtatggttcctaacaagccacagtagtggtctgttgcccaagggttggggacccttgttgtagaggacagtgtgcactgttattgtgttttttgtatgaaaactcctatgagcccttttatttggttctaaaagttagaaaatcctttgcttctttgaaaagtaactgattatatttttatttccttttatttgggcaccagaaaacagttaaatctttgtcctaacattctttttaatctcattctattctgatttatatttttttctattcctgttttctctcgatatttgttttcatagttttgcaaaatacttcaaattccataagagcaaatcaggtataactgaacattagtgaattacagtcttttttcacaattcatcataagtggtcaacattcttggctgtccatttttgcagggcatttgatagttgagccatttttccattacaagtgtttctagtatcaatggttaagttttctgtattgtctgtaagctgtttcttgctcaggtatcttataatcaatagtacatgatacagaattcctgagaagtaggaatagaaaatctatttgtagtctgtgtttctccataaggctttagaagtagacgagactaagcagctttgtttctaattcagtatttggaacttattgtatattcattcatttactctttcatttattcattcattcagtaaatatttgttgaatgcctgctatgcactgagcacttttctgggtgctgaagatgtagcaagaagacaagaagacaaaaaaaattccctccctcaaggaactgacattttactgagattaagctcaaattccaattcattaaactcttaatttttgagatcattaaaagaaaagattgtctcttattggcatctcctctccacgtacaccgaaagttatttcatttccatggccttatttgctgtggcagtaagagagataaataggccaaatcgaactgggaggcaggaggaagaactcttgtccaactttcattgtattcaagaattcaagaatatgagtgagaaaaggctgataagaaatatagtttgttgatcctaggctgagtgcaatggctcacacctgtaatctcagcagtttgggaggccgaggcaggcggatcatttgaggccaggagttcgagaccagcctggccaatgtggcgaaatcccatctctactgaaaatacagaaattatttgggcatggcggtgcacgcctgtagtcccagctacttgggggaccgaggtggggggattgcttgagctagggaggcagaggttgtagtgagccaagactgtgccactgtactccagcctgggtgacagagcgagactctgtctcaaaaagagaaaagaaaaaaagaaatacagtttgttgatcctaaaatatttggagagcagatttatggtcaaaataagacatagtctctgagacctactctgttcttagaagtaatcaggaatatttatagttgattggttttcaaaacaaaaatgcaaagcagttaaatatatatttgctaaacttattgaacacttagtatatgacagtgttctgaatgctgaagatagatcaatgaacaaaacaacaaaactccctgccttggagcttgcagtaaagagtagaaaccatgagagcaagtaattgactaaggaagcaagacagtgagtgctgtggagagaaagtgctataaaaagaattaaaatggaaagatgtgatagtgatagactaacccctttatagcgatacttagaaaaggctttcctgatgtagtgatttgtaacctgaaacctgaatgatatgaagaaaccagccacatgaagatcaggaggaagacctttctaggctgagggaacagttaaactaaaagcctttaatattggaaagaacttggtctggtggcaaaacaataagaaagccagtttgggtaggaagtagtatgagcgccaagtgataggagaatcgatcacagagtgagggggaggccagatcaagtagagctgtttacttatgttaactgaactaaaactactatttgtctttaaagtaaaatgctttctgagtagccagtcctgagtactttccagctgctcataagccaaaagtcaatcacaatagtttaggcttcacttaaacacaggcaatctaatgttccattctttcatttcatttcattatttgttttatattctccttcactcttttttttctcctggtgaagcagcagaacccattgactttttgctgtactttggatttcagtctctgacttccttgcacatgtgcacacagaaggaaagagctgtgaaagagcttcagccaaggggttgggaagcaggagtccagaactttctagtttgctagatggatatgcagtcagtgatgatcacacccatgtctcactggtgattgattgaatcaaccatttaacatttttgaggttatttaaaaagttggaaataaagtgaaatctctaaagaatatactaatatttataattttgataatgaattttttttgttcttttaagttactttatggttgaaatgcagcttttcagtcttaaatctcatatcagtcaccttcccataattttaagactgcagtatttatttggttctattatataacttttatggcctttgaaagtaagagagtgaatgtaactgatagttttctgtcacttatactggtactggatctgacttttagctcttttaaaagttattttcactttggaaacactttaaagatgcattgaactctttttctacagctctataatccatttttatacacaagacatagtagcataaggctcccacatacaaggctcacaacaggcaaaattccatatgtctgcttcagatttgcctgctgaatacattgttgtggctgcttctaaaacattaaagacatacctgccaggttgtggatttttttttttgtcttgactttttgaaagtttctgcactattttttcttagattacatatagaatataaagtacagttaagtcctatgaaagatgagaatcttatagaccttctggccacaagaaaccatcaaatttacattaaactctacttctctgtattatcaatttctctcaataaaaatatgaaaataattattatggcatgatacagtaaaacacaggaatagtggatttagttccctgaatactgtattcctttcttccttcccttcctagtacccactggcttgctgttggattgtgcatgaaattaaaagaaacttgaatacattgtgccctggaattgtttgaatgaaagtgattgcattaattcaaaggtttggatgcctttaagcatacgttgtaaaatttttaactggagagataggtgaattttaaaaattagagacatttcaaatcagtaaaatgttactagagcagtagacaaagtggggggaaaagataaattgattccctatatcataccatttaccagaataagcttcagaacaatgagttataaatataaaaccatacacaaactaggcctgaatataggtaatatttacttgaaataagagcagctttgtgaaaataaaaacaaaagtagaagataaaagaatatatttttgactgtacacaaatgaagaacttttataaatcaagaacatagtatatactattaaagggcaaatgccgattttataacaattttagacaattttgataatggattaataactttatgagtattcttatatagcaacatgaaacatgtgtatcctaatagaaatatgaacaaaggtattgaacatagtattcataaaatataagttacatatatgatgtgcatggtgtatatggtatgtatgagtgggcttgtatgaatgtggatggctgtgcatatattcagcctaattagcaatagaagaaatgactattaaaagaatactgcagtttaatagacaaaaaggatctaaaataatgatctgatatgtgagggtgcagagaagcatgcactctcatttcatgatggttggtttgtagaatagtacaacctttctggagggcagtttagcagaatgaaacataagcaatgaaaatatttatattcatgcctagcaattccatttctagaaaattgtcctaatgaagcagatgtataaaaaatatatctgtagtattcacttcagaattatttctagttgtgaaaaattagagcataaatgcccaataataaaggaattttaaaataattgtatgataatttaaataatctatataattatatgggagatgtttatgatatagtaaatgataaagcagaatgtaaaagatatgtacagccaatagtatgaccccaattttctttaagaatatattgcacatgggaaaaatgattagaccaagtgataaaatatattaacagtacgtctctctatgtgagaaattatggtgatttttaaattttcttctcttgcattaactctgttttccaaatttttaacaatgaacttgtattagttgtgaaatgaggcaaaaggaaaaaatgataaaggagaaagggttcaattatattatctttattctctcagtgttgcaattaatgatagaattaataagccctatttttgccttgtttaccaactttgagtttagcaacaggaactatttgtattccattatgtttataaaagatggaaatatattttctgttttttcttggtggaaggggcaaagtaagccacagcaattcttttagttagcatttcttttagatattcaaaaggacaagtatgttatatactcttgatttgattaaaggaaaacatatataaagaaatataaaggtatatatataaataaagaaatatatatataaagaaagatgtataaagaaagaaaatagatatataaatatcttcacctttccctccacactctgatcattctagtcacatctggtcttaaactttagacaggacatcatattagtaatttattttcaccacatctgtaggggtcttttatttgtagattctatagtgataattaatttaatgggagttaacatttagaaatagatttgtagccaggttttgtgctcttttaatgggctgggaagctaaaaataacgccttgtaagggaaacaattgcaaacagatgaaatttaactgagcaccagacattcagagttgaagagcacacatgggggaaattgtatgtccttaaattatcaacttactggaaatgaaatgctttggtacagatgtgaagagtaaaacaaaaacaagtctggtagttggttacatcttcccgtctgctcttcgtattacaagtaggagtcccactgtccaagctcatgacactaagctcttaaaaaaaaaaaacaaataaatgctttacaatgtcagctttagataatatattcagaaagagatgataacatcatgtatagttgtaagggacaaatatgctagttcaatttatctacagatgttcattgggatgcttcccctcaaagtgtttttgattttctcaaaagaccaatctcaggagctatttaagaaaatgtcatttgatttgcatatgtaaacaatcaggtctatgaaccatatgattttatcccctaattatttatgtaagggtttaaagtgagcatacatcacctatcacaaacctatcctgcaaattagcaaatgcatacactaacaaagacaattgctctgcttagctatatctcttaaggtgagacatttaatcccttggtaagtggttgtttatatgtaactaaaataagcttttccctccttcaccagtattaatgtttttctttctttttttttttttcttttttgagacagagtctcactctgtccctgaggctggagtgcattggcgtgatctcagctctttgcaacctccgactcccaggttcaagtgattctcctgcctcagcctcccgagtagctgggattacaggcgcatgccaccacgcctggctaatttttgtatttttttttttttttagtacatatggggttttgctgtgttagccaggctgatcttgaactgctgacctcaagtgatccactggcctcggcctcccaaagtgctgtgattacaggcatgagccaccatgcctggccgtattaatgtttttctaatacttccttaatcagataaaaatttcaatttgaaaaacttgaaatattgatgtaaattgtttgattactacatgtgttttcttttttttttttttttttttactattttgctaaagaatatggttagttataagttgatactatgtatatcttcatggagatttttaagtaggtttttttattggccctgtttatatgtgtaggaaattatgctaaatcacaaaactggaaacaagagctatttcttgctgtgtaagtcagtttatcaaaaatctagatagctgtaataatctttttttccttgttacatgagaacattctgtattctctatcccttaataatgattattttaagttatacttgaatgttccactggcattttacacttattatatctaatatggactttgtaagttttcgttattacctactctagtcactcctcatctgccttctatgtagtccttattactgttaacatcatcattcactcagttaaacaaatctgggtaacctgtccctcattccttcactctattctccagggtcaaccactcctccttatctatcagttcctgagtagtttcctgaatcttcaccttcatcttctctacatcctatctctgaactcatcctccagaatgccttcagaattacttttataaagcttagtctcctctctaccacttttaaaaaatataattcttttaattttgtccagtgttcaaataaaacactcctagaaagagtatttcttcatgaattcctttttcttatatcactatttggctcatactttcactgcatttttgtaatccaagtccccctaacacaaaatgagcttaaaatatggttattttggccgggtgtggtggctcacgcctgtaatcccagcagtttgggaggccgaggtgggtggatcactcgaggacaggaattcgagaccagcctggccaaaatggtgaaaccccatttctactaaaaatacaaaaattagccaggcgtggtggtgcatacgtgtaatcccagctacttgggaggctgaggcaggagaatcgcttgaacccaggaggcagaggtggtagtgatctgagatcacgccactgcattctagcctgggcgacagaacaaggctctgtctttaaaaaaaaaaagaaatgtggttttaatggttaaagccattaaaaaacccttaattatataaagcaaataataattacaattaggacatcagagaaaaatgcactttactatcagttaccaatatgtgaattaccacccttttacgttatctgtgagagtcaaactgtataccaccatgtaagttgaatatgtgtacactttgccttggggaggagctctaggctgatgtttctaaatggtgaggaacacaccacacctgatttgtaaagtcagagaaggctagagctggaatcgatcatttagtccaaaaccctcttaaaattttttaaaatttattttatttttattttttagagatggtatcttgctatgttgcctaggctggacttaaacccctaggcccaagtggtcctcccatctcagcctcccaagtagctaggactataggcttatgccattgcacctggctcaacactctttttttaaagagggaaagggcagggtcttacccaaggttatatatctagttctagagctatattgctagttatagattacttaaatgtactatgtgaaatttaatgtttaaattatttggttgaaattattaaacatttgaaacacaattatttttaatgaagtgacaaatatgtattaagtttaaaatattttttgaaacacattcttgtacttgaacacattttcttgattaaatattggtataaagcaggaaatgatctattaaaacaaaacattcttagaaaacttagtagcagttactccatatcaatagttgagcctagattagatcataggtttaaagcatacttctgatattatctgttatctatctaacactttgaaatgatctgaatgtcttattgcaaaacacggggaagatattagctaaagatttaaagagaaaaagcaaaccaagggctggaaaatgattctctgagtagcaaattggcagagttaaggagtttattgcaaagaaaaaattattatgtctattatatagctattaaaccatagtccaggtgaagagagcatgttagattaaaaatagcattagcaccccaaaagatctggaaggctacttttcaaaggatagcaaaaccaattgtgttacagggacaaaccttacttagaccaataagttataatgcctttcaaactttttggtcttaggggccatttacactcttaaaatttttgaggaccctgaggaacttttttgtgtggttcatatctattgttattttctgatttgatttaaatctgagaaaattgtaaaacataagaacagtccatttgccgtcagagtgatgatgccattccaggtcatgaagcctctggaaaacaccactgtacacttgtgagaacacaggagtgaaacagacaaataacttttttttgttttggaccgagtttcactctgctgcccaggctggtgtgcagtggcgccatctcggcttgcagctgggactacaggtgcccactacctcgcccggctaattttttgtgtttttaatagacacgaggtttcactatgttgaccaggctggtatcaaactcctgacctcaggtgatccacccacctcggcctcctaaagtgccgggattacaggcgtgagccaccgcgcccagcctcaagtaacttttagtcttgttacaacaatagttttgaatttacatacacctctgacagggtcccaggaataccctggaatcctttgaccacattttgagagctgctgctcttctcacggaggtcagtgtatatggacccagtaaggacagcagtgaagcctgggacagggatgagaatgggcctgtattactagaattttgtcattttctcatctcctcttctcttaatggatcagctcattctctcctattggagagaggcttcttgatttggccgaagtcttagttatcagcagcaatgagagcaaacagactggctggacaacaatttctgtgtttcaatgccagtgcctagtgtgatgttatttgtcacatatgcatgtggaagatgtcttggccaaataactttgggaaattttgcatgctctacacctgtcccctccctttgaagaatcacaatgcacattaacatattaaattatctgaaatgtcctatggtagaaaaattaattacctttattgaactcactgtttccaaatcttaggtgatttcagagcatttatcatcatccatggatactagtgtctcacaaaagagtttagaaagttggatgttataaaatttttatttcatttttacattgtagaattttctactcccctttcaataccaggcaaatcgatgtgatttctgtgaataagtaagcaagccatatacatttatacaaatatgcatcatttgatggaaaggcagcacattgttgccagggaaaattgtatctaaatgatgtttagatttttgtttggaatataaatggatagataaatgaaattattccacttatacttttaaaatgccactgacggaagaaaaaaaaacccatattatctcaatatgtattgtcaaaaagtccttgataaaatttagcatgctttccgattataaaattaatacaataggacaagtacttatttccttaactggctctttcttgttattcaggtctcagcttaagtatcactttgtcaaagaaacctttcctaacttcctgcatgaagtagctcccactccctattgtattagtctgataaaactatatattgcaagccaaatggcactgttctgtttaatgctaaaacacttgaagaattcccatgtgaagagccagactaggatgttcacaatcactagtattttttaggcttttttccccattttttagagaggaagggggagtgtgtatctgccaatgcaattaaataagagagagaaggaaataaaaagatttagaaagatatatgtaattttttcacattatgtgactatctgataaagtatgtaaaaatcaatagcatttacatatatatatgtatatatatatatatatataaaacaaggcaaatgattgtgtgtgtgtggtttttttgtttgtttgtttttgagatggagtctcgctctgtcgcccaggctagattacaatggcactatcttggctcactgcaaccttcacctcctgggttcaagtgaatctcctgtctcagcctcctgaataagtgggattgcaggcgcctgccaagatgcccggctaattttttgtatttttggtaaagacatggtttcaccatgttggccaggctggtctcgaactcctgacctcaggccatccgcctgccttggcctctcaaattgctgggattataggcgggagctaccatgccaggcctaaatgattgataatggaataaaaagtcctatttagtatagtaataagagagagtcaatgacataccaatataatttcaacagaatttttctttttcttttttttttttaagaaattgacaacatgatgtgtatttttatctggaagtaaacatctgggaatagccaggaaaaaactggaacggaagtgcactgaaggggaactagttctaccaaatatatatataaaaaaaggttaaagttataggattaaaatagtttattcttgtttataacagagtcaaatagtagaccataatatatgcaggaatttactgtatgatagatgaggcatttgaattcagtaaagatcagttattcaatccaaaatttaatttgataaaaggatcataaagttaaatattacattacaggctaaaaaatatatttgcaacacatatggcaaagggctcattatcttaatatacaaagattttttacaaaataaatatgagtgggccaggcgtggtggctcacgcctgtaatcccagcactttgggaggccgaggcgggtggatcacgaggtcaggagatcgagaccatcctggctaacatggtgaaaccccgtctctactaaaaatacaaaaaattagccgggcatggtggcgggtgcctgtagtcccagctacttgggaggctgaggcaggagaatgacgtgaacccaggaggcggagcttgcagtgagccgagatcacgccactgcactctagcctgggcgacagagcgagactcagtctcaaaaaaaaaaaaaaaaaaaaaaaaaaatgagcaaatgaaaacccctattaaaaaagtggcagagcccctgaaaaggtagttcatagctacagaaatacaaataagcaataaaatgcatgaaaaaggatttaacttcaaacagaattaaataattggagatgaaatcagcaatgacataacatttgaaaaaaaaagtaacaaattaacaaagttttaaaatgttcgataatggtataagagagaatatggaaagaaagctcttccttctattgacacagtttttttcttttgtcatctttttggaggggcatttcgtgatatctaccaaaattgggcccagcagttccagttcttggcacgtatcctacacgtaatcctatacaaatatgtgaaggtacatgtaaaagaatatcagatgaaatattgcccctcagtgaaagactggtaaaatctgctgttactcttcccctggcttagtgtgctccaaccacagtagctttctatctctttatgggacatacccagtcttttccaccttaagacatttgtactagctattctttcctcttgggatgccttttccctaggttttttacgtgactttttttttcttgtcattcaggtctcagcttaagtatcatttcctcaaggaagcctttcctaacttcccactacaaagtagctcccatttcccatcatagtactctgttttattgtcatcatagtagctattactatttaatattgtcttctatgtttacgtattatctgtttctctagaatatggaaaggcagaataacttggtaattaaaagcattgactctgtagccatagctgggttcaaattttggctctgccatttacagtctgttggcacttggggacaattctaacttaatctctagtgctttcactttttaaaaaaaatctgtgcaactgtgattaagaatagaacctacctcacaaatttgtgataataaaatgaacttaacatttaaaacacagcactattgaggacatggtagacactcataaaatacttgtagatcaattgaattaaattatcatttattcatttaaaagaatattatgaaaccatctcagtgaatgaggtagatctgtatgttctgatatgaattttcttcaaaatgtagtgtgagtgaaaatagactgtgaaggtaacctcaaaatctgggtctttaaacaacagagactcatttcttgctcatgttacatatctattatgtgtcagtgagggtctctgtctcatgttgtcctcactagtgtcctgggctccaccatatggcgaaaggaagtagaatattcagagtggcattttagatgcttccatctagaagcactaccctccacttatcacattgcattggccaaaataagtcacatagccacacctaacttcaaggagtaggaaagtacgatcctactgtgaccttctaaggaggagaaccagaaatgttgatgaacagcaattattaatgagaatgtaataattgagaaaaaaggtacaaaagagtaggtataaagagagcctatttttcaaagatgtgtgtgtacttggatttatattataaaaatgtatggaacaatctgcaaaactaatagtggtctgctctgggaaatgggatatttactttttacattaaaccttttgtactatttgatatatttttcaatgtggacatatattacttccataactaaaaaaaaaattgtctcccaactgcctctcacatatactttgacaaagtgctattgcaaatactattacaactcagtaaacatgggatggcttatattgagagaaggaaactgattcacaatgagagaaaaggggcagaaatagataggttattttctgggtagagaagtacagagaggggctcctaaaagaccagtggcaatactaaagttctttataaactatctagtagagaggattgtgtggtagaaatttacaagctttctagtaacaaagtttcctgggtagttaagtgccagacagtaggggcagaccacaaaaatatttttatatcattttgtatttggatagaagaaacatattaaggataatatatttctgaatagatatcagtgataaatttgaagattctgaactattgcagaagactgggaaagttccctgaaagtctccatttttccatgatttcataaaagttgctgttggcaatgattccagggcttttcccaacttggaaattcttagttttcaaagtactttaaaagtaagatataaaattattttaagggaaaatgataagataatgttttatccaactctgcttgccaaattatttttagatatatatgaatatttgtgtatgatttgcgaacaatggaagaagtattgattttagataaaaatcacttctgttttagatttttgttatttgtagtgacaccagtgtgtgtgtgacaccaacacacacatacatacatacaacataattagatatatgtacacctaattagctcccttgtttttactttttttaaaattccttggaaatgcctactttttacaggggaggcacaaatatggaagttctgtatggaggcacagatttagctctaaagtatgtggaatggtaaattgaaaggattttggaattaaacatttattgaatcatctccaaagtagtataagatatttgtatacagaaaatgctgtgagagaatttgaagcaaaattttctattatccctaattgctctttgtaatatattttaaatattgatattaaatatttatttttaattagtgtgtatttaaaactatagttaaggtaggaaattatgatttagtgtattttaaatatgtatttttattcctttcctcagccttctgttaaaatgagttgcataatgcttacattttacataggaatgcaaacagtcctattttaagtctggtcagaatttttaaaggattaaattcaggtatttaaaaaaatcattacgtcattatataaagacaagtctagaaaaatcagatagattcacaggcctttttacttactcagtctcatgacttttctcaggggtttattttattttattttattttttgggactgagtctcactctatcacccaggctggagtgcagtggctcaatctcggctcacggtaacctctgcctcctgggttcaagtgattctcttgcctcagcctcccgagtagctgggactacaggtgtacaccaccatgtctggctaaattttgtatttttagtagagacaggacttcaccatgttgtccactagtctcgaactcttaatctcaagtgatctgcccacctcgctctcccaaagtgctgggattacaggtgtgagccaccaccacgcccggccaggggtttattaacatatatacatacaccatgagaacactatattttgtatctcacattcttgcatgatcatatttaagacaacaggatttgttcaacattcctagacacctagtatgtcaaggaatgtttctacataagtattatttattgaaataagctgcatttagactatgctactcaccatataaaggttgactatgcctaatccaaacatctgaaatctgcaatactccaaacctaaaatgaaatactcattagaatatttctgatttgggaattttgggttagtgatgctcaactggtgggtataaagcaaatattccagaatccaaaaaaatctgacatctgaagcagttctggtcccaagcatttctaacagggatacccacactggactcgggtggtaatctgcagcagctagtgaggtagcattcctgccaaacaatttgagatacattttgaagtatttggaaataggtgtcatattctccctttcctgagtttctagtaattataagcttttcacttcaatagttactcatgtataatcagtgagtttaagaaaattccagatatggtaattagatactaacacaatatggtgaaaaataggaactaatatacaaacttgcagattctttatatatttaatacagatggaagtccttgtttaaattttaatagtatgatacattaggagaaaaggacatatttggtaaatctatatcatatatagtgtcagattttacaggataacttgtaaggaagggatttatgagaaaaaaaatgttagcggggccaaacaatgtaaataaatacatgttggcaaatgtgctcaggagtattttgtaaggaaggagttataaacattgcctttaccttttgattgtatttgcaaaacaatgattcttaatggaaactaaaatttaaagtgttgagccatgagtgctcaactttcattgcatactctgtcataaagcatgctggaaagaaacaaaaacaagcctactagttgatcagttatttattgagtttttgttatttactcaacactacaattaagtgtggagaatacagaaagaaagtgtaacatatctttatttcagttaaaattttactgtttgacctgccgagagaggttaattggatagtcaaattggactttaaaggatcttcctgggagaagaccaacaagaacggaattttaaaaagtggcagtgaggaaactggctcaatccaaacacagggcatgtcctcagcaaataagggaataacaacaaaaccaacaacaataacaatggtgcttcacattaatcgaatacttattacctgctgaacactgttttgaagtgcctttagttcatgaactaatttaattctcacagtgcctccttccaaatagaggaaaaagagatctctcccctcttccatggctacctgggctgaccccaggagggcattaaaagcacctaaatattcttgggttggatggaaaatccttgtttgggattttaaagacctttccaaaagaggagtcaggggcattttgtaatcagctttcacctttccctaccctgtcaggcctaatgccaaatcggaaggaggagctttctatattttatacattgtaaacatttattgccttggaaatatattcttataagattttgttttagattttatgtttaaaggattttaaaaattgagtagagatttgcttttatcacaaagaatgctatttatgtacaaatgcagttatctgtttaactacaaaaaatgagttctctgtgttgtacatgggagggtgatgtccaagtatcacacttgaccaccagtctagttttaatctttttcttttacgttttttgaggcagagtctcactccagttgcccagactggagtgcagtgatgtgatcatggctcactgcagcctcaacttcccggactcaggtgattctcccatctcagccacccgagtagctgaaactatagatgcacgccaccacagctggctaattttttgtatttttagtagagacagggtttccccatgttgcccaggctgttctcaaactcctgggctcaagtgatctgcctgcctctggcctctgtcactgtgcctagccaagcatggaattttttttttttcataatttacataggtttttggagaacaggtggtgtttggttacatgtgtaagttctttagtggtgatttttagtcatttacccctcatccccctcccaccgtttctcctaagtctcttaaccacagaggtggtaagggccttgaaggctaggcaagaatttatggccaagtctttgccttataggattatataatctaatgatttagagaacttttgttatctagagtttaaggtactcataaaatgctgtttggttatagaatgaattttctcttgataaatgactgtactcaaaggcatattgatttccatataattatatagctagttatactctattttattagcaaaacagtcttgaattttgcataatttaatgaatataattaatgactaactattcttccttcctctgataggctaagtaatcaggctgacctagcccgattcattatactcattacagaatagaaaaaagaaaagctgcaaaatagtattttgcatgatggctctatttttctcagtttccaatcttagggacttgactaatttcattttaaagcagtacaggtatatatatatatatatatatatatatatatattttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcagcctcccaaagtgctgggattacaggcgtgagccaccgcgcccggcaggtatatatttaatacaaggaatagagacattctagccaaaatagtggtgaagtaaaattcacgtgtaaaatatccctttccttgcatgcttcaaagtaaagtggtgtcactggaaagatatacactggtgttttagatattagtttttaaaaatcatttaattattaggtaagggtgttttattttgtgaaatatggataaaaatctgaaatataagtcatattaggtaatgaccagttcccaaaggaaccttataaagagcttcatggatgaatgagtttacatctaataagatataaactcgctgataagtggctttctctctctctttctctgtctctctgtctgcctccttccctccctcccttcctccctccctctctctctctctctctctctctctctctgtgtgtgtgtgtgtgtgtgtgtgtgtgtgtgtagtactagtagtagtagagagcatagtcaaggaaataactacaagatgagatagtgaaaccttttgtttgatcaaaaaaagcaactctttgagcaattcagctccactggggcaggaactatgttttctttattcctccctctgtgcctagaattggtagatatttaaaagttttgattgtatcattgtaagtaaaagggggacttggattttggttataaaaacgtttatgccactttcaggaacagatatattgtatcataatgcgataattcttaattgaaatggcggcctttttgaactcttgtgggcacatcagaactattttactatatttagattgttcatgtgtggcttttggaacttatttcccatcgtgtaaatacagtgtattcatctgttgatcccctacttattaggcaccatgccgctactcttatagatgtcatcttatttaccagatatcttcagtatgtgtctgaaagcagatattttaatctcagtttttcaaattgggagatcgtgactcagaatttaagaatgctgcccagtaagttgcttggcagtaagctcttgggcttacatttgaactcaggttgtgtttgtcttgaatatccttgatggtcataaatctttatcttctaagaatggaaataatctttgaaaatagccaaaattttctcccttaaatttgatgaataagatgagtgactaaattgatcaaattctggccttaaaatataaagcaatgagacgtgttttattatttgggtggtaaactgtccctgaaggtaatttcttcagaatcaaaacagggatattcagcaatgttttcagcagtggcagcagaactatagtaagcatgtggcccctgagataactgtgatagtcaatacacattaggaagattaacttctgtttgttataaaacaaaacagaatagttattttatagtaacattttcatgatgccaaaataaatactttcatgtcattatctaattgtatacattgttttaagaaatgtaaagaaatactgtattagtacaaaattacaccatttatgttagtgtggaatgtttgatcattttatttctaagggaaaattacaaaactgtttagttcacctcagtttctataatgcagcctctaaagtctcatttctttaacagggccttgtgggtgttctaaaggaatgattgaaatgaaaagaaatgagagagtcaaacagtgtaccgtaatagatgaaatggaaagtaattatgttaatgttgactcattatgaagctctaaccatttttacctgctcatttctgtgtggaaacctgtgcagctgagatgctgaataagaaattcttgtacaaatgagcctagaggcatgtttctagtataggagctaggtctatgcagaattataatgaatttccctaagtcattatttaaatatgctatcagagtaggtgattctcctgccagaaaatttggcttctaatgtttatcatcaaatttttagatgtatatttgaatcttcattgctgcatgtaattctcatttgttaattagagagaaaaaaccctatattccacaatacatctatatcatatatagtgtcagattttacaggataacctgtaaggaagggatttatgagaaaaaaatgttagcagggccaaacaatgtaaataaaaacatgtaagtgcttaagaacgtgagatttggagtcagatgggctagattgaaaccaaatctgtctgactccaaaactgaagcttttattcatggtcagaaaattttgaaagtgtcactcccctaaatgcctataccattccccccattgcgcttaaatgtttctttttgccagtattctgtttctaaagcatgcatttttcagtcataatgtataataaagcttaatggtcttgcctcctatgactaaaatgtcctgccagtattctggaaataaaatattatagagaatctctctgattatgttaaattgctaacgatggcttaattacttgttagaaaaatggtacattgtcatttttaatttacagacacttaattttttcctatgctaataagtgacttctaaaacaattaaatccctgaaacaattaaatacctaatttttgttaaattatattcaacattaatttaagagtttaattaaagctaaagaacattttacctcgggcatgaactttttcccctttctgtcagatgtgaatgcttttaagtaataaacttaaatttcatgttcttaaaattaatgttggtgcttataatgttattttgtatttggtggtttttaatggcagtcttttatgtttggaatttcaatttttgtattatttcctacaaagatgcaagaactagttatactttacttttaacagtgaagtcttgatagcatagaattattacaccagaaggaatgtaaaaatttcatctagagcagagctgtctagaagaaatataatgcaaaccacatatgtaatttaaaattttctagaagccacatttaaaaagtaaaaagaaacaggtgaaattcattttaataatttattttatgtaatccaatatatttagtacattatcattttaatgtgtgatcaatataaaattaatgagatatatctttttattaactctccataatatgatgtgtattttacatttatagcacattttaattccaactagccacatttcaagtgattggttgccacatgtgactaatgacttccatattggacagtgcagatctagagtctcgatttatttcccatccctgtatccctgatgatatggcacactgtgaatagtgctattggcttatcaagtggtgcatacttccctagtaagggattattggaaaatccaggtgagaggagctgtcttctgtagttttggagagtaaatgcattcaatatgatcctgatcagcccataacctggggtaggggagcttacattctccactgggaatcactgatcttatttgacctctttatattctgcaagaggaaatgaggcccaccttcattccagggtccatgttctgcaataagcttggccctcttacatttctttctctcttgaagtagccttttcctgtgttgtttgttcattttgggatttttttttattattatttttgagacggagtctggctctgtcgcccaggctggggtgcagtggcgtgatctcggctcactgcaagctctgcctcctgggttcacgccattctcctgcctcagcctcctgagtagctgggactacagacgcccaccaccatgcccagctaatttttttttttgtatttttagtagagacggggtttcgctgtgttagccaggatggtctcgatctcctgaccttgtgatctgcccgcctcggcctcccaaagtgctgggattacaggcgtgagccaccgtgcccggcccattttgagatgttaatcagtttcccttctcttctagttttggatatctaatggaagattatcacatatcatgaatgatagttctgttgatgctatttctcttattaaatgttcattgccattatcttctttaaatctctaccatttaagtcacactgttgaagactcaactaatcagaaccaattgccttgcattttgaatgtgaactgcccatgaattctctggattgaaaaatattctccctcccctctattgattagtaatgtgttttttgttccttttcaacatatattctaaacgtttatagagtcctcttcactttcatgcttatgttatcctcttattaaataaagtaatgccaagcccatcatgtgagtgtttcttgggaattgagaaatttagaattgggaaaatagagaaagaactcagaaatcaaaggaacctggctcactgtgttcaatttgttcacatttcaacctcttaagtaatgaaatatcttctgaaataattgccttctcctctccattcccttcccacttccatatttttaggccacgacttttataagagcctctcagattgcactccttatgccttgaaagtgcatccagagttgtcattctaaaaataaatctaatcatgtgttcctttttgtctagcagtcatccagcatggcaagatccccagggttcttagaagcttggttccaaaacctacctttctaccagcactacctatcatttccttttgttctgctacccattccccactaaccagaacacccagcactctagcctgattgttattcataatttcccaatgcactgtaaactttctgtcatgcgtgtccctgtgaagagaccaccaaacagactttgtgtgagcaataaagctttttaatcacctaggtgcaggcgggctgaatccgaaaagagagtcagctaaaggagttaggggtggggcagttttataggatttgggtaggtagtggaaaattacagtcaaagggggttgttctcttgtgggcaggggcggggatcacaaggtgctcagtgggggagcttttgagccaggatgagccaggagaaggaatttcacaaggtagtgtcaccagttaaggcaggaaccggccattttaacttttgggattcttcagttatttcaggccatctggacgtatacatgcaggcttgggctcagaggcctgacactttcctgcctctgttcatgatgttcttcctttacagaatgccctccttccccaagctacactaaaggtccagtgccatttctgttggtgtaatgtccctccataaagagtaattagagttactcttttctttttattctcctaacacgttttcatttacaggtttcttgttttccactttgtgtggtaacttcatgtctcttgcttgtttgatagtaaactccttgagctggaaataaacgtagctggcatttattgaacatctaggtgctagacatcatgctaggtatgtttcctttatatttgcaactccagcatcagaatagtttatagtagatgtgcagtaaatatctgtggagttatatgtttgcatttttaaatatccattggaattcctttaggaatcctaacttagcatttccataggaggaggaaaatgccatgtataaaatacctactaggtgctttacaaatattatttcatttagtattgtcaataacactgcagttggagtatccccattttagagatgattaaatgaaactaagtaaagtggtctaattacccaactctttcacctagtaaatggcagaactatgatctgaatccaggtatgactgaagagtgtctccttagatttgaaagtacagatgtagagtaaagaaatatactttagtgggggtaggaggtaacagtctttgctaactagatcaattgattcatgcaaaatgggtattaaggtgcaggcatttccatctgatagcctttacttccttttcccaaggtgcactagtttagtcatgttacttaatgtttccattcacctgtgttggtgaatactaaattttgggaaggttattattggtaacatactgatacagtttggatgtgtgtccttgctcatctcatgttgaaatgtaattcccattgttggaggtggggcctggtgggatgtgattggatcatgggagcgtttttctcatgaatggtttaccaccaccgccctggtactgtccttgagatactgagttctgtgagagctggttgtttaaaagtgtgtagcactctccgtgccttactctttctccatgtgacatgcaagctcctggttcgccttccaccatgattgtaagcttccagaggcctcccagaagtagatgccagtgctttatttccagtacagcccgcagaactgtgagccaattaaacatcttttcttataaattacccagttttaggtatttctttatagcaatgcaagactgacctaatacatgtacacatgtgaaatttcagttagtaagacatgactgtggaagggaaaactcttctaagttagtaaaaagtctgaattataggaccttttcttgaaagtagagtggtcgggagtaggccagcatcattgctagcataggactgttgtaggaaaagctgggttcttgtcacatgaccaggaaaggttagactcacagatacttggaagggcaagacaaatggaatttatggggcgaaaaaagaaaaagaaaaaaactttaagcagtgcacttaggaagcctgttaactactctcgccccactacacaggaattcaagagcccagctcctccctgcggcaaaaggcaggaacttccttggctcaaccctgctctcccagtatgcatgctggtggaagattatccgtggaccctccccgttatctgcctcctgcatctatcaggaccttaggaagcctgttttactgaatgtatgaaagcttttagtaattagcatatcaattatttgtccataagaaggggcttcacaagtacttgagggcatttgaaaaggagtagaaaactagcataaattgagtggcataatttatgaaatcctcaccctatgtggtaggttaccagagatttgtaaatagaggctctaagaggttaaatcatttgcttaaattacaaagtaaataagtggcggaatagcatccaaatatacatttttctgacttccccaatgcacatactctttcagatatgctaaaatgtaatttcaatattttctctgtaatatttgatactccattaatttcattaacaagcatatttcataagtagtacaaagatgaatttcaaaatagctctagcaataggcaccaaaaatccacattcataattcttcactatacatgctaaatgaaaacatattttaaccatttaaaccaccatcaatcaattttttctttttagttatgcataagctttacataggtaaagtggcttatttttgtgttaaacaaacatgcttaaaagcacaatttaaaggtaatattcactgttatacctttaaagtgaaattaatattctttactaagtcattagtttacttttcctttatttttagatcaagtttttaattcagcttcagccaaaaggagataatataaaaataaattccatttaaaaaatggaaatagtacaactttcattgatttatacacagattctgaggatctaaatgcttaattgttttaatcagtccaatttccaaacccatcgtagtatatggtgatacttccgtttcatatatttttgtggataacggtaaacctgaatgagtctagaaaatttatattcacacacagagttttcagggatatttagcatattgcagaggaagtgttatttcacgtcaatacactaaacttctctgaacccccctattcatcgaaaacactgaacaccccattcattacacaagctagagctcttaagagctagaaagctttaacattctccttataattcagttatggttatgaaatatgaaaaataatattttatgatttattttaaaacactttgttaaggaaaatacatttcttcttagtctatcattaatctggctttacatatgggctggtctcacttatcctggaggcagttaatcattaaacatttttagtggcaaaagcctttccttatagaaagattttgtcttcctgtcataaatttctcatttttcttcctggatttttaagctagaaaacactgtaaatattttaaggttgcactgcaatttttctgccatattgaaatgatagctgtctgacatcatttttccttctttataagtggcatattgtttactagttcatgacgtacgtcttcagagatacttaggtactcaactctatgcaaatatacactgattacctttgccatagacactagatgactacttgattaaaataacattaagacgactagccaaaaccaagactaactgctagtgaaaagaagcagctatcagttaattgaagaacatctatatctttatttccctttaagtatttagaaagtcttattgatgaggtaccatttccatattcaaaagacagggatctgttaaccttttagtgaatgagacaattcataatttttccttgtttctgtctctgttaatcctaacacacaattactctatgtagggaagcaggaaactccatttacaatgattatttggggttaatttcatttaatggcattcttgacaaagatatgaatatggcaagaatatttttatattttacgtttaacctttgtaatttaatctttctaatttcatttgatataaagcgtaaatgaaagcaaaaacaccatttatagttgagtgtgaatttttttctttttttgaaaccagtctcactctgttactcaggctggagtgcagtggcatgatcttggctcactgcaacctccgactcctgggttcaagcgattcacctgcctcaacctcctgagtagctgggattacaggcacatgccaccacgcccagttaatttttgtattttttatttattttttattttttagcagagacagggttttaccatattggtcaggctggtctcgaactcctgacctcaggtgatccacccgtctcggcctcccaaccaaagtgttgggattacaggtgtgagcagctgcctccggccgagcaatacatttctttgtgtctctgcattagcgttatacttttttttttttttttatattgagagggagtttcgctcttgttgcccaggctggagtgcaatggtgcaatcttggctcactgcaacctccgccttctgggttcaaacaattctcctgcctcagcctccggagcaactgggattacaggcatgtaccaccacgcccggctaattttgtatttttagcagagacggggtttcaccgtgttagccaggctggtctcaaactcctgacctcaggtgatccgcccccacttggcctcccaaagtgctgggattataggcatgagccactgctcctggcctagtgttatactttaaatatttttatttgaatacctataattatgaaacctgcaatattaagcatagttaaactttcaaataaagcaaatgtataaatatatccaattctattcatattcacttagtccactttctcatttcacacatttaacaaagcaagcaatgataaaatatgcatgtcttgagtattataatttgcatttgaaactgcagaatcttctggctgaatgaatcaataatgcaaatatctttctaattagatatttagtgttttttagttgtattttgtaaaatctaaagttttgtgtacaaaatagtttttttttttttttttaaagaaatctgacagatcttttggtcctgtgtttcaaagtacattgtgaattttgactgaaatcacagttgtctttggtataccaaaattaagttctgcatagtacctattttagtgttacagtcagtgtaactgctggaatattcaggtctagtggaatcagtaattatgtaagcctttcttgttagaggatttcttggcttagatacatcccttatatgtgcattgccccttattgccttattgtcattctaattactaccactcctttgtccccatccccaccccatggccttcattctttgttgctatctttgtgagtagaaagacaaactataaggaaaacttgtatgtgagctgtgtggggggagcgggtgagttacagttatttctaatatctaaagagttgtgtagaagaattagacttgcttgatgaaggcacaaaaggaataagtagaaccaaggaataagttgctgtgataaaggcatgaaataattgataacccaagatgcctcgatttggacctgctgccttaagagatactgagttgaatgttaaggcagtgaagtgcaatggaaggaatctgtgagcttggaaccaggcagacctgtatttcaattttgggtctacttcttaaataatagctgtgtggtcatgagcaagtcactaagtgacagaaccttggtttctttatttctaaactgggagatgatgcttaccttgcaggttgttgtaaaaactaagacatgatgtgagtaaagccccttggcacagtgcctgtcatgtaataggtctgtctattattgttgttttattcattttttgagtgatcaaaggttgctctttaaaaaaaaaaaacaactctaggtttagtggtacatgtgcaagtttgttatataggtaaattgcatgttgagggatctggtatacagattattttgccacccaggtaataagcagaggacctgataggtagtttttgatcctcaccctcctcctacctgccaacctcaagtaggcccccttgtctgttgttcccttccttgtgtcaaagaccactctttagaaatgatgttgaaagattgtacaaggtagtgaactaatataatttgtattatcccgtttatcttgttgatatgattctatattacttttaaagatatatggttgactggtaatgagcattatccccttctcttgttattggtatactgactaggttagtaattcatttttatttttatctttaaaaattattattattattttttttagagacaaggtattgctctgttgcccaggtcagagtgcaatggcgcaatcatagctcactacagcctctacctcctgggcttgagggatcctgccatctcagcctcctgaatagccaggagaataggtgcacaacaccacaaccaggcaatttaaaaaatttttttgtagagttggggtctcgctttgttgccaggctgatcttgaactcctggcttcaagcaatcctcccgccatggcctcccaaagtgctgggattacaggcatgagctgttgtgcctggccaaggttagtaattcatggagagaaaatgggattgatgctttgctttccagacttccacaggctttttaagtgaaaatgcaagttgacatatgggaattttaaaattatcattttgttattgattgctatgccaaccaatactcttttgtttgtttcttcccttactaatttaagctatttgacctggaactatagttcatgtagatcttgtgggcattttccaagtcgttatttctacaatgcctattaatatgtgtcttctatatcaagcaatggcactttttttgttgaataaatggatacaggggttgagctgttcataatttgatgcattttcaggctgttgtaagtgaattgaccatttgctcaaaatcagtgaacattaagctattaaagtaattttcatgtctgcattactgatgttttttttggaaaaagtatgaaattgaggaggatcatgataaaatgcatttatctttattctgcctttttgaagagaatcttaaagggcacaagcctgttggcagagatattcttaagtgataaatgataatgacaagagtggcgatggttttttccatcacagttttggggatcaaggtgagtcagagagaatgatatcctaaaccttagcttcttcattaaatgacaacaaaactgtcatttgctgatttttggccatcagaagtattatctagatcatattatctatttataactttgggataatgggtttctgattttatgtaatgtacttctcagcccttttatttatttttttatatagctttgattctttgaagctggtatgtgaagcacaagctttatttatttacttatttagagacagagtctcgctctgttgcccaggctggagtgcaatggccggatcttggcttactgcaacctccgcctcccaggttcaggcaattctcctgtctcagcctcccaagtagctgggattacaggcatgtgccaccacgcccggataatttttatatttttagtagagatggggtttcgccacgttgaccaggctgatcttgaactcttgacctcaggtgatccacccagcttggcttcccaaagtgctgggattacaggcttgaggcaatgtgcctggccgagcattattttcaaagtgtgctcaactggagtgcttctttctcctaggatgcccactatttgtgtagggccaatacttaatgattgttttttcatgattgctattaaagatactatttttgttacccaccctgatgctcgtgcttcacataacagcttcaaagaatcagcgagcatttggaaatgtataaaatgactcctgtcttttgtcaggagtagaatatactgataaaatcctttctcatgaatgatgaagttgccagaaatttggaatacttttggactgacaacaattacatgataaaatattgtgaaaactatttgtgaataaataatgaaccaatactacttctgttcactcagaacaaacataatacagtggttcagaagagcgtagtaaccttcatattgcttaatagttcagtaaacttttaatgcctctgaaaatgcataatagttccttaagaaagcatggtaggataatcagaaaagactttttttttttaatttgacaccaaagggattcatatatgacatctgttcattttttccacttcccttcttctagtaaaatacctagaaataattattcctagagaccatgtgatatttccacctttagtgtctagcctgcaattatttcaacaaagtcctcttggtacagtaaatagtaaaccccactggaccaaatcctaatagtatagtattggctgccatagtgtaacacacatggtatgtttacattaaattggtctcatgtcttaaaaagcatttgtctttatatttagtatagatacaatctagagatagattaactggctagatgatgatgataataataatagctaatctttattgagcacttactatgtggcaaacattgttctaagtgtcttatgtgtcttaattcacttgttataacatcccaaatgaagtacgtagtgtttttattccactttatagagacctaaactgaggcacagggatttaagcaactttcccaagattacacagctagttaagtggatgtaatccaggtaatttgattcaagggtccattctcataaccattatgtgatactgcttcatagccattgtgtgagactttaagagatgctgcagtgctttctcctttttcactacttcactatttctcgttcatagccctttgttcacagggaaaacataggaagggaaaaactagaagctccttgagtttcacctgtttattccagatttttatctcgtggtgtctcccattgtataaactgagatcagtaagaactgttattatgccatatgtttctaatcatagcaattgcttcattctctgaggcatacaacacatgaaattattgtcagacatactgattttatacgtttacaaatgctcgtttaaatagccattgaaatacaaacttcagtaaagagagtaatgtttggtttgcatgatgtctgaattctaagatttggcaatggagtaaagattttgcctagatcttatctttttccccccattctacagtgaggtacaatgataattgttatcatagtgatgaccctgggagagcattaacatcttttgttccctagaatgtacttattgaagcaggaatgtggatgattatgtttatgtttgattttgtttgtttttgagacagggtcttgccctgtcacccaggctggagtacagtggtaccatctgggcgcactgcaacctctgcctcccaggtttaagcaatcctgacacctcagcttctggagtagctgggactacaggcgcatgccaccatgccaggctaattttttgtatttttggtagagacggggttgcgtcacgttgcccaggctggtcttgaactcctgaactcaagtgatctgcccgccttggccccccaaagtgctgggattacaggcgtgagccaccttgcctggccggttgcttatgttttagatgtacagttgtccttaggtgtctgtggggaattggttccagaaccacccccccttgccaaatcccttatataacatggtatagtatttgcatataacctgtgcacatcttcttgtatactttgaattatttctagattacttataataccaaatacaatgtaagtgctatgtgattagcagctatactgtattgtctagggaataatgacaaggaaaagagtctgtatatgttcggtacagacaatcatccatttgtttaaaaaatatttttgatctgcaactggctgaatccatggatgaggaacccacagccgcagagggctgactgtatttttactgacaaaagtttaaacataaaagcaataaccaaaaaaggtagtttagtcacaaaaagtttaaagtgaaaattaaattaactacaacatactgtaattcatgccaaacagttgttcctcctaatcaatatttgaattttgaaagagaagtaattgtatatatattgtaagaattccactgtagatgagtcacagagcagattgatgatcgtatttttttgctatggtagttaaaactttttattcagatttttatttagtgctaaatgagttcaaaatgtatattacctctctggaaaagctcttatgttagactgtcagctatctagtccattttatattttcaacttgaaaaatgtttaaaatgttaatttatttcaattaaaatttaacaggttgaaataaaatgaacatcagatttctcttttgattcactccaattcagaaaaacaacttttgaaatcttacaatgtggtaggcactgaacgtttcaaagactgttaggaaatggttcctgtgttttcaagctttttccagtggccagttggtcacatttatcaaatgtactaaaactatgtttttagacatactctttaatatattcatgtgaagtttacagaattatgtttgaacacaatcctttttgtaggtgttcacagtttctatgaggttttacttcactggttttcatgttatcttcataatagcattttaatgaatatttatttctacccaactccttactattacagctggagggagctgtgctacaaagagagcactctctgttgagagaaacttggaaagttgagttaacatattggcctgggttgctaatcccaaagaacaggaagtcttagggctagagtgagggaggagattgggtggaaggggtatagtctgaagtctccaaagcttagagctctgacagcctacagttttattttgcccttccaatccatccaatgtgactcttttgacattcttaaaataattgagaaaaaatttctgatatagcttgtaaattctgctaattgatcctttagtaaattgaccatttggcaaatagtcttttctgcgactacatcaagagtccctgttgtcaaagaaatgccttagcaaatggaagatataaataatacctttaccaagttacaggtaaaaaggtgccctattaattaagtctgattttcaaaataacccactgaagagtacagggattattatccctaattaatatctgtatttaatactggaagattcagagaggctaagtgagttgccctcagttaaaagataatgaaaatggaggaatcaagatttgactcaggcattctggccagtaagtgtatttccattataccattctgaagataatcactttgtttaaataatttcatttttcacattttgagggctagagagatggggacgggagatgaaggagtactgaagtttgctcacttgatgacatgtttatgtatacttttcctgtacttaggaaatcaatttcacaagacattgttttaagaaattttaagcctgttattatagacatgaattaactacacactgttaatttagaaattattgttagagcagttattatttttgtacatgacagcattagaaaataatgaagttctaatattttgatttttatagctcacatccctattctgggtctcctttccaagttttcaaacttagcaggaccacagaatttcttgttttagactgctaattatcttaagacaaaaagggatcatcctaggttctgctggttctcacattaaagagaaatttccattttccattaatgtattcaaatacattcactttaaagatacctatactgtactgctaaagagattaccctctatgtcttattctctattttaggacttcagctttcagaaacagctgtaaaactttcttaagcattatgaatataatatttctcaactcatcttaaaacacttactatttactatttctcttattagatatggcttctgaaatggtttaattgcacttcaaaactatagcattttattgattttattttttgaaagctgctttatgttctgtagtgtttaatggaggataagttactagtcacatatgatactgtgcatacgctagatttaaatgtttagtgcttacttttgacaactacgtaaagaagatctatatactagttctggatttatttttgaaatggaaaattgtgcttttaaaattattatgggtagcttcagtttgtatcacagtataccagcaccaatacattactggtgtcatcttacgtgatgtatgaaaatttgaggtactagagtattggtaaaatgctatttacccctatattcttactcatttaaatccaaagctaagtctttctactggtactaaatattttacatcgcaatggaaaattttaataacgttgtacaaaaatatatagagaaactaacaaaaatccaaatgacctcattcatcttttaagcagttaaaggcagtggaataaagtgtgcaaaataatgacatgcaagatgaaaaccacctaaaccttattttcctttcctagcctagcttgttctattatgggttttatatgaacatactttgaaatgaaatccattagttgaaaaacaaaaataaaattcttaaccaagtggcaggcatatacaatagtccccccttatccacagggaatatgtttgaagaccctccagtggatgtctgaaaccatggatagtacctaaccctttatatactctctctctctttctctctctctgtagtgtatatatataaaaaaccaagactctctctctctctcatatatatatatatatatatatatatatatatatatatatatatccatctgatagccaaggcagctaccaaatgactaatgagcaagtagcctatacagtgtggatacactggacaaagagaggatttgtatgccaggtaaaagagtgtgggacagtgcaagatttcatcatgctactctgaatggtccacaatttaaaacacatgagttttttatttctgcaattttccatttaatatttttggaccatggttgattgcaggtaactaaagctgtggaagggtaaacaaaactatggataagtggggggctactgtaacataatctttggtttttaggtatatctcagatgtatctgaaataaacattgagatactgaatgaatattttatagcaaccatcttttctttaaatctaagcatccttcttaactctaaaattatgaatctaatttgtgttacattttatattgctaatttcttatttttttattttatattttatgttcagtccatctttccgttgcttggaatatttttctgaggtaattagaaatttatatcttctccttagatttttttctgaagtcttgttacagtgtgatggtttttcttcatttaattaattagagaaactatagtataactaaattcatgattgaacacattttatacaaattacaattgagagccgagggactatcttcagcattaaaaactcaaacattcctaactttactgtaatgcccttcaaattaggattgggtttatttagcatataagagcaagggctatgcagtacgtaaatacaatacgtactaaaaaaatgttttgttgcatattcatttatttattcatatatattattacaattttattgaattttgtacaaaccaatgcagcaataaaaaactatggcttagtctatatcctcatgaagatgaggatagactaagatataaatatagatatagatataaatataaatatagatataaatatagatataaaaccaatattcattttaatcatcctaagtgcttaaagaaaacatccaggagattagagggacctagtttgggaggacagggaaggcttccctgaggaagtgatatttaagctgaatctttaaacatgaataaggattagataagcaaagagaataggaaattttttttaatatggacaaattagagcttaatattttaaaaatatataaatctgagattggatattccgaactaacaattcaagttatttaaacattgtgagctttataacaacatggaaataacaatatatggcagttttagaaccttgctgaaaaataaccttggtaaatctaaattttatttaaaatgaagctgtgtggcacacattgattcaaactgtctgtaaatggagtattgagaaggaatatgacagccagcaaatgtcaatggcgactttgattaagaacagaatgttgaaaaacaaatacctaacaaaaactaatcaattaaagtgtgtgtggagtggagggaggaatagctcaaaacacgaaagatgtttataaggagccactatgatatctaattctccatgccatttaataagcagactagccatgactgtgtacctgacctgttgaccccaataactcattattcaagtgtttactagataattttcatccaacagcaaatttcactgtgcctattctaggtaactgtatgctggggccctctgggtgataaaaggtgttttattagctgcttccagacaccccagttctcacaaggttaaataaattgtatgcctgctaaatgagttagcaggagatttaaaaatagaattcaaggttttttttttttttttcctttgtgctttcttactgtggttacactatctttaaagtttgtgttggtttttcagcagcacaggtctagattagttgcatttgtatacttccaaagagttgcatatttatttgtcctaatatatatatttaaaaaaaaagttgttcagagataaagggtaaacacaataagcttactgatcattcaaaactgcctgtacctactcatttgctctttcagcaagtgtttattgagtatctgtggtgtgtggtgttgaagggttatccttaggaaacccaagaaaaaaaaatgtggtcttggccgggcgcaatggctcatccctgtaatcccagcacttggggaggccgaggtgggcggatcacttgaggtcaggagtttgaaaccagcctggccaacatggtgaaaccctgtctctactaaaaatacaaaaaaattagctggacgtgttggctggcacctgtaatcccagctactcgggaggctgaggcaagagaatcgcttgaacccgagagtcagaggttgcagtgagccgagatcgatccactacacttcaggctgggagacagagtgagactgcatcttaaaaaaaaagaaaagtggtgtttgcacttgaggagtttttgatattactaatgttatgaaaggtctgcatattctcacaagacatgaagctgaaaacgtaaaatatccttctgaattctggggttttttgttttaaattagggagatttggaaaatacctgctatagtatttcatttctgctgtgttctatgtgaatataatgtgaatgctcactgaatgtatatgctataccactggttgaaacttctgcaagtttattttcacttttgaaggtgtatattatttccatttttacaggaaagagggagtaaatacactcaggactaatagttgcttatttacaaaaatgttcagaaattacaagtcattactttaataaaaagtttatcatagtactgagtgtttcaaaatattatttctagagatattgtttattttcagagaaacaatctgttgaaatgtagatttctaaagtattttctgcatttgatatcaagtgtccatagaaaaacgcagtatcctttaggggtaccaagctaactaataagtgtgtttcacatacatttcgaaagttatgttgcttttattataagttggaattttcttcccattggaataacgagcgttttctttaaaaaggctgttaaagagaaaaaaacactgacccaggagtagcccaaacacctggattgtgatgctttcagcgatatagctgcatgaatttcaacagcacagtcacctagcatgaatcttgttttctttgttgttatctgccctgcatgtcacacatggttgttacgaggatcaaatgacataatatatgtgcaaatgcttgtaagttacaacttgttgtataatgtaaggtacacctattttctgaaagctaagctataagtattttttatccagtagagggagtcaaccatttgcatgttataaaaaccagatctaaatttcttctcctcttaaaataatttattcttaaatcaaagtaaatatttggagtaaagtatatgtgtgtgagaattcatttttattgatagaacagtgataaaatatttgatgaatacatgggtatttaataatatattacatatattgacaaaactcatttgattcccttgaagtacacttttttaattttgtattccagggtactaggtaaaatcattcatggtggtcattggttgtttatgctagatattggactatttcagccttgatgtctactgtgaacactgatgtagtggccagtggtgacaataaagtaaattgacaaccatgagtcagaattttagaacttggttgaaccttccatgtggcatggctgtagatgaaatgaaggctcaaacagatgtggtgaaatggcattttatctggcctattgacaatatccaaggagtctgctctggtcatgagaatgcagctgcatgttctttcaggcagacctttggcagaattgtggttccaggagatcagtctggtttggagcaaaaattcttgccaagctttgggattcaccatgcaggatgctatattcaattcctagagggaaaggttagcataatgccaagttagctagtgttcaagtcaggttcctggcccagcaagggacgtttaccctaagtacctgggactcaagacttaggacaggaaagataaatctagatgtgacttacaggcaatactgtggatcctaactattttgagttcccttgtcataattgagcctgcagacagtaggtgtcattgcctggaagcagccatttgtgaggctggaggaacatactaagaaacacacagctgaaatgtgacagatatgtccgcttctctctgcttcttttaactgatgtgggaatttgattgatacaaccaagaaaaacttgttatttttgatacctctgaagacaatccctgtattagaaatttaaaagcctggagtcacatgtatttgtgtctcatgttccaattgaaggtttgaattttgaaagagtttaggaggaagataagtcaatggttgactatgtacctaaatttattaaaattttaaattaaatatttagtaaagtgatgtgttatcaataccatttccttataacaatagtagccagtttgagaacatgatgaaaaaggtcacattcataatagtaaacaagtataagctgattttaataagcttaataggagggtatataacctacataaatctacagcactttgagagctatagaaagcgactagaataaatacgaagacagtgcaattctagatggataaaggccataaatatataaaatttctcttgtaaatttatacatctaacataattataaataaaaacaggaattttagttgactttattgaatttagcaagattattatacagatggaagaggaaactggcaagaatgtaaaatgccattttgagaaccatgggcaatattttggtgatgggggactaatcctataaaaagatgaaggattcacatttttaaaaaagggagatattataatagcacacacattcatgtaaataagtgggaatagaaagaaagttcaataatagattcttatttatttatttatttatttatttatttatttatttatttattttttgagagggagtctcactgtgttgcccaggctggagtgcagtggtgcagtcttggctcactgcaagctccgcctcccaggttcatgccattctcttgcctcagcctcctgcatagctgggaccacaggcgcccaccaccacgcccggctaattttttgtagttctagtagagacggggtttcaccgtgttaggcaggatggtctcgatctcctgaccttgtgatccgcccgcctcggcctcccaaagtgttgggattacaggcgtgagccaccatgcccgccctagattatgtttttgcatatgtatattataaatatgaactatgttttctgtaaggatagaaaataatggggaggaaatatacattccaataccattcattaagtaatctgcctgtaaatctggctccataactcatattgtgtaccaaaatcatagacagattaaaagtaaacattgaagtgaaaatattgtaagctttgaattaattgaagttacaaaaggacagatttacaactttgaataaataaaagctaaactgtatagaatgctgtaaaatataaaacactcagaaaaatacctgcaagtttattacacacgggattaatattgttagtatccatgcactgcatagaatgtgatggaagcatctaggtttggatagataaatgtgcaaaaaaatagacaatacgtatgagtggaaataaaattagtaaaatgggaaaaactttaacataccaattgagaaatgcaaaatttgaaaatgaggtatcattttccatcttttcaattggaaatcttaaaatggcattgcctaataccatgaaatttgtgcattactgtattatgctggtagcattaaatctgtttgaaaagaatttgacggaatataccaatccttgtatctattgacccctgtgatttagtattttggacaatttaccctaaggaaattatccaaaagaagaaaaaagtatttatttgcaggattgtttatactaatggaaaattggggtgggcagaaaccttaattccaagagggcaatgcttaattatgagccatacactcaggagtattatcaggtagacactagaatgacttagatatgctgtgtagaaaatgaaaacattcctctgatacagtggttaaaagaaattacacgtgtcatatgatgtatgctttcagttatgtacaatgtaattatataatcgtatgttagatgacaatgtgaaaactaagcttctagtctggtgggatttttaatgacttataaaaaattctccccggactttatggggtaaaaggaaaatgagaatggcagagatttttaaggttttaatgttatgaatgctaaagtattctgctaagtaaaaatgataataacttttattgatcatgttctatggaccaggaaccatagagtgttctgcatttattctttcgttctgaaatgcttgaaaactgaaaaggaggtttaggcaggatatacttgtctccataagatagaagggctgtgataggatggaacaatttgaatagtcctttttcattccattggaggttaaaaaaatctattatcagtaaagtaaaaattataaggaaacagatcttaatgctaacaaaacaaaacaaaacagcaacatacgtgtccctttctttgctttctccacctcaggaaattgacattgccgtacttccagatgtctaaactagaaacttgtgtttcatacttgattccttgcacttcctcattctctacttccaatctgtgaccacattctatctattctaactgctaaaatatttctgaaactcatctgctccttcccattacccctgtcacctttttagtttaggccaccatcctcatcaccttgattacaatagcagtctcctaactggtctctttccttccatccttaccccctttcttctattcgctacacaaatctaaacatgtcactcaccagcttacaaaaatcctcagtgatttcacttcgctggattaagtccaaaccccttaatggggctttcaaggtcttcatgacttatatttacttcaccagcatctgctccccagcaaataaattcattctccctttcctgctccttgtccctttccccaccccatctctctcagtcacacacatgcaaatgtacacacaaatacatgtacacccctacagccataccgaacttcttccatttccatgactctgtttcattctctctcatcactgaatcttccacggtgctgtgccctccacctggaacactctccgttacttgtccaacctcgcctgagctttctcttatgatctcttgttcttgcttatccttcagttttcatattagacattccttctcctacaaaggctttttggacatctgggttgcatcctcctatgtgctaccctaataccccattccataccctttatacttacattactgaaaaataaggaccacctgagtagcattgtacctttggtttactaccatatccgtagagttagcagagtgtctggcacatagtagatgcgtgctaagtattcattgaatgaatttgtatggtttgggcctgtgttgtcaactacttaagatttatatttttaacttcaaatttgagcactgtcttcttggtcatcatattattaacaacaagcacaatgccaaacacggtacattttcagtaatgattggaaatgaatgagtaactcagtaagtatttgaatgaatgatcattgtaatggtgacacctcactgagattaatgagcattcatcctttctttaagttccctgaagggaacttcatttgtctctgttttacctaacatagtgtcttacatgtagtagacactcattggataattaccttcaattcccaagactgaccactatgtacagagttccagctagtgctggcgttaattaggtgatcttgaccatatctggaatttgaacttgagctggatttctctgtatatttgtgtatgtgtgcctgtatgcatggtcatgtcaacatatattttttaaagacatagactggttttgtattatgtatacagtgaccattaaaacaatgccatcacactacaaccagtcagagttctcttcttgttgttggttgttcatttgttttactgtggttgtttttgccttggactttgagagaatcctggactgtaaacttttaaggcaaggtttaagtcttgtcctaatcattcactgtgtagtcaacaagaaggtgttaggacttgagaaaaaaaattacctgaaggaaatatatatgagaaacgctttatggggaaatttttttgtcttttctgcttgactgtagaacttcaggtgttgtgtaatacgtattctttcacctccacttccctctgtaaatgtgctttactcataaatgtctgtctataaagatgtgtcctgggtctttaacaagtaggaggtggtacatacttgaataaacatcctctaagtggttgaggttgaaaaggtgcaaatctttcctagttgaagtaggagaggctgtacctgctttgttatgagtcctttctttgtgttctcattattcctttttttttttttttttggttctacatttttttcctgtactattttgtacagctcctttcttatttttttctttcacctctcaactctttcattatcactcttttttcatttattgaaaccatatatccatgttttttgagtgactttgaccagaacagttggttcagctttctttttaaaataatatttaatgtatttcaattataaaagtaacaatctttaatttagaaaatctgaaaacaaaggaaattttaaagaagagagtatgtatctaaaatcctcttacttaggtataattatcattaacattgctataaattactatttagattttttacctaattgaaatcattctgtacctagagttttttttacctaattgaattttttacctagttgaaatcattttttacctaattgaaacattaggtaaacatttttacctaattcaaataattctgtacctagagttttgtatctcattttaaataatattgagtcaaagatgtatttccacatcattaaaatactttaataggccagacacagtggctcatgcctgtaatcccagcactttgggaggccaaggcgggcagactacttgagcccagaagttcgagatcagcctgggcaacatggggaaagcctgtctctcttaaaaatacaaaaaattagccgagcatggtggtgcgcacctattgttttagctactccggatggggaggtgggaggatcgcttgagcccaggaggtcaatgctgcagtgatatgtgatcacgccattgcactccagcctgggagacagagtgagaccctgtctcaaaacaatttttaatggctgcataatattccattttaaatagataaagcttacctctttatttcccgatatttgcactgttcaatgtatttacaagtttctctgatataaaaatgatgtcatgaataacttagaacgtgaagtcctagctacagttcagattgtttcctgtgaaagattcctagaagtagcattatcaggtcaaaaataagtcatactttttgaggcactttttttttttttttttttaaccacatggctttccagaaatgttatgccaaatctgctcattgctatcagcattgtaaaagaatatccatcttaccccatgggtagggctttttagtttctttaacggtattgtagtttctttaacagaatattaacagaatactgttaaaaatggataaaaatggataactgtgtgaactgttatcaaattaattaaacaaagaatattatttggcatacatatttgaatcttgttctgaaggcagtgggtacatggtgtgttttcttacaattggaatgtcttgtgtgtgtgtgctgggttgttattctctgaaattgcattactgtgttaaatccccaaactaaagcagtgaatttttttgtaagttctgtatctttgtggccttgacaactgagccagtcctttggagaataagcaatcctggactgcattttaggacaatgagaactgccaaagtcatgagagagaaagacgaatggataggacactgaagtagaaatcagatgccctaggctttattcccacatccatttgtcattgtgtatcatggccaaatttgattaaagaactttcccaatctgtaaaacggggataatatgtctcaccttacagggatggtaaagggattactgaaatatttttttctaattcattttgtgttcttccaaaagagctctaatattcagaaccaaatactgaaatctatccaaaatctgaatggtagaaattaactattatactttcaagcattttaaaccccagtttattaagaacctaaccccttagtgaagagggacagatagtcaacagaagaataaacaaagaaaataccaaatagtaatgagcctccaaaagactaaaacattgagtgttcttttttgttaagatgccattttaacccatttatgccagaggctgcagattttttatgtgaacaatcagaccttggcgatgaccttgagcagtaggatataataactcccacaagcttagtgttccgatactggaacagtaggcataagtgggttagttgtgtgctgcatcatattggttggccagagaaggcctgtgcaaagaggggatatttgaatgatgggaaggagacaaccatgttcaaattcaggaaaggggccctctaggcaaaaagaagaacacatgcaaaggtcctaatgtgagaatgggttttgagtgtttgagtgccagataagagaccagtttggaagttagtaatttggggcaggggagggcatcagatgaagttgtagaaagaggtaggggaaaaattacccagggcctggcaggcccctggaaggagtccaaatagtccatagtttggatctctcatacttactagctgtgtgacctcagataaagttttttaacttgtgtgaatttttgttcccatttataaaatgtgtgtgattactgcttttcaagattgtttctaaggattaggataataaatttagtgagtagtacagtgaatggcacatagtacactcaagaattggatattgttgatgatgatgtttggacaggaaataaatgtccattgtgtacctaactatgtgtcaggcatagggccagacactttacatttatttatatttaaatcctcaaaacaattctataagatataatgaaactgggaaaaattgttacttgtacagttaaacagtggtcttaagtagcagactactggattcaaatcaaattttcatgactccaaaattagttatccctcactcctgtatcatatcgagggagtcaatcagttgtaatgtgttggttgcttttgtatgtaaatataatttgtgactagacgtgcttttagagatgaggccagtctttgaccttacatgaacagctcttgccaggtgggaagtttgtgaatgttcatattcctctcaatgcttaggatcatgcctcgttcctcctagaatttcttattatattccttgactaagtggatctgcataacaatattaatacttgcctgcaacatgccccaatttttaaaataacctaaggaatattcaggttttttgtttttgcaagatttcttatttttcccaaagacatatttcatatagcagtcttttcctttgagagtgttttgcccttaattgtactagttggaagtgtcagaatagtgcattaacctactgagctccagatggctgacttttttttgttattttatcttgtcttgtttaaaggaatatagaattggcagcagagcccactaactgatgtcagatttggttagcataaattgtatgtttaatatcaagtaaacatgcacttaaaaatcatatgagttgtactttttattctttgctgtacaaaatcttcactgaatatatttgataagttgaaaggctcattcattttgtgagaaagtttatgagattactgattatattacttattgaaaatatttagtatctatatcctactttgggtgtagaaaaaagaaatgaagccttttggaggtatgtgtgtgcatgtctgttgaattgttagattatactaattttttctctgagaagtaaatgacatgctagaatagtaaattgtataatgtggaccatgaaaaagtattatttctaaaataattgttttgaggaaacagaaatgtgtgtttccttatattcaaattcacaacttaggtccttagaggtaagaatgctaccagcagaaacagatggttggtaatctgtaaaagtaatgccatcatattgggtaatgccatactgctgtttctattggcataacctctaactatgacatgatatatagcacttatgggccagaacattgtttgtacttttataaaaaccctacaaagtctatacgctcaagtactagctcagtattcttatcaggttgggtttttgttttgttttgttttgttttttttagacggagtcttgctctgttgcccaggctggagtgtagtggcatgatctcggctcactgcaacctccgccacccaggttcaagcgattctcctgcctcagcctcccaagtagctgggtttacaggcgcgtgccaccatgcccaacttattttttgtatttttagtagagacagggttttaccacgttggccaggctggtctcgagctcctgacctcaagtgatctgcccgcctcggcctcccaaagtgttgagattacaagcgtgagccaccgcacctggccagattgttctttcaagttaggataggactttggggtaagcagtatttcgtgatattcactgtataccattttagaactgaaattggttcatgcagcaaagatgaattatttatcacaaaaggcttgaataacctatacatgcatcactgctatagaaaataaacacatatgtttgagtttgttaggtaaaattagtttattgaaatgaaatcccccaaaatcaactttcatatattttttgaatttatatatactaatataaacaagtcattcctcttttaaatattaaccagaggagtatcccactaagatactatttgatttcaaatatgtcagtgttaactttaaatattttaattatactgtttaactacgtggcaacatagggtacacactatagcagcatctcttatacaacttatcaaatatacatgttaaatacaaaacccataaaatttaaattaacattattttaagtaataaatcatttgctgactctaaattgccaattacaatgtgaatatactacagtgcgggcacttttgggttctctgtgcctaccgtgccgtaggataacccaactgtgccactagtgttctctgatctatggttaaattttgattggtatagcatgctgcgatgtcatttggtctttattttggtacatatgtgttttcacactaaggccatctcattagccagaggtaatgaaagttgtacttcctggtaacagtgtgaatatatggatgctgagactaattggcaggacttggttataaggtagttatctagatgatccagcttatgcctagctttatcatattaagaaatgaaacttcagaattttaacattaccttaccagactcagggatgattaaaactatgttcaaggatcccagtttgagtaccattgctgtgagctccaggtatattgatctaacaaatccccgaacatagcatgttgtattatgacccaatatttattgtaatttctaactgaaatagccttatctacctttggtgaacagtttttacagctgggcagaccttcttcccccgcatagagtcaagtcctttaaccttcaaactcccttatcaccccctatctattttgaaggcacatatcacattgacagtggtctgcatgttgttgcttaccatacctgaataagctctgctgggatggtgaggatatatcatcgcttatctctgtactctcagtgcctggaacctcatgggaactcaattcatgctgactggtaatattctaatacaaaaatgataccatatgcacagtaagagatagatgccttgtgtctctgtagtctattttgtgaagaaaccgagaatctgtataatcaatgtgtgtgcagagaatatagtgaatgtgtgtgcagagaatatagtgtccaattaaaattttatgctttaaagaagaaaagcttttgctttagtatgcatatagtggcatattccaaatcatagattcaacagggcaggacctttgggatcatctagctcagtgggtttaaaaccttattttatttaacataagagcagcttattcataaaaaatcatatgtgggatatgaataaattagaagataaatgtgtaaatgccctcatttttgggggagcagagacttgggaagtctccccaggagccttccttttttgcacattccctactcaccctccaaggcaacctggaaaacacctcaaggaattccatggacccctgtgaaaataatagtcttctcaggccggacgtggtagctcatgcctgtaatcccagcactttgggaggccgaggtgggtggatcacaaggtcaggagttcgagaccagcctggccaatatggtgaaaccccgactctactaaaaatacaaaaattagctgggcgtggtggcgcacgcctggagtcccagctgctcaggaggctgaggcaggagaatcacttgaacccaggaggcgcaggttgcagtgagccgagattccgccactgcactccatctcaaaaatactgctactactaccactactactactactactactactactactactactaatactagtctcctacctaaggtaagaatccttttccagcatctcagacctagtggcaggtctttgcttgaataatttaggtgaacagaaactaataacttcataacatgagcagtcaactaggcaattgttaacgaaagtactcactaaattaatgataaaataatgtataatggcaccaaacattagttaagtgcttattatataccagaccttatgtttgaccaggatccttatttcacccttatgacaagcctgaggagggtagatgctttattgttcccattttgccaataaggaacctcaggcccaggaagtcaagtaatcacttgactaaattcatacagctattaaggtaaggaatatttcagaaacttttgcctgcttttccctttttgttataatcctcctttggaagcaaattatgcccctttttaagatggttttgtactgtcctcagagggcgactctatagcctgggttctagccttgcttctgacagttagatatagtctcagacaagacatgacttctccgtgactcagttttcacagcagaagaaaaaatggttttagtaatattttccctgttgttagattcagatgaaatagtatgcaggaaaagttgtgaaagctgtttttgctatagaagtttaaggtatcctttatttatttattttttttcttgagacagagtctcgctctgtcacccaggctagagtgcagtggcgtgatcttggctcactgcaagctccacctccggggttcacgccattctcctgcctcagcctcccgagtagctgggactacagacgcccatcaccatgcccagctaattttttgtatttttttttttttttttttaagtagagatggggtttcaccatattggtcaggatggtctcgatctcccgacctcgtgatccgcccgcctcggcctcccaaagtgctgggattacaggcaatcccattcagtgctggaggcacacatccatttattcatgtgacaattagttacatttctttttatttttccttgttttcctatcctttggccattttactattgatgcactacctcccatcagcaggtagacaaggaactgataaaattcagtgtgttcattttgtctgatagcacttactaaaatgtttagaaggctagcgttttgaaaataatagggtaattttttgttttgtggaaggaatatttctttatttcatttacaatgtatagcttcattacctacttaaaatgcagtttatatctaggctgtaggatacatttataatctgcaaaagtattattaaacttgctttgttacactgtctaaagttactcttggaatcggatttacaaaatggtaaagcagagagggaaaccattttatttaaataccttcataatctttgccccaacacaacaaatgttggtaagtcttactgttgttcctatctttaaacagtacaatgaagagattgcctatgcgaaatacattggttatcctattgcacattatcattgatcaaatcctgcccattttttaaagtcactatttacatacatgaactttctttatttaaaatggtagtgggccgggcgcagtggctcatgcctgtaatcccagcactttgggaggccgaggcgggaggatcatgaggtcaggagatcaagaccatcctggctaacacggtgaaaccccgtctctaccaaaaatacaaaaaaaattagccaggcgtggtggcgggtgcctgtagtcccagttactcgggaggctgaggcaggagaatggtgtgaacctggtaggcggagattgcagtgagccgagatcgcgccaccgtactccagcctgggcgacagagcgagactccgtctcaaaaaaaaaaaaaaaaaaaaaaaaaggtagtgtactttttcttctgtcctaggacagtgggtggagtaaatgcagtgtaattccaaaatagaggtaacaggctactagaagggttcttactcattttgtgccatgggcccctctgaaagttggtgaatttatggggacctttttagaatcatatttttagatgtaaaacacaaaagacataggattataaaggaaaccaatcatattaaaatgtacttataaaattgtttttaaaaattatgacacattccagagacataaacacatatgttcacacaaaaacctgtgcatggatgttcatagttttattcatagtagacaaaaactggaaacagcctaaatgttctttaacgggtgagtggttaaataagctgtattatccatactatgggatactgtatggcaataaacaggtataaactattgatatacacaataacttgtgtgccttcccagggcattatggtgaatggaagaagtccatgtgccaaaaagttacatatagtatgatttcatgtaaatgacattcctttttttatgggtacatagtaggtgtatatacttaaggggtacgtgagatgttttgatacaggcatacaatgcataataatcacatcagggtaaatggtacaatctttaattgtacaataaattattgttgactatagtcaccctgttgtgctatcaaatgccagatcttacccattctgttaaactatacttttgtacccattaactatccccatttcccctccccacccacttcccagcctctggcaagtatcattctactctcttatctccatgagttcaattgttttaaatttttgctcccacaaatgagaacatgagatgtttgtctttctttgcctggcttatttcacttaacctaatgtccttcagttctatccacgttgttgcaaatgacaggatctcattcttttttatggcggaatagtacaccattgtgtatatgtgccacattttctttttcttttttttttttttttgagatggagtcttgctctgtcactcaggctggagtgcagtggtgtgatctcggctcactgcaacctccacctccctgattaaagcaattcccctgcctcagcctcccgagtatctgggattacaggtgcacgccaccacgcccggctaatttttttgtatttttagtagaggcggggtttaaccacgttggccagactggtcttgagctcctgacctcaggcaatccacctgcctcggcctcccaaagtgctgggattacaagcatgagccaccacgcctggcccctgtgccacattttctttatccatttgtctgtagatggatacttaggttgcttccaaatcttggctattgtgaatactgctgcaataaatatgggagtgcagatatctctttgatatactgattctttctttttggcatatacccagcagtgggaatgctggaccaaatggtagctcaattgttagttttttgaggaagctccatactgttttccatagtggctatactagtttacattcccaccaacagtttatgagggttcccttttctccacatcctcgccagcatttgtcattgcctttcttttggatggatacaagccattttaactggggtgagatgatacctcattgtagttttgatttgcttttctccaacaatgcatgatgttgagcaccttttcatatacctgtttgtcctttgtatgtcttcttttgagacacgtctactgagatcttttgtccatttaaaaaaatcagattattagtttttttcctgttgagttgcttgagctccttaaatattttggttattaatctcttgtcagatgtatgtatagtttgcagatatgttttcctattctgttgtctctttgttgattgtttgctttgcagaagcttttgaacttgatgtgattccatttgtaaatgatacttttgaaaaaaaatgatagaagtggagaataggttagtggttgctggggtggagggttgtgggaaggagatgggtgtggttattgaaaggccaacttgggggatccttgtggtgatggaactgttccatatcttgattgtggtgttggtatacctgaatttacacatgataaaactgcatagaaatgcgtatatatatacacacacacacacacacacacacacacacacatataaaaatatatatacacatgtatatatacacacacacatatataacacacaaataagtacaaataaaactagggaaatttgaataagatagatgggttttatcaatgtcaatatcccagttgtgatatcataatatagattaccaggatgttaccattgggggaaaagggatctctgggcattatttcttagaactgcatgcatatttccaatatctaaaaatagtttgattaaaaaattgagacacagtaattgtagttctttacaatatttgttaaataacaagataaagtggcaggttgtataactcaagtaattttgaagaagtgataagcataaatgatagttaaggtattttcacaagtgcactatgtgtggtataacaggaaaataaatgtgacttggtgaccaagttgcaggggctgctaataccactgtaatctgtttcctatattcatagttgaaagaagtactagatttaagtaagaggttactgaaaatatgttttcctttccaaattcacataccccctaaatttagaccccaggataagaacccctgactttatatctttttacatttcattatctgttatatctcaaaggcctctgtcaaataaaagagaaacataatgtgtatttgttttgcctcaaataccatggataatgatgggggctcatagaaaatactagtggacacacttcacagttttaatgatttacttgctattactcacccatatgcccattgttcaccaaaattgcttaacactagttttaaaagagaagtatatgtggattttaagtatagaataaactacacattattgatatgaaaaagaaatatgtcaaattgattgcttattatccagattgactaatattgactatcattaaatattttaatttgctttcgctaggaaatcagttaatgatggtttagccttcaattgtccgtatctctgagagtatctagatcaaatgaggctattgttttataagaaaggaaggttagtgttttgggattaatgttctactttaaaatatcacctttttgtttcctctaatgttaaaatctaaaattttttgaatatttgagtaattatttgaaattattatgaagtatttcctctatactctattggttaaatatgtctttcataacataagaagtaacaatatggacacagaattaaaaactatgtttagagtttgtgtacttgacatttctaatacaggctgagcatctctaatccaaaatcgaaaatgctccaaaatccaaaacttcttgagaaccaacatgatgccacaaatggaatattccacacctgacctcatgtgttgagtcacagataaaatgtggccaaaactttgtttcatgcacaaaattattaaaatcattgtataaaattatcttcaggctatttgtatgagttgcatatgcaacataaataaataacatgtttcaacttgagtcttgtccccaaaatatctcattatgtatttgtaaagattacaaaattggagaaaatcagaactctgaaacacttctggtcccaagcattttgaataagggatactcaatctgtaatacaagtgctcaaaaaatcatctaaatatttgttctgtgatggtctaagagtctgtaatttgggagtgaaatgcttaattgatatttagtagacagaagcttcaataagggaacaataaatgatttcatcatatacaaccttatacttttctttcattaaacattttagctaatcatattttagtaaacttatttaaatttttttgggaaaaatggcacatataatctgaagaattatgatgcttatacattgctgtagaaaagcttttatcacccctgccctataatttgcggtatattctcttgttttgcctattattttcatcctctgaaaatgccttagttagaaacagtgtttcctgcaatgggaaatgacacaatatgaagttaacctgatgacagtaattttctgtgtaggtttttttcttatagacttcaattgataatatgtagtatcttttaccctacatttttttgtgtggttaaaaaaaataaattaaaaaaagacttaaaggttagacctaaaaccataaaaccctagaagaaaacctaggcaataccattcaggacataggcatgggcaaggacttcatgtctaaaacaccaaaagcaatggcaacaaaagacaaaattgacaaatgggatctaattaaactaaagagcttctgcaccgcaaaagaaactaccatcagagtgaacaggcaacctacagaatgggagaaaatttttgcaatctgctcatctgacaaagggctaatatccagaatctacaaagaactcaaacaaatttacaagaaaaaaacaactccatcaacaagtgggcaaaggatatgaacagacacttctcaaaagaagacatttatgcagccaacagacacatgaaaaaatgctcaccatcactggccatcagagaaatgcaaatcaaaaccacaatgagataccatctcacaccagttagaatggcgatcattaaaaagtcaggaaacaacaggtgctggagaggatgtggagaaataggaacactttgacactgttggtgggactgtaaactggttcaaccactgtggaagacagtgtggtgattcctcagggatctagaactagaaataccatttgacccagccatcccattactgggtatatacccaaaggattataaatcatgctactataaagacacatgcacatgtatgtttattgtggcactattcacaatagcaaagacctggaaccaacccacatgtccaacaatcatagactggattaaggaaatgtggcacatatacacaatggaatactatgcagccataaaaaatgatgagttcatgtcctttgtagggacatggatgaagctggaagccatcattctcagcaaactatggcaagaacaaaaaaccaaacatcgcatgttctcactcataggtgggaattgaacaatgagaacacatggacacaggaagggcaacatcacacaccggggcctgttgtggggtttggggaggggggagggatagcattaggagatatatctaatataaatgatgggttaatgggtgcagcacaccaacatggcacatgtatacatatgtaacaaacctgcacgttatgtacatttaccctagaacttaaagtataataataaaaaaatttttcaatgcaaattgcatattaaattattttaagttttattataaattgattttaatatattttttatattttttgatacataaattacataactgtattactctcccagtaagagatggctttcttacataaatggagagaagccatctaaaggttctgcactatatagcattctctgttcaaaccaaatataccgctatcagaataaataaatagattcacttggatagggcacttattttgtgtttccctttcctccttgaactcaaggaactgatggtgatgaaaatggcattttgatttcttatgtttgaaagttataggagcctctccaagaacaacagtatgaacctttgtagatataatcccaaatatgttaatctatagcattatattttcagagaacatgatgatagattagaaacttatttgattaaaatagccaaagaaatggacttcattagggtttgtaaatcatggtcaataacactaacaaaattactgttttcatgaaaatattgcccatcctatttgaagatgacatccctgatactaattgctatctatgtgcatgctgtatagctgaaaagacctgtgtacaatcaatagttctgtctagtgtctgcagcaagatacctttacagctaagaaccataaagccttttcccaagttgtaagtaagtctgtttttacattaaaaaatgacagaccatgctcagactaagtccatctaaactcagaagtgattatctccactgcaaactagaagtgttctttcttagaatattgcttctctgctgttgattttaacatttcatatcagagcaaggggaatctgtgactattaaactggcccaaactaccttttgattatttgtgtactgtcttaaaataatacaagcccagtcacattgactagtatctccatcctaatgattttcaaattaaggaatggcttcaaattaggaaagctctttgttcacctaggtttggaatagcatgatgtatgctaattgctaactttgtctgcattattttttaaagatcaaatgggcacagtggtaattttcattaatctcatacagagcagctaattaaaatttccattattacccatccattatctagttgtttcctttgttcagtatcagaacaggatgttaataagccattcttgtcttacagccctattaagtattatgagaattaatgtattgcactattttgtttttaggtgattttaaaaatattttcttgcaccatattgattatactgaaggtactttgacaccttgacattttgtaatagagatttcagaattaaatacttgttgctttaacgttttattcaatattgagcaaaagtagtatatagtagagacaggagctatccaaggaccagaatatttgttttagtctcatactcttactgattatgtgaacttaggcaattacttggattcctcatttttgtaatgaggatattagaagaactgatctttaagggccagtccagccttagcttgctatcatattttcataattttcaaatatgaacttatgttaaaatctcaaagtccttctaagcttggtaaaaagcatctgttctataaagttatatattctctgtcatgctctagtagattgtttgcttccattccttataaccagagaggatcctaaattttataatttaagcttgtttctaagacttgggtggggagtgagccacaaagtgatgggctggctcacttgtccacaaggagtacctcggccataaccatatgtcccaattagactaatcctgtagggaatcaattagaaaaagggaaccaacattttctcagtagattattctgtgtccatgagatgcccaatataaaatacctctgagctgtcctcagcataccatacagtgtctcagtttacctgttctatattcagcatctctgaatatattacaactgaaagtctcagaactataatattctgaagcaaaactaagcttagaatcttcagcatgttgaaactcatcactcatctacccttttgtttattctctatccatccatccacccaaccatccatccattcattcattcaggaaatatgtattgaatgcttacttaagcactgtcttaagatctgaggatatagtggtgaacaaggcaggcaagaatcctgtcataagagcttatgttttagcgcagaagacagtaaacaactaaattacaaaaataaattttcatagaggtaatactgtaaatgatatttaaaatggtgttgcgatgataactagaatgtggggtggggagaagactatggagctgagattaaaatgatgggagccagcaatggagaggttgggataagggtcttcaaggcagagaaaactgcaaaatacaaaggtcacgcaacagggttaaattccatatacaatcctctaggggaagattagtggtgcctttttatatattaatttagaaataactttgaggattatatgaaagcggtatgtgactacagacttgaaaattttaattcgttttactagtagttttcagactggcacatgtagtaaatagatcccttgttactgatgaactttgtgttgttgtagaaagtgagttggccgagcaaaaataaaactataattttgaatttgcaaaattatgctttaaatatttacttgctattattccttgtgaaataatagatggataaggaagttacaggaatatggacatgatctctcggtgatggttttacttactgtgccatttaggtgatgatgattcatccagtatacttttttatttgtggaggagacggagtcttgctctgtggctcaggctggagtgctgtggcgggatctcagctcactgcaacctccacctcccgggttcaagctattctcgtgtcttagcctcacgagttgctgggattacaggcatgtgcctccatgccagctaatttttgtatttttagtagagatggagtttcaccacattggccaggctgatttcgaacccctgacctcaagtgttccacccgcctcagcctcccaaagtgctgggattccaggcatgagccaccgtccccggcccatccagtatatttttaacgtctactgtgtctcataacgaagcaagaaataccaagtcagtggccattatacaaaatatgggagctcaaagtatgaaatcgtattccttgttctgcagttattatggagaagttcaataataacacacttttattgaagctcactaaattcatgaccggtgttagttatgtggcatagatggagttcccaatgtagaagtgagacagacacaaataatgacctctaccacaatattttaagtgctataataattataatattgccacagcgctaagggaatagagttcccctatatgttataagcctttatcagactttaaaaatttagcatctaatgggatttttgaaattcagaaattaagaatgattaacactttctacattgaggaggcattctcaataaaaacccaaatagtgtgaaatcatagggaactcatttctcattattaacatttttttaaatgtcatatcctctaatgataatacctctacccaatggggaaaaattcctttccttatgatctccttataatattatatttcctatgatagtatatccttatgatgttattttatagtaagtatccttagatgcttagcagaaactgagtgtaatttttatgaacctgtaaaatgggactcaagcttggagtcttaattcagggatatacatttacagtataggaaaggggcaattatgattaggtacgtctagaatgtgaaactatcagttgttagtatagtgaatgtgttgacaatattttcctcccagccttttccctgaactacttatatagttatagcaagatgatgaagttaaggagctgtgatgagatgagttctagaaacaactccatctatattgaaagttaagttaaaaactagtcactatcagataaatgtatttaatgactttttaagattaatctacaacctgagagtaccagaaaggaataattgggaactggtgaatgctttcaactgatttgattaattaacatgctaattggagactatattgttttacattttaataactgttttcacttattttttttagaaaggctgatactctgatatctttcaatagatttgggttatgtataatggtatatattaaattttatttgctggattttgtggaattgaatatacatatcttaactaggaaaattaataagatgatttttgaatgcttatcctctgggttaaggaggactagctaatattaattctaatgcctgaattgtaaatttaagcacccctgtcaatgacactttatgtaattcaagttcatattctattcaggtcatgagcaccagcactgtaattttttttttaaatgaggttgaggaaaatgttgagatatatacaacacaattttactatatcaattctgtgatcaagaatttttaagtgtgtagcactctgcacacatttttatataacaaaataaatattctatgcattattttacttaaattttttttgaaacattgtctaaaatggtctctttgtttattttatagggtgggctgaaaaacagcaaacatgaatgcaccctgtcttcacaagaatatgttcatgaattacgatcgggtatatcagatgagaaacttcttaattgcctagaatccctcagggtttctttaaccagcaatccggtcaggtaagtcgttcttatcatttcggtatgattcatacaatttgtagtgcatataattgtttgggaatataataagttttgttatttaaacctcaagatttcctgactaaaaatctgatgttaataaaacagcagcatctgattgtgaagtcgtaaacttttaaaaatatatttagttagttggatctctagtaatgtacaattttaagaatacaaatgttaacatagagccagaagttaaatatccacatttacatggaaatctatttgtgggatcagataattattatatatttatttataaagcaaattaagtatatttgctccatgattttattcttttttttttttgtgagacagagtcttgctctgttgcccaggctggagtgcagtggcacgatcttggctcactgcaacctctgcctcccaggttcaagcaattcttctacctcagcctcctgagtagctgggactacaggcacgcaccatcatgcctggctgatgtttgtatttttagtagggaaggggtttcaccatattggccaggctggtctcgaactcttgatctcgtgatccacctgccttggtcttctaaagtgctgggattacaggtgtgagccaccgcgcccggccgattttattcttttaaaacttgaaaggtatatataactttatgttcttctataagttttagatatactcttcacatatttctgtaattttgagatagcaaaaagtgaattattttaaccagtaaaagaagtgagagcattaataaacttctcaaaactctactaatttaggctattaactaactacaaaggattgttattaggttacttgccaatggtggattccagtaactgtggttcctttattaagcctttaaatcaataacacccaaaataaaatgttttataaagaaaaataaaatttcaataaaatatcaaaacattcttggccgggcgtgggggctcacacctataatccctgcacttcagggggctgaggcaagtggatcgcttgagtccaggagttcgagaccagcctggccaacatggtgaaaccccgtctctaccaaaaatacaaaaaagtcagccaggtgtggtgatgtgcgcctgtggtcccaggtattcacgaggctgaggtgggaggatcacctcagcccgggaggtggaggttgcagtgagcccatatcccgccactgcactccaacctgggagacagagcgagaccctgtctccaaaaaaaaaaaaaaaaaaaaaaaacaaaaaaacaaaaatccgggatctatttatgtaactactagaatcttaagttcagaatttactccataagagtatataaaaaacttactgtgattttatccatgtttttcctaatatataataggtctaagtcttgtacttttctgtcctgtccacagagccttgaaaataatttagagctcagtcattcagtttggatttatgtataaattgaaatatattaattacttatttatagtgcacttggcaaaatgcccagaaaattacaattttaaaacaacaaaaaattttttaaaagccagtgttaagatgtgacttatcttagagtatgataatcgttgaaagacgattgtcttgccatttcttccaaaatgctcctaggttttttgttttttgttttttgtttttttttttgagacggagttttgttcttgtcaccgaggctggagtgcagtggtgctgtctcggttcactgcaacctctgcctcctgggttcaagcgattctcctgcctcagcctcccgagtagctgggattacaagcctgcaccaccacgcctggctaattttagtatttttagtagagacgggatttcaccacgttggcaggctagtctcgaactcctgacctcaagtaatcaacctgcctcagcctcccaaagttctgggattacaggcgtgagccactgcgcccggcctgatgctcctagttttaatggtttgaatgaacaggggacgtgagttcttgagaacagtaactacggtggtgcatttttcccccctgcacgtaacgtacagcactctaccgttttgccaagcactttgtgctcctaaaatttctgttgcattgttgtttgaatgaatgaataaatgagtcttttaaaagtaattgtagaagttgcagcattaagaaataaagaggggggctagtaaaaatgcatttttatagagatgttgggaaaggcttgcttgaaattacacgtgggacttttaatagataggcgctttgaccagctaagcaacagggctcccctcgtgtgggacttttagaatgtagcaaccactgacacacagggaaggattatgcgatcaggtgagaaggtggccgaccctgactggctggaagcagatgcattctggtagttgattggtccacaggtagcgtgacgcttgtcacgtcctcagcctcccagcattcaatcgtagcctttcggacagctcgaagccttctgtggagagctcgaagccttctgtggagaactcaaagccgtccgtggagccccagacgagccaaagcccaccttctcctcagcctgagctgtcttgaagatgagtaagagtgggtttgggagctatggcagcatttctgctgctgatggagcgagtggaggcagtgaccaactgtgtgagagagatgcaactcctgctattaagacccaaagacctaaggtccgaattcaggacgttgtaccgtgtaatgtgaaccagcttctcagctctactgtgtttgaccctgtgttcaaggttaggggaattatagtttcccaggtctccatcgtgggggtaatcagaggggcagagaaggcttcaaatcacatttgttacaaaattgatgatatgaccgcgaaaccaatcgaggcccgacagtggtttggtagagagaaagtcaagcaggtgactccattgtcagtcggagtatatgtcaaagtgtttggtatcctcaaatgtcccacgggaacaaagagccttgaggtattgaaaattcatgtcctagaggacatgaacgagttcaccgtgcatattctggaaacggtcaatgcacacatgatgctggataaagcccgtcgtgataccactgtagaaagtgtgcctgtgtctccatcagaagtgaatgatgctggggataacgatgagagtcaccgcaatttcatccaggacgaagtgctgcgtttgattcatgagtgtcctcatcaggaagggaagagcatccatgagctccgggctcagctctgcgaccttagcgtcaaggccatcaaggaagcgattgattatctgaccgttgagggccacatctatcccactgtggatcgggagcattttaagtctgctgattgaggcagggaaaacatcctttcatttttcgaagacccttgcatccagctgtgagtaattttgacctgttgactttttaggaagtaggactaaaaaaaaaaatctcaagtggcattctttgtcaactcgctgcttttctaactgctttgaacttttcggattttctgtatttgaagctcagagagagacggtgatggataaattgacaactctgtaggatttactagcaagctaatggaaacatgattttcggggaagaaaaactacagaaaatgtagaaatttattatttaattgtgttggagcttctttttccaaaagaaaaactagttgcagtcagggagccagcgaaaagacaaaaaaaaaaaaaaaaaaaaaaaaagtcttgcttgtttttatgttagacttattttccgtgtttggatttagcttattataatgatactgttatctcttgctcaatatagtatttagtatttgattaattcaaatgagctgaagatactaatttgtgaattctaatgctcagttcaaacatttatgtgtgatttgctcttattactatgaatttatgttttcttaaaataagattatactgtgtttaaataaaccatttttgccaggttatctttgaaattttttaaaatgtggtgaagttcaatgattatttcatatatgatgtggtatttggatgaaattacaatttattgtagttgtatggtaaatggatgccagagtttctgtaagtttgatgtgctggtgtattatttattttactaaatgctctgttttatgtataaaaaggtaatttttaggacgttagggaaacagctcataggaatatgaaacttactgagtttaacacaaatttattcaaatgttttattaaagtagtttacaaaatcttaactttcctgtgtgatttttttttctaagtacatttgaaaaagcctttttgttttatatccttgaggattaatagtttcacttatccagaattttttcttttctatatataaaatacccagaacatatgctatagcctagttctaacaatacattttagtgtagattatataaattatgtgagacttttaaataattgaccattaacgaaagccctcagttacctatacactaaagatggtgtctttcaagatgctaatttttttacattagaggaaataaaaaacatatactttttaatgaatatatgttatattttatatatgtatattcatatataatatacaaatagaagaacattatttgtcaaattgaatcatgaaaactgcaacaaaaaaaaaatctcttaaatggaacattgccagtactccgtactttcaggaaaactttcagaaaatggcctgtgtcagtggccattagaaaaaccactaattcttgcctaagctttgtgatgcatatttttcttccccttgaaagtaaagaaattgtaaatggcactcttgaaaagcacagatgaataacatactataaacctgttacttaaattatcagacattttgaaaattctggtcttcataaacctaaaatattcggaaccactttttgttgaaaaaggttacctgtcctagggaaaatcatactgggggagaggcaacaaggggcatatatacttggaattgtggagctgaaagagtctagcagatacaatattcttttgtgacattaaaatctgatatttatgagtataattataggtcactcccataattgcttgagctgattcagctggccagtggatgcgtagccacttgtttttcctatactaggagcatgcggagggggaaaaaaactcttttttttttgtttgggaggccaaactgcttttgtccctgcaaactgatacactgagatatgtacacctgaatttaaggcagaagaccaacctctctcccatcctgtgaggggaaatgtcctctatctgtgttcgttggggtttttttaggcttttaaaattactcctcccaacgcttattcttctgaatggaatcgtgtgctttagtggattctgctgcaggtaagagatagcagtggaaaaatagtaagtaggtctagatataatgtcagtggaaataaaacacttttaggcagaaaatcactggattgttttatacatgtatatttagtccatgttaaaggtagcagatttttaaagttcattttgaacacccacctggcatgcatactttttcaattttgtttagactgggaatgacttggctaatatcccctttctccaaggtcctgccctgatagttagccacaccttttgaggataagatacaaatcctggggacatactattgactattttgggcagggacatttaagcctgaggaacctgaaaaacataattgatgattataatccacccaaggttttttcctatggctcacaggcttacgaaatgtatgtatttatattgaggttgattctaaattaactatgaataaatatatttgaaagtgttttcaaggccaatataataatcttactatggtcataattattagtgatcattttgttacttttacctactaaatttagtaatatttggagtagaagctgaaaaacataagttcttatattttttcaatttctgtttactttttataacagcaatttaaaaaatgtaactagcaagaattatgtttgttcctgaaacctttattgagttcctactatatgcatttaagtgttaactttaattttgataagcttaaattttattgacttctgaaatgcttattaaagatagtaatagttaacattttaacatttatttagtatttattatctcccaagtactgttctaagagtaggagttgtgtgtatgtgttgtgcgtgtgtgtatgtgtgtgtgtgtatgtgtgtgtgtgtatgtgtatgtatgatccctgtgatgcgtagatttacgttttcagctcagacctctctgtttctctctctctttttttttttgagacagagtcttgctcttgtggcccaggctggagtgcaatgtcacaatctcggctcactgcaacctctgcctcccaggttcaagtgattctcctgcctcagcctcctgactagctgggattacaggtgcccgccaccatgcctggctaatttttatatttttagtaaagacggggtttcgccatgttggccaggctggtctcaaactcctgacctcgtgatccgcctgcctcggcctcccagagtgctgggattacaagtgtgagccacccacctggccagacctctcttttgaaattgagactccatctccaaatgtcttattggatgacatataggcatttttaatacattaaaaaataatgaaaaattatgtgtgatatgtgttttttatatatatatataacacagatatatatctctatatatgtacacacagatacatatatctatatatatacatacagatatatatatctatatatatacacagatatatatatctatatatatacagatatatatatctatatatatctatatatatacacagatatatatatctatatatatattaccatgtatatacagatatatatatatctgtgtatatattagtatgtatatggcatttactacccctgtgcaatgttttaagacctttaaatgtacatatacaatcaggataacagtattgttcgtattttgtagatgaacttgaggctcagagaggttaagtaatttgcgccatattaaagttgcatgcccagcaagtgtcagtgttaagatttaaacccaggctttgtatctctcgagagcctaggcctttaacaactggtttgtacagtgtcacaataaggaaagtctattaaaatagtattctttcactgttgttagtattctttcactgtcatcacatactgaatattttgactttctttcattaatatttgtctgatttaaatgaaaaagaaactatgaaaactttcagcaaatgtgtagaagataatataaaaacacctttgtactcatctatcagcttaagagacaaaacattattttttgctgtggtagagaacttagttgaataacttgggagtttttttatgatatcgtaataccatttgggcctatattttcattgatttaaaagatcgtctgaaattctacattttctctaaatctatgcatgtagtttttgcaatataatatcttaagaatatatatcagtgtattgaaaagcctatttttttttctgatcacatagctgtgtgtaaattgggacttctttgccctatccattgtggatgatacttctagtaattctaacaccatctctatgatatttattccaatttgccatcatgtgataaattacgaaaacaattttttaacattaagagttaatttcctttggtaataccttaaattggagaagttcaataaatagcacttaatattatgtggtttgtttttacatatcacatggataatcctacaaaggaataacaaaactaaattccccttgtccatatggggcttatatatatggagcttacattccagtacaggaattcagacaatttttttaaaggtgtacatcaaatatcaggttgtaatatgagctgaggaggagatgttgctattttatattagatgatcagtgaaagcctccctgactttaatgacatttgcacagaggtctaaaggaagtatggcagtgacctatgttcactggaggagtaatgttgttagaaacggaaaacagcaacagcaaataccaaagatgggagcatgcttggcatgttctaggaatgtcaaggaggctagcatgctggaagcagataatgtagagccttattgaccattcaaaggactttggcttttactttgagtgagctgggacactgttagagagttttgaggaatggaatggcatgagatgacctacatttttaaaggatagccctgggtggaagcagggagaacatgttgtacattactcaggcagaaggtgccactggccacagaggtttctagctggtgaagtgacaccccaggatcctgtgacaatatgataaatcattctagttcttgatcactcctctgtggtgaccttggtccagtcaatggacctctttggtcctcagtttcttgatatgtaaatgggattggagccttccagctctaagcctctgtgttctgtattttcttttgcttagttttaatcctcttacctttgctattggaactagattagtgtttaggtattattttgaagagtgagaagaatgttcctctataaggctagaggatttcctaatgtttcattattttttgtatttataaatgtatttaaccacccccagacagatatttataatttcctttaaatacggatgaaagcagttcctaaaactctgttgcataactgtttttgaaacctggtgttcattagaacccacaccgttgtcctctcgtgggtaattctcctccctaccacagttttaattggtttctttttgttcagcccctcgtaaaatttaaaaatatatataaataagtgtacacacacacacatacgtatacatactaacagttttaccaaacatcctcaaaacagtcattttggaatattaagtggggtcatgaatttcaaattcacatggtatttaatcactcaggtgataaaggctctaagaaagtcattttggtatattattttctgctaaagcaaatacttaaaaatcccttttataagccctcattaactggtcctatctcagatcactctgttactgtacatttccctcaacatttattttttactatatacatttacctgtgtctgtttatactctgtaatagtttcatgcatgcatgtctgtttttctcatttagattttagtctcctctggggaagggaccctcttaccctcttatttgtctcgtggtggctggtactgtgtaatttatatatactaatgtgtgatttgatgtagttattgacccaccatcaataaaaacctatgcttctccaccagtgggaatgaatttgcattaatcggcactattttgtggccatgcatttttagctgtaatcagaaaaagaatgaagctaacttcttccacataagaatgaaaccttggtttgaatcatattcacaatccacagacaacatagcatgctttacacaatagccttgttacagttgcatggtgaattaatgaaattgaatgtttacaactctatttaacactctaaaaatccatgtgctttgaccgtaaagtaaatcccaatctgccatcacaaattgcattagactttgcacataccatggtctatgtgtgatttagaatgaggactctgttatttagagatttttgttcatatctctttactaaagtttatgaaaggaagcagtgcctgctgagaaatgaccaatgagtttggacagttttattcccagccaattcattgcaagatgtataggtatttggcaatacattttatgaagatccaaagaaatacgtagcaatagatcattgtcactaaggtttcccagcacatgacaaaaacagcaaatattgctttgaagaatagtatcacagaattgtgattgcctagaattcttgttagagttgttgctgaaattgcctcacagctttaggggtattttaccccacgaggaaattgttttttctgtttggttgggatccacttatctgccaaactcatggcatagtgtctgtattcacatcctatgatgatagcttcctcagccaatatttccaagccagtgaaaacataaaatatcttttcaagttgatacatgtgcagttatttgcattacctctggaatatttgtgtttatttgatgctatcttccctttagatttaaacatatttttctagtgtatttacaaatgtgcattttaacataatcataatgaaaatagatggatcttgacaacaatacaaattaggactagaaagcactttctgaattgtaggtcttaataagtatttaaacaacctgtattaaacttattaaaagcttggcaaagcggccaacagtacttagaaagttaatataaaggtaggtacagatcaatactcttagaacattttgcaggggactaactatgaaagatggaataataaggatactttttacaatgtagaaatgtgaacacggcttaaaattgtgagcacatctcataaagcagcattatgtgcggtattactaaagcaggtttttaaatattggtatttggaacttctttgctttcactttcaaatccataaatcattttagaatagcactagtatatttatacatacaatacgaaatggtaaactcattgcagttgtcaatttatatgccttttgttaaaatcttggtcaacaattcaaattcgtatcaagtatattcaggctcatttgactaagttgataccatatatattaagtgacatggaaattttaattatatactattagcttcaaaacataattctgacttcggcacatgcaatgatattacctcttaatagaagcaaagtagatttatgtgtcatacattattttaaaaaagaattaggcacagcaaatactcgagtttttgaagtattattaggagaaaatgctacaggcattaggataaatagtggttcttgtgttggatttattttattactatgtaagctccaccaaggcaatacattttctcgtttaaatgatgtgttttaaactagaaagccaatttttatataataatcatctaaaataattagaaacatgtaactggtcatataaaggtatgtataatctagcagcagaatctaggcacactgattatatggatttctgagtagaagcctaacttccctcttaaaacacttatatgcattttctacttattcaaaattagtcttgggaagaaaatgcttataaatatgtcatttgaaatatatttatttcgagttatatgaactaatttaactaaaggtcttgggcacatactagagttttaatacttctctcattattttgagaatattgtaaaagtagttgcagcttaaaataaaagaagcagatattctacttccgtaagacaaaggtaaaaatgccaagctccaattaaatgaggaaaggaggtggaacttttccaaaaacttaggacaatgtcaggtaatgatttgagtataatgtagatccaagtttctttgtgtggagtggagaggggtcggggggtgtttatcaggtaaacagttctgtctctcagtaaaagtctctcaataaaaagagagacatagctgttacctgataaacgacattgcatctcttttgtgttgttgtttgtttgtttttcaggagggtcattcttcctaattctgaactcattttattttgtggttctttaaatgagggatattggacaacaacagtagaatgagtccttgatagttttccataaagtacagaagatttctatgaatgtccatttcctgcatttagccaaaaagtaaaaaaatcaaggttatgatatttctacaatgaccaggaataatagtactggaatgcagctttctagtaatctaacctgctaccaaggtgtacttgagaaatgcccctgaggctctccccttggactgtctatcatctcagctggacttttgatagaagttggatagctgacaactcacaattaagatgccagctggcacctggagtgcaagtagtctgtatagttgattgaaagaagatccatgtgcactagataacagtatttgctctatgaccccagctgttcgactggtggtagataatggacagctaatttggggagatttgccacctggtcagcaaagctgtaagtgtatagcctctcacaccaggcagtttaaacctggaatcttctgttaagatggaatccatgaaggcagaatatagaagataacataatgttatagtacttctaaaaactaaaacatcttcaaatgagacagttttggtgacctcttatatgaatatgaatttcaagcctttcatatacccgaaatcaacctactcctgttaggtcagttctgcagcatccagtgttattgaacatatgcagattgactctatttctattttggaggatattgcctgagtactgagtactgctacagtttttttttttttcttttatgtggtaccatacttcccttgataccagcttccaaaagaatttcctggagatcatatcttaaattggtacgttcaacatttattcatcaaaaactattgaagattggagtgctgtagttaaacacatttttaaaaattgagttataaatttccatatgtgaattaatatctgtcaaagaatatcttgaagtggatacagcactaaaactatattaagtattaatgaatttttcttcgatatagagaatgcttaagaattttatagtgcctttgaggttcgcattatgagcatttattaagatggtataatactttaagtgtaagtggtgtgggacatcaagctgggggtattctctgaccttgtgatatgctttggatcttcaaaaacttttctgtcagtttatgtgcttgatgagcaatgatgttgctttctcctgggaaggagatgggttattatgtgggtttatcattaattttggtttctgttaccatttttgtattgtttgcaaattataatgatttatctgttgaaatcatgtgtcttaatttgctgatgaccatagtttgattcaagtattcaccttattgcatttcacaatgtgcttagaaagttggaatgataaaagttaagaataaatcgctatagaggagttcatttggggagcaggaaaaaatcgcatatacagattagtttttcttaatttttttttttttttttttttttttttttagtttatttgtttgttttgagatggagtctggctctgttgcccaggctggagtgtagtggcgcaatctcggctcactgcaacctctgcctcctgggttcaagcgattctcctgcctcagccttccaagtagatgggattactggcgtgcgccaccacacctggctaattttttctatttttcgtagagatggggtttccccgtgttggccaggctgttctcaaactcccaacctcaggtaatccacctgcctcggcctcccaaaatacggggactacaagcgtgagccactatgcctggtccagactggtttttaaaatacgtgactggaaagttctgaatcatattgatataaaggatattagataaatgtgaattatcaaatagcactgtggagattacaagcattatgctggacacatactgcagaggtctatataagcatgatattgggcttattaatctgtgaactcacagctgatttggaatcacataataatgttccactatttaaaataataatccttagtatattctttgtcttagaaaactcatccatgcattcaggatcttggctctgatccttgtgtgtatgatttagcatctttgatattcctcgtatgtcacatttgctcattttttcacttgtgatatctaaatggcttttacatttccattggcaataatctagctcaggcctcactccatttggagacaaaaattgatagaggaagtgattggtctggcaaaacatagttactgggtttattgaaaattcagtataaccaaagtgaataaggtaaagtgcaaaaggataatgaagtcaaggaagttagtaggaagcaaccccaaaatggctgaccaatgtctttcatgttgagtatggaagcaaggaagggttaccaaggactgttattcccaaatgaaaggcgagtggctttattttttcaaactgattcctaatatttgtgaagtattttgtgtcagaccaaataccaactaatagttactacattttttgaagtgggtatttacaggtatatatcattgacatgtctacagccaatagtcataaattgtaatatgatagggctcagtattttatctattggtacatggaaaacagaaagaaagtatattttttggacatctctgatgtttttattatctaaagtatcctgtgccttgatgatgcaacccaaaattaataattaaaaagatgaaaaccacctcattggtattgtttttacttctacatataaccattggtgatatttttaatatattaacttttatccaatatttgttcatgaaaggaaaataaaatcttgtaacctctaattaatgatttttatgttgttgataatatagtttaatgagagtatataagaattgagaagtgctggattctattgttttactattaggaagctctgtattctaagataagtcactaaccttctttagtttcttcatctacaaaatggagtaacttattttatttcacaaccagaaaagctactcttattggtgtgagttctttcatggaggtttgtttgtaaatgaagaaaaatccatgtttttaattaaaattatttgtttgttttggcttttaactgttccaattaaaaagagagtctttgttattttgaataaggccaaagttatttcagcaattaagacgtgctttctttacaaagcatttatatgtttgaaaagctttagcaaggataaatgcatatcttttaggtgtagctatatttctagagttttctgaaaataggtacaagtcaggttgacaataacagaaggctgatatctcttagggactttatactgcatttagtcctacaaatgctttgtttgtatgtcatgtatatatttgttatttttgtgttgttattgctttagatggtttatttcactataatataagaaaaataatagcagatttggcttattttgtcttggataaaagccttaacaagttgtttagtgggggattattaaggattttgaatattcgttgtatttatgttggtcaaaggatacaaaatttcatttaaacagaaggtgtaagttcaagagattcatcgtacatcatggcgactgtagttaataccaatatattgtatacttgaaaattgctaagagaagaaatttttaaaagattatttttaaaatttcaatagttttgggggtacaggtggcttttggttacatggatgagttctatagtgttgaattctgagattttagtgcagacatcacccaagcagtgtacattcattgtacccaatatgtagtcttttatctctcacccacctcccaacatccgcccacttactttgagtaatgatggtattttgatggaagttgcaatgaatttatagatagcttttttttttcaaacaggtcttagtttattccaagttttacaaagtcaaagttgcataagtcttacaaagtcaaagttgcataagtcttacaaaattaaagttgcaaagtgaatagtgaagcaaatcaagaagatttttttagatcatataagaaaaggtagtaatcaaaaagtaaaacccagttgctgaatttaggttagttaatataaggcatgattatgtaaaactgactgtaaaattgagatccagtttttaaaaatccaagttatttgtaggcaaatgttaaacaattaaaaaaaattttttttcaatttttttaaattttattttattattattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgatggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccgcaatggttgaaccagtttacagtcccaccaacagtgtaaaagtgttcctatttctccacatcctctccagcacctgttgtttcctgactttttaatgattgccattctaactggtgtgagatggtatctcattgtggttttgattttcgtttctctgatggccagtgatggtgagcatttattcatgtgtcttttggctgcataaatgtcttcttttgagaagtgtctgttcatgtccttcgcccactttttgatggggttgtttgttttttttcttgtaaatttgtttgagttcattgtagattctggatattagccctttgtcagacgagtaggttgcgaaaattttctcccattttgtaggttgcctgttcactctgatggtagttcttttgctgtgcagaagctctttagtttaattagatcccatttgtcaattttgtcttttgttgccattgcttttggtgttttagacacgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctaaccagttttcccagcaccatttattaaatagggaatcctttccccattgcttgtttttctcaggtttgtcaaagatcagatagttgtagatatgcggcattatttccgagggctctgttctgttccgttgatctatatctctgttttggtaccagtaccatgctcttttggttactgtaggcttgtagtatagtttgaagtcaggtagcgtgatgcctccagctttgttcttttggcttaggattgacttggcgatgtgggctcttttttggttccatatgaactttaaagtagttttttccaatcctgtgaagaaagtcattggtagcttgatggggatggcattgaatctgtaaattaccttgggcagtatggccattttcacgatactgattcttcctacccatgagcatggaatgttcttccatttgtttgtatcctcttttatttcattgagcagtggtttgtagttctccttgaagaggtccttcacatcccttgtaagttggattcctaggtattttcttctctttgaggcaattgtgaatgggagttcactcatgatttggctctctgttcgtctgtttttggtgtataagaatgcttgtgatttttgtacattgattttgtatcctgagactttgctgaagttgcttatcagcttaaggagattttgggctgagacaatggggttttctagatgtacaatcatgtcgtctgcaaacagggacaatttgatttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattgttttgagataagtcccatcagtacctaatttattgagagtttttagcatgaagtgttgttgaattttgtcaaaggccttttctgcatctattgagataatcgtggtttttgtctttggttctgtttatatgctcgattacatttattgacttgcgtatattgaaccagcctgtttggcagcatggtcattttcacaatattggttctacccttccatgagcatgggatgtggttccatgtgtttgtgttatctgtgatttctttcagcagtgtttcgtagttttccttatagagatattttgcctccttggttaagtatattcctgagtgcttttttgtttgtttatttgttttcgttttgcagctgttgtaaagagggtcgagttcttcatttgactgtctgcttggtgccactgatttgtgtacattgattttgtaacctgagactttactgaattcatttatcagatctaggagccttttggatgagtctttagggttttcttggtatgcaatcatatcatcagcaaacagtaacagtttgatttcctcttttccaatttggatgctctttatttctttctcttgcctgattgctctggctggggcttccagtactatgttaaatagaaatggtgaaagtaggcatccttgtcttgttgctttcaacttttacccattcagtatgatgttggctttgggttggtcatatatggcttttattactttgagggaagtcccttctgtgcctcggttcttgaggatttttatcataaagggatggtggattttatcaaatgctctttctgcatctattgagatgatgatatggtttttgtttttaattctgtttatgtgatttatcacatctattgacttgcttatgctaaactattcttgctaaactattcatccctgggatgaaacccacttgattccgatatattatgtttttgatatgctgttggattcagttagctagtattttgttggggatttttgcatcaatgttcaccagggatattggtctgcagttttcttttttgttacgtcctttcctagttttggtattacggtgatactggcttcatagaaggattcagagaggattccctctttctcttttggaatagtttcagaaggattggtaaaaaatttttctttgaatgtctggtagaattcagttgtgagtccatctggtcctggagtttttcttgttgacaatttttttttattactgattctatttccttgcttgttactggtctgttcagagtttgtgtttattcctgatttaatctaggagggctgtatgtttccaggaatttatccatttcctctagattttctagttttcgtgtgtaaaggtcttcatagtagtcttgaatgatcttttgtatttctgtggtatcagttataatgtctccagtttcatttctaattgaggttatttgcatcttctctcttctttctttaattaatctcgctaatagtctatcaattttatcttttcaaagaaccagctttttgtttttttaatcttttgtatttttttttgttgtttgaatttcatttagttctgctctgatctttgctatttcttttcttcttctagctttttggattttgtttgttcttttctttctgtttttttttttttttttttttttttttgagacaagggcacccaggctggagtacagtggttcaatctcggctcagtgctgcaacctccacctcccaggttcaagcgattctagtgcctcagcctcccaagtagctgggactacaggcatgcaccaccatgcccaactaatttttgtatttttagtagagacagggtttcaccatgttggccaggctggtctcgaactcctggcctcaagtgatctgcccgccttggcctccgaaagttctgggattacaggtgtgagctactgcgcccggcctttgtttgttcttgtttctctagttacttgaggtgtgacattaggttgtcaatttgtgctctttcagactttttgatatagacatttagcactgtaaactttcctcttagcactgcttttgccatataacagaggttttgataacgtgtgtcactagtaccattcttttcaaataagttttaaatttccatcttagtttcattgttaacccaaaaatcattcaaaaccagactaatttccatgtatttgcatagctttgagggttccttttgcagttgatttccagttttattccattgtgttctgagaagatgcttgatctgattttgagtttcttaaatttattgaaacttgttttgtggtctatcagatggtctgtcttggagaatattccatgtgctgatgcgaagaatgtatattatgcagttgttgggaagaatgttctgtagatttctgttaagtacatttgttctaggatacagtttatgtctattgtttctttgttgactttctgtcttgatggtctgtctcgtgctgtcagtggaatattgaactctcccactcactatgttgctgtctatttcatttcttaggtctagtagtaattgttttataaatctgggagctccagtgttaggtgcatataaatgcaggattgtagtatcttcttgttggtcctgagagaggagatttttaagtgttctcataacaaataaaatcaagtatgtgaggtaattcctgcgttaattactttgatttacccatttcacagtgtatgcatgtgtcaaaacatcatgttgtacagtataaatatataccgtttttatttgtcaataaaaataaatataaatttaaaaaaacacatatttaaccatggttaagaatgtatgtatgtgcacactgaagaacatataatctccacggtatctttctcagcattaggaggaatggattttaaaatattatataaaaacaagaaaagactaaagcagtacctgttacagataacattctgaggaaaaagaacatttggacttgctaaaatgtttttgacatctacattgaggacccaagaaaatgattttctttttaggtttggtttcagttatcttgtgctaaaaatgtctgtgaacattaaatttctttgatctttgtctacgtagctatcacactctgtaataagtctttaattatatgtttttggcactgcacctggtaggtgagaaggactgttgcatttctgttgttcactcatcaaatagcaattacccttcaactctccttacccctgttactgtgaaaaaaaaaaaaaattcaccaatttctctgctgcccactagaatcagatagtataacatacaaactggtttaggagaaaagaatatgtacaggtggtatatgctaatgcctctatgtttcttcattgcattcaaataacttcttactttattcatgacataaacttggtatgagctctgtttcatttgcagggcttatggattgggaatgtgattttttggaatacgtttactttaacaaaattccacaaaactaaatgaaattggacatcctgtggtgtgcatgatagaattttaactatattacttatcttaggaaaataaaccaatacatttttcttgtggaagttaacattttattataagtttgactggttatgttactaagaaggcatctttaataagtgtcctaacataattatatctactatttcaaacatctgaagaagatagaaaatgtgagtagcttttacttgaatatttggaatactctttcccttcgcttcccttattgaccgtagattgaagagtctattttcattgtcattcaaattttttggtaattttttcctcatcattactttggaacaagaccttctcttatacttttctaccaataatgtttaaaggaaggtggggaggaaaatattcttgattgttagcctgttaggcattcagatagatttgggcataagccatttcttagactatctccaaagtaacttagacagcttatgaaattgattttaataaataaggaacttttatccttttagagagtgtttacttatactgttgccctcaagagatttttatatgtaactagagcatttaaaattattttgtaaatatgtaagaggaatttgtctttatgcaatataaacagctagaaagaatgcacatttcctactttgtaaggaactcctaaaaatggatgagaggcatgaaacatagtaggatttttgcagtaagactgatagaataaacgcagccagagagaaagatggaatgtcttctttggtgtttctaaggcaattgtaatctatcacaacattgaagtcaaaaccactcagaggtagaactggtaaactgatgcattcaaactttctatgagtcacatgaaataaatgatcagtgactgtcaggcttcgaaggtttatgcacaaatgtctgaaaatggtagtgttacgtcaaatagatattttataattggtcagagatatctcatggattaatctactatgatgaatagtttccaaggacattcaaatgcccaaagctattgtgtttgctttcatgtagagaaacctgagtggacgtatatgtttttatggatctaagaccaagtcagttgtagtgtacacaaatccacgtatatattatacatgtttatatattttttagtgggtatatatattgacagtgaaactgtttatgatgtttatttagccgaacaaattttccttttaagatgcggaaaatactaaggtttacttggttactgtttatgcagatttgatccatggactgaatatgtgatactgtttatgttgggctacatactggttttaatcacatggaactctttctttccttaagtgtatgcaactaaaatttggttttagttgcattaaaaaacattacagtagcaatattggtgtttaagtgagatgttttcctattttaaaaaaaacaaaccaaaacccaccactcaagataacatttaaagtctcctcaaccttttgaattagttgtttcacatgttataattttaccaaatttctgaattcccccaagaaaccctgaactatcattcattttatttgatgttccagtgattcaggttgtagtttgagattacacatgggaatagaacaccattagagggaaataaaatcctttgtacagaacacataaccctctatactagcctttagcactgcacaaacagtgataaagggatgacatgactaatattggactccttcacatgagaccaattgcctttacagcttatgggattcagtatagaagtttctaattttagctttaactcttttgaaagagatgttaatttggataatctaatcattgatggacatgcagtcactattttctattatatcttcattgtatatagcatactgaactcatctgttcattacatctttggttttacattatatttaagtgaaatgtaactaaataattcagagtctgaatctcaaatttatgggagaaaggttgaggttttgggaaactgtgaaatgttgtcctttataagaatctatgagggagcacagtcttattccctccttcaataggtacatttatagaaaattttcctcgttttgctttgccctgaagagctagagaggggagaatcttgctttctcttagatttagggttaattgaatcttctgataccttcattaaatgtaagattttctttcctttgatcatgctgatcagtataagtgggtcctttaaaaataatgaccttagaagttctaaaggcttgagataggtttctgttttaaaacttcaatatatttttgatataattctgtcaggattatacatgaactaaaaattctctccccctcaccattataatttccatatctattctgatgtgaattggccagcactaaatacaattagaattaagtatacacaaaattggatagtgaccagttaaaacacatgaggttggctgggcgcggtggctcacgcctgtaatcccagcgctttgggaggccgaagcaggcggatcatgaggtcaggagatcgagaccatcctggctaacacgatgaaaccccatctccactaaaaatacaaaaaattagccgggtgtggcggcaggcgcctgtagtcccagctactcgggaggctgaggcaggagaatggggtgaacccgggaggcggagcttgcagtcagccgagatggtgccactgcactccagcctgggaggcagcgagactccgtctcaaaaaacaaaaaaaagaggtaatatgagtaccaaatatttaaattataaagtctggcctcaaactcttgggctcaaatgatgcccctgtttcagcctcccgaatagctgagatgacaggcatgacactgtgccccagtcttatttttaaacaagtcaatagagtaagtttagtataattttagtcatctgcatgttttgtaaaaattaatataattttcattaagtgattaaaagttgtgttaatactgtggaaaaggattctttaatttatgcctaaaattcatactgcattttggactagaagattcaaacaacattcagatttttggtttttaacattttccaaaaatttcttaatggctttattgtgatgttttatatacattatttcatttaatagtcacaaagacttcatggggtataggtagtattctcatccctattttgaaaatgcaaaaacaagcttagaaaatttacgtatattatcaaaagtaacacaactagaatatgtagagatgagattagaacctagatctgttttcctctaaagcttatgcatttagccatgcagctatgtggccccacagcataatccaatgatggatgatggaatattttctttatttttgggtgaacttggaaaaaagtctttaatttttagctttttgagcagcgtaacagatattagcctccctgatagatacagccaaaccttttttacatagggttggaagatgctgtctcactgtgattcagacctcttgttcccaatataagcttcctggcttcctttttagtctccagatataatcttggctgctggttcactcaaacattaatcttcctgactggtctattgtttttgtttgggtggttcatttgttccacttggtctcctgacatgtgaccacaaatgtcaacttggatgtgtagcatgttaagacagttctttaacttaggtaacttataacacaaaatcaccaatatgttaataccttaaaaagtgagatcgtggacttacatagcccatccaaaaagaaatagtataagctacattttggccctattctttctgataaactaccttacctaaatgttgactgaaaattttagctgaagtctccagttatctgtccttaacagtattttgtagatttcttatgatgctcaggactttacttatcctatctaaataaatgaactaagctgttaaataatgaaacgtatgtttgtctgtctaggcatagatatgtagatataaaccgttctgtaacaccactaattcttcttaagcaaggtattagagctattagctagatgttatagaaaattgtgtaccggtcctcttttagtaatttctaaggatgtggttgaaataagcatgtgcttaagagtcagatatggatttgaggcctagaactgctacttacttgttgagtgatgtttgggaagtcacttaactactttgcttctcagtttctttacctagaaacaattttcagaatggctaaacttaaaaagactgacaaggatttggggcaattagaactgtgatattttgctgaaggagtgccaaatagccactttggaaagcagtttttaaaccgttaaacatctacttaccataagacccagctgttccactcctagatatttttttaacagaaatgaaagcatgcttacacagataacttacatgtcaatgtttgtatcagctctattcataatcatcaaaacctggggacaactgaaatactcatcaaataattaatagataaacaaattgtggtatattcatacagtaacaaggaatggaatactaatacatgcaacgaaatggttgaatatcatagtattcatgctaagtaaaagaagccaaacacaaaatttgaaaactgtacaattcttttataattatattctggcaagcacaaaactatagggacccaaatcagataagtagttgccaggatgctgggagtagggaaaagggattgactgcaaaggggaataagggaatattttagggtgatgaaaacgttttatatcttatttgtattggtggttacatgactatacatttgttaaaatgataaattttactatatataaatcatacctcagtaaaaaggaaagaaaaaataactcatgtttgggttggttatgaaaattattaagagtaattttcctccgtttttccttctgtttggttcttcattattctctgcctgttctatgtccctcataaatgtaaggtccatgagaaatgtcagtttcttatttcagggctgagatagtacagaaaaatttatgtctttgtctgtaatctctgagtaagattttaaatcaggtcatcaactgtattcttatcattctagatgttccagttagtactaaataattcagagctggaatttgcatactccatgaaatataccaaatatatctgtttcaactggattccttttttttgtttgtttgttttttttgagaccgagtcttgctctgtggcccaggctggagtgcagtggcgcgatttcagctcactgcaacctccgtctcctgggttcacgccattctcctgcctcagcctctccaagcagctgggactacaggcgcccgccaccacgcccagctaatttttggtatttttagtagagtcagggtttcaccgtgttagccaggatggtctcgatctcctgacctcgtgatccgcccgcctcggcctcccaaagtgctgggattacaggcgtgagccaccgctcccggccctcaactggattcctgatctgtgttctgcggcactgggagggcacagtatggttgggagggcatgtaaagcagccttgagttctgagcctgagtcttgcctgagaaaggcttcccctgcttctcagcaatccattgttccctgccagtggttctcaaacttgagcaagcatcagattcaccaggagaattagttaaaacatacacttctatcttcctcccagctactgattcagtaggtctgaggtagggcacaagcattttgatttctaacaagttcccagatgatgtcaatgctgctgatttggagtgcacactttgagaacccttgatttatgcttacttctagtgtttcaatgtcagaatttctgcccacatgctcacatacaggagccaacattttgtttttaaactgcctcctcatttcatgaccacttttgtattggctgaaatcagtatactctatgtatatgagaaagggaggctgggggaggggggtggaggagaaagagagaaagagaagcagtaaaacagtaagtgcttggctggagttcacaaagtgtttgatgtctgaaaggcagagaaatggtggtgctggcaagagaaaaaggaaacaaagctatgtctagccacacctccttccttttaacctcttgcgcatcgtcatcgttcgtaattattttatccccttagcaacgggctcatttcaggctcccattctctctactttaaaagttttaaagactcttactaggcctcctctgcccattggcctaaaatattctcatttaagacttttccctgtctagcttgtaataataggtcctgcctcctcacacttaagttgtatgattgtatcttattttttttaagaaaaatagtaattttccctgaataaaaccaaagtaccataaactgcatcatttgaaacaggggatgtgtgggcgactgatttcaattgaacaaatatgaatcatgttcttgtgaatcatgcttccctacaccaagaaagaaataaccctaataattttaatagcagtagacataaagagaatataagtaaaattcagaattttagaaacaatttgtggtaaatttaaagaaatcatggattatttcatcttcccaaataccaaagcggatattgaggactatatataaatttgttcagaattcctattatgtaaaggttattgcagggtacagtgtgctgtagtgatatctgctgatttttctctgtgataaattatatattacatattatttaagtatattatacttaaagctgatgtccctttatccctctaccaccacctcactgattatcgaggctttagagaaaatagctggttgcactagatgattacatgcctcaattggatagtagcttgttgccaattatcattacagtgccatattgattttttttcttgtttccattatggaaattaaagcagaatttgtttaaaatgagcttctatgtatattgtggatggcgattggttctgaatatgagctattttaaaaatatattttcttcagtggtgtgatgtctctgatattcccttaaaaatttaggtctctgctttgttgataagatttaccttaggtagctatgaaatggataaagactggaatggaatggtttaaatatagacagcatagatgttattatttcacataagtctatatattgatttatgtttatgatgttcttgggtagtatgagattgcttattctattaaccatacagccagtaaatttaattaaatttaaattagcaaatacttacttagtgttggctctatttaatataaatatttagtggctatatatgagctaccttgctaaacactatgaaacatagaaatattaatgaaatgatataactatctttagagaatttacatgccaaaggggtaggtaagacatggcaagaatcattatgattatgtcaagcagtaagagataaatattacatggagattttgaggaaaaggaactcatttgatcggaggaattacaggggaaaacattaatgacttaaaacagccaattttagttttaaatagttgggagaaatggagttgaggttactttctgggaagaaagaataaatgagctaacatgaggaagtgcaaggtgggctccagcaatgataatttgtctgattttattggcacatgtgtcttaaggcctgaggctggaaaggtagattgaggctacatcagaatgttgagccaaatgatttaaaatgtattaagtagtccagggaaaatttttggacagaaaactttggttgagggcaatttaatctgtcattttataaaatgattaagagaaaagaatgaagttggggaatcaccaattgggagtctccaggcttattaaaggaaagataactaggactaaaccagaatgttagcagaggcattggaaaggaagaaaggggccatttggaggaggcattctagaagtagaagtagaagtagaagtagaatatttgtgaataatgctctacattagcagtgtttcagccttctgccacacaggagaatttatgtccagccaatctcctaaacctgcgtactcagctcctgccacatgggtctcctcacagttcctggaacattctaaacacactagctaatgcctcatgacccaatttgcccttaatccttctacttggaaagtcctcactttcagagttctgctgaaatacctaaccttatcaaagaatctttcctgatcacacaatgaaaaatagcagcctgccactcctttcattctattttccaaggtttatttttcttcattgcatcaaagcaattattacatttattatatagttagttatttgttcactgtctccctatctctagatagtaaagtccatgaggctagttgcttagttttgttgcttgttatgtatctctctcacctagaacatgcttggaactttgtagacactcgacaaatatttgttgactgaataaatagaataaatgcaaaggtgaaagaaatgggtcatcaaataattatgccagtatttcaagtctgaagaattaaaagggtagtgatgttattaataaagtatcaaagagtggaagataagttgacttaggggtatggagacagaggaagatgaattcagcttgtgaattcatgcttaagtatgtcatgctggtgaaacaaccaaggcagtgctgtgtaatgggcaatctaaaatgtggagaagtctaggattgaggcaaagatcactgagtcatcctcatagagtcaatacttgaagcagtgggaattgaaaaaataatgacaagcaatattgagacagaattatcagatttgaaaattaaaattttattttggatatttaatgttttaaaattactaacttacttatacatctaattttttgtttatttctcagctgggttaacaactttggccatgaaggtcttggactcttattggatgagctggaaaagcttctggacaaaaaacagtaagaataaacactgaaattaaaatcaccaaagggaaaatgtttcagcacaacataatatacatttttcttttatttaggcaagaaaatattgacaagaagaatcagtataaacttattcaatgcctcaaagcatttatgaataataaggtaagtagtatttatttctgcccctgtcacaaaaggtgggaacttgcccaacactatgaaagtatgaaatgaacaaaatatttttttattattttttttaatttccagggtacatgtatataggcgaacatgtgccatggtggtttgatgcacaaatcgacccatcaacctaaataataaacccggcatgcattaactcttttccctcatcatcttccccaccccgtacctattttttacttatgtttctgctgtactaattaattgtagactagttattacaggcttataaataataagtgtttataaagttttacagtgaggttaaatacacatttgaaaccatatataaaagataaatttgatgtttaattttccaaaatgtgagctattgttagttttctcgatttttttttttttatttctatgctgatatttcattttaaccaaagaagtcctcacagcatccagaggatttcagggatgatataacttctgtagatctaaatcttttaaaaaatggagccctattccaatgtttcttctattcaaatatattgctttcatatagggaagatagataaaacagtactttccattgtctatgctgctaatttcctcaggagggtgagctagtcaatgaaacaaacaaaaaaaatgattggaaaaagtgtatttgactcttgtctataatttagaaatgctgtgtctgattcttattctgtttattcctccaataatttctttcatgtgaacagaggtctttttgattttatagtatactaaatgttcagaaaacataacaaaaagaaagaaatgaacaaaatagtgagtgcttgttcagtttacaaaagggtctttatgatgtaaatccttataatatttaagtaatacttacatgaaagttatactttgcttcacaaaatatttattggtgggtttttgaaatcatgcaaatgaattagtgttgttcccaattttggtaataatgctttttctttaatggtagtaggaaaatttaaatgtcgtttgttgaatatgtttccacacagagaatttctgttctattgaaaaggaaaattatagggatgggttgacttatttgctaagaacattgtaagattgagatttctctttcttttatgttttattaatgtcagcaagtttacatacatataagacatctctgaaaaattgcagggctttttatgtatatgtataatactagttgtattataagggaccctgtgaattttagacaataatttttcttctaaaaatagactttactcaggttatgaagttacagtattttttctataaactattttttttactgtcttagaaatgacctcttcatacctatagataaaatactattgactaattcacttaattacctaattccctttacatagtattttaataatctcaaaatagataatagaaataattacaacaacaagtagaagtttgccaaatgtaaaatatggctattaataaccaatgcaataagattatatattaatctatagacagtctcaagcatatggaaatacatataagtatttatatattatacatacatgtatcagcaaagaatgttactgtatgagcatatgcaatgaatgcttgctagtggacatgagactcctgaatatgctagttgtactgtttctggaagtttcttacagaaatattcccatcactactagtacagattttctcaaaatctgggctcttagtctttggctacaaagttaaacagaatctgatgcccaacaaggaaataatgagcattgcttcttcacagctcaagatagatctctttcgtcaattgagggaaacaatgacataatggaaagataacacagttctagaattcaggagatatatatagttcatgctttgttcctaataagttgtgtggcctttggaaaattacttgacctctctgagtatcagtcccctcatctgtaaatttagctataggacactttgttctaaattcttattgactcatgttgtcaattgtcgtggcttttcaggatgctaagtaattttaatcaggacagtcactagagagagtcataatagtaagattcttatagagccctttttttttttaacagaacatactttgatttgtcaacatttagtttcttaagagtttggcagtttcggaaagcataatgatttgacttagattattcgaaattgatgtttttagttaggccacgttaatgtcttgcacataggtgctcagagcatggattaatggatcttttgaattatagacatgtgaaacaataggcataaaatatgccttcagaatagaaaatatgcagtgatcttttcacttcatgttggaataaattgtccagatcaaggaattaagcttttatccaaaatgacttacacatcaaattttttggccccatggagtttagattacctacttcaaaaactcctttcttttatccaatacatgtaacaataggatcataaaaagcaacccattgtttcttaacttccagtactataatattgctctgatgtttggattaatgattttccagatatatttttcatgtcttcttttttatttttgatgtgtctctatatattaaaaactacttataaacattaagtaaaatttttaaaacctaatgatttcactctcagtctcaatgactcataaagctattaagtttggtaattgcgtggtcattgtctctcagttttgcaaatgtgtttttcactaatattcattacttttaatcatctactggccacctttatacatacttatctattttgtttttgttgcttctttcaagacttgtttcttgcattttctttttttttttggtcttatctccatatattttcctatttattatgacctgtgataaactcacatttaagagctttagctatgttccccatctgccactcggagttcttttagaaattaaattagggctgatggaactattcatatggttggtaattaactgaagtttagctgaaatggaaattttgctccgatgaaatatccaatttcaccattagactgtaaaatgaagcaaaaatattttataagaaatctgaaaaatactttgtgggacaaagataaaataatatattgctttcttaatgtaatgaaaactcaagttttagactttcattagaatttctttacttatttattaagtgcgtgcatgcacacgcatgcacacacatattcatgcttagaaaataaatgaaaatggtgttttctctccttagttgacttgtgacacttaataaaacccaggtgccatttctttaggttcacagcttttgtagtgcagcacagctgtctgaatcagggaggataagagagagaaggcatgggaatatccatactgaggcttatactggcatatagtattcaaaagagccttttaaaaaaaatttctctttttcttcaccttaatttttcatacaaacatattggacaatttaaccacgaattccagacatctccagggagacccagtgacataagtagaatcttactttagaaaatcatatcagtatgcgctttatatgttattctttgttgaagaaatactgattgttcccatatttctccaaatttatggaatttttagggcaggctaatggagatatatctgatcaaggagcaacaactccaagatgcagtgatttcatataaaaaacaaagacagataactgcatttgaagaatattcatataattaggtagaacctcattgtgggggtatgggtttttggaagatcattgtacgttgcttttttaaattaaagatatattccatagacattctgaatgaaggttttttttttttttttttagtttggattacaaaggattctaggagatgaaagaagtcttttactattggcaagagcaattgaccccaaacaacccaacatgatgactgaaatagtaaaaatactttctgctatttgcattgttggagaagagaacatgtaagtattgctatattattatatttgctgcatggaaaatgacacttaagaaattaataagtcctacttttgttctctttctttggataactttcatgaaaacagtattttagataatttttgattgaaatttttatcttgcctgtttatattttggcttctttgttgacattatagaaactcagtttaaacagataaaatcctagtgggaaattcttgaaagttggattcaaagtgattgagcagaattttgttttgctggaggtacagcaatcattagaaagtggacaaaaatcagagagttattttggcaaatacacacacatacatacacaaatactgtgctgcatatcacacaatttgaatagatgcctttattttacattatcttataatagtattttactttatatgccatggtaaatgaaaattatttgtaaagtgaaataaacccacctgttagaaaaaaacggttgttgataattattcaaagtgtatatgtgccaccaaatgcagcaagttgttgctgaacatgcatttgatcacatcttcttatggaaataatattgaatcagaagcaaactttcagatttgatgacattaataagtctagtttgtaatgaacccttgtgataaagaatcaaatatctgctaaggacccgaaccaaaatatttccttggaacactttgcgtgacagtaataatgtcaatttgagtcagaacaggactatgcaaagatttaaggatgttggaatatgttgactttctcataactgttagagtaaaatgagatgttgcttagtgttagctactgtcctcagaaaccaaaagacaaacactaaacaaaaatattatcatattaagtctcacctcaatgataacaaactgagaatgagataacatatgtaaaagcaaggatccttaggattttattttttaaaagtcagtttatacatgtgtaagaaatattttttaatcacttagattttcaatattcataaaatacaatgtagtccagtataactgttatgatttaattataatttcagatataatttgataagagtagtatactatatagagattaatttgttttaggcattgtgtggagataccaatatttttggtcaggttaataagtttcttgtgctagataattatacattcttctttaatcacctgggctttcctttttagagtcttttttctttttccattgtcaaaaaatgttgattaaaaaaattctttaaaaaataatcactctttccagaactttattataaaattacaatctgtttatgctccaataaactgttaacaattataggtgtcatattatgtttaagtgatattaatgttaacacatgaaatatcaaaacctgaaaatttaaattttaatgtttatcacttaagtattctttttttaatgtcacccagaaaagttactttccttaagatttttaaaatcgaattttccttttgatgccctaaaattatttagagctatcaatatttgccttaaagaaatatacggacaggaacacaattcctatattgtaatggtctttcagttagactggaggaatcagttcaagaaatctattttatgtgatagtgactgtagttaataacagtgtgttgtatactcgaaatttcctaagagtgtatgtagactttaattgttcgtaccacaaaaaaatgtaagtaggcgaggcaatatatgttaattagcttgatttagccattccagtatgtatacatatttgaaaacatacaatttccatcaaaaaagcaaatgataatttttaaaaattctaatggtatatataaacatcaaataccagaaagaaaacagggaatactgaaaggaccggtgctcatagtgtctgtataagaagtatttctcatttctgtttcttcttttttctctacagtctagataaacttttaggggctataacaacagcagcagaaagaaataacagggaacgattttcaccaattgtggaaggtttagaaaatcaggaagccttgcaattacaggtgagttagttttgtcttaaattgcttctagagttatatttagagtactcattttgtatgacatcaactccattttagctggcatttaagtagtatggaatgtaaaactaaaattttttctgttgctagtttgtgagaattgcaatttgtttaaaattaggaaaaatacttttgaattattataaatgtggcagttatggctgtcattgatatttagacaagaatttagtaattaatgtaataaaccagggaaattgaagcctcagcagtaactaaggtaaaagggcaagcagttcagccaatgccattatcctaacaagtgttagtgaagtcggtgggcttgtagaaatgtaagacaattaaacacatctctctttgtgccattcagacaatattcaaaggtgtgactcaccagaatagaagggattgaattgcaattcttaggttagcgttaatttgatagccctgtgtagacacaacttactaaatgcctcctttagaaaatgacaaaactcactatctttacctagatggtttcaggaaatgatccattttatgaatagctctgttcttgagggatgagaatgcatatttattggctgaacttatggtatgaagtcctgcactaaacattttaatttgcatatattatttgatttaattctcacaacaacctagatatgaaggtattgctatagtatctttgttttgcttatgggacgaataagttgaatgagattaaataactggtctaacgtgacacagtttttaagtgtcacagtcggaatttgattccaggtttttggtctctgctaatctctcttttagacaatgcataccatttaatgtaccatggaaaattctctgaatttttttttagttctcatattgttgttcaacaaagagaaggtagtttccacatttaattttatcaagctacttagcatcgaatgtttaactcttcaaatttcttgcttgatgtgaaacaaacacaattaattttttatgtattatgaagtattttttgtattatgtattttatgtattatgaagtatttgtatttttgtttgccagagtttgaaacggcatcagatagatgaattggcttgtctaaagagaatctgtaatgttacaaaattgtaatacctctccaaatgttgaaggatctttgttaatcatgacttctactccaactatattgaaaattttggatcaacttttatggtgtacttttatgtcaaatgtattatttatttatttatttatttatttatttatttattaagatggagtctcactctgttgctcaggctggagtgcgatggacgtgatctcagcttgcggcaacctctgcctcccaaagcaattctccctgcctcagcctcccaagtagctgggattacaggcatgcaccaccaagcctggctaatttttttatttttagtagagatggggttttgccatgttggccaggctagttttgaacttctgacctcaggtcatccgcccactttggcctcccaaagtgctgggattatattacatattttaaagattagtatattttttcccagtgttttttaataatacattgtttcttataaaatttaatcttgataaaattttatacctctactgaaaggttgaaaactgccttttttagatgactttgaaagttttgttcatgttcctgtggttgggcttacctaactaaatttcactggtttttcagatatatgtgtatgtttgtacttctcttcgaaagtttgttgagtaggaatgaactcttttatttatattcaaagttttcattacattgatatatttttaaaatcttctttaaataaatttttagctacaactctgtgagttatgtattattacctctggtttactgatcagggaattgaattggtggaaggcactccaaaatcacccagctgtgtaagggatagagctgtaatttgaacccatgtctttgtgatgccagaatttgaatacggcattgcctatactttgaagggatgcctctgccaatgagtagttcaccccaaacaatgagatgggaaagacatttgctagccttcaggaagctggacagaatggaatgataaagtgacaaattgttaacaagtaacatatggaagaatcatagatgtcttgttaagtattcaataaattgttgaatactgattatagatgcaaacatatgcagaccacaatttaaaatttcacattttaatgagctacaaaattagtaatttgttatatacaaaaactagtactctcacaagaattgtgaagtgagtttgtttatttagactatttaatgtgaatgaaaagatgtcctctaaaagttcaaaaatacatgcagaatacagaaacaaaaacccaaaagtttaaatctgttgtttaaaaaatataattagtgttgtattttaacagaatgacttttctatttctgtagtatcctgagacttcccaaaatgttattacagtctcgggaagtaattttgttaaaatacaggactaattattttttaaataacaactatatacattttcccccctttttggggttttaaaaaaggttattaacttctcacagattttttttcctagcttttaaagtgaaattttgtacctatgataggattttcattatcttcaggagttcaagaaataggtggaagataaatcgcatatcttcatacactctctcttcattgactttccttcagcttagtagcattctccggtctcttttgcaaagcacagattatacaccagcagcttcttttgatctgacttaaccttctaactagcctcttgtctctctttttcattttaaagtccatgcctctagaataatccatatttgttttctatgttttctaaattaccttttacaactctattacagttctcaaaaagatttacagtgagtgactaatttcaaaatccaatggcctctttccaatcttgatcacttggcactgttgatcaccttcttccttgaaaattttacttcccttgactttctaggcaccattctctcctttgttctctacctttatggtttttttttttttttctgtcttcctaatgtatttctcctcctcttacttcctgggtattttgttccctatgttctatccgtggtcctcttttagtatcattttatgtacatacattcatatgcacatacacgtatctacatgtacatgtatatacatacagacacatacttttttaaacaattttgtccatgaatgttctgaattgcttatctagttttacaatccaactgtggtagtgattcttcagatttatacatccagctcagtgactggtatcataaaattaagaaattaaaaataacatttacaacccatatgccggacagtgtttaaaatactttaatatgttatcccatttaaacctcgcagcaattgattgagagagatagaagtattatccccattttatagataattaaactgaggctcataaaggttaaataacttccctagggtcacagtgtgaatagaagggaaagcacagattatacaccagggagtctggctatagataacgtgctttaactactaagctgtaactccttttatattaaaacttagcttatatctctttctgttaacctgatttttcctaagtcttctcttcttcctgtgtttcctattttcggttatagaggtatcatcttctacccaatctttaattttcctcaacacttctttcttttttgtcccctgcattcatcatcaagtcttattacaaagtatagtattgactgtgaatctaacccattctacttccactgcctttatcttctcccaccaatattatttcaacaatttcctaattagtacccatactgacatgttttctctccagacaataccctacactattgtcagttatctgtaaaaaatgagtccaattctaatacattatcattcttaaaaatctatgctcatgacccattgctaactttttcattgtggtcctaacttaatattctggcctttgagcctgtcattctcccaaatgtaccatatgtttgcgccatactacatttggtgtttcccagatatgctgtagacttttaaatgctctcaaacattttatcatgcggaacactttgcctgaaatacctgtatttccccacctatatctgtttcttctgtgtcttgcataagtctgggaaggcttcagtaatgaggtgatattttaactaggcctcgaaggacaagtaagcatttttcataaattatctttgctgatagagaagcagtactatggtaggatgagaggtgaaaagggcttccaggaggtaaaatagaggccagaatagtctggcagtcacttcataaaaaacagtgaggtaataccagcatccagttgaaactgctttctagatagccaggtaggaaaacctaaggtatactgagcatgaataatggtttatagaacgggaaagtagtatagttaaaatacaatgatgtactatcaaaacagccccagtcttcacaggctgctgttagtttgaaaggtgccatgtttttacaatatttcaatatatacaaagaagtggagtagcataatttaatacatttaaaaactgttttctaagatgctgaaaataataatgaactctgcacattttgtaattagatatggtacacaaaaacagagctgtaaatatgccctttcctgatgtgtgatagcttcacttacccagtcctcgcctatttaatagatttgtcctttggaatacaactgagaactaaaaaataaaacaaaaattaaataaaacaatctgagcagcctacaaatgtcaccagatctatcaagtaagcctcatggtgagaacgactttttggcctttaatgagagcctatttattctcttttcatatgttatctttacgaacccaattatctgttttacatccacagcagactagaagtgcaggttggaaggttgggagagagtttattccagaatcgtacactggaatcatcaagaagtgacaactgataagctggcagcaggggaggggtagatagaaatgtaataaaagactgaaactggaatgcaaatgataacaatagacttcacagagcgcagaggctagtagccctgcacacttcagtacctcccgagatactgagttacaccatacctcactaactcacatatttagtgatgaccctgactcaacaggaaattgttaaattatatctagtttattttgcgtaagaatgtgggaattatataattcatttcagagagtgtcccatgtgaaacaagatgttgatacttaaatagataaacagatatatggaactatcctatgtggcttgattctttccacagtggttcttgagtgttgagattttactgcaagcatacttgtaaattagccattaatgtactcagaccatcacatatgagggagtagctttggacaaagtattaatcatttgtcagtgaaagtgcatttataagaaaacaaggcatcgaggcttatgaatatggagaaaatttgtggaaattagcatttataaagtgttgaatgactgcttgatattacttaggaaacttgttctatttattgacagttttatattattgtcatttagaaaatagattactataatgggaggttgtttagagatatttgtacaatgtagtcatttttggtattgacacaaaactaacttctgacttaaagaaggatgcctttattttaaatctgtttcaacactgaataattgtcaaacctatcattttcagtaatagagggttgccagtgacctccatgatataaaaaggaacaggctgcttttgaagtcattatattagcttcctcagcactatttggcactattgatcactcctttatcaaagctccctcctcccttgacttccatgatactaaactgtattagtccattctcacattgctataaagagctacctaaggctgggtaatttataaagaaaagaggtttaattgactcacagttccacaggctgtacaggaagcatgactggggaggcctcaggaaacgtacaattgtagtgggaggcgaaggggaagcaggaggaagagagagaaggggaaggtgctgcacacttgtaaacaaccagatcttatgagaactcactgagtatcacaagaatagcaagggggaagaccgcccccatgatccagtcacctcccatcatgcccctcctccaacactgaggattacagtttgacatgagatttgagtggggatacaaatccaaaccatatcataagctctccttgtttttccttcacctatgtttcatttaaattctcttatttctatgcttgacccttaaatttgcagattcctagagcttgatcctcagtcctttggtactttgcttttctcatattgatgatccttgggcaatcgcatctatcctcacagcttcaattaactaccactcatatgtgatgtctttatctgatctcttctcttcctcccaactcacagaccccatatgttcagctgcctcctgactagatttcaaattcaatattgtccttaaatatacttatcttccttttaaaaaaaatccttctccctactctaatcctctctccagccttgacctgcatttctcttgtattcccaatcctggttgaccttagtattacctaccaattagcatatagcagaaacatactagtcatcttagaatctacccttactccatcttccattccattagtcaccagatcctatcaattctatatccttaatgttatatttcccttcctcgacatggtatccttctctctccaccctcactgccatttttaatttcagagcattgttacatctcactgttttatcctttccctatgttctattcttcattatggccccgtttaaattatcttccccaatgttgtctttctgaaatgcttttctcagaaatgcacttcagaatgcttaaagtccagcattggcttcccatagttcactgcttaaagtccaacaatggcttcccacagtctccagaattgcagtctagtcctagcccaaacaaaatacttcatctggctgttgctttctctttcgcctcatattccaccacccttctacatatgtttttagtctagtcatattgtgctttgtttcctatagattttatgctgttttatacctctaccttcatacctttgtacatgacttccgttggcttggaaagtactccacttctcaattaactcgctctgtacattcacatctttcttctctcatactttgacttaaatcatctttgttcctaactcctgctgggctaggataaagaaagaccttgttaatgtcaacagagtacttaataaggtcaagtgtggaacagtgtcaataaaattttaaatgtacaatttgtcacagataatggcaatatggataatctgtctgagaatgccctggagttgtcaattattgtaccccatagctctgtgaattgtgattaaatagatagatgtttgtatagttttcaagcctgtaagttaaagtcagtaaaaggttctagcatttttccagtaattttatgaagatatttgtgttcaaatatttccctttctctgtcacttaggtaaacaacaacaacaaaaaaacttaaatttctttttgtaatgctatgtcttatgccaataaaattggaaatttttaaatgtcattcacttactatattttaattattttatttgggacagttaagtgttacaaataaaccctaggcatatacagatgagctttgccttttgaaagtttatcatctgttttataatatttcaccctttataccataccaccccagaatgaagacaacagcatctggtgactaaagaatgtagatgattattgtagaaataaaataaattgttatagtaaaggaaggatcttaatgtggtagaaaactgataatgattcagtgtagtatataattatacatgacataaatgattggatactttatcacatgcacagaactggtagtttttaactatgtatgcttatgtattcatttaataggatatatatgcatctcatgttgaaatcttatgacatcactgaatgaaaatgcaaatatagaaaccaattgtatttactaattaaacatcagaattgtggccctagcatatgtattaataatggagaaaattcactgattttttgtgactttaaaattttgatcctcatggaagctgtatttgtaacaatagatatggcggaccattttgaaacatagccattataaagacactaagcaacagagcaactctggataatggactttgtgatattcaattcaagggcatttgttttctttctaagatcaggagaaatgatatcaagcaagatttgtgcgatataatgtggtagaaaaaatgcaaggctaaaggtcaagagagctgagttctagttgtatcattggggcttattagttatgtgatcttgggcaaatcatccaatctttctaggttttcagtttctttacttttaaatagcatattggaccagagtattttatgttctgtctagctttaaaatctcatgattattttctgtctctggagttgaattttttttttttttttttttggaaagcagattgattttgcattgttagaggacaatagagtacactcatctcttaaagatttatatacttggaagttgagcatatgaattttgaaattttcattattcagcaatgagttttgtagttctttgaagtgaaggtttcagagattaggccagatctctttttttctttaaaatctccagtgtagtgctattcaatcaaactttctcccatgttctatatccctgctatccaatgtggtagctactagccacatgtggctgttgaacactggaacaatggctagtgaaactgagcaactgaatttttaattttatttaattgtaattaaattaaactgtgataagtagctcccatatagaatagcacagtactgtagagcgtgtgtgtgcgtgtatgcatgtgttcacatgcatatacatgctgagtgtggagtggggtggcagaagtaaaggagaggagtggtagaccattattttggatgatgggatgccatttatactttactgctcaggatgtacatgaagtggaatttaacccactccaagaaccattttctacttttgctttttttctgcattacattatatattatgatagtcactatgtgtactagacaacatattgtttatattattgtatgtttttctaattaacctatagttttaaagctacatatccccagtatattaagcatgttgcaccagttaaattttatcatcttacccatccttaaaatcttttgttgcgagaatctataaatggagtttatgagacctttggaatgtgctggaaattatatttgtagtaaaattatatcatttatagtcatgagtttcctccttgctgtgtggccttatataaagttattctatctgctttgagcctccacttcatcatctgtaaaataaggataacagtaatactaatcttgtgtggtttttatgaagatgagattagatggtgaattatgtaaaggacctaatacattgtctaataactaataataataatggtgataatagtttgggatttcgtatttagctatgaattcaggatacacagaatgggtttgtcatgtttataattaagtagtaatatattcttccctttaagctaatttaaatttaattttgtatttgtaaatagtgacaattatttcagttttgaatttgagatatcgtttctattctctgaaaagggcagcacttgtgtaacggcataaaggaatagcaaaaatttagatgacctttttgttttccacattcatattacaatatacatatttctgtaaaagaatattattttatcagcttatgttggaaaatgacatgatagcatgtttattcatctgttatttgtaattaattaaatatctattagaatatgatatataataaatggtacattgttaagccagtacctttaccattttaaaactgacttcacaatatctcctaattgttgtgtactatagtcaatggatggaacgtctttgttttcatattaaactatatgttcatacattgtatgtaaagtgagtatttaatatattgaaacattattaaagttatattgatacattcattaattttattgacttttattatctttattgtctcctgatctgaatacttttatttgtataaagatacaattgcaggactcattaacttgtttcttacagaaatgttctctttacttgtagggtattaatacaagccattaagctagaatttcttctggcaaaaacaatcctaacagatggcaacttttctctctattaattttggattggacatgcactttggcttgtttggtcatgtcatagttgtaacataacaagagtcattcaagcaaatacaatgataatatagctgtggacatgtacagtatgcaaatttatagcctagcctatcaaaactatttaaagatttacatgatttcctgttgtaaataggaaggttaagtaatccattaaagcataagcttcatactaacttatctggtatgtctttaaaggtaatgccaaatgtatggcaaatatttagtcagttgcctaagtgttttatcttgatacttgaatgttcatagaaattagactatattgttgtatcattcagatatctggtcatgttagaaacaaccttaatcagcccttttaaagcatgtaacttttgatttttgaacatagatgtgaggcagataggctaatctcccaaaaagcaacttaaatatataagatacagattcaaaagtaaagcataccttttaatctcttctccctattttggaaaaaataactctatcataatagatctgtagatgtcaagtcaaaatacatttgaaatatttgtctttcggtaatatatttttcccatgctaactattaatttatttgtgtctgcttctataaatacttagtatctttatataatatgtttttttccgaggattccccttgtagtttgccctttgagcactcttctactcattgcattctttaaaaataaaaaaataataaatttaaatggcatcttttcagttaaacaattagccagttaccttagatttgagcagcattttccaaaaatgctacttaggaataatttatggaatacctggcacttagcattttgttgattcccttctagattaaaattaccagcaaataagttcctttttataatagggaatctcaaaatcagaaggtaagaaaagcaaaactcatttttcggtatcaatatatttaatcaaatactttacttgaaaacaagctcttacatatgctttattatgaaatgtgcattagtattagtctcccagtgccttctaattgatcttaattcacttccattattttttcaaacctagtaaattaattcatcttaattatatattttaatactttatatattttgtacaaatcatcccattaagaggatggagagagtttaaatcaatgtaataatttatctaagttatcactgttccctgtttaatattagggtacttttatatctttgatttattttagaagtgtttataaccctgtagaattgaggccaagtgtactgtgaggaccactggacatgaaagatacattttgtgatcttttcaaagggctctgtctgcccacttttgcaatttgggtttttcagagggagtttaatatttcttcatattatttttaaaagcataacatacttggtcatcacatctttgttagaattattttggacattatacactttgtcgttaattttattgtttataattaaagtcataatcattatacttctagaaatatttgcatttcttattttatcattatgtgtgtatgcctttagtgaatatattatcttaatgcattatttcattaatttaatgtgtttttttaaaacaaaatttgctttctaattgcaggtggcctgcatgcagtttataaatgcccttgtcacttctccttatgagcttgattttcgaatacatttaaggaatgaattcctccgttcaggactaaaaacaatgttaccagtaagttgaatgtatacatttattatgctgatgaattttaaaatttttttcacttccacaaaagtacttgaagcagagtaaataaatgtgctttgctattttgttttgtaaagcattagacattttgtaagcttttttgtattccagtaatagcattctctacatacaaatgatgattcagaattcagctaataatgtacccagaagcgatgtgtttttgttttttgttgtttccctcaagtcaaaagggacttcttttctttgaattttgaatattgaaaacatgagactttttttttggagtttcaattttcatttaaaatattctgctttcctctttgataacctagattgatttcattggtattcaggataagcatgcatagagttttgattagcatatgctagacacattgcttaagaatgttactcttgttacaaggctataggaacttttcagatcaaaaacaatttgtttcttaaattaaatgtgaatatttgctgtaattatgatagtgttaaaaacatttttggaatgattttgtatgctgaatctgaaataaatgagcacacttatttttataaatacaaatacaactactgtggttttatattttattaagtatattaactgaagagtgactattgcagactatggcattgttcaagacaagtaaaattctgctagtgtctttaagctactcagaatatacctgagagacaagaagtaaaagtaaggaagtgagaaaaaagcactaaggagagaaaaaaacaacaacaacaaatgtcattgaatgtgcatgtgtgtgcgtgtgtgtgtgtgcccatgtgtatgacctagtctaccagaaatacccaaattggggacatttcctggtgaggaatcaatatgtagcataaatttgtaacatatggtgggatacttttaactgaaactagttgaaacccatcataataagttgtgtgattggacctgttaaatccattttaataagatgtatgattgggtccacctggttttggaaatttctatgtcaatcccacctgaagcagttctttcattcttgacacttaaaaccaaggcattggttgcagagaatcaaagcaacattttaagtgacccatctagagattaactgtgcagttaacttaggcatattcaccaattatagttagtgtgacatgtgattattcttgttttttttttcactaattttcttttcatccaaagcctgtagccttggatagctaaagataatcgtatggtcttgattgtagtttgcttttgaatttccttcttgttggtttccatgcttgtttttactgggctggttctctgtttatagtagcatctttgaagacttgctggctgcaagggctctgtagcatcctctactcgtttattaatatgccatgttttctgccatagttgttgctcttacttttctctctttcattcccctctatttataattgaacattcactttctgctttatactactgaatggctagtcaagagaactgtgactctcattttaatttattttagtcctcatttttcagaaaaggtatggtattgtagctcttgtccttaaccttttgcacttttgtctgggtatattaatctctgctgggctcagtggcctcatgttattcatttggttacacagacagctaagattatgtgtctgtgtttctaagctacacttttccattggccatatagccctatataaaactttttgtggtaccatgtgcttcttaatttatatattcttttttaaaattaaaaataatttttaattatggatataaaatagttgtatatatttgtgtggtaaaatttatattttgatacaagaacatggtgtgtaatgatcaaatcagggtgattgggatatccatcacttcaagcattcatcatttctttgtgttgggaatattctaatcctacccttatagttattttgtaatacaaataattatgaactatagtcactctattgtgctactgaacactagatcttattacttctatcaaactgtatttttgtatccattaaccataccctattttcccccacaccctactaccctttctaacctctggtattcttaatatatacttccaattagacttttctttatcacatctcttcagtatgccctgcttctcagatctcagtgattcttcagcaagataaaagtgggaagagaaagttttggaatagaacctacaaggattctcataatttttttttcctctctaagacagtagagctaaatatgattaaatatgactctgattctcaactaagaggttgggcatgtccccctaaaatcttactgtattgaggatagggcagacatatttggttgggaaaaaaaaaatcctccgcaggtatttcttttccttttccttttcctttccatttccctttttctttttttctctttttcattttccttttccgttttctttttcttcttttctttcttttttgagacagggtcttgctctgtcactcaggctagagtgcagtggcacaatcacagctcgctgcagcctcaatctcctgtgctcaagcaatccttccactgcagcctctcaagtagctgggaatacaggtgtgccaccacacccagctaatttttgtgtatatatatgtatatatatatgtgtgtgtatatatgtgtatatatatatgtgtgtgtgtatatatatatatatttatatattttatatgtttatattttttttattttatatttatttttgagacagagtcttgctctgtcaccaggctggagtgcagtggcgtgatcttggctcactgcaacctctgcctcccgggttcaagcgattcttgtgcctcaacctcctgagtagctgggactacaggtgcgcgccatcatgcccggctaatttttttttttttttttttgcatttttagtagagatggggtttcaccatgttggccaggatggtctccatctcctgaccttgtgatccgcctgcctcggcctcccaaactgctggaattacaggtgtgagccactgcgcctggcctaatttttacattttctatagagacagggtttcgccatgttggccaggttggtcttgaactcctggcctcaaatgatccaccccagcctcccaaagtgctgggatcgcatatacaagagtagaatcattattcaggcagatagaccttgagaagattagcgatcatatatttagaaccgtagatttcactactattgttttagtttatcacaacttgggagcaggacagaatggtcatgggttaacatatactacatacctcacatgtcaactactatctaacctactaatgaatgaaatatttaaatttaaaccactggaatttatagtaacattacatatcctttacatatgcagtgaagcttaataatatggtcatagattgtctttaaaatccttacgttttcttctatttattcttttttttatatccagttctaacaagaattccctaatattctagaatacagtatattcaaagcagcaaattagatgtgactagggctaatattaattgttggtacatggatgaaaaattatatgtatctagaaccagtatgagttgggaaaaactagttcttagtatttcagtaatccttgagatcaacactgtagtagagtgaaactttttttcataataattatcagaatcttcaagacaacgaatttttaaattatattctttaaaaatttattttcaaggttcctctcatccctatggttaaatttagatgttgaaaaatagtttgtatttcatttatatggaatttcacgtctgataaatttgctttagtaatttagaataaatgagttgttacaaactctacagtgaattttaaaataggatttttttctgtacttaatttacattgatttcttctgaaattttccccatttgccttttatttagttaaataaattaagaaaatattagttaaatcagataagcgaaggaaaaacatagtaagaaatggtgttggtaggcagtgggcatacttttatctctttaaaagtctgagaaactctttcttgttttaaagactcaattttggttgtttgactgttaatcagcagtgtactggcaatggactttgatttcctttgaagtgcactatgttatagaaaattacatatttcaggaattctgcaaaaaataattttagatctataccgcatgtctttttaaaaaataacaagcatagagtgtttcacataattaataacagtgtgtttcagtaactttgtgatagttcacgttttaaaatataaaacttcagtgatagatttccatttacttttataggatacccatcttattatttgtactatgtaaaaatttttattcagtaaatgattattttatcaagaatttatgaatatttcaaggcttgacattttgctggaaggaagtttcataaagataaacatatatatgtgtatgtatatatgaatatatatttacagtaagttcttagttaatgtcattgataggatcttgcgaactgcaccttgaatcaaaaccatatacagtaggtccttgaataatgtcctttcattataacattgatgagaaaagaaaattggttttgctatacgtattttgcttcaagttgcagtttccaagaactactgaggacaattaaatgaggactgactttgataggtctggagcattattaataaagaatatttataaaatactgcatttacacatgtctaaattttatattgtgctatatgtgctcatatactatgtatattgtataaataatgtctgggcctaattaagaactaaattgcacatttaaccagttattttcactgaaagcattttaattatgctgactgattttcatgttttgtaacgttctatgctaattaaatggcagtacttaaatttttctgtttttctgaaatatttgaaagtgtttaagttttatgatgaatttctgagagagaatatgtggtgacaagaataagacatactgtaaaatgcgtgacaggttgtttctgcagtgaccagtgtattgggtttgtctggcttatgtaattttctaaatagagttcagaaatcacctgataatatgacccagcaatgttagatgattttgcattctaataaatttcttcattccatttcaaactggaaaactagagctaaagcaagttattactaaaaatgaaaccaaatataaatacatttacttgttatgttttatatgaaattgtgtagaaactaattattttcatatgctctgcaggtaaattttcaataaattattatgtatgtgagtgttagaaaaaaaagcatctagaaattgctgaaatttgtttggcttcagtaatagccattacatctctataatagttctattgaataaagatagaaacaagaaatgtatcccattttgttttatcgacctaatttgaagtacaccatgcttgcatttccttttagagttcaagctcagctctgaaaatcctagtcccactttcggtatcacccttgagcatccacagttgtgattatcgatttgggttttgaaagctgcaacttaatggacacatattaaaagatattccaggtgatatatattgagcccaacaatctctagtgtggcatgcttctaaattttttatactattattatgaaaattatcagaggtttgtaatgcatgtgcttataatgtattacaaaaacataacttttatgcccaagttggtattttgtgatttagctaagcaaaaatataaggtgggggaggaggttagatgtacagcttaataaaaagtccaaacgcctttttgctttaaaatcacaaaatagcttttaaaataaatgtgtttatacatcttttcaagccatacttgggactgttgtgcttgaatatatccttgcatttgttcttcattaatacaattgatttgtatttgcattttttgccagaggcatatgtgaatgttctgactgcatgagttcttttgcaatctttgattagtgtgtttagtcaaaatgacagcatttaatttgggttgttagcaattagtttttttctgttgtagaactgatcgttaattttttaatgtgaataatcaaaatgtagggcatggaaaaaatgaagtgaatgcaatgaggtccttttatgttgaaacagaaaaatttagctacaattactttcagaaaaccaagtgcccgcataaatatttgaaattgcttctgtgtttataaatgaataattgtgttctgccctttattacctaaatatgccgttgtcaaactgttattcatgtgttaaattttatgtttatatattaggatctaaaagaaaaagagaatgatgagcttgatattcagttgaaagtatttgatgaaaacaaagaagatgacctaactgaattatcacaccgtctcaatgacattcgagcagaaatggaatatcctttgacaaaccacaaaacaattttgtttgcattgtgagaaagggatttgtgggcgattttgtggaacattattagagttcttgtctgccctcccaatttatatccatttatttatattagaaccttactatgatgctgtccttgagattcatgttgaggaattgtcaggctgtcttgatgatttacacagagtgtattgaaatctgcacaatggctcacagtattatagatatactctactcagtggtcttgaataaagaatagcataaggcaatatatcttacatgtaaggatttttttggggaaaatttcactgcgttcatatgtgactataggtgaaatacttattcagtttattaaatcaagcttcagtgacttagagataaaaagcaattcaaataaatgtcttattctgtattcaaatatttgtgtttcttaacaataacaaaaatgtttagatgcaatagaatctgaatatagcaaagctatgtggtagaagcatctgagtcaaatacagctagcatataaccttccgacggcagcaattttatataaaatgattttagatctaagagatggttgtcacagcattgctggccatttgtttcgcacctgttatgtttcttacttaatggattctggtgaacctgggaaacatgtcaaaaccaaagtgacctttgagttggattttttctcaatgatgttttcttccctttcctactgcttgcccccactccccaaagctggaagtaatattcccctccttgaaatacccaaagtaccttgtttgttctattttatttatgtacacttctgtgcccctgtgagattgagggcagaaatgttatgtttaatcttttttccttcaatgcatctatgaaagtcttacacataggtattggataaatgtgtgtgcaatgaataacaatgttattattttaaggaataatttctagtaatttttattcatcattagtggtgccagtctactgtggcttctataatattaaatgtttttcatatcaattaatatcttgctttacatagattcctcttataatcaaacttcaccataaaactatttttggatgcattgtgtagccatttaaggacctcatgagactttagcacaacactcttatgtggggtctaagaagtaagccatcgtatgcttaattctactttggagaaaatgttgacatttcaggttattttaggatattgaattacatcttgtcttttatctttattttaccttggttttccaggtcctcacttttattacaaaaatggatccatttgtgaaatctgatttctagtttactaaaagcatctaaatttctgcaactctatatcttgtctctactttccattttttatcaaataatgaaatacaaatgaatgcaaacaataataatttcagatttagtatttcatctggataacataaaactgattttgtgacctcttagcagtttacagcatgctcatttgccttctatcttatgtggcagtgaaaatagagtagtagtgatttgcatgaataatataggtcctctatcacaactacagggagatcaaaaggaaaccattttcactgatggcattgctgttccaatggtaccagctataatctggactttaaaatatgtataacggatcatttaagattttgacagtcaaatggtcttggacatgctcttgaggtctgtctctctagttaaaagatcaaaatgattccatagaatcattactttatgcagatgtttaaatactggatcatagagttgaaggtttaaaaacagtaatggaagcaagattataagtcaatgttttaaaaagttaaactcctttgttatgaatgagacttccatcaaggatctttaatatttttcctttactttctactgatatgaatgaagtctaccatcttctatataatatgctgaaggacactgctgctgaaaattacttcttatctattctacaacattttttgcttatcagaaatgattattatatcaggtaagaggcagttctgagagtactatatttataatttgaatcggatattaaaggaaaatgaacaatgtagtggggcctaagcaatatatgcatatgtgtgtgtatgtatatatatatgtatatatatatgtatgtatatatatatatgtatatatatatgtatgtatatatgtatatatatatatgtgtgtgtgtgtgtatatgtgtgtgtgtgtatatacacacacacacacatatacacacacacacacacacagggtataagagtttgactctttaggtaacattttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggcccaggtaacattttttaaaaggtgttcattttttaaatttggccagaagagacagatgcacttgtaaaaatggggtactccagcgacaggactttggtagcaatgaacccaacagattgcactggccctgcaatgaattttctttgctagatagtgatatcacagaaaaagcactgaagattctgggatagaactttaaaggttttatcttgtgcatattaagtaaggttttactgttatttctctttttacagtatttatctactaataaatgtgatcttaacatctaagaaaataaaagtgctaatatttcagttttatgtctagtagtgtcatccttcaaaataaatgagtatgaaaataaccattaaagttaaaagttttagaatctagttaactgggaatatatcggaaaaccacaaagttatgaaaaggcttctgagtgactgaaattatccacagactggtgaccatgatgttacatttaactgttcaagagactcttagttgttcttcatactctgatttgcgtgaaattctgacaacctaggttctttgatttctcaaaacctgcttgattaaatggaaaaggaaagctaccatgaggtcagcacagtctcaacaaaaattacaactgtaaagcagcatagagaactattatagttcagaccagtacagtaatttgttgggcatcgtgacattacagagagataaaaaatgtttaaaatattaaattgtgtgctgttttttaagcaacaaggctggttatacgttaaaaattattgttgtatttttaattaagttctaacaaatttaaaaggggtactgtgcccaaaggtactcagttacctggggaacatcatttatgtgaaagtatccatttctcagcaactatgaataaataagaagttatcctcatatggcatgtttttcatcctaagaacatccatgtgaggcagaagtgtgacaagcattttattccacttagggatgattaacctggccccagctgtgttttccttatttaaccattgactagactgaggttataatccaatattatttactctagacccgaagatgacttgaaaaaaaccagatttgtaatatgtattactatttattcttattcttgggaccagacccattactaaagacatagaagagcaattagagtctatttggcttcatttacaaacttttagtaggttggctatttatcagcacactatatttagggaagtttatatcataatttgtctatagtcgtacttcttactactgatttttctctgttgaatttattatcctttgacaaatactaaatcttacccaaattttaatgcaaaagtgccttttaaaaaattttgcagtatgtgagtggtcatttttaaggccagaattacgctgatggattacagaattaggatatgttttaaaacctctgacactttaaacaaattgaagcaatagccatgcatattaagtgtgtatgcttttataaaatgggtcttttaaaatgtgttgcataaatagatccttggatagtcttgtaatataagtggctctgtccagttttgtaagctgttatagctatcttgactaaaagtgctgtagtaaattcaagacattgcttgccacgtaatgtgaagaaactcatcccttattgaaattgagaacctgtggatgcgtagaaccatttctgtatccatgaatgtaggactaatggctcatttgtttttattaactttagaaacaatagcataagtaaatagaaaaggttgataagtatctttcaacacaagcatgaatccctgcaaactagattatgaagtcactagatgtagttgattacatcacaatgggtttggtactgtaacacccagaccatccttaagcttaggcatgcttgtcctaagaaagtgtagtggctgcaggattttttaaaacaactccagaaaaaagacctagttcttctaatatgttgaatgttttctaaagcaaattgatctgcatggttagaaaggcattcatgagtactttctctccttttcaggccacaatattataaaataattgaggaatgtgtttcacagatagtgctacactgcagtggtatggatccagacttcaaatacaggcaaagattagacatcgatttaactcatctgataggtatgtatcataatcctcattgtcctctgattgtgttttgtgccttctgtattataagcactttttaagtgaagaagttcagtaagaagcttcagttcttactgaacttctattcatatctggtaaatcattgtgtctctgggcactcaattgctgtaattgttaattataatgatcatgagagttctgcctgtgtgattagaaatattaacctgtttaataagttccaacactcctggaggtagtttaagcttagtgttccacaaaaacccattacattattatagatgaatgcattactatttagaaacatgactctgaaatcttttcattttatactggtaccttagtggtcttgtagaaatcatgtatacaatggggtctcattatagttatgttattaatgcccaagttttagaaaagaaatacaggctcatttcaatagcttgagaccttctaagggtatcaaatggatcaatttatattttcatagaccttagagttagaaagaatttgaggtgatcatattcatctccttagattgctgaggaaatgactttatatcatcctagactggtagttagcagtacttttcagaacaacctctgaaggatgatctgaaccttcccttgtgaaatgtgctatgctatctagccttatggctaagcagtcttatttatacttaattggaatcactattgttaaggtttaagcatgaactcatttgtcttatatttaaagaaagaaaacaactattatatgccaattatatattatttttgactccacagcacaaggcagatacacagtaacattcaaagatggataacttattatttatgtattatttctgttttaaatgtaatgcatacttatttcaggcaatccagagacttacataagtgacaaaccaccaatcacattcgtgatcgctcccttttcagcttggtacatttccttatatctctttctctatgacctatctatctctctgtatgctgatttttcttggaactttatattatgagagtttttccacattaaccttcaaaatgtgacttttaatgtctgtataatattccattttgtgaaataccatagtcgttgtaaccagtcctttctttttgtgcgttcataattgcttttagattttcacagttataaatgaatgtgctgtcaacattcttgtatataaatgtttggctttttctcactatttccttaggattgatttctgtaagtgagggtatgaactttcaaaaagccaaatgcttttcagaaagcttgtgccaatttacccagaagtgattgtgaattttagcctcattgcatatttttcaatgagtttgaaaaacaagtttattttgcattttgttgagggagtcataagggactattttcaaatatgtatattagcttataatccattatagaccatagttaggacacatacactattgttgattttgatcttattaatcttaaacatggagtcattgtcacctctcacataataaactatagttttttgaagtattttatagttgaaaaataattgaatacctataaaaaataataatttagtcaagtagtattcagtattcaacagacgtttgttttgtgtactgtgtaccaggtacttatgattctttactattaatcaaaagtgttgggtgaggagagacgaacggatcaggtgagagaggatagtcagcatcataaacccattgtgatgttatccacatgtcatctctgcgactgtgaacaaatcatttaacttctctaggttttagtttcctcaactttaaaattgaataagtcacatatatgagtggctcttaatattttatgttcaaaatcctttgtgagaagttgacaaatacttggaactttgattagaacacacatatgttcatgtacacaaaaaattatcaggtgcttcaagaacttctaggaaacccatggatctgtatttcaagatgacttggacctgaagagattagtctcttgtaatttaacaattctttgagtctgatatctttcataaatcagatcgtatcagatctctgcctgaaactctctgatgcctttccattgaaatttaaattctaaatcattaccagccatggctaggacagcttagattcggctgttctttgacttcgtcatttcctactttcctcctcagttgctttaaacaaacaaacaaacaaaccagctttattgaggtacatttgatgtaagaaaaactacccatatttaaggtatacaatttgataaattttgctattaatatagacacttaaaaccatcatcaaaatcaagataataatcctgttaccccctaactgcattgtccttttagttctttctttccatgtctaccacatcttcccatcctgggatattactgatctctctcttactagttacattttatagtctctctcattagttgcattttttaaaattttataaaaatagaaacatacagcatatatactttttgcctgtcttcttgccttcagcataattattttgagattcattcatgttgttgtattgcatgtatcaatagttcattcctttatattgctgagtagtattccagcttatggatataccatagtttgtttatgtatacacttgttgatggccatttaggttctttcgagtttgggattactataaataaaactgctgtgaatattcacataaattctgggtactggtatatgtttttatttctttttgataaataagtgtggaatggctagatacagaatagagtttatatatacataaaataatgagagatacaatattgcccaaaagttgtttatattctgaagtgtttgatttgacctgagaagtttgaagttagtttccttatgtacatgatacattttgccccagatcagaagttaagtaaaaatcttttcatgaagaagcctgaattatcgaatgttattctgtctctctctagcttttttgtaggacaattttgaatcttgctaagactattcatatcttattaatattattaaggttacacatggagtctttgccacctctccacccataataaaccataggattctgaagtgttttgtagttcaaaaataattgaatacccataaaaataatttaatgaaatatatttttagatgcttggttttgtgcctccacaatactatcagtgaattcagtttgtatgctaaagaaagaatatatgatttttatgttttatgtatagtataggtcaatttccatttaataagggttgacataaaaatgatagtctgcattgcagagttataggctagaagacgtcttttgtctagtgatctcatgccataatttcgaatcacttttgtttgatcttaatagattcttgtgtgaacaaggcgaaagttgaagaaagtgaacaaaaagctgcagagttttcaaagaaggtaagcttataaaatattagccataatcgttaggttaataatttaatcacagtaatactctaccttctttattaatatgagggcttctaaatgtttcatttatgtagtactttatacttttgggttcaaacatagccgtggaatattgatttatttccttataaggtaaggttgctattgttccctcatcatcatgtttaatccattatggaagaaaaacactagccacattatactaaagtgatacatgaaataaaattacattgctgaaagggtatagttggaagcaatcaaccaaaataaattctccctttgctttcttgcagctgtcgcttgcaataggtagctctttggagaactgtgagatgtttagctagtcttttctgttgtggtcttttatgtcagtgctattgatagtaccaacatgttgcagtgttttctctctttctcactctctttctctctgtttagacttagcttctttgaatttcataattatcattttgtaagtgatgctgctacttcatgtaggcctggtggaatttgaggatcccttttctttctgtgttaatgtcttaaatgcctttgagtaaatgccagctttgtgaatatccgaattgtattcagatctaagcttgtcttttccttgtttcatggaagcatagctataattttattagcttctaccacaagtttctctttttttgttctagagcctattaagcattagtatagtatttctgtcctgttgtgtgcagccagaaggattgaagcacatgtctaaaagctctccagttttcagccttctctcagcaagataatgtgcttacatattgctgtctcttcaaagttatgacttaccttggagattagataatcacttttgctatcactctagaaattatagagtattactgaagaagttacttcagggcatctgaagaaatatctttgctcttttagttactagaatagattctaagagcttgagcataaaatgtttgtgtggagctgtcatttttattggtgaaagaaaatgcatgctttttgattaatagaccttcatatttctaatgttcttgttttaagtagcacatttaaaattccctttgaaaaaccttagaatctccttaagttttggctggcactgtgattagacactgcaagactggagcaaattgtgattatctgtctggtaaagtttttttgtgagcatatatattatggaaaaaggagtcctaaagtaatagaaaagaaatttcagtgtttgatgctttagtgtcatcaccaacatttagaatgaaaacatgtatggtctcccagtggttagctacatgcatccccttgttctgggtcattttaagaggcagtataaagtcattttttaacaagtactagaatgagaggcagtagttgtgagatctgatctcagcttttccactaattagctgtgactttgggtaagccacttactctctttagatcttagtttcttcatcattaaaaggaaagaataaaattagcggacttgtaagaagacctcttccagctcacatatttcaggcttctgtgatccccgtttgctgtgtttgcagattaaggtaattttaaattaaaagcagaaacattgtgtgcctctcctccaacatactaataaaccatttttagaggaaaaaatgtgtatagtgtgcttgtgtaggtgccatgatttagaagcacataggagaagctaactttaggagtggggatgggagtacagattgagataaatcttaacacggatagtagtaaaggcaaacaagctcacattggaggatatccatcttcttaatgaagtaggaaaacgaggtcattgactgaaggatatatggatccttcactccaaggatctggggtaggtttgaaatttaaagaaattagagaatatttgggccaggatctgtgggacattttcccgggattcaaggagagatgaataaaagcatttcaggttcgacccaaacagtattattatccagtttgctcacccactcttcagacttagatcagaatggcattttataatttccaaaggtcaaagctactatgaggatgaatatttgttaacagtgaacatacttttgcattgttccacaaactcttaagatggttttgggcagtagatgtatcacttttagaaacagaaataacattgttagaataatgtatagacttctaaattgacttgaaacaacattgacaataaagggcaaataaaatgttctatagccagtcccaggcagtattcactggaaatatgcaggcaggtttgtgcctgcttagagccctgtctgaggtaagggctaaggcaggatacagtgaataaatattaaccattcagtctttttggcttagcaccccatattttaacctctagtttttcctctcataacatgctatacaaatgttttggttaaccatctgaatgagactgctattagggcatcctactgtcagagtttgtgaagtactgctttatggattctagacaactaagattgtaatagaaacaattccaatttgtattaatatacgtacatttgagcattctaaaagtgcaatttcttttcaagattaaatatagttaaggagttgaaactgcttgatggtttatttttagatttcattttctaattcattaaacttaaaagtatgggatgaggctgcacatggtggctcacgcctgtaatcccagcactttgggaggccgaggcaggtggatctccagaggtcaggagttcaagatcagcctggccaacatggtgaaacccatctctactaaaaatacaaaaattagccaggtgtggtggtgcgcacctgtaatcctagctacttgagaggctgaggcaggagaattgcttgaacccaggaggtggaggttgcagtgagctgagatcatgccactgcactccagcctgggtgacacgagtgaaactctgtctcaaacggtatgggatgaaatatttttaaaattattaattctaaaattgaattttcattaccaaaacaataaaaatgttcattatgtgtgaagagagacttttcagtctacctttttgtctttgtattttttttcagaagtgaaaatgtgttttcttaccttgggtagggggcatatttcttctttactaccccacctccacttggatacttaattgttatgaaaataattacaagctgtgattttctgagtgatctgggaattcaactaagtaaaaaccactccacttatttaatacataatgttctttaaagcgttctgaaaactatattattaactgtacattgatggtgatcattgcagttcgatgaagaattcacagctcgacaggaagctcaagcagagcttcaaaaaagagatgagaaaatcaaagaacttgaagcagaaatccagcaacttcgaacccaggtaatgaaagaagatatagactttgtgtcatgtcacaatgagtttgatggtagaaaattatcttgttatatagaaggaaaaatgtgaccagaagcagactttttggcagttttacattttcattgaaataactatacagattttatattccagggcaataaatcattttaatgcttggaaaaaaaataaagcattagttgctcaaatggccctgaatatttttaatagaatatattacacaagcaaaagtgtttttgagatgaaattttcgtgatgatttgaaaaattgggtacatgctattttctttcaaaaagaatgtagaaatagtcattaattgtaattatcccaaaagcttcttgagatctctttgaatctcaagtaaatttccacctacatttcctatggtgaaaagctcccatatatacttaaaatttcaattagggtgtctaaactttcaaactgattgtgtattctcctcaatatactttatgtcttaaattaatattaagaaattgaagatgggccaggcatggtggctcacgcctataatcccagcactttgggaggcggaagcgggcagatcacgaggtcaggagatcaagaccatcctgactaacagtgtgaaaccccgcctccactaaaaatacaaaaaaaaaaaaaaaaaaaaaaattagccgggagtggtggtgggctcctgtagtcccagctactcgggaggctgaggcaggagaatggtgtgaaaccaggaggcagaacttgcagtgagccgagatcccgccactgcactccagcctgggtgacagagcgagactccgtctgaaaaaaagaaaaaaaaaaaaaaagaagttgaagatgatgtcttaacatagtgggtgctcagtagatatttgttgattgactaggtctgtttccaccagtctagtgaacgattacttcaaaagtcaccaacaaactccataatacccaatccgggggccttttcctacccttagcctgtattacttatctctaatatttgatcatttcttttcaataaattaatctctttctctgtctgtttccctccctctctttttcttggacttctttttctacatgtttgagaacttagtttctccttattttttcatcctcaaatggtgaccttccacaatattctgtcctctgctcttttcttttttgtgtatatttttgctgtactgttccattcagtatcatacattcacatatccccttttagtaggggtcaagtctcttgagtttgtcttctagttccagctcgtgattagctacccccataggatggtcctgttgcatgttgaaatcaaacccagttttgtggttttgtctctttcctcaaaccagtttgttgtccatttcctgtttaaattttactaccaattttaaagatggtgaagctggagttttctttcccttttccctgccccacccactgacaaattaagctagtcagttttatgtctgttctttcttcaactccactcatactacacctcttcgcatcaaaccccagaaacctccaggtcccctctcttatgatgtctcgcctggactattacaattgttgcctaacttttctccctcctcaaattcatcctttatgtcagtggcaaattaatcttcctgaaacaattccctgattattgttactccagcctttaatatgttcacttgttgcctgttgcagacaggattaaataaaatctccttaccaggaatgttaagaccctctggcatgagtttttcctcctttatctcccctttgcagcctaggctctgactgctcccctaactacagcctctgttgcagctaagtcacctttcctcccttcacatttggaaattactgtctccatacttaacccttctgccagcatttcccagagattagttacagaaatggcaataggttgttcatgacgaaagcattccatagtccaataaattgagtacgcatgaaattctcatcttagagattcataatactcattagcatattaaaggtcccagatattttacactgaagaaacctgcctacctctttttcatatagatttcccatactcatttgaccacagcaccctttatctcagagcacccttcaacatctcctggaaatagtgttttcatagagcttagttgagaaatgttggcatacattattctctgtaagaaattccctcctttgctcatctgtgtgtgtgaaatgtatcctttaaggagaagctcattaagacatcttttggaaagcttcaccaaaaactccattagcgaatttctccgaactttcatatcacttttctagaccactcatgggatatttgtgtgcctgctctatttcttctgctagagcatagacaccttgaggacagtgtgtttcttattaaaggccccactgtacctagcacaggcctttaccgcacagtgagtagttgcttacttatggttaaattaactgtaaaaagtgcagaatcacgaagcattctcaactcctggcctcaagcattcctcctaccttagcctcccaaggagtagctgggattacaggtgcaggcacagggctgtatactttctagtgtgcccaaaataatgtcaaatactaaattattcatttaccatattcaatttgcaatacgatgtggtagcctaatttaattattcaattcctaattgttcatgggagggaaaggaaaggctgatatgatttgatttttaaaggctggtagcatttaatataaatatttgagattccttattaaatctgtaaaatatatatttaacttgagtaaaattttatttaaataatagcattttgtggttgtataaaattcccaaaataaatgtgatctaatagaggtgaaaaattgactgatgtttacaaatgtatattactttgaattatgttgtccattaattaaaaaatgggaaacgacacacattttgcctttcgaagtatgaaaaatatcatgtcatacacaaaatttgtaggataaattactaattttctgaacctttaattttgccacaattacttttatctcagttaagactataaaatgagactgttttccatagttttgctactttcaaagtaaaattaaaataattttacatattttaatcttgtctttctttctaacctcagagagaaaattgcattccaggagaggatggttatttgctaagtatagaaacactttagttgtatgtatgtatatacatacattaacattcatctatgtgaaaaaactagtgtgagtgaatattatgggtaacctttccatgatcttgtctacctatgagtgttagttttaatatttttgtaaataggtcagtcctttcaactggttgttccaaacatttgcttcagcttactttctaaagatatttatggctgtgcacagtggctcacgcctgtaatcccagcactttgggaggccgaggcgggcagatcacgaggtcaggagttctagaccagcctggccaacatggtgaatccccatctctactaaaaatacaaaaaattagccgggagtggtggcaggcgcctgtaatcccagctactcgggaggctggggcaggagaatagcttgaaaccggaaagcagaggttgcagtgagctgagattgtgccactgcactccagcctgggcaacaagagcaaaactctgtctcaaaaataaaataaaataaaataaaataaatgaaaaaggtatttataaattcagttagaagaactaaataatccaagtagaacatttatattaataatggtgagagggctaggcacagtggctcttgcctttaataccagcaatttaggagaccaaggtgggaggattccttgagcccaggaatttgagactgttctgggccacatagtgagaccccatcttaaaaaaaaaaaaattagcctggggtagtggtgcatgcctgtagtcccagttagtcaggagactgagatgggaggatcacttgagtcctagaggtcaaggctgcaatgcactatgattttgccactgtactccagcctgtgcaagagcgagactgtctctgaatgaatgaatgaatgggtgaggacaaaaaggacactatcccaagaaatttaattagctttttttgttgttcactgaaaatttgtttattaagttgttaatgttttacagagttcgttcaatattttatggaacttaaaatcctgagtttcccctcaataatacagatgtctgtaatacagacatttgtacaaactactacaattactgatgccttatataattagacttctataacttccatttgtcaggtaaataaaacacctctcaaagttaccacaactttaggagttcacaaattcctatttctgcagtttttcattagtatattttaaactttcataaaagaggaaaccaaaacctccaaatcaaaagccttaatatgaaccaacattgagaaacagagtaatgtaagaagctcttttattcatcacggagaacaaaaatacagaatatttttactaatttattttccactaaagagaatacactttgtatttagataaataaatgtttatttactgggagttgcttttggagaatgatccataattgccctatcaatggtcacatattgataccagggtccatctcttctcttccacattaatcttcgtacttccagctcctttatctgcagttcagccttttcagtttcagtgtgaaggatagccattgttctttcgtaattattttcaggatcatcatagaaagtatggacaatccatctcaatataggatgcttataatatgcccattgttctgggatatagccttctggaattcctactagttcagtttcaccaatgaatacattcactagagtttctccaattgccactggaatccctataaacaaaatatagaatttcagtaaattaaaaaaacacccattgtagaatccagaaggtttcatgataaatagtctttttcctatgatctccactgtgttaaacaggagtgacagctttaacaaagccacgggtgaggaagcccctgaatcccagtcgagcgtcaaggcactggccagacagctgtcactgcagtgactgaggcctgttgcaaaaaactcatggctgccttggctgccttaattagttttaaacgtttcattctgttaatctaatgtcgtatcttgattaaaacagatgtgtgttcattggtagtggtttcataagaatgtttataatgaacagctctacttttcatatatatttatctagcaaagtgagccattgtgatcagtactggtttaaggaaatggatatagattaatcatctctaaaaagaacatgatatggattgcagtgttccctttcatctgttatccattgtcattagagaatgagcttgaagttactttctgatagaaatgttatatcctcctcataatcctatctatttgaattaattgtcctcattgtaaatggcacccattcatgaaaagacagtcttttatattgggatgaggatggtattagatgtaagaagaaccacattgaaattctaatcatgttcagactctgaaacttttggttagtcatttaactttttctgcagctaacagtttcctcatctttaagcagtgaaataaaggtgagataataatgccctatctgtattacagggttataataaggatcaaaagaaataataaatgtaaaaatgttgataagcatatattactatggaaatggatgctatttagtatttattattggtgttagaagccagctaagttactagagccatgaaacagactctttgtatgaagctaattagcccccaagggaatttaatccataaccttgtatttattatcccatattcaaaccaactaatctaactggcccaagccatacactgtacttcttttgtacatatatttataaagaaagttaatttttcattattttagaggagtatttcacaaaatctttgaggatactgtattagtccgttctcacactgctatgaagaaatacctgagactgggtaatttataaagggaagaggtttaattgacttgcagttttgcagagctggcgaggcctcaggaaacttacaatcatggtggaaggggaagcaaacacatccttcttcacatggcagcagcaaggagaagtgccaagcaaaaggggaaaagcctcttaaaaaaccatcagatcttcggagaactcagaattatcaattattcattattcattattcaattatctccccctggtcccgcccttgacacgtggggattattacaattcaaggtgagatttagatggcgatgcagagctaaaccatatcattccacccttagcccttcccaaatctcatgtcctcacatttcaaaacacaatcatgcccttccaacagttccccaaagtcttaactcattccagcattaacccaaaagtccaagtccaaagtctcatctgagacaagttatgttccttctgcctatgagcctgtaaaatcaaaagctagtcacttcctagatacaatggggatacaggcattgggtaaatacacccatttcaaatgggaaaaattggccaaaacaaagggactgcaggccccatgcaagtctaaaatccaatagggcagtcattaaacctcagagttccgaaatgatctcctttgactccatgtctcatatccaagacatgctgatgcaagaggtgggtttccacaaccttgggcagctttgcccctgtggctttgcagggtgcagcctccctgctgattgctttcacaagttggtgttgcgtgtttgtggcttttccaggtgcatggtgcaagccatcagtagatctgtcattctggggtctggaggatggtggccctcttctcacagctccactaggcaatgccccagtggggactctgtgtgggggctccaaccccacatttcccttctgcactgccctagcagagattctccataagggctccacccctgcagcaaacttctgcctggacatccaggcgttttcatacatcctctaaaatccaggcagaggttcccaaacctcagttcttcacttctgtgtacctgcaggctcaacaccgcttggaagttgccaaagcttggggcttgcaccctctaaggctatgtcttgaaatgtaccatgactccttttatccatggctgaagtggctaggatgcagggcaccaaagagactgcacacagcgggagggccctggacctggcacaggaaactatttttctctcctaggcctccaggcctgtgataggaggggctgccatgaaagtctctgacatgccctggagacattttcctcattgtcttggtgattagcatttggctcctcatcacctatgcaaatttctgcagagggcttgaatttctccccagaaaacggatttttctttactactgcattgtcagtctgcaaatgtttttaaacttttatgctctcttcctcttgaacgctttgccacttagaaattttttctgccagataccctaaatcatctctctcaagttcacagttccacagatctttagggcagacaaaatgccaccagtctctttgcattgcaagagtgacctttattccagttcccaacaagtttcacatctccatctgagaccacctcatcctggactttattgtttatatcattatcagcattttggttaaagccattcaacaagtctctaggaagttccaaactttcccacattttcctgtctacttctgagccctccaaactattccaacctctgcctgttacccagttctaaagttgcttccacatttttgggttgcttccacatttttgcatatctttacagaagcacccaactatccggtgccaatttactgtattgttgttctcacacaactatgaagaaatacctgagactgggtaactttttttttattttattatttctttgagacggagtctcgctctgtcaccaaggctggagtgcagtggcgtgagctcagctcactgcaacctctgcctcctgggttaaaacgattctcctgcctcagcctctcgagtagccgggattacaggcacgtgtcaccatccccagctaatttttgtatttttagtagagacagggtttcgccatgttggccaggctggtcttgaactcctgacctcaggtaattcacctgcctcggtctcccaaagtgttaggattacaggcgtgagccaccgcacctggctgagactaggtaatttataaaggaaagaggtttaatttactcagttctgcagggttggggaggcctcaggaaacttccaatcatggccaaaggggaagcaaaacacatccttcttcacatcgcagtagcaaggagaagggccaagcaaaaagggaaaatccccgtataaaaccttcaggtcttgtgagagcttgctcatgatcacgatttgggtgggaacacagagccaaaccctatcagataccaactttcctagcatttgtgtgttaacagaagtagtcactgtccagaatttataatgcttataaaaaatctacacaggcctttttcatatactgttaaacccttagatcttgctaaatatttagatattttagtaatatctaaaaaagtatatatgatcttaaaacataagataaataaactacaaatatctattgatatatatttcttcagttttttcaattatattttataagcatttaaacttggattatttatatttcaggcacaagtactctcaagttcatcaggaattccaggtcctcctgcagcacctccattgccaggtgtagggccgcctccaccaccacccgcgccacctctacccggaggagctcctcttcctcctccaccacctcctttacctggaatgatggggataccaccaccacccccaccaccacttttatttgggggacctcctccaccaccaccccttggaggagttcctcctcccccaggaatatcacttaatctaccttatggaatgaagcagaaaaaaatgtataaacctgaagtgtccatgaagagaatcaattggtcaaaggtaatactaaaactagagtttttttactttgtctagcttttgttgatcattgctatgtgtacacattgtataatgtttgagagtatgactgctgactctttccgttcctttgtgggttcatcattttatgtccatctttcaatttaggttgtagataattggaaactctccagatagtttgacattgtgaagcaggcaaaaggaaaatcgaagtgatgtagagaataatatttgaaatataccaacaaatgacaagcaattttgattcttttaacatagcttttctttaaaaattttttattgatatgtaatatttgtacgtatttatggggtacatatgatttttgctacatgcatagaatgtgtaatgatcaagtcagggtatttaggatacccatcacctttaacatttgtcatttgtttgtgttgagaacattcagatcttctcttctagttattttgaaatatacaacatattgttaactatggtcactttactgtgctatcaaatggtagaacttattccttttatctaactatatgttcatacccattaacctatctctcttcaccctcccacctcccacacacacccttcccagtctctggtaactatcattctattctctaccttcatgatactcactttttaagctcctatatatgagtgagaatatatgatatttgtttttctgtgtccagcttttttcacttaacatagtgatctccaattccatacatattgctgcaaatgacaggatttcagtcttttttatagttgaatggtattccattatgtctcaatactatattttctttatccattcatccgttgatggacacttagcttgatttcatatcttgatttcatatctttgccattgtgcctagtgctgcaataaacatgagggtgcaggtatctctttgatatactgatttcctttcctttgtataaatactcagtggtcagattacagcattattgtatggtaatcctgttatttaggagcattattgtatggtaatcctattatttatatttttgagaaatctttatagtgttttccataatggctgtactatttacattcctaataacagtatatgaaagttcccttttctccacatctttgccagcattttgtctttttgataatagctattctaactggcataagatgccagtaagatacctcactgtggtcttgatttgtatttccctggtgattaatgatgttgagcacattttcatatatcttggccatttgtttgtcttcttttgagaaatgtctacttaaattatttgtctactctttaatgtgattatttgttttgttgctattgtttgggtttcttgtattttttggatattagtccattgttggatagtttgcagatattttttcccattcaacagattgtctctttactctgttaattgttcccttttctatgcggaagcgttttagtttaatataatctcacttacccatttttgtttttgtttcctgtgcttttcaggtcttagccacaaaatctttgcctatattagtgtcctggagcatttgtcttgttttcttctagtagttttatagtctcaggtcttatgcttaagtctttaatcaatgttgagtccatttttatatattgtgggagatataggtcaggtttaattcttttgcaaatggatgtccagttttcctatcatcatttattgaagagggtgtcctttccccattgcatgttcttggtacatttgtgccaaatctgttagctgtaaatatatggatttacttctgggttctctattctattccattggtgtatatatctctttttacattagtaccatgctgttttgactactatagccttgtagtatattttgaagtcaatgtcctgctttgatctttttgctcaggattgctttggctattcaggctcttgtgtggttccatatgaattttaggattatttttcctattttttgtgaaaaaatgttaatggtattttgatagggattgcattgaatctgtagattgctttgagttgtatggtcgttttaacagtgtaaattcctttattctatgagcattgtctctttccatttgtttgtgtcctctttaatttctttcatcagtgttttgtagtttttcttataaaggtcttttacttctttggttaaatttattcctaggttttttatttttttgtagctattgtaaatgagattgcctttttatttttttttccagcaagtttattgttcagctatagaaacattaataaattttgtgtgttgattttgtatcctccaacttactgaatttattaattatatgagttttttgtggggtgtttaggtatctccaaatgtcagatcatgttgtctgcaaagagggacaatttgatgttgtcttttccaatttggatgtcctttatttctttgcttgactgatggctctggctaggacttccagtactatgttgaataggaatggtgaaagtgagcatcctagtcttgttccaattcttagaggaaaggctttcatgttttgtccattcagtatgatgttagcaatggctttgtcatatatggcatttattatatggaagtatgttccctctctgcctaattgttgagagtttttattgtgaagggatgttacattttatcaaatgctttttctacatctgttgagataattatatagttttcatttttcattcttttgctgtgatgtatcacgtttattgaatggcatatgttaaacaatcctggcattcatggggtatatcccattgattatgatgtattatcttttggatgtgctgttggattcagttccctagtattttgttgaggatgtttatgcctgtgttcatctgggatattctttaattgttgtgtccttgtttggttttcgtattggggtaatgctggcctcgtaggatgagttaggaagaatttcctgctctttagttttttggaatagtttgacaagaattggtgttagttcttttttacaagtttggaagaattcattagtaaagtcattagtcctggggcttttctttactggggggactttcttggtagattgtatgtgtccagtaatttatccatttcctctggcttttcagcttgttaatgtatagttgtccatagtagtctctgatatcttttgtatttctgtgctatcagttgtaaggtctcctcttccatttctgattctgtttatttaggtctttctttttttttttttcttttcttggataatccagctagtggtttatcagttttatcttttcaaaaaaaaaaaacctaactttttgttttgttgctcttttgtattatatttttaatctctgtctggctcagttctgctctgatctttattatttttttccttctactgatttggggtttggtttgttcttgcttttttagttccttcaggtgcaaaattaaactgtttatttgacatctttccattttttcgaagtagttgtttattgctatgaacatccctcttagcattgctttccacaggttttgatatattgtttttttaattttcacttacattaatacattttttaatttttttcttaattttttaattgacccagtggtcattcaggagcatgttctttaagtctatgtacttgcatagtttctgaaatctctcttattattgatgtctaattttatcccattgtggtctgagaagatactcgatatgattttgatttttaaaaatttgttgagacttggtttttatagtagcatatgatctatccttgagaatgtttcttatgctgatgggaagagtgtttattctgcagctgttggataaaatgttctgtaaatgtcttttaggcctgtttgttctaaagtgcagtttaaatccaatgtttatttgttgattttctgcctagatgatctgtctaatgctgggagtagggtgttgaagtccccaactattactatgttagagtgtacctttccctttagatctaataatattttctttgtatatctgggtgctccagtgttgggtacatatatattttgacatgttacatcctcttgctaaagtgatgcctttctatatatatatacatatatatatacatatatatatatacatatatatatacatatatatatacacatatatatatacatatatatatatacacatatatatatacacatatatatatacacatatatatacacatatatatacacatatatatatacacatatatatacatatatatatacatatatacacacacatatatatatacatatatatatacacacacacacacacacatatatatatatatatatatatatatacctactttgtctctttttactatttttgacttaacatctgtttgatctgatatacgtatatttactcctcacttttggttaccatttgcaatttaatatcttctattttcagcctatgtgtgtcttgcaggtgaaatatgtttcttgttggaagcatatagttgggtcatgttttttagtacattcagccagtctatatcttctaagtgggcaatttaattggtttacattcaagtttattattgataggtgaggagttattcctgtcattttgttaattgttttctgttcattttgtgtatccgttgtttttttctttctttgttattgtttatccatgtggtttagtagttttctgtagtgttaacatttgagtcctttctctttctcatttgtgtatctgctctacatgtgagttttatactttcatgtgctttcatgatatattctctttcagacacgtaggacttccttaagcatttcttgtagggcttgtctagtggtgatgaattccctcagtttttgcgtgtttgggaaagacattatgtatttctccttcatttttgagggatagatttgttgggtatatacaactggcttctttttttctttttttcttttggcactttaaatatagtgtcccattctctcttggcctgtagcctctccaatatgctgcaccacgtgttcctgggatgtaggacaccttgtgggctagagtgctgggacctggtctcattgctggatctagccagtatcacaccactgcagtcatctgggtggatgtggggagatttcagtgggctccaaggatgtggagatagagtatcattcatccccagggcaggatgtagtctggttgggtttgggctctcaatctgttaccatactgcacctgctttggtcttggtggcatgtgtgggatccagtgtgaatgctcattctagagcaatgccattgcacacactgcagctcgctttgtatactaaagactagtttcagggcctgtggaggctgagtggctctcctatggctagaatcttcagagttcacagtgggaatctggaccactggggatatgttatttacccttttcccacattgggggagcgtctctgggctcccagctaatcacagccaggcttgctgcctggattcccgctccttccgtgcctcaggtgttttctgtaacttccctgccaaattccagtgtttttacatgttgtgattatctactctcttttttggccttttatggaggatatgagtgccacctgcctccagtcagctgaagcctattccccatttttcttgaataaaatcctttttattattgagcctttttatcttacttgtttttcttagtgaatgactttttttttaattttacactttcaaatagtgtggaataagtgacaatattcaatattgatataccttaattttttttgatgtatgaaaatactttcttctgaatgttgtttggctttattattattagaaaataatatgtctgttttaaaaggttattatgtagattgacacagtcctcattcactgggaactaattttctaatgaaaatccatttacccagacaaccatctggggaaatgtgtcatccaataacatatttacagtattagacagcatctatgtagtaagttggtttaaacagaatgatggttaaatcatttttcaatcttatgcatatatttatgctttgctcataagagtaaacttggagtaaatggttttagaatgtagttttctttttaaaaaattaagtacaattcatcaaaattcaagattacaaagctgttgcctagttatcttcctgtgttaatgtagtcgtatgcttcctaattttacaatttagtatacggtgtaatggtagttatacatcacaaaacttcatggtgtattggaagataaagttctaatcttgggtagtagttaagaccacagtcctctggagcacttatctaggtttaaaatcccagctctgccatttactaatttgggcagccacttaaactttcttgggctgtgtttcctcatcttttaatgtagagataataacaggtgaaaaaattattacgaggattaaattagttaatatatgcaaataacttaagacagtacctgacacaacgtaggaggcgtgtgtcagctatcattatggttgctaccttaaacctaatgagtgaacaaggggaattcacttttctaagtctgagtttccctgttttaaaaaacccaggaacaagaagattttatgtgagttggggttaggatttcctaagttatttttaagactccttccagtagaatagtttttaaggtgcaatttgctttgtggtctatttctattgttcaccatttcgtcacataattctgaatttcccaatgaatatttactttataagtattatttagatacatcctgaaattgacttagaggatagaggaataaaggaactgtcattcaaccttgctgaaagttagttccttgaaaatttaaatatgaggttataatttagaatctattctttgttatttttgtttcagattgaacccacagaattatctgagaactgtttctggttaagagtcaaagaagacaagtttgagaatccagatctctttgccaaattggcattgaattttgctactcagataaaaggtacatttttaaaaataaaatataagttcccgattcaggtacaatttaatttagtgctttgctaaaaatttctagtaatgggtatatgtatacttttcccacactggacagggtgaaacataaatagattgacatttaactatattttacctagtaaataaagaaggaaatttattttacctttgaattttattatacataaatgttattattcttctgaaaatacaggttttatttttattgttaaatatgtgtgttgcactgctccattataaaatagtcgtttttactgagaagcagggaagatgaatccgttgattcatcatgtaagagaaaataatgtaagagaacactaaagtctcagaatttttcatgaaattgaaataagattggtcccatagtcttaaatagtctttcctgtcatgcttgtattacttatcaatttggattcctaggaaatgttatagtttttgctataattagatattttctattaatatcaaaatccagtaccttataagtattgtttactgatttgataatagagtgctttgtttatgattagatcctttatttatttgcttgtgaatttcacagatgattttgttactatacaggtagcttctcaatctcataatagatcgttatggttcattaatttttggtattttatttcaacatgattatttcactaattattgtagaagtgatagtttagttgaggatattactttttgtctgaatgagtccttgcagttgaaaaatggaaataatccatactctcatgcccttggaattagcacctttatcattcatttgtctgatttgtcacattatgccttagaatatgagaatataaattttggaagatagagaggtgtgaaaattagtttcttttttttagattatgtacactggagattgttgtgctgtatttgttgttctttgtaaattgaagttcatatgcacacacaaatctggggtgattagactattctgaagaattttgacatttaaaaaaagttactactattaggcctacctttcttttttctcatttgatatcgcagacctcacatttaaagaatttttcaatgattcaagtgattgccatttattataatcactgtttaacgttaaaaaattgcttgtagcaaagtgttcatgcttatagcaaattattcatatagtaaaataaggtagtttaacaaatgtaaatctcccttcaatctcagacttacagcattttgcccagataaaatcattaattctaatttttcacattttctcctagaaatagtctatgcctctcaacacatatgtgcatttatcattttttgttttttattccttgctgttttcaccaactgtgcctaaagattattctgtaggtgcttgtgtttatctactgtgttctttttacatactgcatagaattttgtgtatgggcctatcttaatttaattaatcccatatcaatggctatttagattagttctagtcttttgcttgtttaagaaatgctgtggtgaacatgactccatatatgctgtttttcacaaattctacaagtaaaattcctggataaaatgctgtgtacatttacaaattttaaagatagtatgaaattacattctgatgagtttgtatcagtttataatgtcacaaagaatatatatgaatatctgttttcccaaaatctttgcccacctcagaggtgaaaatggtaaatcattgttgttataatttttgctttttgaatatggagtgagattgagcacattttcttatattcacaggcaattttattttactttcattttaaaaaataattttaactcttattctgtattcagggggtacatgtgcaggattgttacatgggtatgttgcatgattctgaggtttgggacgcaaatgatcccatcatccaggtagcaatgagcatagtacttgaccattagttttttaatccttgccctcttccctccctctgttctctattagcccccagtgtctattcccatctttgtgtccaagaatacccagtatttagctcccacttataagtgagaacatgcagtatttaattttctgttcctgcattaatttgcttaggataatggcctccagctgcatccatgttactgcaaaggatatcattttttatttttatatttatttatttattcattcattcattcattcattcattcatttattcattttgagacagagtttcggtcttgttgcccaggctggagtgcaatggcgcgatcttggctcactgcaacctccgcctcccgagttcaagcaattctcctacctcagcttcccgagtatctgggattacaggcgcccaccacccttagctaatttttgtatttttagtagagactgggtttcaccttgttggccaggctagtctcaaactcctggcctcaggtaatccacccgcctcgacctcccaaagtgctaggattacaggcgtgacccaccatgcctggccaggatatgatttttttttaattacggctgcatagtattccatggtgtatatgtaccacattttctttatccagtccattgttgatgggcacctaggttgattccttgtcttcgctattgtaaacagtgctgtgatgcacataaaagtgcatgtgtcttttgggggaaatgatttcttttcttttggatttgaacctagtaatgtgattgctgagtagaatggtagttctgttttaagttatttgagaagtctccgaactgctttctatagtggctgaactaatttacattcttaccaacagtatataagtgttctgttttctccacagccttgccagcatctgtttgggttttttttttggctttttagtaatagccatgctgattcgtgtgagatggtatcttgttgtggtttcaatttttcatttccctgatgattagtgttatgagcattttttcatgtttgtcagcctcttgtatgtctttttatttttattttatttatttatttatttattttgtgacagagtttcgctcttgctgcccaggctggaatgcgatggtgcaatctcagctcactgcaatctccgcctcctgggttcaagtgattctcctgcctcagactccccagtagctgggattacaggtgcccgccaccatgcccagctaatttttgtatttttagtagagacgagttttcaccatgttggccaggctggtctcgaactcccgacctcaggtgatccacctgcctcagccttccaaagtgctgggattacaggcatgagccaccatgcctggcccatatgtcttcttttgagaagtgtctgttcatgttctttgcccactttttaatggggttatttgtttttttggttgttgatttctttaagttccttatagattctgggtattagacctttgtcagatgcatagtttgtgaatattttcttccattgtgcaggttgtctgtttatcctgttaatagtttattttgttgtgcagaagctctttagtttaattaagttcgattcatcaatttttgttacagttgcttttgagaacttagtcatgagttatttcccaaggcagatgtccagaatggtgtttcctaggttttcttataggattttcatagtttgaggtcttacatttaattctttaatccattttgactttttgtgtatggtaaaagagaggctttcggttttgttcttctgcatatggctagccagctatcacagtgccatttattgaataggtagtcctttctccattgtttatttttgtttgactttgtcaaaattcagatggctgtaggtgtgcagctttatttcttggttctcttagtctgttccattggtctatgtgtctatttttgtaccagtaccatgctgttttggttacggtagccttgtaatatagtttgaaggcaggtaatgtgatgcctctggctttctgcttttcgcttaggattgctttggctatttgggctcttttctgattccatgtgaattttagaatagttttttttttctaagcctgtgaaaaatgacattggtagtttggtaggaatagtattgaatctgtaaattgctttgggcagtatgacctttttaatgatattgactcatccaatttatgagcatgagatgttcttccatttgtttgtgtcattcattatttcttttagtagttttttgtggctctccttgtagagatctttcaccttcttgattagatgtgtatgcctaggtatttcatttttttttttttggcctattgtaaatgatattgtgttcttgttttggctctcagcttgagagttattagtatgtagaaatgacactagcttttgtaagttgagtttgtattttgaaactttactgaaattttttatgtgttccaggaaccttttggcagagtctttagtgctttctaggtataggatcatatcgtctgtgaggagaaatagtttgacatcttttcctatttggatatcttttatttctttctcttgcctgattactcatccaagggcttccagtactatgtttaataggaacgatgagagagggcatccttgtcttattccagttctcaaggggagtgcttccagctttcctccattcagtatgatgttggctgtgggcttgtcatagatagctcttattattttgaggtgtacctagtttcttgtggatttttatcgtgaagggatgctggatcttattgatggctttttccatgtctatggagatgatcatatggtttttgtttttaattctgtttatgtgatgaatcacacttatttatagatgttgataaacattgaatcccagaaataaagcctacttgatcttgccagagtaactttctgatgttgtgcttgatttggtttgctggtattttgttgagaatttttgtgtctatgttcattagagatagtggcctgcagttttcatgttctgttgtttctttgccaggttttgctatcagggtgatgctggcttcatagacttatggaggagtccctactcttcaatgttttgaaacagtttcagtagaattggtaccagctcttctttctatgtctggtagacttcagctgtgaaactgtctgttctgggtgttgttgtttgtttgtttgtttgtttgtttttgtcatttttttttaatttaaattactgatttaattgtggaactcaatatttgtctgttccgggtttcagcttcttcccgattcaatcttgggaggttgtgtgtttccaggaatttatctatctcctctatattttgtagttggtttgcacagaagtatacataacagtctctgaggatcttttgtttttctgcaggatcatttgtaatgtcacctttgttgtttcttattgtgcttatttggatggcctctttttttcttttttaatctaggtagcggtccatttatcttgtttatgcattcaaagaatcaacttttggtttagttaattctttgtgtggatttttgggtatcaatgtcattccgttcttctctggttttattcatttcctatgctagcttttgcattgatttgctcttgtttttctgcttcctctaggtgtgaagctagatctttaatttgagatttttctaactttttcaggtaggcctatagtgctattaacttcccttttaatactgcttttgctgcatcctcaagattttggtatgttgtgtctcttttcatttattccaaaaaaatttttattttctgtaaaggcataaaatttctttttctgtaaacttccccctccatttctttgcatattttctattgagcatttacgcttttgattatggacttatttgaattgaatgctacaagaatcatagattttataaaattttagagttagtctggatcttagaagttattaaacacagactctttgttttaccaatgaagaaactgaagtaagagacaatgaggtaagtgtaaaacccattaaagatagcgtggtatagtaggaaaagccagaggaaataaattcacacatacttgcattccagctgtgatacttgtaacctcggagactgaattttctcatacataaaatgaataggctaatgtttacctggtagtattgtgagaattaaacaaggttatatatttaaagcactcagcacattggtatccctttcatttaacttgatgctctgtgtgtgtgtgtatgtgtgtgtgtgtgggtgtgggtgtatgtgtgtgtgtgtcttagttattgatgcttcagtacaactgttaattcagcaaaatttactgctcttcttttcagcacttggtagagctaatcagtcagaattgaagcaattcttactgcagctgccaaaacctaatcaaaccaaatcaaaaccaaacaaaattcatacaaaacctctcatgtatgtattgctgagaatgctttattttcattcctcttaacgttgattctttgaattttctctttcacgctactatgacttccctaattgtggatatttaagtagaaatctggacagtatcacctttcagaaccattacttttactaaaatttacttctgaaaggacatatacaggatcaattatgcatcatagcctatttcagacatgcacaccatagctaaaacaaattttaatgatactaaactgccattcttttgtaacacacagtaactattgattgatgttactgtaactgctgaagttccttgtcattcgcagtgccttgattcatactgtggtcaataggtggcaggtttagtaagaaatcagcaggagggtctgctttcatgaaacttaaacttcaccgcctgggttttcttttctctagggcacctttttcccccggtttgctgttcgttgcagctcactcagctgcattctggaaggagcatcattcctgtttttgctaatagctgtttcaaaacctcttagaccagtgttctaaaacctctgattatttttcactactgcaagaacataggagagctcatgcctctgtcctcactacgtgtactgtaaagcactacaagtctatttttcaggaacttgtttaagagctaaataggagctttaaaacacactagttctcatatctataatatttaaatgtttaaatatttaatatgtgaaagtagcataaaattatacttcctatttaaattagttttagagaaaattatttttaatgttttatttaaaaacagattatttctgttgtaggaaagaatggatgtcttgtttcatttaggttaagtttgtagagtatctattatgtgtgaggttctatactaaatgggagggaaagaaatgaataagatcttgtccaggcaccagggaactcacaatctactgagagaggtaggaggatgcccagtatacttagtcaagttgtagtaaatgttagagtagatactttttaaaaagctactggggtacaaaaacaaataattaattttgagtagggtcaatggagatcctagaggtagtataattagagttgggacttgaaattttaatagaatttctatagggaaagaaggaaggaaagacggcattctagctagagaataccatcagtaaaatgttaaaagaaaaacttgagacaaatcaaattttacagaattcatttgagcaaggaatcattcattaattggtcagcattcagaaccagcaggatttcagtgtgagcatcaacctttcatagtatgaacatgggaacaaagtagaaaagtcatctaattgtctacggatagtcatttatctcatttgggcgtggtgtgatgagacatttgccttgtctgggaataggctcatccattggctgcctacagttggctgaagtttcgctatttgtgattggctgaagctcagctgtttaaaatatacagttggcgtctcatctctgtgtaggcctctgcacccatggattcaaccagccatggacagaaaatatttgaaaaaaattaaaaatataatacgctgagcgtcgtgactcatgcctataatctcagcactttgggaggccaaggtgggaggatcatttggactcaggactttgagaccagcctgggcaacatagtgagaccccatctctgcaaaaagtacaaaaattaactgggtgtggtgatatgcacctggagtcccagttacttgagagactgaagtgggagggtcacgtgaacctgggaagttgaggctgcagtgagccgtgatcgtgctcctgcactccagccaggatggcagagtctcaaaagaaagaaatgtaaaaaatacagtataacaactatttacatagtatttacattaatagcagaaactgcaattccttttgcatcaacataatatttaggtattataactaatctagagatgatttaaagtatatagggggatgtgcatagcttctatatgaatactatgccattttatagcaggcatttgaatatttgcttttttttttttttttttttttttgagatagagtttcgctcttgttgcccaggctggagtgcaatggcgtgatctcagctcacctcaacctccacctcacgggttcaagtgattctcctgcctcagcctcctgagtagctgggattacaggcatgtgccatcacgcccgactaattttgtatttttagtagagacggggtttctccatgttggtcaggctggtctcgaactcccgacctcaggtgatccgccctcctcatcctcccaaagtgctgggattacaggcgtgtgccaccgcacccagccaaatatttgtatattttggtatctgcaagggctcctggaaccaatcctcagttgatactaagggatgactatactctttctttaggtttccatttgttaagttggaatgtaaagtttggagacagtcttgggccaatgatctgctgttcatttaatttattaataaggaggggtgaaatgcatactgccttgaaggcacgggcagtcagccttgggtcaggactctggaatgaagagactttgtggcgtaggtggcaaggaaacttcacgctgaagaattagggttttattctttaagcattagtgatttagtaatttggtgattagcccttgaataggctttttgtggacagataggtgatgggaatatatggataggtgatgggaatatatggataggtgatagatcattgattgtgagtaaatatcagtagactaggtaagatatgatgatatcctgactagtatgaattcttaatctgcatctctaaggtctattctagttcccaaatcttgtaccttcatgcttatgacatttacgttctactcacaagccataataatgtcatattacaaaatatgtttcaaaatactctctgaattcatgaaatatatatgttagaaacagctggagaatatcctgttagtagctttgaatatgtatcatatatgtaagtgttggaatttgtatatatgttctagttttgtttattattcaatttgatgatatttgggggcatagaatcatcaaggctagaatggtagtgtcactctcctttaaaaactatagtaattatagacaataatgatattatataagatttaaagtaatgatggttgatattaactaaatttgaaataataataaaatatgtagcttataactgctaattctaattagaatttctagggttctctagaggcttcaggaagaacaaagatagtgtgggtagaagttgtaagcaatttctttgcttttaatgttgcttggaggaaatacaagaaataaacataagagcttaataaaatttagcttctttaataatatatttctatagtgaaatttagctttaataataacagaaaattgaggtgttataaatatttgaaatgcatataaatgtcattttgcagtgcttgaaatattggacatagcttcaaccttatggtgtaactgagattgaagttgtgtgtatgtaaaagcactttttctttaggatcatattttaatgtgtgtttcttagtctaagaatcaactggctgcttctgaagacacccacccttgcttggttgctcaatacagtcttctatatttagtgaactaatgaaaagacaaaagagtggtaaagtgtaattcatctttgccttcataatatagaaattcttgcaattgacttgaaattaatgagatgtcagtctcagagtgcacagcccttgtaagatggtgctaacgtgtccagagagagttcgtgtcctaacaaataatttgtcatcttaatggcacaacatgcatccttctgtagtataagctttaatgtatatggtaacaaaccaggaaggcttaattctttcaggcagcaaactaaaaaccatacttaactatcttagtgtgtttgggctgctatcacaaaataccataaattgggtagcttataaacaacagaaatttatttctcacgcttctggagactaagaatccaagatcaaaatactggtatatttggtgtcttttgagggcctactttctggattatggagggtagcttctttctgtaacttcacatggtggaagtggtgagctgtctttctgaagtctttgttttaagggcactaatacaatcatgaaggctctgccctcgtgacataatcacttctcataggccccacctcctgataccatcaccttgtgtgtaggttggaacatatgaatttaagggggacataaaccttcagtccattgcaatacctgtacataatttcttttctttccctccctccctccttccctctctccctccctccctccctcccttccttccttcttttccactctgtaacccaggctggagtgcactggcatgattacaactcactgcggcctcgacctcccagggtcatgtgatcctccaacctcagcctccctggtagctgggactataagtgtgcaccacgatacctggctaattttttgtattttttgtagaaatagggtttcaccaggaggcggagcttgcagtgagccaagatcacgccgctgcactccagcctgggcgacagagcgagactccatctcaaagaaaaaaaaaaacaagaaataggatttcaccatgttgcccagggtgatctcaaacttctgggctcaagcaatccacctgcctcggcctcccaaagtgctaggaatacaggtgtaagccactgtgtccagcccataatttcatcattttaattatatctaaagttttttggatttctaaatataaataattgtttttgtatatcactttaccaaagtgttttttttttcattatggacattttaagtgtttcaacttatgatgacacacattaatttccagttgtcattttctagcattaatcacctattttatgtaaaagaaggaacaagggatgtttcagccagagatacatgacgttgtttaagtataagtcaccaattgtagagagaaagagagtatcttctgccttctaagcaaatagacttcaaaatagctccgtctttacatattgacaatatgtggtgagtgtactacttctattaatataataccatctctacaacatctagtaacagcaataatagtaataattataattaaaacaataataaatttattaaacattatatcccaagagcgattataattattttaaattcatatcataccaacctcataccaaccctaggtacttgtattgttgttttgtcggttaagaaactgagactctgggagattaagcaatattttgtttacatatctagtaagtggcaaaatggtgatttgagcccaagtttgttcttaatcttaatcacttctgtatgctgtaacaatgacttttaatggcttctatgcccttagtaatttgtgcattttgttgcactgttaactgatccctttttcatatggttaatcatatagttccacatatattgtattatcttgtgaaatatgtaatcctattatcctggcactaaagatagttcttcagagctcaaaccaaaactaggaagctgtacgttatccatggaaagaaataaggttctttctataatttagatttttttaggcattttctatgtagaatctgtcagtggtaaaacgttgccgtgacttgaagtctgtcttttctaataatgagggaaggaatgtggtcttcatgtcattaggcatttggtaatgatatattaatatagttgagatgcataaagtaatgaaatcaatttttcactttgactcttttgaaggtagcttcataacattacagacaccttgtgttattttaatatgacacttttagctatgagttaatgagactgcctttccccatttcagtgatttttgctgataaatatatagattaagcacaataacaagtgttctgttaatagcatttctaagtcatatagcttctcattcatatttggaatcattattctaagttaattagttttttttcttttttttttttaaacaaagtgttgctctgttgcccaggctggagtgcagtggcataatcttggctcagtgcaacctctgcctcccgggttcaagcagttctcctgcctcacccacccaagtagctgggattataggtgcacaccaccatgcctggctaatttttgtatttttagtagagacggcatttcgccatgttggccaggctggtctcaaattcctgacctcaggtaatccacccaccttagcctcccaaggtgctgggattacaggcgtgagccaccgcgcctggccagtagattagttttatattggcaaatagaaattatttacattgaaatccagtgggaaattgtaacattgctgtataaaactacaaagaggtgtgctttgttcttactggatattaatggcagttaaactagttccagagtatatcttgcatgatataagaagaataagagatttgtctgatttaagaaattaatttagagaggttcaaatctggtagcttttctgaagcattctatacaggtaatcttccatttagtcaattaatccttgttggtgagaaaaatttaatgcattcttttcaaaccgtatttcagtaatttgtgttcattactcagttttgcctaatttaaggatagccccatttatattattattattattatcattattacagtaatcactaatgttctttttagaacaatgcttatcatcttgtaaagtaggtgtgctgattgagcaagctaaattttgttattaggtgtctggcaaacacctaatgggagatgtcccaggaaattcaaaattataacagaaaaatatctcgtctattttaatgcatgcttctaggaatacagctgcacttgaaaacagattcacattttgtgtatgactattatgttgaaagaactttaactttttattttattgttgtgaataatattaattattaattattaataaatattaatattaattatggctgcataacccaatatccccaaatttagcaattaatagaacactcatttattttctcacagattcaggaatcttggcagatctcagctcagtcctctgtttcaaagttcctcacaaggctgcatagaagatgttgtcagggttgtggtcctgtgtgaaggcttgactggtgaatgatttgttcctaagctcattcatatgattggcaggattcagttcctccagagtgattggactgagggccttcattcttggatgtttgttgtccagaacccacccttggttccttgatcatggacctctcagtagggcagctcataaaagtccatttgcttcatcagagtgaaagccaaggagtgaagacaaagaatgaaagcaagtcattcataaggaagtcacagtcttttatagcctaatttcgtcattaataacatgtaactaggttcaacccttacacactgataggggaattactcaagggcatgactaccaggatgcaggaaacatttgggagtcatttaagaagctgcatactcacatggatatatacaatttgattttaacaaatgttatgatatctctttctttgatgacttcaacagaatcctaattggtctttctgccttctctcctgttttgtgataatcatggcattcccatgtttggaacatttcactgactacctcttcaggaggagattgaaactccttgtcatgtgtttcaaggttatttaccttttcactcccactaaaatgtacttagactgaactcctttgttcctggaacagagacacttaaaagacttggagacttctccctgaacacagtttaatttaaccaattcttcatttggcttgtatttagatgacacttccatcagaatgcagccttcacaatttactatcgtcttgactcattcacctccctcattagacactgagcttgcaggaaggaggaagcatttctgtttactattgttttctcgcatgtaccacagcttctggcaaatataagtatgtaacacacaaatgagttacagttatatatacttagtttcattgcactaagacaagtacaataaggtatgagtactaacccataattatttagtcacatagtaatgaaacaggaaattttcccagactccttcactggcggaaactggaatgagggcactggagctagccagctgttttggctggctgcaattgcttggatctgctgcactccacaccttgcaggagggggagcacagctgagttggtgcaggagccagggtgagtgcttctgagtgtcagcagaagcaaaactctggtgcgggccctgcagcagcatctagaggggagtacccacaacccccgaagccccagaaggagtgttacaggcaaagcgcttatagccatctgcagatggcttaagtgtttaacagctcagtggaccctgttccttttcacgagggcagagagtcagtgtaacagtcttctgtaacctgaactcttgtctggcatccaggaaaaatcagttcacacaattgaatttaaggatagtaaatgtaggggatgttattgccaatggaagtggctcttagccggaaggaaagctgggaaagggatggagcaggaaggtatttgtcccctgaagtccagctgtttccagctggactcttttctaaagtcctgccaatcaagccgtccctctgaagtcaagctgcttctctccaacgttcagctgcttcttctcatctccctttctctgctctcagccagtggaacctagggtttttatgggtacaggatggggggcagggtgggtcagagttggttttgggaaaagcaacactcaagtgggaaaacggggatgaaaagttttcactgtgggccatggttccaggcttgaaggtggagccctcgccagggaccctgcccttttctgcctagagcttatctgtctcctatccctatcagtaggaactcaccatctttagtaattcattcagtgtgtgtgtgtatatatctatgtatatgtatagaatatgaacctgtttcttgaaaaatccttctcattactcattaaataccagagatctatataattgagtctggctgtggcagtttgctaatgttaatttgtacacttatgttcccgtgatttagtaattcactccatttgggtgtttttaaaaaaatgtgtacatcaggccaggtgcagtggttcatgcctgtaatcccagcactttgggaggccagggtgggtggatcgcatgagaccatgagttcaagaccagcctgggcaacatggtgaaaccccatctctaccaaaaaaaaaaaaaaaaaaaaaaaaattggccaggcatggtggcatgcacctgtggtcccaactacttggtagactgaggtggaaaaatcacctgaacccagggaggttgaggctgcagtgagctgtgatcatgccactgcaatgtagccttgatgacagagtgaaccctatctcgggaaaaaaaaaaattgtatacataatcacatattttctttaaagttttcaaatgtgaaacttagatttttttttgtttcaaaagtggttgtggttgatttagtcaataaagttttaaaatgtatggttggcccacttaaataaacaactttagtgggctgacatatatgtccatttcttgatttgttgtttcattctaagtaaaatttttaatttctttttgtctgtttaaaaaataactgaaatacaataataatcaatagaataactatcaaaaggttttatgagaatgaagataaatatatatcacagattcaaaacaaactgacaatttctgtaattatatgttaatatttgttgtgccttcactatatgccaggtactttgtgaagttttgacatggattattacattcaattttgttttctaccctatacagtaggtactgttattgaaatcattttgcagatgagcaaagtggagcttgaaatcaagctcaagcagggtgattccgtagcctacatgctacattactttgctgtgtttacgacataaacaaagacttggaaattgaatgtattagcacaatcctgaatccacagcttgtgcttttaaacactactggatcactctgtagtataactgtgcctatggctctactatcaaaaatctcacttcaagatccctttatctgccccacaggacaagggtaagggtattaatacatgaatttgtaacctctgaagtaccttattcttgcctacccgattctacctagtttatgtagagtattaatacatttctattaattggacccagtaaaaatgtacccacaaaagacagaactgaatgactccatttgcccactaaatggtttacaacatattgaaacatgtctctcaatataacaccaatctagaaagagtgaaaatatattgaggttactaaccaccctagattaagttttccattgtgtgcctggtctgcctttgttttatccatggccacatattaatactattctgatttccccctgcttcctggcactgtttcctcttgttctttgtcatctgttgatactggcttaaggatcattggatggctgttaattaaattaattttgtaggagtctaagcaaaatatgtgatgcattcaaatggcaagtacaactactgtgaattaacaatagttcctccgttagaatggcttactgagagctgactgtgcctggcttcatgtgataagaataaactgataacttgcttctggcaatgtgttaggaatgtgttgtttcctagcatgtaattgcttttaatagtaggtaacaaaaagtaactactctgtgacatgtgatgctattaggatatttgtaattttctttgaaaagagaagctggtgtgattaggtaccttttgttctgctaacagcagtgataaagatgctatcactcctctcataggttttacttactatttgctcttgcagaatcagatcacatccctattaattattggcattttggttctattttacatgcttttgttttctgaatgctgacaatttaagcattttaatgattgactgcattagcaaatattaatatagctgcatgatagatcagcatatggttctgaaatctttgtaatatagtgtatagacattcatttttaacattttcgtaatccatttccgggcataaactgaacacatacacagactcatcagaaatttcttagatttgaggcagggttttgggacacaagcgatttttaaatacttcagactgcggcaaaatttagctaagggattccttgttttttagcagttcctgagaagacttgcaatcagccatattttggggggagtgcgggttcacttatattctatgaaagcaatgggattttttttctttagtgttttctacttgaaggttttttggtctgctaatgttgtctattatctttatgtaatgatgatgccaccccctctaattagtagagcataatactgttttgatttttagtaataatgtttttttaactgatcatatcatccatatttgcttaatatttcctgtaactagtgacactttttttatgatgacaaggggctgggatagagtttgtggccatggtgcaaaacaaagctgactgactcagtaagcattgaattcatgaccttagtgttatcagcatagtgctctaaccaacttaaacaattggccacaggtaaataatatgtgatgacaaaaatagctaaagttttcagccattttaagctgataatatttgctttctgcagtagcagtgcctgaggcagcttcatattatagctctcttaaattgtttaataatgaagacttttgaacatgctttttaaatttagtgcctacctatatcacaatataacaatatataattgatcttatatttttttcaaaaggcaagtcaataagttgttgattttgttatttttagggacacaactaaatatattttaactaaggtttattgagagagagagagaattacttgtacaaagtcttttctgcattgtatcaatattatggtgtcatttgcattttgttccagtgatagtctccatttcctccaaccctcagagacattaaggcaattatttattgtaatcaactctttccaatttaataacgtttttgaaaataccattatcactttccttggtgggcagtttatatttgtgcctcagtgtttatatattgcataatatttccctgaaaattattaccaagaactaagtttaattaattaggatggaccctagttagaatctaataaagtagtggtcttaagagtttgttctggtttttatgaattttgcaaatggttataaatgggtaatctctttttataatttagtatttatgtggtatatgtagcttctttcagttatctgttttaatagaggggaacaaatgtacagaactttgaaggtatatgtggaagggaaaggtaattaaatgtttttatggtaatattatttttgtattttagtatctttagctcagatctatttatgttcccctagactaggagtaagaagcaaaaggagtagtgagaacaatcaacctctggtcagatatttagggattgtttagagatcttttcaaagatcatctgtaccttttggcagcaaagcaaaaaatgggctctaggcctttgggaaatttgctatgtaggtccattcttaggccgtaagtttcctctgggccatatgttaaagaaaacccagttatctcgtattgaattcctttacggtcaaaagaattactagggacttatgctattgggggtgtaattttaagttgtgaaactctttttgttgattgtctgaattcattatctccattatttgtctcttgcagcaacagtgatattgctggtcagggtccaatgtctcaggattaatatggttagaattgcaacaaatatatataaaatgaattaattcataagctgtgctagatttgttttggtctgtggtcattctgttgactggttgttgagggttctgcacgttccttagccgctgggcaatggccaaccagaaatatacatgtgagctggaaattcagctgtttatttaaacaggagcacagatagcatagacagaaaggagttgattcatatggtatttgttatatactgtacattcttctgaacattttatatatattaacccatttaattaattctcatggaagaaaacctgtacgacaatgttgttatcttcaattatataggggagataactgggtcatggggagattaagtgacttagctaaaggttacaagcgtaacagataagaaagctgagttcccactcagtgctcttaattagtatacaaactgccagcttccaaattcatttacacgatgtcagttgtataactggcagtctagattccttttatatatttatgaagtatataccatattgtagaactgtagtcttatttcactggccttatacatgccctgacgggtctaaagcttatctgagtaccaggatgggtgtgacagcagggaagagaatttgtctggatcagtgatataagctccagtagagtttctagattatccacatttctgtctctctgagttgcttctgagtctgagtagtattactcattcttggcatctaagggttctttttgtagaatcaagtcttgaagatgacatttgcaattttggaaggacatgagaaaccctaacagaagttgctgctgctgttttaacccctccaattttgtgtttgtaccaaacacaaacattttttcagtctttcctattgatacggctatataaacagatatattccttatatactgttatataaggaatgattcagaattcctttataagcaattgctatgttttgcaagtttatttcactatcatgtaaaaggccgaggattctaaaccaatattactgtctttcttttgatatgtgtattgatcattattccctaccatctacccttactgaaaggaggggccatatgggattagattgtcagtaatgtttttatatcttccttgaggcctctagttcatatgactcttagaaatgctgtaacctaagtacctaaattatattatcatgcctgttatgtaaatattaatgctttcctaatagtctttgaagtgtggggttttgagttccaaggtcattttcaaacatctcctaagaggtgactgttagcaggggcaggcatgacagcatgcttctttgactgaaaggaatcgatatgtcaacttatcaaaatatgttttttttaatgctgtttcaaacagattgcttttaaaaggtcttgaaaaaatataaaccaattaaaagttgtggaaagcttaattttataataatttttgtcaaattcgttattaaattgaaatcatactgtgtcacttttattttttgcatgaaaaacacctacttatttataagaatcattttatttaatgcctatcatactggctcactaaacgtttggtgttcataggctttcttttctaattttttgcactttccagttttgaattagagtcagggattatatgaaatattttaaatttgagtaatcaaaaaggaggttatataaaaggactttgatgcatggaaatattaacaatgtgcatgtatattaattgttgaacattatgagtaattaaacctatcaatagttacttaaaatttgtttgattttaatatttctgaacaaactttagcctgaccactgccattgaggaagttgactttaggaccaaccaactttccatgtaggaagtaacagagttaccaggacattagagtttgtgacatgactgtttatagaatgtcaatattttacttatcacattgaaattcatcactgatatctttgtagaggaaatgaaaatatgccctgctttattattcatatttacataacagaaatacaagatttaaggcataaatgtgttaataatgccttgactcttaaggacatgtaccctgaaattaataggactaaagcaacctctttcccttaccatgtagagattgacaattggggcacatgaaatattagacatctctttgccagtcaaaatacacaatactttgatgtactgataacttttaatgaaggcaccagctatgcgttaaataaaccattcaatagacttaatactaaccaatgttcagaatttgctggttgtggaaaatacatttttctagaggtatttaatgctaatctcctttactaagcagtgattaaagattttttgagaccaaattttaatcaaagataaaattttttttacaaccctttcaggtaatatcataagcctaaattcagtgtaactgaactttagaaaatagtccttttgcctatttctttcagaaatacacacctcccttctctcaccagacccagacacctgcataatcaacatagggataaatttactttgtttcacaaatcttatatcaattgatgtttgggtattaggagctacatttctgtgtataggtgttaataagaaatgatggcctacatagagactaatttgctgtagaaatgagataacagcattattctagcaattcttccaagcggccattgaggctgtcctcctcatcttatttgctcattcaacaaatatgtattgaatttctatcatatgccatacactactagtttttacagaatggttattactccattagacctatgacccatggaatgagtaactctgaattctctgtggtagaaatggattttgtttatcttgttttgccatgctagtatctctttctttctgtattttaggccctgcttgcttacttagactcaagataactatttcttcctcctcctttcaggaatctcctaggatccaaattttgttttgttgttatttagagatgcttaaactgatgtgtattaactgaatcattgtgtactatgatacacagtgttttccaaagcccttctgcttattgtcttatttctagcctgtttttatctgagtcctctcattgctttgtaaactcaaatatcaatatgatcaaaaagatccagtcaactttggggtcactgtatcttgaagtttagaaatgggaatagagaagacaacagttgagtatccaataagagaaaaaccaagatagtgataaaaagtattcagagtagtggaatatgcttgccacctcagtaggcatttggtttatagaattactaattaattttttgttggagaaaactgcttatattttcttggaaatgtattttttattttcaagaagtatgtagcaaacagtctttccagaaagtatgggttccttaataatgttcagtaaattcattattctatacattcttatatttagaaatatatatatatattgaggatctgctctgtgccagatgctagtctaggccttgggggatatagctgtgattaaggcgatgtgatcttgactgttttagaacttaaagtctaacagtaaaaatataataataaacatgtaattatattactgtgagtttcagatagtattggtgctctaaagaagataaaatacagtaatatgatgggaaagtacttaggtgggggcttaagtgtgatggttatggaaaataactttaaaagcatatgagttgggaaatttgaaaaacataccctcagaagcagaatccagcaggacttgttgacggattggatgcagtactttttttttttaaagcaaagaatcaagatctcttttagatttggggcttgagctgaacatagtactgtccaataagtatcttattgtagccactgaatcagaaaaggctgaagaggatagtgttgacagaaaaagtggtcagaggattaaaacaatgtgatcatctagaaaaaccatctgtggatgtactataccaacattttcaaaggtaagaaatacagtgaagctcgaattagtttagtgttggtacatggaaataaattgtatggctttatcattaacctttgcttcaactctagggatttgtgctttgtttgattggactgtagagacaatctttacttttctgtctatgtttaactatttagtcaaatgaatattgcacctctaagtgtttcttttgatttactgtaggctgaggtcatactgtgtactaggcgtgaattaattacaaattgaacaactttgctctagtgaagagagaattttattctcattccaactaaatctatgatccaagaaagatctttatattctttgtgtgtccgagggggactgaaagtatactcataaaaacctgttctgattttaaaaaaagaagaaatgaccttcatttcttttggatcttctactaaatggctttaaagcatcacatcacaaagtcctcttccccatagaaataatattctctatccaggaaattttaaaaggtttgcattatcttgttcttgtggttgatagtaaatttagcatttattaattattgacaaactgccaaaatggatcatacatatgttacaaaaaatcttttgtataaatttcaaagtattcttaatgtggctttattgttatttatgatagatcactaaggtctctctcacttatttcttcgtgctccattcttaagcagccatttctctaggaacttagtcctacagaatgagtggaattggtaaagtaattgtgatcgttgatgatttcctcatctttttaatccagaaaagttagcaacaaacctgaattcttagtgggttgtctgagctttgcaactttatccaggaccatggaagaatattccaactgtactattttactgtatttcagtttggcagagaggtattttagcaccattataataacctcatttatgaaagtgttggagaattgcattctataagataatgtagcttctctgtatgataatgttttcacacagtgtattagtgcatgtggaagtatattggaattgagatttgctaacctgcatctaagatagcttagtttatttgattagtgaactccaaataaattattttggagggcccctgggaagtatataagaaatttaaaaaccaactccttcagaccactagtttcccttctgtttatgatgtttatcacttcacatttttaattagtaaagtataaaatgaatcatacaattatagtagtggagttttttgtcttctagaagtgacatcgtaatagttattttaaaacatgtagagagtcatgcatatgtatgtggaagggtaatcaacattgttttaatgtcttatgctaagttgcacatacaaacacatcttttaatttatggaagttacttacatttctacataaaatctcagctgtttgtacatgtcccagactatactggattctggtttgctcagttattccttccttattctgagagtttagcaaagggaaaatgtcaacctcaccctagagaaagtagagagctaagcagtagaaaaagctatttgtgccaggcttggaagaccccagtctttccatttctgcctttcaaagaagctctttctaggggcatagtactaaagattgagccagggcttttgttctggttattcattgcacaagggtgccttgctgatggtttgattaggggctgaaatttgacacgggttctacttgtcaagctgtgtagccacaggcctatttccaactagagtgcgcatttccgattttcacaacagtatcatatagtctggagacagcccaggcaggccatagtatagacagccactgcacctggctcttattcttcatagctccctcaaagtgttttctgcaatacttcctgctctgtgctcctctaccctgttttttaaatttttttttcgaaaaagttttgtttgttttttattgatacgtaatagttacgcatattttgggggctacatctgatactttgatacctgtatacagtatatagtgatcaaataaaggtaattgggatctttctttttcttctgagccttttctttgctgagaggaagctaataccactaagggtgcttaattatttatctttgttggaataaggtaaatgttaccttgaagagttatatttgctatcattatcaatatcactggagtctggaatatatcttagtactttctctcttttctcagtaaccccttccttcaaaatgcagcatcttaaatggtagtttgtgtactttctgacttctcagtgaatgatgtaattttgttcattaaaaaaaaattcaatttaaataaacttgcaggtggaaggtggaaaataaatcatgataatggctcacacatagcatttactctgtgctaagcattgttgtaattgtcttacatgcatcaactcattttatcttctcaataatcctttgaggttacttattattagtccctctttttttttttttgagatgaagtttcgctcttgttacccaggctggagtgcaatggcacgatctcagctcactgcaacctctgcctcccaggttcaagtgattctcctgcctcagcctcccaagtagctgggattacagatgcacgccaacatgtctcgctaaatttttttgtattttttgtagagaaggggtttctctatgttggccaggctggtctcaaactcctgacctcaggtgatccacctgcctcgccctcccaaagtgctgggattacaggcatgagccaccgtgcctggcctattagtcccattttatacctgaggaaaataaggcaaagagaaattacataacttgcccaagataacacagataataaatggggacatagtgattgaaaccaaggtatcctgttttatggtgttttttttttttttttttactatgttataatttatgaatttgctaattgcttcaatattattttctctttaacttttcatcaagctttacagtaaatcattgcttatttgttttcctgctattcattgaggataaagtagcatcacatcagtagctttaagaggtttgccgtttaatctgtattgcttttagaggttagcacgttataaaagccccatttccataatggatgactggaaaaaccaggttgctgtatatatgtgaacacatatataactaacagtttgttttctctgtctctaagcttgtggggtggtataaacaaacttcagtgtactttaagtgcagttactgtgcttcaactcataagcatttctttagaaagaacatatactctgaaatatctagcatgcattgatgaagtaatcaaaatcttgatctctaatatcttttcaaagggtttccttcactgtctctttcccctggaatatattatgcatctctaggtggtcaaacacattgagacccataccctgactaaattttcataatccctggggttcacaattgttatttaaagttcatagatgtatacttcacaagtataggggaatatccttgatatgcatactgctagaccactctctagcctgaaatgttaatatgatgattatagaggagttggatccatttagaactattaggaagattattgacagtaatattttgactggttagttggcattaaacctcaatagaactgtgaaaaggtgattgggcaaagggcagtgataaaaccaagataatgaaagcacataacaaaagaagatttaccctttgtctttttaacacaagccatgttatttgtcatagtccctttaatactttagtacttgctcctaattaaaagtatttctggaaagagatctggaacagagctttcctgacaaaaatcagataatggatgatgttttgtaatactgagcatattatatctcataccaacatatttctttctcttttaagccacaggcatgatatggaatgacctgcccattctctccctgctacttccccaaatagttttcctattccttttatttaaggtattattccgatgtttgtgttagcaggcaatgtgcctttgctttgcattttgtatatccaattaatccatgtgtgatgatcacaactgattacagctcagggaataagatggggtgatgatatgactaatgcatacaggtagaattaacaagagacttttctagaaggtgttcaaagggcagaataaagagactatctttaagtggggaatcagtaaagaagtctacaaacttgcttctagctgaaaagatggtgtaagtgtcaattctgttgtgttctctctctcccaaaagacctggtgggatacaaacaagttacaatgacttcattctagagaaaacatggaatccactttgttttgttaaaaagttcttgaatcaaaaatttcaacaaagtatttacaaaaataatattctgtgtcttactttaaaactgatgatatcaatatcacaccagtgtgacaagacactctgattgtggtccactggagaatgttccatgttaatccagaggaagaattacttcttgtcataggattattggtgaagaaggccagtagaccaatatcttgactttttgggagagagttttataccttaggccctcttggcagctagagatactaagatgaataagatatggtttgcatcctcgaagaggtccttattttcaaaagagaggatgtgtattagttcgttctcacactgctataaagacatatgtgagactgtcatttataaagaaaagaggtttaatcggcttatggttctgtgggctgtacaggcttctgctttggggaaggcctcaggaaacttataatcatggcagaaggcacagtggaagcaagcatatcttgacatggctggcaggaaagagtgaagggggaagtgctacacactttcaaacaaccagatctcgtgagaactcactatcatgagaatagcaagggagaaatctgcccccatgatgcagtcacctcccaccagctccctcccccaacactggggattacaatttaaaatgagatttgggtggggactcagaacgtaactatatcaggcagatatataaagtaattgctatactacaatgtggtaacttctataaagaggcatggaggaataatattattaaagaataattaaagatgaattgagatgtttgcagagaaaaataatatttgaactgggatttcagggctatgtagatttttatttccaaaaaacagaagggtcttcagggcagaagaaactacatggacaagggtatgataaagtgtcacatcatggggagtaaggcatggaatgtttggttggagaatgtggtatgaaggacaggagggaggtacattggagacaactggtaaaggatctttttactgtaacctatgggtaaccttaaatgtatttttaatcagggttttgtgatggtatgatcaaattgcattttagaatgattgcttttggtaggaaagtttaggattgatgggagaaaattaggagttttttaaacaagtctcaattggacactgtaatgacttgaactaaagcagtagaagtgaggatgtaaagggggagctaaatatttagaaagtgaacttaacagttaattagtgacatattaaacttggggaagtgagagacaaaggggaagcagaagtctaatatgattcccacgtgtcttgctcatgcagcaagttggatgacagtgctacttactgcgatgaggatgaatgggaaaaacaaaagttaagcttcagacataatacatttgagaaataagatagttaagtggctataggctactgtcttgtaggcagtcatgtgtagaaagtttgtagctcagaagaatatatggctttgagggagaggttgggagtccatccacgtatgtatggaatttaaaaccatgagaatgtataaaattactgtattagtccattctcacattggtataaggaaatacatgagacagggtaatttataaaggaaagaggtttaattgactcacagttcagcatggctggggaggcctcaggaaacttacaatcatggcagaaggtgaaggggaagcaaggcaccttcttcacaaggcagcaggaaggagaagtgccaaaagaagcaggaagagccccttataaaactattcagatgtcatgagaactcactcactgtcatgagaacagcatgggtgaaactgcccccatgattcaattacctctacttggtctctcagttgacacgtggggattatggggattacaattcaagatgagattttggtgaggatacaaagcctaaccatatcaattacctgaagaagaactgtagaaagagaaaaataaagagggcccaggattaattgctgaatgctaacatttgaagggccaatgggaggaagagcagccagcaaagaaaatgccaacaaagaagtggcaaaatgaagaacaatatgatataataaatgccgggagaagaaactgtttcaggaagaaaggagggactagtttcgtcgtgtagattattgcttaaagtcagataaaggcagcaaatatattttaggtttggcagtatcaagaatgttattgatcttaatgcattattttctaacacttagtgtagatggaagccagattggaattctttggagtttaggaccattggaggtatctgttgatgtcagtcattgagataatacaggaggaatgtaacgtttgttaagagaaagaaagaatgaattgttaaatcctattgaatatgataagcagctggagatgttcagcaactagcaaagcatatgatctggaactcacagaccagtctgggctgaggctaaggattttgaaggtattcagtagttgaagcctcactgggtattctcagccacatttcaaaataaaattgggtccaatttattatggaaaattggcaaattttattaatatataataccttacagcagtacacacatcacagtttacaaaggagacagttgacaaatgaatgaaatgtgttagtttagccctctctaaagattaattatttgaatacactctaatattggttaaggcagttaatacctgaagagtatattttctttttttttttctcagttaagtggctgtaggctactgtcttataggcagtaatgtgtagaagattgtagctcagaagaatatatgaagagtatattttctgagtctgggatcctagttaatattaaaaaaatgtgacatcaggcattcatataaaatccaaacctaatcaaagcagatagtcctatttaaataactaggcttgaaaaaaagaaagggttaacaactcaaatcttgaatttgtttccattgtatttacaccctagatttctatgaagtgccacattacattatatgcttatttatctctactcttcacctagagataaaatacagtcagacaaatagctgagaatctgaaattcaaagcagttcttttgaaagttaattctccagtaagtttctccagtaagtttcatcctcagattgcttcattcacaatggagtataatggttggttggaaatgtggaaatgaccatttttgatttaaattacttttgtcacacagtttttgatactagcaaagaaaacattgaatatgattgacctagttaattttaatttcatacaattcataaaagttatgttagtaattttacagagtaaaacctttatccatttatgcttctgaaaaatgaccttgtaaaatgtcagaattgccatggtatgcttttgaaaaatacttaatgatttgtgcttgatgcatttaaactctttattgaaggtcaaggattctattagggcatttttgtcagtaaaatgttgacagaaatgaactaggtagttgaattctcactgacaatactgtcacaattgttaagaaattgtctaatgataaggccagattttgctcattatttttcttagtaactaccactagttcattaaatattgccttaattagagtgtgtgttaagtgtcaaaacttaatggtcacagtcacaatccttatttaatagatacttagtttgaattgctatagttatattattctcaatgactgtgtatatatgccatgcatttggatgagatggaattgtgtgggtattccaaaagcactgatgattatgttgatttcagtgtatttttgatattcgatattgagcttagatacccacagtttgatctgtgaaatcacattccaaactagtaaagccacaaaataaaagcaatgaagtaaagctgggatatattcttattttcttatttataactctttcctatcacctaatcagtgcagtatattttgcgaacagtcagatttgttgccacctaaaataagagttgcagttgtttcatggtgatagtttttctcacctctgacctcgttaaggagatggttataaacacaattgttttaaaggcctaataagacatgtgaatatagtgtaaaaaaaatcttgggattatctcttttatttatgtcagtgattacttgaatggaaaattcctaggttagtctgtacaaagatcacattcctctgtgtatttttgttatctatacttagaggtgcacatatttatgttctgttgatatagcatattgagaaatgtttttaaatgtatgcatcctagagatgctatcgttgtagtatctaggagttgtataagtatggtgaaattagccctcagaatttttttgcctcagtgtgtaagataagcttggatggtatgtacagcatcattcccccatacatcgtgctccgtggtaaaaatgaccttttaacttaggtttttgaatcacatttagcaaattgatgcatatcctatgactccttgggtttttgccaagatttttcattgtagtattcaattctgttaaactttgtatggcatacaagagtcatgcgacttctggttactaatgattatagatatgtctcagtctcaaagctctgaatacaactgttcttcatcttatgagattttgtgagtttcataggtcttatggaagaccttaagtcgtcattgccctttctctaggcaggactgtattcatacctccatctcagtaatcatcttcattttgttaagaatcttcaatgtcttgtgtactttgttggattttctcatttcatcagatgattgtgatcacgatcattttgattatattaaatgtcacacttttaatattccttatttgaaaagatatttcagtggatagcataaacattaaaggtgaggtggtgaatttagtgcaaaatgtgtaaggtaggcaaccagctatcatttgtataattcatgcttttgttacaaatgccattgtccactaatgctgactttttatcagcttaaattgtgggaggctatattcgtagttaattgacagaattttatagaggcagcaaatgctttttatttaaaggacatccttagcttctatatcctgtgatataactcgtgtattttgccagtcagtagaagtagtaatgcactgaagaaatgtatatattgtacctcaataaaaatagtaattaatatttacctttaacttctgtggcattttttaggatatattaataaactccatgtcacttatcacaaaataaggagaaaaaatacctaaaatctatttcatattttctgtcatagtttactgagcagatttttgaattggggggagaaatgacagttgtattagaacaaactcaatttaatgatccctctatttttctttctataagaaaaaaaatgataatgctcagtttatggaggacacattaatcatttttagtttgaaaaactggattcttttcatattattaaaactttttgatgttgattgaagccaaatacgttttttaattgtctttgatgatcaaaatgagggattcatgtacctgcatttctctgccaaacgtagccctttactatagaatatatattagtgaacttcacttgctttatttgttctttatgctgatctgcaggaggtcattataaaatgtgaaccaaagacccactagcaaatagcgctgggttagagaagcaggattagagatgcaggctctggagccagactcgttgggttcaaaactcacttaaaccacttcgtaactggtctgatcttgggtatgatgtcatatctcagtctcttcatctataaaatggggataataatagtatgtaccctttaggattattgacaattgagttaataattgtaaaatgtttaaaatggtacctgctgcatattacagatggtattcgttgtaatcgtttttatcactgtcaataatgtccacttattatagcagcagatatttttgaatccagggatgtagtcaattctttgtcatctgtcttcagggactgtgacctacacctttgacaattttgacagtattactacctgctcagcttccctatagtgtctgtgagctggctagcaatttagtacactgatcttatttggtagatgaggaaactgtgggccagtaataaatttacttatggttataaagctggtaattaagagtctaatttcgattggctgggcacggtggctcacacctgtaatcccagcactttgggaggccgaggtgggcatatcatgaggtcaggagatcgagaccacggtgaaaccccatctctactaaaaatacaaaaaattagcctggcgtggtggcgggcgctggtagtccagctactcgggaggctgaggcaggagaatggcgtgatcccgggaggcggagcttgcagtgagctgaatttgcaccactgcactccagcctgggtgaaagagtgagactgtctcaaaaaaaaaaaaaaaaaaaaaagagtctaatttcgaatatagctcttctgatgacttgtgtggtagtacttgtacttcatggcttaagtgtgtctatgtatttttctttcatttttgaataatgagttccttcagggtaagaaccatgaagtaaatgtacaaaatgttggtacatgtatccattgtttttggttttccagggggctaaaattaacactgaaatgcaattgatatagtttggctgtgttcccacccaaatctcatcttgaaatgtagctcccataatctccatgtgttgtgggagggacctggtgggaggtaattgaatcatagaggtggtttttttcccatgctgttctcatgatagtgaataagtctcacaagaactgacgcttttataaagagcagttcccatgcacatgcactcttgcttgctgccgtgtaagacatgcctttgctcctcttttgccttccaccatgattgtgaggcctccccagccatgtggaactgtgagtccattaaatttctttttctttataaattagccagtcttgggtatttcttcatagcagcatgaaaatggactgatacaacaatttatggaattatctttctattgatatctgttatgaaactatgtatttatacacctaaaatgtgataaaagtcacactcgagaatggaagagaatagggttaatgacaaacaaaagaaaaagacgcaggcattggctttaaccactgtgagtacaagacataggctaaaaaagaaatcagtgataggaatacattatttcccaattgtccactttcaaagtaaaggcctggcaattgtggaattgaaatttcttttatcttcagtaaacagagatggctaaaattttcacgactcatttaatcccgcagcttttagctaaatagtgttcattcatctctcttgattcttaatttagtgattcagatttccataaacatgagtttctgtaaaacatttataatatttgcccatgtgccagtagtcctagctactcaagaggttgagatgggttgatcgcttgagccctggagttcaaaaccagcctgagcaacatagcaagatgccacccccacatacaaatgaatacacacacacacacacacacacacacacacacgtatgtctactttgagttttgtaaaattatatttcctttaaatgaaaaatgtagcactagtgattatgaaaacaaaaattagtattttcccaaagattaatctgccattgttatccatcagttcaccatctaagccccattgctctcaaattcaatgttcagtgtgtttgaactgtacccttgcttcaaccaggccaatttgttttttctcacttatccacactgtcacactgtcagcccatgtgcctgtcacataccacttccccaaataaaatttctgatacatttgactcaactaatcactgaacttactcctttacagtctcctttatttcttctaattattcctgataccagctttgagaatactgaagagagttaactatgcctgagtggagcctttcattttcttaatatgcattccattaacatgagcattttgttcctaaatgcccttgagttacttttaaatgttccctttggtgtcctcaacctgtttctagctttttgaaggtaagaaacaggtcatctgtttgttttgttcccttcacaacaccagtgggtgttttgttcaagctatttcctgactaacttcctcagtggggaaatgttcagggtatgcaaatttattttcaattaacttacataatacaaaactgggtaaatacaggagttgaggtgatttatgattgctttaaaacacaaagccagtccaggtgcggtggctcacgcctgtaatcccagcactttgggaggccaaggcgggtagatcacgaggtcaggagttcaagaccagcctgaccaacatagtgaaaccctgtctctactaaaaatgcaaaaaaaattagccaggcgtggtagcaagcgcctgtaatcccagctactcgggtggctgaggcaggagaatcgattgaacctgggaggcggaggttgcagcgagcctagatcacgccactgcactccagcccgggcaacaatgtgagactccacctcaaaaacaaaacaaaacaaaacaaaacaataaaacacaaagccaagtgtatttattattagtatggagtgtatcagtgttgaattctctctgtatctttttttatttttttatttttaactctaatggaagaagatcctagaaactttaaggattgtagattatatctgtagccttgattttttttccactttgcttgacaaaggtaatcctatttagcaatgtatttaagtgcctctgcatttgaaagaatgttgatttttccaaatagggtacgatattttatgaaagttttttttcttgaaaacagaatgagcatcccaagatcagacagagaagtaatatatagatataattagcttttctgtttaaaaaaaaaggtgatggacaaatactgtcttgataattcaagtcaataatccacaaatgtatattagtctcagtggctgagagtctgtgagtctgttgtcactcagtaggtcaaatctaatccgtgtatctatagtctcttaaatactcatttgcacattggattaactgtgtgtatttaagcattacatgtttttatatagctaagcttgagtatattattaaaagttttatccctttactttgcaatgaaaagaagtgataatttgtaatgaatatatatatatatacatatatatgtttgcatcagtgtcatgtggcccatccctatatagagtggaacacgtatgatcaaactatctgagtgcaaagcctcaatttcatttactgttgtgacaactaatgtttaatgttagcaaagcaacagataaaattcacattttactaaagcaagaccatattgattcatagaagactttagttgttaattcttaggtcaagatctaagtatgtttcccttttccttattatttttacttgctgtatcagactgaccacttctcagtatattattagttatgagatagaaaaatgaattatgttctaagttttcttaacatttctaattctttttaatttttattttcgtgggtccatagtaggtataagtatttataaagtacattaaatattttgatacaggcataccatgtgtaataatgacatcagggtaaatgtgatatgcaacacctcaagtatgtattcttttctttttgttatacacaatctaattataatcttttagttattttaaagtgtaaaataaattattgttgactatactcaccctcttgtgctatcaaatactagatcttacttatttcatctaactatacttttgtacccattaactatgccttctcactagacacctacctttcctagcctctgctaaccatcgttctactatctatctccatgacttcaattgtttgaatttttggctctcatgaataagtgagaatatgtgaagtttctctttctgtgcctggcttatttcgctccacataatgatcaccagttccattcatgttgttgcaactgacaggatcacattcttttttttttttactggctgaatagtactccatcatgtatatttaccacattttctttatttattcttctgttgatggacagtttgttttgttccaaatcttagctattgtaaacagtgctgcaacaaacataggagtgcagatatctctttgatatactgatttcttttcttttgggcatatacccagcagtgagattgctggatcatatggtagctcaatttttagttttttaggaaccttcaaactgttctccatagaggttgtactaatttactttcccaccaacaacaatatacaaggcttccttttaatccacatcctctccagcatttgttattgcctgtctttcagatgaaagccattttggctggggtatgataatatctgattatagttttgattggcatttctccgatgatcaatgatattgagcaccttttcatatccctgtttgctatttgtatgtcttcttttgagaaacgtctatccagattttttgcccattgtttgattggattattagattttttcctattgaaatgtttgagttccttatatattctggttattaatctcttgtcaggtgggcatttcacagatatttcctgccatcctgtgggatgctctttactttgctgattgtttcatttgccttgcagaaggtttttaacttgatgtgatccttttcgtccatttttgccttagttgcctgtgcttttaggatattactcaagaaatctttgcctagtccagtgtcctagacagttttcccaattttttcttgtagtagtttcatagtttgaggtcttataatctattttgatttttatatatagtgagagataggggctagtttcattcttccacatatagatatccagttttccaaataccatttattgaagacattgtcctttcccccaatgtatgttcttggcatctttgtcaaaaatgagttcactgtagatgcatggatttctttccaggttctctattctgttccatttttctgtgtgcctgtttttatgccagtaccatggtgttttggttactatagatctgtagtataatttgaagtcaggtaatatgattcttccagttttgttctttttactcaggatggttttggctattctcagtcttttgtggttccataaaagttgtaggatttttttcttggtaggttgtatgtgtctatatttgtgaagaatgtcactggaattttgatagggatcacattgaatttgtagattgctttgggtagcataggcattttaacaatattgaatcttccaatccatcaacatggaatatattttaaattttttttggtgtcctcttcagtttccttcatcgatcttttagagttttcatggtagagatctttcagttcattggttaattcctagatattttattttatttgtagctgttgtaaatgggactactttcttgacttatttttcagatttttcgccattggcatatagaaatgcctctgatttttgtctgttgattttgtgtcctgcaactttactgaacttgtcagctcttatagttttttgattgagtcattaggtttttccaaatataaaattatattaactgcaaatgaggctaatttgacttcttcctttccaatttggaggtcctttatttctttctgttatttaattgctctagctagggcttccagtattatgttgaataacagtggtgaaagcgggcatcctagttgtgttacagatcttagaggagaagctcttagtttttccccattttcagtatgatgctagctgttggtctgtcatataatagctcttattgtgttgaagtatgttccttctgtctctagttttttgtgggtttttatcatgaagggatgttgaattttatcaaatgcctattcagcatcaattgaaataataaggcttttatcctttattctgttgatatgttacatcacattgatttgcacatgttgaaccatccttgcatccccaggatgaatcccacttggtcgtggtgaatgatttttctaatgtattgttgaattcggtttgctgttattttgctgaggatttttgcatcaatattcatcagacatattgcctgtagttttcttttttaatgtgtcctagtctagttttggtaatattggccttatagaatgaatttggaagtattccctcctcctctattttttttttttttgaatattttgagtatgattggtatgaattcttctttaaatgtttggtagaatttagcagtgaaaccgtctctcggatttctttactaggagacgttttattttggcttcagtctcattacttgtttattggtctgttcaggttttggatttcttcatgattcaatcttggtaggttgtatgtgtctaggaattttattttatttttttggggacggagtctcacttctgttgcccaggctggagtgcagtggcgtgatctcggctcactgcaagctccgcctcccgggttcacgccattctcctgcctcagcctcctgagtagctgggactacaggcacctgccaccttgcccggctaattttttgtatttttggtagagatggggtttcaccgtgttagcaaggatggtctcgatctcctgaccttgtgatccacctacctcagcctcccaaagtgctgggattacaggcgtgagccaccacacccaatcactgattttagtggtttgatcttgctttcctagttcattaaaatgccttgttatttatttgaagtttttcttttttttttttttttttttgatgtaggaggttatagctctaaacttctttgtagtactgcttttgttgtatcccatcagttttggtatgatgtgttttcattttcatttgtttcagcaaatttttaaattttcttcttaatctctgtattaaccaactggtcattcaggagcatattgttcaatttccatgtttttgtatagtttccaaaattccctttgttattgatttctagttttattccattatggtcaaacattcaagtttttttaacgttttaagacgtgttttgtggtatgtccttgagaatgatccatatgctgaggaagaaaatgtgtattctgtggtccttgcatgaaatgctctgtaaatatctattagatccatttggtctatggtgcagattaaatctgatgtttctttgttggttttctgtctggaagatctgtccagtgctgaaagtggagtgttgaagtctctagctattattgcatagggttctatctttgtctttagctctaataatgtctgtttcacaaatctgggtgctccagtgttggctgcatatatattttgaatcgttatatgctcttgctgaaatgactcctttaacattttataatgaccttgtctctctcttcttacagttttgaaatctattttgtctactcctgctctttttccattggcatggaatatctttttccatccctttattttctatgtgtgtctttataggtgaagcgtgtttcttgaaagcaacaatgcattttaatgaactataaaagcaagagctttttttaaaaaacatttaacccctctatgtcttttgattggagaatttagtgcacttacattcaatgttattattgataagtaaggacttactcctaccattttgttatatttttctggttgttttgtggtcttctctttcttctttcctttcttcctgtcttccttttagagaagatgattgtctctggtggtgtgttttcatttcttgttttttattgtctgtgtatcctttgtatgttgtttatttgaggttgtcatgaggcatgcaaataatatcttataactcattattttgaactgatgctaactaaacactggttgcataaacaaacaagcaaagagaaaactaataaaaactctacactttagcctcatccccttgctttttaactttttgttttttctctttatatcttattgtactatgtcttgaaaaattgttgtagttattatttttgatctgttcatcttttagtgtttctactcaagatatgagtagtttacacaccacaattacagcgttacaatatcctgtgttttttctgtgtacttactattaccggtgaattttgcaccttcaaatgatttcttcttgctcattaatgtccttttctttctgattgaagaactttctttagcatttcttgttgatgaaatcccttaacttttgtttatctgggaaagtgtttatttgtccttcatgtttgaaggatattttctctggatatactatctcggataatagttctttttcttcagcactgtatatatgtcatgccactctctcctgcctgtaaggtttccactgagaagtgtgctgcccgatttatgggagctccattgcatgttatttgtctcctttcttttgatgattttaggatctattctttatctgttacttttgggaatttggttgttaaatgtcttgaggtaatcttatttgggttaaatctatatttatattctatatttcttgtatattggtatctttctctaggtttggaaagttttctgatattatctatttgaccttttaaggctgttttctttttttctttttttttttttttttttgagatggagtcttgctctgtcacccacgctggagtgcagtggcatgatcttggcttgctgcaagctccgcctcccaggttcacgccattctcctgcctcagcctcctgagtagctgggactacaggcgcctgccaccacgcccggctaattttttgtatttttagtagagatggagtttcaccgtgttagccaggatggtctcaatttcctgacctcatgatccgcctgccttggcctcccaaagtgctgggattacagatgtgagccactgtgcctggccttaaggctgttttctatatctagtaggcatgcgtcattctattttattcttttttcttttgtctcctttgtgtatttttaaatagcctgtttttaagcttactaattgtttcttcagctttatcatttctgctcttaagagactgatgcattcttcagtatgacattgcattttctaacttcagaatttctgctcgattatttgtaattatttatgtctctttgttaaatttttctgctgggattccaaattccttctctgtgttatcttgaatttcattggatttcctcaaaacaggtattttgaattctccatctgaaaggtcacatacatattttcctctccaggtttggtccccgatgccttaattcatttattgaggatatgttttccttaatggtcttgattcttatggatattccttggtgtccgggtgttgattaattaaatatttattgtagtcttggcactcggggcttgtttgtacccatccttcttgggaagacttttcaggtatttgaagggacctgactattgtgatctaagtttttggtcactgcagtcgtatcttcactaggggcatcccaagcccactaatgctgtggcttttgcagacttgtaggggaactgccttggtggtattggataatatctggaagaattctctgtattgtcaggcagagactcttgttcttcttccttactgtctcctaaacagtctctattctgtgtgctgagctacctggagctggggaaggggtgatgtaaatgctcctgtggcgaccaccactgggactgcgctgggtcagacctgaaggcagcagaacactggttctcatacaaggcgtatggtaaacactgccaggctattgcctgtgtttgctcaaggccctagggttctacggttagcatgtgccaaagccagccagggttgtcttcttcccttcagggcagtgagtaccctttggccttgggctgatccaaagatgccatctgggacccagggcctggagttggtaaccttagaaatctgcctagtgcttttttctgagagccgagctgggtcccaagccacaagacaaagtctgtcccacacttccctccccttttcacaagcagaggaggttctccgtgtggccatcaccaccccaggcctgcagcaaatactgcttgactactttgatgttcattgaaggccgaagggctcttcaggcagcttgcggtgaatgcctcctggcctgggactcacccttcaggtgaatgtgctcccctctggcacagggcaggtccagaaatgtcatccaggagccaaggcctggaatcagggaccacaagagcctgcttggtgttctaccctgctgtagcagagctgatacctaagctatgaggaaattcacccttactcttccctctgctttcctcaagcaaaactagtgtctccctgtaggcatcaaagctgtgaatgtattgggtcacacctgaagccagcatatccctgactgtcattcaaggcccacagctagtatttcctggctaccactgctaactacttagtcagtgcccaagggctctttagtaagcaggtgatgaatcctgccaggagtctgtctttcccttcaaagcaatgtgttcccttctggaccaggatatgtctagaaatgtcatctggtagttagggtctgcagtgggggctttaggactcttcatggtgccctgtccttctgtggctgagctggtatccaagtggcaaaacaaagtcctctttactcttccctttcctctcctcaagtggaaggaaggggtctctacctaagctgtgggctgcactgcctgggtggtggtggggggctgacacaagcactcccttggctgaccctaatggtatctcactaagttatatgcccccaaccaagtccactgactccgtgcccaccacaccaggaggagttgcccaggaatggcagttcttgtggccgagactgtgttataagttgatttaggactgcagaacactttagcctgtggtggtgaggtttgcagtgaatcaggtacaaattgctggcatatgccctacctctcttggttagggcttatctaaatgttccctctgtgggcactggctgagttctaccccatattgctttctgctatgacatgtcagcattgggttacaatgcaaagtcccacaatcattgtgctctctcttcccaaagtgcatagaatctgtctccatgccatgtggccactgccaggaggtgtatgttgggggtggggagtggtgggatagggatgggggggatggtgttggtgattcaaaatggtctttcctaccttcttcactgcttcttttcagtggtatgaatttaaaaccaggtactatgatagcttacctgatttttggttctcatgaaggtgatttttgtgtggatggttgttcaatttggtgttcttgtggggaggatgatcacagtagacttctatttggccaccttgttatgcttgcctcctgtaattcctgtttcagtttattcatcctgaaattaagaagtagaagagaagaatggcagatagtggctttcctagaggaaaattttatatgacgtttcagaacattatttttattgttatgaaggaaatttagtacttgtaaaaattatcatactgaacagttttagatcaaacctaggtacaactacggtatgatctaagatgacatatagatctttcccattgtacttttccaatgcaaaccacacctctttcctgtctttatttttgtttctacattttcctttcccttttatttcccgtttccaggcttctccctatcttctctttttcctttagtctgttctacacaaatgtgtgcttagcagaaaattacaacctatactggagaaggaaacaatctaaatctttatatctttcaaaaatttaccccacataatattattcatgatcatgatgaaattttcaaatggttttgttttacttcaaaaaggaaactcaagaaaagaagcaaactcttaattaattgctgtaattcccatatttgcctacgtgtatatgttcctgttatccttttaaattaaacacatgaatatgtgaattacactcaaagtattcttctctgtaaaaattacagtagtcataactatttataaatgataacctgaagcccagttacttcatagtcctttaaattccatttgataagcatgttgtgtattgtttagtccttgctcgcttcatttgttcatcagccattcatccaaaaaaattttgaggatctgccatacgttatgttctgtttgggctgggctaagacaatgaataaaatgagattcctgaagtggaattcacagtccaattagagaaactggtgtgcagatgaaccgataagttatactgtagtgtggtaagtattacagttgaggtgcaagaaaactgccctgggaatcttaaatttgcctgttaagatcaacatttgagaatgttttacattggaagcaattttgtttttcaagaatgaagagggatttgtggcctgttgcagtggcacatgcctgtaatcccaacactttgagattccaaggcgggtggatcacttgaggtcaggagtttgagaccagcatggccaacatggtggtgaaaccccatctctactaaacacaaaaaaaattagccgggtgtgctggcacatgcctgtgataccagctacttgggaggctgaggcacgagaatcgctggaccctgggaggtggaggttgcagtgagccgagatcgcatcactgcactccagcctggttgacagagcaagacactgtctcaaaaaaaaaaaaaaaaaaaaaaaaaaaagagggatttgctagttagagaagatagtaaagggtatttccagcagagggatttatatatgcatgtaaggcactgttagagaatgatgttacaaagttgagtaagatggttcctgtttggaaggaacccttcttgccacttgggagatggacatgaaaacaattagccaccactcattttggatagtgatattgtaggttaagattctacaggaacatagggagatagtatttctcaatttgtctcaactggaaaagctttataggacatacaatcgtagtgctgaacaaaatagttcctgaggtgaatgacctcaatgatcacaagataatagccactaacatttattggaaggttactctgtgctagccactgttctaaacacattacatgcattctctgatttaatgttcacaaccatctgaagtagatactattattgaagcctagttaagggaaaaaatgttgaagctccagatggttaaataactcctctactctctcatggaaatgacagaactgggtgttgagctgggacagtttgactctagattctttgtccacatgtatatcccatgaaaatggaacttattaaatggcatattgtcattttatataaaatttgaacagttttatcctcacttccatttgtcacctctttaagtacatttctcactattcttcagtgtacattttctaatccaaactgactaaattgtacactcttttccaacgttatctttgtaaacttactacctctgtgcatttaatagtaaacaacctaaaatatcaagttcttcagtattttgaatagttaactgtacacatttctttatatgggtgtgggattatagaaaatttaacatttattgactgtctctcctagcaaaggaaccatagtgggtggttcttcatcacaacattggaaaatacatattattaaagaatgttatagctaagaacagtgcaaataaaccatttgtccaagttcacacagcagaatctacatctacagtttcttcacaccactttttatattcttttcctttgcatatcccacctctcaaactaactggaagccacaggcaatcttgctgcctctctcaacttagctaagtctctcccttgctgttgctcttgtttgcctgctgatgctggaaggttcaggcatccacactaattcagtaatttagaaatgtatttaattcagtaattaggatttctttaatgccagcacttaggcctcaactactgaggtatggcgtgttcactgacaaccacatgaagtgacagctgacagcaagggagaagacaaaatacctataaaaagcagacagaaaaactattaaatgacagcagactgggaccatgagcctttcctggtattctctctgtgcatttctctccaactgaaaactgacaagcaagagcagagcagctgtccacccccttttctccatgactattttctgctcattgaacacagaaagaaaaagtgggggagggagagttatttctccaggcctttcagtttgctctgtgtttagtccatgactgcttctttttccttataaagatggctgtacaacagaccaaggcaatgctcagctctcagcaactttgttaaccaattcaaggtggtttcccaaggaggcttccttacggcatcattctgttcttgcagactgcttttctgcagtgaactcttattcattctgccaggttcaaaggctactttttccctgttgctttccctggtcaaatgggtcttcaaaaacaaattctggagatgagatctctgactaacattaggaaatcttggtgcacttgcagggtgatgtttgagataacaaatctggcacctggacatggcactggagtgggagaagtttggggcaggggcatgagctatatgactgttttagcaaccaagaagtaagataactaaaacttagaaactattaatagctatggacatacaagggaaggaaggcggaatcagtgagcattgatgttggagtcaaaggattgactggctgataagcctaggaaagtagagaatggctctgatgatagaaaaataggaaagagcctctttgtgatgcagtgtattatttctatctttcccatgtttattttcatgacacagtgggatgtataagtagtgatgagttttaagcaacagaaatataaatatggaaagatgagctttctaagattgtcagtgaggagagaggaaccagaaatacattattgcactatggggttaatgacaaaagaaggaagaggtagaaaagaagggatggtgatcattgtttaagtaatagttcaggaagatggataatggaaaggaattcgggggaaatttacaggcaaagtgggaatatctgcgaaccaggttgttgggtcctaaggagggaatgtgatttgtttcttggctttgtttcttagattttattttcgtaaaatttgcctttttgttttggatttctggagttaatacttctgttgcgtacttttctttgcctctatttctcctcatacttgttttccactcttcctcatgaaacataatgtttttatctgtttttcctaatcccagtataaatcttggcatccacctttacaacaccttgaaccagataaattctacagcttctactgctctgagaactatagacatttgtcagaaactgcctgtgagagaccatcagcttttttcagagtgggtaggagaatctgaagctctagtgtggtgcttaatggcaatgaaaacgcgtcagtgtgcttgatttggaaacaggcactgccacttactagctaagtgaccttaggaaagttatctaacctcttacatctcaggttccttatctgttaaataggaaggacaataatattacctcatagggttttcatgatggtaaaaataaagaaaatatttagtggtctagtccatggtaaatgttatatgagtgtttggtgccattattattgttattgtgttcttgttattctgatgtatcagtatatagagttaaaacatgtgtatcgcttaggaatatatccaacttttagacctaattttattttttagtatatttgagaaagttatccttaaagcagttgcttttattttaaaaataaaatgtttaattctgtctctgtaaagaatggataatgattacatgaaaacatatttcagaaagaatggggataagtagcattgtttaaatctaaaaattatataaataacatgaaagatacatggggaaaaaattaggctacatatagtgttacagtcatcaaaatgtaccatatttagcttaaaatattctgcaatactaactgttatatgggaaccaattaaaaaggcattcttgaggatatttcatttcttatcaggtaaataaatgctctgccctccataaatctaccactatttcattttggggaaggtcttgttttgattttcattgatgcacaataaaaagtgactcaagtcaattgtttccattgtctttcctatgtgtattcatttgtcatttattctttaagtgacctgccttctgacaatccttccaagcttcttatagtagcaagtatccaatatgctgaccttacatcaaagttactttttctattgtttgatgttattatctgtgcttaaaaaatgactcgtgtaaatatgtgtcggtgtacatgttaacatggcattttctaaattgggtggctttgtaacacatcttcctcaatttaagcaaatactgcctcaaaatatcttttaaaaaagcctcatgtatggaggttgcagtgagctgacattgagccactgcactccagcctgggcgacagagcgagacgccatctgaaaaaaaaaaaaaaaaaaagcctcatctagcagtttacagcagatgatctgtgtaagacaaaattaatagctgtatctggagtactctaaatgtggatttatacactaacctatatattgatcaattcctctatgcttgctttggttttgagcaaattatatttaaataagtttgttgctaggaatgtcttaaaaagctactcaccctttttgttagaagtaagtaaaatgattatgtcaggacctgccattaacttggtatagtacgaatatatcctcagaatactgataaaatggtatgtcttgaaacaaatcacaaactgtcaatatgttggtgatgaatttcttctgttttcatttggatcagtaggtggggcagttcaccaagtgtgagatcgacatttaatgttttcatgaaatgcaaacccatcagtggctaatttgtgaaaaatagatgttgggcttttcttaaggctaaattgttcccatttgttttagagaacaactcacttagcctatgagtttatgcaatttggcagaaagtgaaaacatatttggaagtattgaaagtcactcattgttgatcttttatattggaatgccaaggttgcatcatcagagtgtcgttatgaaaaaaatcaaataaaattagaagaaagaatcagccttctttataaacagagagatactatatattttaggctactgatctttactgtgtctgtataaaacgttggtcatgttgatggagtttatgctttctctcttcaggttcattctgacatgtcaggatatggaaagtccttttttccccccttaatagtttgagactgtagccactgtttccagaatggagtgctattgatacctttgacaagttgcttgccacaaagaaaattgctcaaaaggagctgcccaattcttagctgctatgtatttaactgttgtcacggcttctgttgtttccaagctgtcccaccataatgtaatttgttttaatctcttaaagtatatcattgcttacatcattatgcccatctactttgtttatagctgcctcagctcatgctgcaagtcttcatggttgtgtgataagaaagagaatatatcagtttcacggagaaacgtggtggtggtctagtcttgctggttaatgttgaatgtgactattttttaaatccttggcacgactggcagtctgtgaggtgtgtcacgggcctccatcatggtggtgggtatgaagctgtgcactacttctgtttttaacaccttccttggagctgcctgaagaaaattgcaggaattttttaggcacatctactggaaagtgcttattttaatatttgtcaacataattaccagaaaacattaaccctgaagtgtgtctctcaatacaaacttgataatcactaaatatttttaatataggcctttgaggaaaacatcgtaaatatcattagtcttatttttctctatgaattttatttactatacattagttgtttagaattatcttttttctcctttgtttgatggtagtgagagaagaacactactttttggaagattataaatagtacattaagtgaaaggtcataaatactgtaaaacttcaataaagcactgggcaacaacatgaattcacatatgcattgaatggggaggaagagttaggaagtgaccctcaagaatttgggaccttctttgttcattttacagtcatatatgttcaatgtaagttccactgtccttgttttaatgctttcatgagatgatatagataaattgaaatatatggtttttaactaaattcaagataacacaagtctccattttatgtaatttaattttttagactccacctgtgatcttatggcgcagctcgatggcagttggaggtgcaagtgattcccaataatgaatcacctttcaaatgtttcaatgatgatgtgatagaaaagacagctgcagtagtgtgacttaaaaagaaattacctgactgcccttttttcccaattactggcacaatcttcatgaaatccaaataaacttaatagaaggaggaaaagccatgtgagtggagctgacctgccacaaattaattatacttagtactttgtgccagcatggcatggtggagagccaggactcgagagaaacacataaatatagcaggatcttagttgcctaggtgagcaaggaaattgctgcttgcaaaacatgttggaagttattagttagcataagatgttttagcatttgcatttattaatctgacttatgcatttaaaatatgtttctgtattttacaagaccagatctggaggaggctaaatgccccaagtttcctttcacaccaacatcatatgctcatatatattcagttgattaattattttaaataaagtgcagctgtcttgtcatgttaacaggcctctaattttatttgcctattcatatgtgaaacaggagaggctagcatcttaaaaattcagtgtaaaagtttatatgtacatgtttattttataacattttggggtgatttttaaaaattatttttcagacattgtcaaataaggtagtaaaacaagattcaggtattattggttcttcatttttatttttatgagaagtactgcatttgctttgctgctattgcgacagcattgccagtagaccaacatataccacatatacttttgcttttaaatcctgcttaagatacattgattttaatagaggaaattagtgatatattaaaaacccatgagcttaattagccattcacgaatgactagtgctatattctatttgttattgttttaattaacagactactttttaaagagcattttaggtttactggaaaattgcatggaaagtcctatgtatatgctcatctcctccctgctctccagtttcccctattattatcttgtattagtgtggtacattttttacacaataatcaatattggtacattactaaagtccatagttcagagtttactctctgtgttatatagttctatgtgttttgacacatcatgtatctaccattttagtatcttacagatgggtttcactgccctaaaaatcttccgtgccctacctattcatgccttcattcctccctccaaacccctgacaaccactggtcatttttctgtcttcatggttttgcctaaatctttccggattctttcactgagcttctgcttctttcactgagcatttaaggttgttccatgtcttccaatggcttgaaatctcatttcttttatcgttgaataacattccaccgtgtggatgtaccagcacctaccaaaggacatcttggttgcttctaagttttagtaattatgaataaagctgccataaccgtttgtgctcaggtttttcctgtgtgtgtggatataagttttaaactcatttggataaatactaaggagtatgactgctcaatcatggtaagagtatgtttatttttatatggctggtgctactttatccctatccctccagttttattttgttttgttttttgatatcggattaatagaattgaactaatcacaatccctttgttcttaacccactcttatcattgatttgagggtgactttttatttaattagttatttatgataatatagtaagtacttctgacctcaccacccaatacaaaatctagatccttgacaatcacatatttcttaagtgtgtgtactcctttgcatattccttgcctcccctaacctgaggccagtgctattttagttttaaatttaataatgtttccatatatatattctacatatatggatggaattctaatatatatacggaatatatatattctaagagttcaatgattatttaagacatacttctctagaataatcatccaaataatttaaaacaagattttgcctctgaatatgtaataggcattaatagattttcacttggattttctaacattagtttttatccattttgatgccattcctagtattaatgataaatttttcattggcaatataaaaagaaagtcttctgctaaaaaaactaaggctgttagtgaagttataaaaatcacaaaagactaggattgtcgcatcattatgtgaaacagatccttgggggaatacatcagattgtaatgccacgactcctgtattttaaatctacctgcaccctaaagctaatggcaataatgccatttcaactgaaacatcaactggattaaaaaaaatcctaaaggacaaggaaaattcaagctcttggctatgcagtgctgcagttgacccattcacttctctgttcaggtaatctagttaacacaggcttcagtatcaattcattttaacaaaggatggttaatgtcattgtttgtaacattttctagtgagaataaacctgaagcatactatataaataagcccttgcttgcgctgactcaggaacacaattcttaatttacttagtgctctctgcagctacttgtgtatgtgtgtgcatgtgtgtgtgcatgtaggtatatcttatggaacttgcttctaattaacaatacattagtcctcgctacttctaattagcaatgcggtagccctgccttatccacagggggatataaaacccacaatgaaactgcggatagtaccgaactctgtaaatactatgtttttttcaaatacgtatgtatttacaacaaagtttaatttgtaaattagccatagtaagaaactaacagctataataataaagtagaacaataaaaacagtatgccagcatcactactcttgtgcattagggccgttataaaatagggttacttgaacactagcatgttacctctacagttgatttgataaccaagacaactactaagcgactaatggatgagtagcatacacattgtggatatgctggatgaaggaatgatttatgttccaggcgggatggagcaggacactgagagattgtatcatgttactcagagtggtacacaatttaaaacttatgaattgtttatttctggatttttccatttaatatctttggactgcagttgaccatgggtgactgaaactgtagaaaatgaaaccatggataaggagggactattatagttaacttttggacatgtggtgtttgtagtagcaaggtgattttgcagttgtactcattatcacctactgacaaatattattatatataaggaagattatttaagccatccaagaggaagttgcaagtaagatggacattactcttggtttcttcagatgttcttaactctttgagaagtaaaaagtctgtctttactccagaaggtaagatcttgctggatggggaccatctttcattcctcttagtgtccttagggacttatgcaaagaaagacttttttttttcctttttgagaggggatcacactctgtcacccaggctggggtgcagtggcacgattacagctcactgcaagccttgacctcctgggctcaggtgatcctcgcacctcagtctcccgagtagctgggactacaggtgcatgctaccacgccctgctccttttggtaatttttatagatttgggtttcaccatgtcacacaggctggtgtcgaactcctggcctcaagaaatccacccgccttggcttcccaaagtgctgagattataggcgtgagccaccagcaagaaagtcttaagtattattgctgtatgaatggatgttgagagcttcgagtaatgtgtttagacttaatattacaaaagactctcctaaagagcaaagaatataatgtgaatgacgtaaaggtgtataaatgaaattaataattaataaattaatgaaaagtataataattttgaaatataaggaatagttaataagtagaatagtaatagaaatgattagggaaaataagtcattggttattaatatgtgagtacatttgataaagaaacacgctctgaggcttggtgagtggaatgtactgtatgaatttacactatagttcccattcaggaaacagtgactaagcacttcctttgtgcggagtactttcccttgttctggggttacaaagaggaaattatatgattattgtcatcaggaatcttatagtataatagatcatcgtgcctataaagaaacagtctaataaaacagttgttataatggaagcatttgctaagtgtcaaagcaatgggaataacagggaaagaaaacctaagtctgcattactggaggtgaagctgtgaactactgatagagagtaggatctattactggactgggaatcagaagaccaatttataatcccagctctgtactttctagccctgacatcaagcaagtcaatttacttctctgaacctttttccttcaatgtaaagtaaggataataatattaggtctatctagttttaggattatattcaggataatgagtaactgtgaaaatggttagcctataaaatgctatgtgcatttgcatataagctgctttcactgttgacagtgtgtggtgttgtccaacctgaccacctttgtttggaagatggcgtggtactatttttcttctggtaggtggaatagtaaaagttcagctgtgaaggttaatttttggggaagaagacctgcattaattctccaggtagatgtctatacacaaatgtaagctttttatttacaatgtaagttatttacattgttagctttttctctgaaaatgtttcaaaactattgatgagcattttatttttagtaaagttatttcattataaaattaatacttagttgtggaaaatctggaaatatcattggcaaatttggaaaaaaaaattgtatacatcaaaaaattattgtcatctggaattctgacatcccaagataattatttttaacttttaaataatattctcaaaattcatctcatcagagagatttatgttccttaaaatgttagtatgttgctgggcatggtggttcacacctgtaattccagtgctttgggaggctgaggtaggaggattgtttcagcttaggaattcaaaaccagcctgggcaacatagggagaccccatctctacaaaaactttaaaaattagccaggtgatgcacgtctgtagtcctagctacttgggaggctgtggcgggaggattgcttgaggccagtagttcaaggcttcagtgagctatgatcacaccactgcactccagcctgggtaaaagagtgaaaccctgtttctttatgtactatagggatatgttaagtatttggcaattacaaattttattcacatctagacatttatttgataatttgggtttctaactcttattagtagtttgaaattatttattataatgttttgtcattggaaataatgcagattttattttcagactttaattactttatcttggatattagacttgctattcttattctttctttgtttctaatattttctttctgtttaacttcattcaaaatttcatggtttgggtatcattctgtacacctatgaattgatttagattattttaaagagtataccaataatacttacaaacacatatctagtgcttgctatgtaccagacactgctctaagtgtttaatgcacctggactaattctaacagtaacccaatgaaaactaatattttcctcattttataaatgagaaaatcgaagcgtaaagagcttaagtaaattaaccaaggtcacacagctagtaagtgggagagctagagttcatacccacactgtctggattcatagctcagactcaactctttcatcataatgcacctcttgacttacaggacatttcgttagtgacaagaatttccaaatgtggcatttcattttctgttctaagtattttttaggacagtatattggaagcagatttgcattcatacctatagaagtaagaatgtagtcattaagggaaaagattataccatgttgctataagagatattttagattccgtgttttctttgcaatttaccttttacctatataaatagttcaaataccttatcttagcagtgatgctacacataaaacatgttttattaaaacatagctaaagatgacaaacctgcttcaatattaccaaagaaaatcagattacatttggaataaataatcaacaggcattcaaaaatatgtaagtacatagttcagtcttgcaagttatagtctatctaaaaatatataggtaagtagtagtctgggaagaaattatagccatctgcaatacagtgagatggatactaggggttttcttacatatcaactcatgcaagaagatactgatattgtttctttagattatatgggctaatcaaagcaaattagaaaactttacacttttaatttacatttaaggtattttacctggaaaaatatttcgattttatgtgtagattttgctaaaaatatgatattgcatttaatgttatcagttaatgttaccaaactcttctaaatggagaaattctgtgagatccctggtgtctctaaaacatttggtaataccttcaaatgaacatccagcgtattcatatctacacatattccagagccagtgtctctaaaacagatagggattcagatcattcccacatcagagaaagacatgctttagtctgtgtaggttagggaggcaagagtcaccctctttgtgtgtgtcagtgatttatcactcttccacccaaaagaaggcttgtcctctttccctcaaccctgttagtgcttgggggtttgtgttcaaacataaattttgtcatagctatactatagtagcagacatgaatagattcacttatatttccatttatttctcctgagtatgatctgattagaagaggtaaagaaacaaagcaactagccaatatgaaaggcatatcattaaagccagaataaaatctgactgttcttgatttccatctcaaaataactgatgtctttcctaagttgagaatgacctgatctgttaaaaacagattaactcatcaattctgaccaaatcttcttaagaaggctaataggcttctgttgactagacaccattccctgtttcatttttctgatatcctggatgggggtcggagtgttgttattcctgagaaaatcgatatatcactgtattggaaacgtttgcttgtggtagcaacagtcttgatgtttgatcatgttaggttttatgaagtgttgatagatttagctccagacttaagagttacctacccaggctgggtgcggtggctcacgcctgtaatcccagcactttgggaggccgaggtgggcggatcacttgaggtcagaagtttgagaccagccttgccaacgtggtgaaacctgtctctactaaaaatacaaatattagctgggtatggtggcatgcacctgtagtcccagctactcctgaggttgagacaggagaatcgtttgaactcgggaggcagaggttgcagtgagccgcgattgagccactgcactccagcctgggtgacaaagcaagactctgtctcacacacaaaaaaagagttacagccgggcgtggtggctcaagcctgtaatcccagcacttcgggaggctgaggcgggcggatcacgaggtcaggaaattgagaccatcctggctaacacggtgaaaccccgtatctactaaaaatacaaaaaaaatagctgggcgtggtggcgggcccctgtagtcccagctactcgggaggctgaggcaggagaatggcgtgaacccgggaggcggagcttgcaatgggccgagatcgcgccactgcactccagcctgggcgacagagcaagactccgtctcaaaaacaaaacaaacaaacaaacaaacaaaaaaacaaaaaaaaagttacatacccagagatcaattgagaatgcaataatctctaaaataaatcattactttttagtagtctagaaatcatgtggtaatattaatttttataagtggtagaacagagtaataaacagtttcagccatctttctcctaagtctcagttaagagtttctcctccattgtgaaagctgaaaatgggaaagaacctattcttcctgtctaaatgttgatatccttggactctaggatccagtagagacttaggtatcaacaccaagtatggcattaccttacaacactccaaacagaccctgattcataatagtctgtgctcttgcctgaaaactttatatatgaacatggatatgtttatttgaaggtatgtttaatatgggccatgaggacattatggttacctaactgaggatagagataataaaagcattttagaatcattgtaatccaaacttgaaagtagaaacttcactttaaaaagcaagatagtttatattttgatagtgctcccaaaagttgaagattgttcttatggggactcatattgttgcatagttgttagtaaaataccatttataatacaagttctgttgccatttggttaggaaataaaaagtaaccaatgtagtaaatgctcaataaatatattttgattatttgttgaatgcattaacatataattgtaaaaaaagtagaaagcacaaatcttagatggaaaggatcatagaactgaaaacataatataattattttgcagtacatctgagttatattgtgatgtactttcctaaccaagtccaaattaatcaggagctctgggagaatcatccctagaaacaatgcctttaaatagagggtcagaggaattttcgtatttctggatttcaaactgcaggtggctctcttgatctttcagttctgaatttaggttaaagactgctgttctgccttcttcctgtccttgttacatccagactatcagacttcctgttgaaacactgataattgtcttattattggattgtaagcaacatcgctttttctcacatgtagaagatagagttttttttgtttgtttgtttaacaaaatatattgcttggccttcctttaaaatggctctgatttgcctttgcatgtcttgtgtgaggagttgctaagtatcaatggcattgttgataatgcttgtaaaatagcatatcagtattctagcattattttaaaagaacaaaaaacaggtgattctaatcattttccttcctctcattttctgggtagcattgctgttttatctcataatttattttgtacacatctggtactacaggaattttaggagtcccaaaatgaatatgaaaacctgttgatacaactttaggtggaaacctaagccttatctgtccttttattcattctgatggttattttaaagaaattgctggataccattgaagtatagagatacaaatatttttataaattatgtgccgaagtaaattataaatcacatggcttatagtgtggattcttaaattatcaatcatatcacttcatatttttataagctgaatatctaattcttttgcaaagtaagttacgtgcaactgctaccttttaaaataatagataaatctaaaatatggtgggtgataaagtgctaaaaagatacttcttagcaatacttaattgtgttacaactgtaagcaccaacagccaaaagattgtttgcaataaagaccttatactaagacattcatcaagtaataaaatataacctcaaatgtctaattctaagtgatatgtgccttataaatatacttgtagtagtgctacaaaaaaggcacagataccaaactgaccttaaaagtggcacatgtggcgttactgcagctgggctattgtcttggagattcacagaggaggcctcccaggaattatttgtatgttccttttgtgtaaagtttttgtctggaaagtcgctgtgcaaacagtagctgttccatagcacctgcttctgttgagggagagtgagtcttttatttagagagcatcggtagccatttcattcattactgcacaatggacttacataaagagcagcattccaatgacgccaaaagaaaccagagcttccaacacgctgaggcgcttgtaaacattgagtctccctatgtttctttctaaacttttcttgcaattacatccaggtctttattttgaggaaaaaaataattgattcagagcaataataggaaaagttataaactgcaatttttaatttaaaaagctgtattatgtaaaatgctgtggcaatgtcatatataagcttggtcatttacataattattgctttaatcttcttaaggtattagaaaattaattgcattatagaaataaggatgccaaaatatttcatagaattttttttaatggtcatggaattgttttcagtgtgcctatcttcctaacatttaaatgattttattattttcgtggccaatcatcttcaatatgatgtcaatatccagtgcatctgctactttccagccctttcattgacccctggcagtgtggtacccatgtttgttactctactgaaactactctctctattgcctctagttcctaccttctaaccttttctctcagctattatcattcttcatctttatgtttgataagaccttcctgatacatcttctcttggttttgtttttgtttttcaagaaacctgtacccattagcagtcactcctcatcttccatcctcaaacccctgcccctgtcaatcactaacctattttctgtttctatgtatttgtctattctggacatttcatataaatggaattacataatctgtgttctttttgtctggttcctttcacttagcttatgcttccaaggttcatccgtgttgtagcatatatcaatacttcattcctttttatggctgagtagtattcggttgtatgatataccacagatggtttatccgttcatcagttgatggacatctgggttgtttccaccttttggctattgcaaatagtgctgctattagtgttcctgtacaagtacttgtttgaatgtgtcttttgaattctactgggcatgtatcggtatatatctaggagtggaattgctgggtcatatagtgattctgtgtttaacattctgaggaactgtcaaacagttttccaaagtagctgtaccatttcacattcccactagcaatgtaaaagggttccagtttctccatatcctttgcaacacttggtattgtctgcttttaatgttagccatcctaatgagtatgagaatattatggttttatttgcatttccccagtggctaatgatttcgagcagcatttcatttatttattgcctatttgtatatctactttgcagaaatagctattgagatcctttacttttttctttttcttttttttttttttttagtgagacaggatcttgctctgccacccaggctggagtgcagtggcacaaccttggctcactgcaacctccacctcccaggctcaagtgatcctcccatttcagcctcctgagtagctggaactacaggcacatgtcaccacacctggctaatttttgtattttttgtagagatagggttttaccatgttgcccaggctggtctccaattcctgggctcaagctatccacctgcctcagcttccccctttactcatttttaatggggtcatcattttatcattgaattgttgcagatatctcccattctctgggttgtgttttcattttcatgttagtgtcttttgaaacacaaaagttttaacttttattaagctaaattgatctgtttttttaattgtgcttttaatgtcatatttaaaaaactgttgcctaatctaaggtcacaaaaatttatacctctgttttcctctaataatttcattgttttacctaacttcattttttttccatgtggctatccagcatccctgcaccatttgttgagtctattctatttcataattgtcacccttatccaaaattcattgactgtaagagattatttctggatttttatttttattccatcaaactgtatgtctatctttatggcagtacctcaatgtcttgattactatagctttatagtaagttttgaaattggcaggtgtgtgtcctctacttttttcttcttttgatacatactgacctacttagtcttctgctttcttatgatgatcagcttttcttcccactagtttgtgactcaggttcctttttaacattcttcaatggtttccatcacaccaagcaccgaccaccattaccttctctgatggtttcatatgatcccattttcttcacttagaaaaatattcacagagtcacaaatcctgtctaattaattcatatttattagatgaggaataagaaatggaggaaaaagtcaaaaatcttaacacagtttttaaccacccctgggttgcccacttaacatcattcaaatctgcagcaaaaccatagaggagactaaggtagtagggatggagaagagaaatttttgagaaatcctcaaaaggtataattaacgagactattattgatagagaaataattgggtactggagagaacagtaaaacaagtccattttgctatattttggcaaaaattataatcacagctattttcttttttttctactaataattggatggttatgtttaagaacagtatgacaaaatatcattttagttgaaagtgctaaaggatgatacaaatatttttgatggttttgttatacttactagtaatctaatatgacagtattatgcgtacatgtaccatgccttctcgtgggatacaagctatatttggcagcagggggaaataacaaatcacaagaataaagagctcatatttttacattcatattttcagaatgactttagtgtttccccttgtgtttcccatgtgtgtttcaaatcaccttattcaattttgctatctctgactcagatatagtgtactatacatatataatctgtcatcagtttcatttttaagtggaaaattacattaacctctggattttcagtgaaatgtttttcatggcactatgaaaacacaatagtgtaaattgtaccatgttgacatagctaattattcaaaactgggtcatggcttaaattgtagtgagtagaaacatacgcttaaaataattgtaagccaataactatactttagagactttgtgcctttacttgtcatatttttgagactcgatttgatttcctgtttagtttaacaaattattttactcagggctttacaatatctgtccagctcattagttgttacttcttttaccctttttatacttgttctggcttttcaaggctcactgattaaccaccctttgcagcatttctcagccctggtgtgttagctgaagtcatactacttagggagattttaggtattttctgtaagtgatgtccatgggtgactttaggggagccatttatgtatggaggccactggctattggagcctgacaagaggtctccataactagttttcatcagaatgcaaaatgataaaattttgaggaataaccttaggcattcattggaacctatggggcgggagggggggggacatcctaaactgtgataataaaatacagaaagttggaaaaataatggaaaaatctataattctataaactttacagcctacctcaatgcacaaaaggtgtttattatagtataatgtattcccatcttttgttcaagcatcattccatcaagggaatgcccactgtatttaatcttgttaacagtatgttaattgcaagtgctagttgtttttctgctttcttttgtcaattcacatttattaaatgcatacttattttctaggcactgtgctgaatgctaggggtacataaataagactctgtgtcctcggggaatgcaaggatagtggggaagatagataggtaatcaattattatcataacatgtgtaaatgccagaaaagagaagagtaggatattgcaggaccacagaggggagaaggccaccgaactccgatgaagggaagtaagcaagaattcccagtagatgttgatgccagatctgaatttcaaagtcagaatgggaattagccaattgaaaaaggattgcaatagcaaaaaattctagacacaatgagagtacacattgaggcatgtgttaaggtttgagaaactgtggtgttttcaagaaactctaagttgtttggtgtaagtgataggtagtgtacttttagggaaagtggtaagaaatcagggcataaagggatgaagttacctactcactaatggcctagcttgcagtatttaggagtttagattttattctaaaactaacatggaatgagaatatgttaagcagagaagtaacactctcagattaaataattataaagatcactctgattatggtctgagagatgtttgggacctggttggggatggagaaggggccatttggtcttgaggcagagactagtctggagcttcttgcaatataaattgaggcaagacattgcacatgtcataaagtagtgagaataagagctttgtacatattctatatagagaaaaagtacaaaatttggttttagaacttgataagggctattattttacattactcaaattactaaattacggttctatttcctgaatttatccttgtcattttgattggaattttgagtgttggttaggcaatttagtgccagatctttgaactgatcagtttaatgccactagatagctattaataataatagccattatctgtaggcttttttctattctaatttccctaatttttaagctcttggggggccagtgtgttacctcattcttgtctctttttacatctattactgctatgctccgcttaaaaaagcactcaagtccacaaatcttagtgtaaaggaagtatttcaaagagattatctcaattacaaaagaacttgcataagtttcctggaatatttttaagagagtatattatgaaaacttaattttatttgcaccctttgcctaaaggatgtactgctttgtttcagagagtctgacttatgtgactaactactttggctcttttaagttttcagttttcctcgaataattcagtatctctattgggatcattaactgtttacttcacacaaccatttactaaagacctggtctactcaaaggactataattctaagtaagacagtatgatgcccttaaggaacatgtgtaaaccattgtatggtatccttcccaagggttctggattctgtattttgaaagtctcaaattcactgccagccatctacaaagaggttgcttctttttctggtagaaaaacaattcctaatatgctataaaaattttgttgagaatatttgatcttcagatatagttaggtttccatagatacatctagactagatatccattccgtgtcaagaaatgaaaatgtgagatttttatgagcaagattagcaaacaattaaaaccagtttccaactttaaatatttgaaatcctcacattcacagtgtactttttttcctaagtaagataatagcgtcagagatcagaaagatgccagatctaataaactaagtcagctgcattagaatgctagtaaatgtccttttgaaaggtcatctccattagtccttttgttgctctccttatagggtttttccccctctttctctctcttcttttgaaaatggtcatagcttactttagctaaatagagaattttatgaattatttaaagtctctgtatttaaacaaaacaaagcaatagagaatgtctaaatagtataacaacataagtaaacactttctttaaagatgtttgaaagaaaagagctggaaaaccaaagttactgtcacaaggattggtaaattccctcaggataagttactttgtggtacatatcagtaatttctttttaaagagttgctggatcagtgtaaattttcaaactctaaataaaactatatatgttccatctatgtcttgatgatgataaagttatgagtagatattaattacaagcatcctcaaaagaaaatatacactggtataaagggccaacatgattttaacttgctcttttgatgatgacttctaatacttcatgtctatgttgttccagtaattagcatgaaggaactgccctgccagctgggaatgtcttaaagccatcttcttattatcttttaagttattgataatgtaacagagattttgaatttaaaatatataaattctgaaatcatttttttttgtagagcagacattgttagtgtgtgcatttttttttttactgtgacactgttttatgaattaaacttaataaaggcaagtacttgtattactgctaaaaatgaaaaccaaaaggatccagatattgccagataggatttggtcagaattatttgtttatagaaattaggattttaaaaagtcaatgaaaaatataagtgttccaacaagcattgtagtccacttttattattatgtatgtagataattaacagtttcaatcatattgtgagtagaaacgtatgtatgatatagagtgatctttaaaataatctacatggtatatacagaacagattttttttaatgttgttagcctaaggttccaaaaaataggaaagtggaaatcaatgtggaattgtcaagtctgcaaaatatctttccttgggattgtacagaactcattctaaaaaaaaaaaaagtcaaaaacttcatcctgcagcaatgttctttcatgacttaggactagaagaaagagagaaatcagactaccatcatgtaacgatttaaaaattaatccatacttgagacccctgtaccactgagttttttttaacataacctcctcttttctcgtataaaaaaactagattcagaacattacagttgaggaggaatatattaccattgtaactactgaacactctctattacttaatttttttaaaagtgtgtatgtgtggattggatacagtaatctaggaaagtctctgtgtaacagtgagcatggtatttttctagacattgttggtctcagaggtccccattaaaaagaataagagttgctacttctcaaaccttgtcagatactgggcatattacctgcatgcacaatggagggtttgaggataccagtctacctttgtgataaccttgtttatacacttacaaaacatatcggctagtgtatgcattatttctacaacactaccacagctttgcttgtaagattttgtaagaaatacacaagaggaaggaatcataggccttggattctgaaatgtctaattcagtcacagtgatgcagtgctcaaatgaactatagcagatttaatgagcaatccaggacagagacacatgtactggacacactagggaaagagattacgtgtacaggggctaattagcatgaaatatgaatacattcatataagtagtcttgatctatgggacgccttcattattgggaatgatttttgcatgaagttaatgaagagaaattcaggagttatgctgtataaagaattttaaaatagtattttaactttttgattctgcaaagtctcaatttctggagcaaaaaagaaattgcatatcatgaaatagtatgagcaaatgaatgtggatctattttctacagtgtctaaaatataacaaggtggggaacagtagctatccttcatttaactgattaatcaacaaatagacttcaatctcttgaattagatatgtacaagatattgagtgtcagtttgatattttaaataagggaatgtggtcatagtgtattccagaatatatacctctagccagatagttgaaaggcttggattcagtttgttgggtattctaagcatctttaccaaagaaatcagtcttgaagcaggatttagagaaagaatggatttcgactggacatggtgcctcatgcctgtaatcccagcactttgggaggctgagatgggcggattgcttgagcccaggagtttgaggccagcctgggttacatggtgagaccctgtctctacaagaaataaaaaaattagctgagcatggtggcatgcgcctgttgtcccagctacttgagaggtagaggtgggaggatcccctgagaccctgtctccaaaaaaaaaaaaagatttcatttgttttaagtttggttaaggcttataggaaaaggagccagagaagtgagaagaataatatttgaaaatagaccaggattgtaatattaatttgaatatcagatactttattccatttaaacaacagttttattctaatttgaggtttgaaatttaacatatgaaaacttggaatttaaaagaatttttgataaatgttaaatattggaagtttgagaaattaagctgatttttgccactgcccttcaaaaaagttcaacattgtattgcttaaatatgtggctatatttatgtaaaatacacaattaatattaatattttattatttcgtatctgacttcaatacatttttatgtgcttcctgtttgtggatatcttagaaactgctacagaagtcaatattcttagaaaattcagtaattcagagatgtgaaattagaacaataacagcttaagtggtttataaacaaagattatttgcaagaaatagaatatttctgtgtaagttcattgggttatgtgccatctagcagaaaaataggctgtgtatggtgtttatgttcagtgttctcatggttgcccatggtactgaactcacacctttatatgtgcaaaatgtgtgtaagtgaagcaaggagttagtggagctggtaatcagaatagaataggaatgggaataaatttagaagtgaccatcattctctctgtcccagctttgaacaagtcaaaatgcacatgattttgtacatttcattatcagggcaccttttgagagagagagtcgattgacaaaagatgggtcgtaaatcagactaattctttgtgtgactgctctttgctttatgggaacatgtttgactttagggacataaacttcagggaggtgcaataggtagatgacaatcattaaaatagcagaagacacttgctgagtgttgagcatttaaattgtgctaaataatgtgctggatgagtttacctaagtctcctcatttaatgctagcagattccttgtaagatataggtactatttttttttaatctcagatttatagttgaagaaacaaaggtttaaggagataagtattttgcttgaagttacacaacttttaagtggtagatccagtattcaaatctgaatcattcatacaattgaatgtatacctcatttaatttagtaatatattattcttaaacattgagagtaacaaaagttccttttgaatccgtttttctatttagctaggcaataagatggcctcatttcatcttttgtgtactttactgtagtacagctgtgagaaaatcatactaggctttctgctggttagatctcagacatatatgtatatttatctcctgctgcctgtcgaagcactttttgctcttgcaaatgcctgtaatctggcctgtatgtcctctgtcactgtaggttccacaaaatagggtctctttccttcctgcaagcattgccttgggggatattttcatgtttccttttgtgttcattcatggcatgtatgttcattttataccatttaggaagcatgagagattttaaaaaggtctcttgaatttatatgacgcaattgcaatttagaagtaaccatcattctctctgtcccagctttgaacaagtcaaaatgcaccttaacgttttattcattttgctattctttcagtgatggtttccctatgtctgcggtttttcgttttttactgtgtgtgtatccttatatttttataagtactttattctggtatgtagtatatactataacctgctttttgaatctaatatttattcttggaacataaactaatattctgcaaatacatgattttattggctctataaaactcccttgtaagaatatactatgatttattatcattattttttaaatttcaatagctttagggtaaaattggttttggattacacggatgaattacatagtagtaaagcctgggctgttagtatatacatcacacagatagtgtatattgtacacaatagatactttttcagccctcatccttctcccaacctacccccttctgagtctccagtgtcgattatcccaatctgcatgcccctgtgtacccatagcttagctcctacttataagtgacaacatgcagtatttggttttcctttcctgaattacttcacttaggatagtggcctccggttccatccaaattgctacaagaaatgttatcttgttcttctttgtggctgagtcgtattccatatacacacacacacacaccacattttctttatctgctcatcagttgatgggcacttaggttggttacatatctttgcaattgtgaattgtgctgtgataatcatacaagtgcaggtatcttttcgatatgacttattttcctttgagtagatatccagtagtaggattgttggatcaaatcatagatcttttagttctttatgaaatctccatactgttttccatagtcattttactaatttacattcccatcagcagtgtaaaagtattccctttgtaccacatccatgccagcatctattgttttttgactttttttttttttttttcttgagacggagtctctctcagtcacccaggctggagtgcagtggcgtgatctcgtctcactgcaacgtctgtgttttttgactttttaataatggccattctgactgggataaggtggttatctcattgtcgctttaattttcattttcctaatgattagtgatgctgagcatttcttcatgtttgttggccatttgtgtatcttattttaaaaaatgcctgttcatgtgatttgcccacttttcaataggttcattcatttttttcttgctgatttatttactaagatttatttatttccctgttgttcaatatttagattgtttcaaattatttgatattattatgccacatagaatagtcttgtatataaatccttttgtaaatttcttattgaaattactggtggaaggatatgagttgttttgaactcttgttatgtattgcaaatttgtttctgaaaggctttcaaatttagattcctaccagccatatgtgagtagcaatcatttagaacactcacaaatactgagtgtcatgattttaaaaaatattatatttgttaaattgatgggtgaaaaactgtatcttattgtttttatttatatttatttgcttactcatgatgtttaaatagctttattacatattgaccattcgttttcgtctaatttttgttcatatagttttactcatttttgttttacaagtatagtatgtttcttatttctttaattatatttatatgtttatattaacccattatcaccatttttgcagtttgcaattttttcctgaagttttcatttgcattttaattttgttttaaagtattttaagataacctgtagtttttttgtggttgtggttgttgttaaaattagtgggaccgttgaaactagaatttcccttttagataaaaattttgcattagttacttcagggaaacagaagagtataataattgtgatagggactcaagagaaattatacaagtggtgctattcattatcattggcttccattcaaatggagctggatttgttattttcctatttctcttcctgagtctccatttgtgacagtctcttggcaggatttcagtctacttctaacttttatacttgtggttggagcccagccagcttctcctgctttctgggaggagctcactctcatcgtacatctattgacttgcatgtcttgtaatggtaaagcaatacgtggaaggtattcaagtttcctgagactaaagtgggtcatatctctgtcccaaaactgaatcatttgaaatctgaaagtgactttaaagatcatcgtttaaaaatctcaccatgtagatgagtcaaatccagagacactgcttttgcttgctttctcaggcacacagacttcactgaagagtagtaagcttgattgattctctgacagctacattatattgtagagaactttgttgttattgatctcatttacacatttaattcctactctgtatgtgggaatataatattttactgatttaataaaccaggcatgatttcttattgtgtgatttattgtgtggttcttttttgtcacaaactttgtaggttgagacttggcaagtaacctacccttgagggtttttttttttttttctcccagatgatggtatgtgtggtagtctctctaaggcattattatgaagacatttattaaatctcggtctatttgagtgccacctaacgtctagatctctcaacagttttgcctagccatcatttctcagcttgggatggtgtagagaaacatattattcccacctgagcttatagaactgtagctaacatcatcagatatcagggctttgagcaagcctgcttgtgggtggtttatcttttccagtgatttgagacttgtgttgcattgaatatactttgaatttcacgtgtatctctgctctattagtctgtatttgggttgttttgaaggatttttattttaatatgtagactgatacatttttgtatatgttgctggaggcgcttttgcactgctatgttttagaaatcaaaataataaataatgcatatggtgttcattgtttttctcctctgtcttttgatgactattaagtttcattggaagtgttagtaacatttctttatttttatttttactattttaaaaataatagtaataataataataaacgtttagctttttagccaggtgtagcatttcctaatttgaaaatgtgctattcattttttaaatagactattttgtagagcagttttaggcttacagaaaaaattatgcagaaatctcagagttcccatataattttcctctccttcagaatttctcacattattaatatcttgcattagggtagtacattttttactgttgatgaaacaatattaataaattattatccttaaagtccatagtttatatcatgattcagcctttgtgttatacagttttatgggttttaacaaatgtcttgtctactatatactgatatttgacttatcctttgatgacagtgtaatcattccttacatggttcattcattcatttcctcatttcatatattttttcctgtaactatttattgagtacttcttgtggtaggcattctgacagatgctaaaggaaattgccaacctacgcacacccgatgatgatgttgaggtcatttgtgagaaaaggctttaaaagggaataacctttgctgacagaatggtatgataatcagaatggtactgattactggcttaaaatttctacttgtgaagtgtttcaattaaaataggagtagcatgttccaattatgcttcagacatttatttgcagagaagtgcagtgtgggagctatgttaactggtggctgtactgggtatttctttatctcttccctattttttgtttgtgatgaatatttctttatatcttccctgttagaagctgtcagcggtattcaaaaaaagcagtatttttccttggaactaactattctgggacagtgtaagccaatgggaaattttgacttaatgaatttcccattgtaaactttcggcattaaatctgttgataggtgcaaaaaaattgtaatatttacatatctttgatggggaaaacagggttgatttctttttacctaaaccaagcattccaaataaataaataccagtagaaatgaagagtataaatagaaaacaataggaagacttaataagacttaattgagttaattcatctttctttctggttctgtcattccttttctctttagttgtaagattatacattgactagctagcagtgatgccttcaggctagacattagtatacgtttttggtaggttcttatataatctgccaactattactcttgcagaggttatttattattattttttgtaacagtttaattgagagtatattatttgaagctagactatcggagtttaaatcctggctgccatgccaccaggggcaggtgtcttaacctctctaaatctcagtttcatctgtcattataataatacttttttaacatggatgttagtatgattaaattgatgtacatgcaaaccagttccattaatcactgcttagaatttgttgtgatgattatattgtaagagaccaagttgaagttcttcttgatctataaatgtatttctaatgtttcttagatgaatttgttgaacattaaagagatttcctttcatggctaatggctgtgctttgaaaattttcatattaaatgtagaactataatcctctttctgtgtagattgtgaagctagtactttattttctttctctcaggcttctgatttatgttttcattgagtgaatatcagaccattgctaatgtcataaaataaaatccagaaaatagatgagtcactcattgaaaataaaatctgatcagaaatcctttgactgtgttacattttaagataatgaatgcttggtttttgagttttactatcataccaacttttcccatgtgtgcatgtgtgtatacatgtgtatgcatatcagaaaaactgaaatactatttctgctcaattctattttgtgaagtcaatccaacttttatagtcccataaatatcaaataaatgaaataattattgtcactaaagtggagaaactattgcttcttcttatcttgtttattttgtttgctacttaaattgacattgaggcaaattttaagtgagtttatgttgtgaaaccctgctaaaatttagaactcactgtagtttgttaaaatatgtaaaaatccattttaagtaagtatgaaatccattgaagatacttttattttttaagcaaccttggagtgtagattttaaagaatacttgtctggcaatatccatagcttaaaatatgtagacatgaataccgatagttgaaaattaacttatttaaccatttgaaaatgagatttattttgttttatccagtgaaaaatacaaaaccaagtagacattgttttttggttaaaaaggtcacaaatttatgactgtatatgttactgggattagaagtgttttccctattggtagtttatcaagtgagtgaatacctttctgtgaatgtgaacaagcttcaccaattttagcagttcaattttagagaagctgtgatgagttattttgcacaaaaggctttatctttcaaactgctttgctatctttgcttgacagagagaggatttgatgactttttcaaaactcccctttactgcttcacctgagtaatgttttagttgccgtgtaataaaaatggagctgagaattgaaaggccaaagcagagggagttttatagcttgggatcttttaagtttcatggatttattttgtatttatatcctgggggggatgtacattctgatattgctcagtttttgtctgttggggaagtcagttgtccaaaatagcactgtattttctaatataaaaagagtaatgatttgccttttgtgagggataattttaatggtacattgcagagatttagttggggagaaattataggcattattttaatatttataaagtattttgagggccatgcaagaaggctgcatgtaagtacactaccaataaagtaacaccactaatacaattgagatactaaaaaaagaaaaaatatatacttaccatctagtgagcagagactttctttccctaatttgcatttagaaagctctaaattaaaatgctaaaaggaagacaaacaatttcagcacatgctgctggttttgtaaatacaacttgctgacttgatataattttaaatgaatactcttgacattaagacatcatgctttctgatcatgtattggtaagccacagaacaacagaaataagcttgaaatgggcatagtttttaccatagtgtaactttaattgcatgcttttatatcttcaaattaatttttgacatcgctatacagaaatagacttgtacaaagaaaaatgaataacttgcttatctacaagagtgtcattttacttgtgaaccattgtaacaggttttttgtttgagcatacaacaaacaaaatatgtaatgttgttttatcttccaaaaatacattgctgtataataagaaattgtcattttgcaataaaagaaaaatccaccaaactggtatatatgtgatttattttttttttggtcaaaccctgtaagtgacaaatttgacatttaatgctatattgtaaactatcaggtatctttttttcttgcttgttaacatagctatttctcacgttttctcttcttcaacttctttcatgcctcacctctaaatccccaaagtacacaccacacaaacacttagagaaacataaacatgcacatgtttgatgacctacctcataattcattaacaaatctagaagcactccatcaagagccccttcatattcccttgcaaaatctatcaaattgtcctgtatctttattgatattatttcctgttaccatggacagaaagagtccctgtacctatggaagagcaatctgtccacttgtgccctggttcccattcctcagtgatttagctcctttctccatgccatatttattttctccttctcaactggggatcattttcagcagcatactaacatgctctagtgtctcttctcttgatagaaagaaccactctcgacctcatagctcactccaactattccctatctctctgcttctcagagagcaaagccccttgaaaaatttctctattattctattagtcactgtcttacattgtcatctcactctcagtcccttccgattgaactttcatgttcatcattccacagagtctactcttcttaagaactccagtgaccttccatgtttgtggctcaattattattttaacctctcagcagcattttatatatttgaccattccctctttcttaaaggaaactatgatattggttctcatgacttcatactctcctgggtttcctccctcactagcccactctttctcaatttgctttgttcactgctttaattggttttcacatatgttttggagatggaaccaataatacttgctgatgaattggatttgtgcgataaaagacaaaaaggaagcaagaaagactcctaattatttggcctaagcaactagttgatggtaccatttattgagaaaggaaaaacttgggtggtgtcagggtcaggggtcaagaatagagagttatgccttggccatcttacatttgagattttttttctagactgaaatcatgttggaaatgttgtttggtaagtagtaactagttagagttggagtctagaattccagggattagttatagctagaggtatcaatttgagatcattagcacatcgatggtattcacataatacatcgggttgaaattactttgtgaaagagtatacatggagaagagaaaaaattacaggatagaagccctgatgcattctatcatttacaggcctaagaaaggaggaagatccagcaaagcaaattgaggaaagtatgaccaaagaaagtagaacactgtgagtcatagaaccaaaataagaaaatgttctcagaaggagagtacgatcaaatgaatcaaatgctactaagagtttgaactagatgccatgttggtgtgagttgaagaatacagttggaggtgagagagtataagcagtttggctagacaattcttgaaaagcttggctctggaggagcatggagaaggtggtatgtgggaagggtatggtattagggtattttaggatttttttttttttttttttttttgagacagagtctctataggccaggctggatggagtgcagtggtgcaatcttggcttactgcaacctccacctcccgggttcaagcgattctcgtgcctcagcctcctaagtagctgggactactacaggtgcacacccccattcctggctaaattttgtattttttggaagagacagggttttgtcatgttagccaagcggtctcgaactcctgacctcagttgatctgcctgcctcggcctcccaaagtattgggattacaggcatgagccaccgtgcccagcctattttatgtggttttttttttttaatgggaaatatggaagcatctttgaatgctaatgagaataatagtgttggaaagaaaaagttgaagttgtaggagagagagaaaataaaaagtgaaagaaataaaagggaggagtcctagatctacaagtggaagaacttacctttgataggaggatccttttctcctttgtaatgggaaagatgaagatggtgtaaatgcaagtttatttgctggtggcatgattatgggtggggaggtgccatttgatagtttctattttctcattagttaggcagcagtgtcatcacctaacagtttagcaacagtgtagtatggattgatgtgaagtgaatcatttgaaaaaatgtgaagtaattatcggtatagtgttgctgtcattgctggataatagaaagtgttcccttgaaattgattattattactttagagtgatattactcttcccaattatgctattttctaagaatgccatacaaatgcaggcctgcaaaaacatatagaagcattaaggggaaagtgcattagataatgattactaatgtcaaggaatacatcttggaccatggaatttaaactagacagggaggcaagtgaggacaggagaggaatgatggatggtgggtcaaagagctggtggcttcattgacatttaataattggttcagcagggttacttgatcaactaaactggacctatagaaaaaaagatcatcagttatggtgattgaattgagatttgggaggttgtgttactttcggtggtcggggtgtgatgatcacaggattgaatggcagaggctgaattcaggaaaagatggagaagttaaactgagagactagaataggtctgatgcagatgatgaagtcactgaaaacaacagaagttagagtgaacaaaaagactgagtcagttgctacagtctttagtaaatgacaggggagtgactaggagatctgaagattaaatggaaaagatggagtagctgaattatgctacctaatacttatttctgtcaacaggatcatatgaaaatgaaatattggcaaaccaattactttatagaacgatgactgaatgaaaatcacttcatgcattgttagagatagcccaatgaaaatggattccgttgtgtttatctagttcagatagtacatttaatgagaacagtttaagtggaatgacatttatggtggttagccatgattataatgaatttttgaagcgtagtcagttaggcatatatagtaccctttatctataaattcatgttttaaaataaatatatatatatataattataatctgtgttaaacacttcagatatacaagttaaaacagcttaagggataaaataggctttttttttttttttttttttttttttgctgtgttcatagtaacactatataaaggatttacttgaaacatttcagtttgctcaagttagccaagtatatactttggcaggtgacaaggctcaataggagtccttgtgttttaagtcttggttctctgtgaccgtgtgacctcagttccataaaccaaaaaatcaaatggttgtattaggtacttttaagggatcctctgactttgttctatgattctaacaaaaagaaatttgaaatatttgtgtggaaattgtatcttagcttttatcattgacatcataatattatgtggtatatatctctgtaccccctttatataagattctaagctattggtgatggtgtgatttaatacttccggttttccttttattctgtaatataatttaaataggtattaaataggtattcaaatgatttcctttcaagcaagaccaggaaaacagcataatatagtacactgagaaacaccaagaaagaccagttatacattaccttgtatttgtaaatcatttcaaacctacagaaattgcaagattaagaatactacaaagaacacttgtatatatcctttaccctactcaactactgttaagctcctttttctccttctctctttccctcttccttaaccctcttccctctcttttcctgccttctttccttccaatctccatctccatctctatttcttcttcagcctcatttaatgtggaacatttccacagccattctttgtcttttatgacatcaacaatttgagaaatataaatctcctttttagaaacatagcattccttatgattagattcaggatatatgttcttagccagaattcagcataggtgatactatatgaggtatacacctggaggtactcactatctgtccacctctcattggagaagtcagttttcgattaaggtattatgtaatttctctagtgtctaattaactctttttttccttggaattaataagcagtctgtaggaagacactttaagaccatgcacatatcttgctcctcatcaaaatgttcccctaggttatctaacatttatcataatggttgtaaaatgatacgtggccaattacagtactccttccacaaatagcggttggcactcagcattctactgtaagcaagacctctcctttctcatctattatttttacttattgatagatttattattagtatgaacttataaattcccatttttcaatggtttatagttcgttactgcaatgcattacttggtgctaaatttttgccagatttagccagtgagagctccctcaagctgttcctgtgaaatgcctacattttttttttttagcactaccttactttttgacatacaaagacattttagtttcatcttgtagctactctcgcacaatcttcttttttagtgggaaattgtacctggatgctaggtgtgtgctcattgctactggaatgcaaggaaaggcaagttacttttaagttaacagacaacaaacattaaaaatgtaattagggcatgactttttagccatatcataggattgtacttttatatatgtctcatcggtttgatgcaggtgagaggtaattttgagcccatatatagtagcctaattataattaataattttaattttttaaagtaataatgtgtgaggtgaaggagtagcaaatacttactttccctaacataagaaaaataccattaattgatctaacggccatatattcatactctagttgagttgcctcagtgactcacttaataaaataagaaattaaaatgtcaaatagaattcgacaagagattttaaggagaaaacagagtctgtttctacctcagaaagttagttaaacagtagcttcaatcatctgctatggagtactacaggtgaagaaaacaattcttgatatttgtttatattttcaactttaaaaatcagattatggggtttcatagagtttactcaaggtgtggtagttctttgatgtttttaaaaatatatctttattgtagttgggacataatattgaagaaactaatttctacatgttcaatgaattgaataattcaaaattcaattcagaactcatacactcagtgttctcctttattttgatatcactcatgtttattttaaatccttttctcttcctaagcatctaattttttcccttcattcttgtattactttataagtgatcttattacaaataagcatacactgagtcattgcaacagaaaagtgcttcatatactgagttgctttctgttgcacttgatatattaattgtgcacttactatatatgcaagcactgtgcaggcagctctatttctttaaaagttacttaaattactggtgcttccaatgaagctggtggtagggtctgttccctatctccaaactattagaccagcttgtcagatgtattactcattaggttgctaaggcgtaaagtcagaatttcagatttataacatggtgacatttgatgtttttcttttgtttattatcagtgctgtatctgatggtggaaacaactatacttttaaatcttctgtctcaaaatgtattcttcctaaaatttcatatttttaaccattaaattttctctaaaatatatcttagaattgatggtatacctttcccccctttatcatgacagtgatgatcaaatccttgctttgtgaaatattttcttgacatatttgaactgggtagtttttttaaataagtgctgttttttgagtcatcttttccttttgttgccttttgctttatgaataatcatgtattctcacttggttcattaagtagtagtagcataatgatgagagtatattaaaagaatttattttagattgacccaatctatgtgagacatcaacaacacacaaataatagaaccacgtttttttgtttttttttttttttcctcttctggaaagaaactactcttactactaacattgaaactagagtcatccttggactttattcaaatgtgtcagttttggaaaccatacaaagatgttcgctttagcttaagggaacagaagaactttgttatgctctttgagtgttacattaaactagatcattgcctgaggagcctatttaatatgtccatctgatttatgattttttttgtagtcctttttcctttgatttgtcttatctttggaaaagttggcatttatttctcttttattttttacatgctctcaatgaatatctatacattcattactttcagaaatattgcttgctgaacttaaattatttggaatattgtgttttgagtttgcaatcacggagtgaaggtggtaacattgtttctaggtttacagaatgattttgttaaaagtatcactttctgtaaataccttagataccatatagaatttagcttttggtcttatataatagttagaacactataaatgtaagtaagtttttattctcattgttattattgattcaaagagactttaaatttctacagcaaatcacattttatccctttctggacatctactatcattaaggtgatatcaaagactgaataaaatatttaagtcattaagattttaattcttaattatgcaatctcccttgccagggctattaacttttataatacagggagggtagaaattcagcagagacattcatttattttcttttatgaacaaggctgtatagtttgcattttttccaggtggtttggggaatatttaaatagatcacacagctgctggcttggtgggtttggggggtgtgtttagcagatgcttccagaatctggaatttgaagtattcttaattttatctagagatgcagatatctattctctggtttaatttgtcaggggatgactacttctttgatgtcttagtgatatataactgtcttgctttgtttttttttctttttttttttaattggccactcacctcaagcaattttaacagctcagaggatatatttactatagcctttaataattagatggctattcctattaaatagctgaatgtatttttaaggataatgtggggttctttaattagcttgatagtttacctataagaaggaaaatgaaaactgcagccagctgcatttccacagctcatttctgtgtaagaagcacgtatctgggctaaagaagtatcactttcttcatttaatctgagatgagacaacatgtgaagaacttggagcaatctgattttttgaaaatcttttctctcattagctgttttgctcaaaaataaaagctgtcaaacagcaggaatttgagatgctcatgattgtgtttataggccttcaatatagtatttactgaatataagtgcttgttaaagccaatttatctgttaattcaaacaatttattgaacacctattatacaaaagatactttgctaagtatttttgaggactatagatgactaagctagacttggacccttacatgtaggagcttaatgttcaagaataagacgtgttcaactataccaaacatgaaagtcctaaaagtgaaatagagatgaagtgatactgatttacaaggaatgagagcagggaagacaaggagagacatgggcgtcatcatggaagcagaggtaattgagctgtgcctttacagctgagtagatttagacatttaatactatgtttgagggtgggggaaagatattttcagcagaataaattgtatattgaaaaccctggtgcttctaatgtcatattcccaggcaatagtaggtatataacatgtgggtagactacaaggttcgtgttggagatgggggaagcaggggtacctttaggggaaatggcagaaaatggtgttaaaaaggcaagattgagctggattatgaggtcccttaaatgctagtctaagaaattcagactttaattgttaagaaatttggaagcattgagggatcttagaagccagacaggagcagagctgtatttaaggaagtcaaatggaagagtataagatgagagggcctgagagtctgaataggcataatgcctttgggaatgaagatgagaagaataagagcacaaatgctgagttagaatctctaggagtagggaatttattattgttgtgcaatagggtatagggaagagttaaatatgattttatattaaacatgcttattatttcttgtacatttatctgtgggactattttagggcctagcatgagggttgatatccttcagaggagatttatgtttgcttttgctgggttgcaaaaccaacctaggctgatgttaatatttttggcttaaggttttcttttttttaaagactcttgaggagctatgaattcaggctgcatgaaggctggctttggactaggaaattatcagagaagatttttactttctccatccagcaccaaggtttgttatgggcaattttcttttcaggccccatgagagatgagcaagtttatttctaatttactgttaaactgaggtgtgatcctctggggtttgtaggaccattacctattactctttccactttgattaggccctaggcttggtttctattgccccatacttgaggccttgaaaactgatgctcaagttcatctgggttcagaatattcactcaaggtcaaagctgactccactgatatttatctctctaagtttatctttcacttagtttttggcctccaggtattccttactttcttgccaggttatctgtacgttttaaattatttttttaaatattcatcatgttcagttctcttcacaggtagttgatatcagggtacatattctatcatactttcaggaacagaaattaaggtgaccccttcttacatggacatgtgacatctcagaatgactttattcttgttatagtttcctaaacatgagatattggtactagaatacagaaattatggtacctggccttttctgatgtaacttagttttttattaatactcatttttagaatagggaaacacgctattataactacctattgaagaatcagagtgattcaggaggtgatttcatgggcaagaactatgttctgtcgatagttcaagtttccagtccctctttcacacaattcttcccttctccattcacaaaagaaataccttaaaagagaaaagtctaagaaaaaaatcaatacagtctacacagatcattatcttattaatggacctttagtaatgaatgtacatgtgctttgtgtggatatatgtgatttttgatttttcagttcaggactagagggcattgaatgaaagctgcctgcatgcagtcacttcaggctctaggatcacccacagtggctctgcttatcatatagagtgacttgacattgtaggattttgccataggaaaatctgtcttagttttatctgccaccagtaatgggttttaccagggaaacacatatgtcagctgttaagtttcatagtagtgatggaaattgaaaacataatcatagattagccatttttaagtgtaatatgcaccaatgaatgactgtgacatcttaaatgcattttgtttatagatatagaggttgaaggtcaataactggaaaggctggcctttaatttgttagattaggatacaatttagtttctaacatgtataatttaagaatttttacagtttggcaatatagttctttcactgaattcaataagctttattttcattgtctactatgtgtcaaattggtactactttctagtgatataacgatgatcaagatattgctgatggctttgagtgactcacacttaatggaggagccagatatctaaactaatgatagtgcagtatattaagtgctacatccaagatagggagaaaactctgtagaggcccagaggagggaataattaattctgcttggaagagttcaggaaggcatctcaaaggagatggcattttagcctagccaaatgtgttcaggttgagaaggaatggaatataaaaaacattcaacaaaggtattccgcaaaggtatacagccttgggatgtcctgattttgtctaatagtgagtaatctggtttgggtagagcattgggacaccagggtgctattaagttaatttggagccagattttaaaaggtactaaattccctacttattacttaagctttatcatctacatagggagaaaaaataaggataagtaataatatcttaacattttaaaaagataaccccagtaatgaatgtgtagaagaaattggagtaaaggggaggaaaaaaatgcaaaacaaaacaaaaatcggagtgactactgtaatttcatagctcttctatacaccctaatacattgttatagctgttcatttgtccatctgaaagcaaagactgtgctttaatcttttctttctttttaattttatttatttatttatttatttatttgtttattttagcgacagggtcttattccgtcacccaggccgccatacctggctagtttaatttttttttttttcacttttgtaaacatgaggtcttattctgttgtctgggctcaaaggatcctcccgcctcggcctcccaaagcgctgggattacaggtgtgagccaccacacctggcatttaatcatttttgcatttacattgcttgtatatgatcatgcgtgttataactgtagaataagtgaattaatgaatgaaagatctaagcaataattattgagggctctaaacagggcagtagaaatttaggcagaattttgcaggtagagggcaggcttagggagagaagattcaaaaatggcttgaacatttcttatttctatgctatatattttgttatgatgcctttcactggagtagggaacagacacaacacttctcaggtaactgagaatgagttcatgttggagcatatttatttggaggtcctgtggaagagataagagttggatttatgggtctgcaacccagagggaaaaacctgggctgaagatacagatgcaagaaacataagcacatagattaatgattgaagtcagggtagtggattgcacagggcaaaaaatataaagtaaaaaggctagagcatggggactttggggtcactaatatataaggagtaggtagaagtagagaatacaatatggaaaacagactagtcagaagcataggattgtttatcagagaagtctggtctttgaagtcattgagaagaaagtttcaagaaaaaaactattagtaatttaataaattcagtagcttcctatatcgatgtatatacatataggtaaatatgtaacatacttatattaatacagagttgaatgatagcaaggtcactcctatctgttgttatcaaatttcagatcttaaaccagtaggacaatttctaggaagaacacttcatgattcatttctcaactaagagaatagtgctcttatttttctagtgatcagcttgaagtagtttttttcattatgtgtgtttatgccttgcagtttcattgattacatactttaaaaggttttaatgtggccaagtattgaggatgtagctgtaaaagcctttatgtggtggtaaactccagcatttaataactgctagaaatgcaacatcttctctcttattgtatttgacagtttttttgttattattttgatactctttattttgccaagagttaactcattcctaaaggtattttatgccagggaaatttcattccactttgtatagtaggctaggttttatattaacctttgagtgtgcatttttactgtggattatacattactggaattacttaagcaaaattcatactgagattctttattttaaaactgataatgaccatacgtattaaagggctagctcagaaaactgccagcaaataatcatctttgcctttgggaaataatgaagtcattgcatcgtgcttgaattaccatagactatatcagcagatacactcattgattcatttctgttctttttgttaaaccaaatttttctttcatcgtttttagtaatgtaattttctatgtctggtatgcttacctgtaatttgacagaaccccatttctttgtatatctcactctattagactacatgtagtgcagtgtttgtagagggggccattaactaggaattgatatttacaaaggtgcctattaagtgccagtcactctgctttgttttaaacatagttcacttaatgaaatgataggcaaatatactaagggagggaatttgttgtagtggaatgaatatgcattgaaagcataggtttgatctaggtttgaatcccagatctaatagtcatttggtggacgaagtcacttcacgggtctgagccgaagcttttgtatggtaaaaatgggatcctatcttgaagagttattatgataattaaattgttgagagatacaatctaagatattcattaaatagaagatatataataacatcattgataattactattagaaaggaaattagacgtttgctttgctttgagtgctattactaaatgatgagtcgtatgtggcaaaaggagatgtggaacgtacaggcaatcgccttttaaataaaacctgaaacaaaaattatttgaaatgttagtttggcagttatgttggattatatacgtttcttaaggctagtgacttgtttcctggaattctttcacttcatagggtaacaccttgccccctactaggaacttaactatttctttaattttattacattgaagctgcttgaggaagcatgcttttttcactaaaaggacccagcaaatttcattctttcattggaatattttctcttaatatgactgcaaatgcagttagtaagttgaaaaagccacctgttgtcgtattggcaggccacctaactggtctgtctgtacttggtgtgcagggaagcttgaataactaccattaggcctgcacagtgtcagatttcacatactcatgacaccgtaggtaattgggtgacagccagtttatttcaatcagctaatgttatagataaatacttcatattttaggttagccctgatatcacagaatggaataatgttctaatcctcattagcagtttgttatgcagcaactttttgtatgccaataaaaatggcataggctgctgcttcggtggcatttccccttgaacatgccattttattcatttgttgactcagatagatggagttgtcatgtttctttgttggaaatgttgacagaaccttgtgggctgtgcttgtataaacgtttggttctctaaacaataattttcagtttagctctgttgctactgctacatgctatttttctctttctgtcacattgggaaattctattttgttgtcagtaaaaaaaaaaaaggtgtggtacttgcttactgtctatgtagactttattttgctagttgatttcattaaagagtgattccaggaagctttgggtcattgtatcaccttgtctcattccattatatgtattgatgcaacatggatcgttgaacagtataatctcttttgcacagttcctattgattttatccagtaaatcattgtctgctgggtttgttctgaaatcattttgtgcataaaaactattcgtgaatttgacaatcaggtgccttcttgtaatagataaacttacacaaaactggaatccagtcactttttgtctccttcacactatatagttatctttcctactaaactgatcaagtgagtgatctctattcagcaaatgtttctattccctttctcatttcttgtaatatggcttctcttatcattgctcttttgaaattgctctgtatgatctgaaatggcctattttcttctggtctttttttttttttttttaagtatttagactatgcttgaccttcctgctacttttgacactgttgattactttctcttattgaaacattttcctttctcacttctgggacaatgaactcccctgtttctcatacctttttattgttctttttgtcctcttaattggctgttctgtcttctctgggctcaacacttcaggcatcctcactacttaggctttagttacaccttgaagacagaagatcatcactttcacatttatattcctgtaccctcatttttccactctaaaatttcacatattttattctcataatatttcctgagcatcattttctacataccatgagaggagggattgatgtgggagataaagttgtaccgtgaatgttctcttccctacaagtttataacttagataagtcaataagatgcatacatgaaaattaattaagtagggcagcatgtggaaaataccttttcagtgctaaaggtagatgaagaatgtagtggtaattagagaagatttcatagagaaagtgacatttgacttcggtcttaatggatagataaaggtttgacagcaaaaatgtgaagggagatgaactgaaaatattttacagtcattcaggagtcctgtcatacttttgctatcttagctactcttgtcctagtagactataggcaaaaatcacttaaaattagaaactgtaatctctccatctatattaggcacacagaataacagtgtacacaatagctcatgtcatatccataagatgttaaaaatgtgtatattttggaggcgggacttcaaggatgatgctacctagaagtaactattttattttctgtactcacttatacctattacatcttatgtgcttcagttttctttaaatagtgcacctggtatcagatataatctctgcctttttgagtgtcttatcagattcagttccacgaaatctaagtggaaagctagatatatagttgacccttgagtaacatggagattggggtgccgaccgcccgccatgcagttgaaaactcgagaataacttttgactcccaaaaaactttactaatagtctactattgaccaaaagtcttacaggtaacataaacagtggattaacacgtttttgtactttatattgtattttacatgtgttacatactgtattcttacaataaagtaggacagagatgaaaacgttgtgaagaaaattttaagacagagaaaatatatttactgttcattaagtggaagtggatcaccataaaagtcttcattcttgtcatcttcatgttgagtaggctgagaaggaaggggaagaggagagattggtcttgctgtctagggtggcagaagaggaagaaaatttgtataagtggacccttggctgttcaaacctatgatgttcaagggtcagctgtattctgccctttttcattcttcttcatggattgtcacagccaactctggaatctatgttttttaactgatattttagtaaaattttccattaagaaacaggaatttattgtatcttataagccagtttgaatttttaatttgattttattacaacacttttgttccaaattttacgtatttacttcctgctctgtctctgtagttataaccagttcttaagttcagattcaaagcattctgcgctaaaagcagaggcacactttggtggcagccatgagggaagcaacaatgatcccccacagtgataggactgaagtggctggggtgaagtaaaggccagcctaatggcgagcacagcaggtttgaaatagtttgctaggaaaaagagtcagcaggttgctgtcctgatccagtcaaatacatatgctgtctgcgactattagcagttgcttcttacctggctattatcttcaataagtttctagtaaaaccttcaatttgtaggatttctgattttttttttttaacataaggcagatttcattctattctttatgagatgttttttattttgtatggtaatagctctatccgcagtctacagatttcagaaaactagtaagaatcttaggggccatatattgaggatccaccgtacatttgagttttgctttgccttcagatttagtgtttaatcttaaacattgcattcatcttatatatgcctttataaacagtataggaccctctattatctaactcttggctacaaaattaataagaggtgcacagtgggcaattacccattattttactataaatgactagtcttatgtttttgttctatattgtttgcagtaatgttatgaatgctctacagcactgaatatagtattaaacggtagttctcacagaagacggagtttgtcatagctgagctgttatccaacaattttttttttaagttcttaaaagcttacagtccaaactgtttctggcatttagttgaataaatacctcatggaaattcactgttaaactgaaactacctaagtataatatatttcatgatacacaaacgcacacgtgcgcatgcacacacacacacacgcaacagttgtgattgtcaatattaaaagtaaactcaatattaaactgagtttactttttggataggtttcataacaagttgactccatttactttgataaataggttacatgttaaaatcaggtttattttcatagatagtatcaacatgctacttgctaactgaaacggaccttgacgtaaagcagagtattagactcaggaatgtgcactttcagtagaatatggtttctgagatctgttgctctaaggcccacaagctttaaaatgactacatggtgtccaaaagcaatgaaactaagctatgatgtgcttgcttaacattttgtctagctcagttctggacttttattagattgaattttctctcttttgaagactccagtttttaattgaataaaaatttttttcacttcctattttgcatattccaagtctttgcctgccttgattgttttcagtgacctggcagaataggtgtgtgtgtatagcaagcaagaatacactcatttttgggctggacacagtggcttacgcctgtaatcccagcactttgggaggctgaggcaggtggatcacgaggccaggagttcgagaccagcttgaccaacatggtgaaaccccatctctactaaaaaaaaaaaatacaaaaattagctgggcatggtggagcacgcctgtaatcccagctactcaggaggctgacacaagagaattgcttgaacccaggaggcagaggttgcagtaggccgagatcgcaccactgcactccagcctgggcaacagattgagactccgtctcaaaaaaaaaaaaaaaaaaaaaacgctcatttttaactgcttttgatttccttttcaacagcagattattattattttttcttttcccgtcttctctacccctgtgacacctgtacctataaaaggggagagaggcagtggtatcttatattcattttagtatttattatttacataaatagttttaattaatgcattttatgcattcttattctaacttattctaagaacttatatatccctagcacagtgatagattttacaaatatgtgcaagatccttgccctcaatgatatatctagtttgtaattgatttaaaaattaacggagtgtaccttgaggatcctttgttctttcataaaatctcattatttgtcattcctatgagaccaatggttgaccaagtattgccttcagtgttagattccaagatttggaagatattataaagagggctttcatgggttactgttaacaatatttgcacttttctatttgggaagtatttattgagctattatagagtgttgtgttatgtactacagagcagattttctaaaccttgctaatatttggaattacctgaggagctcttaagaggtacaggtcctgaggccctacctgcagagatttcagcatgctaattcagtaggtatgagtgtgttagaattcagatcacaagtaaatgagagaataggagggaaggacagggagatggtgtcaggcattcttctgagatgcttggtagtataacaggataatagattgaggaggaagagggtagtgagtctgttcaggaaacaagagaacttaaagcttatttgaattttattctcgtatgtctttttacatttccaaaatggtctcaaatattacttttctgctttcaaatagaatgtcaccaacagactaaacttgacttaaaaaaagaaacaaggagccaggtgtggtggctcatgcctgtaatcccagcactttgggaggctgaggtgggtggattacttgaggtcaggagttcgagaccagcctggccaacatggtgaaacccagtctctaccaaaaatgaaaaaaaatagccaggcatggtggcaggcgcctgtaatcccagctactcgggaggctgaggcaggagaatggcttgaacctgggaggcaggggttgcagtgagctgagatcatgccactcctctccagcctgagcaatagagggaaactctgtctcaaaaaaaaaaaaaaaaaaagaaggaaatgaaatcttcaggtcctccctatcttactcttctcagaattattctaatgttttgatcacctgcaacagtatacactgatgtggtttctgaactaaagaaaattactgctgaaagataaaattgaaaccagttggaatccaaatggggaaaacagggacagtctaacttgatgtttcccattgagctcagccagcaacaaacaaattgagagactcagtaatatttttatgtgcatagaataagaactgtattatatgaaatacaaaagtctgatttatgtgtgtgtgtttgtttttacagaacttgctcttcattttattataaaccagtatgtcccaagtgaaacattaccgaacactgtagctgcttatgagctctcattcaaccccaataaggatgggatggtagaaactaattttttaattttattaaagttgagctgcgttttcagtcattttacatgaaaacgtatgtgagactatatggggaataaaataaaggacagttacagtttttgatgagataattgatccctgtaggaatgacacattcaaaaaccatgaggagtataaatgtgtttgattatgtgtatcctacttgaaaaacagaatgtcaacaattatagcaaggagcttctagatcctaatttgcaggggtagtgttgaacattttctcatatttgcaaaagtggaagcaagtataaattgacctcagttgcagaaggaaggggataaggaatcagacatttattgaacatcttgttatgtcaggggtttggaaactatggtctgcaggccaaatctagctgaccaactatttttgtaaacaagatgttattggaacacttccatccttatttgtttacttagtgtttctggctgccttcacaatacaatagcagagttgagttgttgcaacaaacatggtataacttgcaaagcctgaaatattcactatctagccttatagaaaaagttcgctgaccttctttatgttactggagcttttacatgtatgtgccatttctttctcacaacattcctatgaagcaggtgtcatcagcacatggtataaataatctaaatttcctatacttcaaacctgacgaatacatttttaatacccacattttcaaagtcctgaatccctacttacatgatatctaaaatttgtctcaactgcttttcaaagactctcctggttgattctgggagtctttgggaatggaggtgatcagaaactaatcagctaatgttctttggctttggattcttcctcttgcctatgccttctgtgagcatatagctccactctacacaaccattttttttcatctggcaactcctctgagcccttggattcctgacataatctccaaccctctcactccagttctttgtacataagttatatggctggactagataagtatggaacacataccccacccccctcaacaccattgttccatctctcgtctctagtctttatcttcccctgcaaccataaaaaattaataacacccagcacctcctgcagcaatcaccaaccatcaaattcagaattatatttcaggcaaataaggataccaagccatgtataatgagaagaaaccacagctttgagttaatattcaggaaggcacagcaaaacactttgattagggccacaaggaagaactctatgaggaatattaaagtgcggggttatgctcagcatctccacggaagttttttatctcaaattatttagtaataatatgtaggaggcaactgtgagtctcctagtctgaaaagtcctacattgtcaatttgagattatggctacaaatatttcagggtgttactttgttgagtcttactcagcaaggttaatgtacgtagcattaaactgaattgtgtgtaggatctgcaccaagctgagatggaccatatcaaatcagaaaagcctgtgtgtgatgaatgcccagactgtattctcaacaagaattgtcctattggcctagtgatactggtttttgtagcatcgcaattcctacagatatgcctttcttagtactttgtttgatgcacttagctcttggagttgattgctggactcactgattcgtgacaggaattctgacatttaaaataacaggaagttctctgaataaatgggatagccagaaaaatgtcagttcgtacttagaaagccagagacaaccagtgggtaaagtgactgacttgagcttgaataaggtaattcatataggttaaaggttaacaggaaaccaccttgacaacctcatttgtcaaatatagtcatgtaccacaaaacgatgttttggtcaacaatggaccgcttatatgatgatgattccataagattataatggagctgaaaaatcccaactgcctagtgacatgtagccattgtaacattctagtgcaatgcattactcacatgtttgtggtgatgttgttgcaaacatactgtgctgccagtaatatataagtatagcacgtacaattgtgtacagtacataatacttggtaataataaacaaccatgttactggtttatgtatttaccgtatttttcattgttattttagagtgtactcttgttaaaaaaaaaaaaagttaacagtaaaacagcctcaggcaggtctttcacatggtattccaaaagaagtcattgttatcataggaggtgacagctccatgtgtgttattgccccttgaagaccttccagtgggacaagatgtagaggtggacgacagtgatattgatgatcttgaccctgtacaggcctaggctaatgtgtgtgtttgtgtcttagtttttaacagaaaggtttaaaaagtaaaaattttaaaaaagttgaaacaggaaaacgcttacagaataaggatatagagaaaatatttttgtacagctttgcaatgtgtttgtattttaagtgtgattacaagagtcaaaagtttaaaaaaaacaaaaagtttataattactataagctaagtttaagttattattgaagaaagaacatttctgtgaatttggtgtagcctatgtgtacagcctatgtctatagtggtgtacagtaatgtcttaggccttcacattcattcaccacttactcactgactcacccagagtactgtccagttttgtaagctaccttcatgctaagtgctgtatgcagctaaaccattttttatcttttatatcataattttactgtaccatttctatgtttaaatatgtttagatatacaaataccattttgttacaattgcctacaatattcagtacagtaacatgctgtacaggtttgtagcctaggagcaataggctactaacctgtgaagtaggctataccatgtaggtttgtgtaagtgaaccgtataatgttcgcataatgacaaaatcatctaaagaagaacttctcagaatgtatccacatcattaaacaagatgtaagtgtactactttgaggtaaagaccatacttcagttttggtatttaagttaccacttcaaacaagggaaattcttccctaaaacctctaagacaactttatttgtccttcctaaaatatgcattacctgctgagttattgaggcccatttgaaaatacacaacattagctatgcacgctgttaaacataatgttctggtgacatttagcagtgttcagtaattggcttaatgaacaggtgtgcaagtatattagttatgcagatgttaatttgcagtaacatgtgcttcctgatttggggtgttcttgtataaactacaaccagtaagatttgttccttaattaggaaatcactacaaagtatgtctgtgttatccctaccattacaaccattagtcttgtttaatgtgctctgaacttcagaaacattcttagtaatgccattcctattgcttcaggtactatgcaggtgtcagaatgaaatctacctttctgtgggatgccttggttagtgtgcagctgtaggcaacatggagaggggaagcttcgcagctgtaatatgtagcatgtgcaaggagacagaaatggaatctcttcctgcctattgcatcagctttccctcctaaggtttggtgaacacatgtgttattcctcacaaaacagactcgataacaattgaacacaaaatagtggttccttacaaacagattcatctttaccagcatttttaattattcttttccatattgtttgtaattcctgtctacacttggcccttgggatttccaaggttaacagtttgtaaactataaaaatggataggaatgtttgtgagatttattcatatgatttttatttttatgtcaaaaaataggaaattacaaaggctaatttagcaaacgcccatctaccagccacccaaaatgaacacatgttaacatttagtcatatttactccaggtctttgcttttaaggaaataaaacattaaagttaaaatggaagtttccaaggttctacctattccagcattagattcctcctcttaggcaaccactgtcattaactggtgaatatctagtctatgtttttataattttgctacatatatactcatccatcaacaatacgcaagattagtctccgttttatttttaatttagatgaaaattatactgcatgtaccattttccatagctttaatttttccactcagcattgtatttggcatcaatccttgttgaaatatatagctgtaatacaatcactgtaaatgctgtgtgatattacattgtattaatatgccacaatttatccatttcataacccctgggcacatgggctgtttataacttttctactgttataaacactgttgaagtgaacatttttgtctccttgaccacttgacctacaagcagaaatgttgggctatgtttatgacaagcataccttcaaatatattagatgttgatgcatgcgttttttaagtcattgctgaatatttactgtcaaccattggcataatcaaattcttcttcgtatcttcatcaatacttggtattgtgagacttaaaaaatttttcaatttgatgactgttaatggtatttcttcagttattttcatttgcatttccctgatcactagtgaagttgagcatgttttcattactagctatatgaccttgggcatatgatcaagtttgtccttgatttcctcatttgtaaaatgacagtggttaatacctatcatataaagtggtataaaaattaatgccagatacagagcagatatgtaataaaaatttgatttttgtggtgcttgtgaagattgtattggtggttaccagtagtaaaactactactactgctgttatttttgttttttaatactctcatctgttgtgtattgcatatgtatttatctattgatctaatcttctttgccctttttttccatcaggttcatgtgatatttccagaaatgcatagataaaggtgattcagaatacagtagaaaataacaaaaaaaatcattaaacctgtcacatgcaaaaaccagagtagatttcccgtacctttcattgccattcttgcactcattttaatattatcaagtcattaattgaaattaaaatattgtatatttcaaccaatatgttaaaaaattatttccatgtagctggaatcacctctggaattgtatccacatggataaaatatgtatttaagtatatatggatcacaattcttatatttgtatgttatatgtaaaagaacaattggcatttacttgttaaatatacaaatatgtatgcgtgaagttacataaatatacaaatatgtatgcatgaagttacataaattttcagtgtgtttgttgacactactattattagctttatttaccctggctttgtatatagtgtacttttttgttagtttgttttcctgagacggagtttctctcttgttgtccaggctggaatgcagtggcgcaatcttggcacactgcaacctccgcctcccgggttcaagtgattctcctgcctcagcctcctgagtagctgggattacaggcgcccaccaccacgcccggctaattttgtattttttagtagagacaggatttcaccatattggccaggctggtctcgaactcctgacgtcaggtgatctgcccgcctcagcctcccaaagtgttgagattacacccagcctgtatgtagtgtacttaataggaagggacatccttttaattctcctcatatttcttataatatgatgcaacacataatgtgatgctgattcaaaggtatgatgttccctatatagaactatgcttgcactaagaaaatgagaatttactgagtggtatacatgtattcatctaagctatattttgtggatattttatggtacctaagctatatattttatggattctttataacatttataaagaaaattataaatgttaggtaccttttggggatacttccataattagtggtttacatatgaccatgcagtatgagtagatatttatgtgttgtgtaccattgtatgctcatgctaagctaattcatagtaggtgctcaagaaatatttggtagattaatgaatgtgattctggccatagaaatcagtctttctcactgaaattttaagataaagtagttatacaaattttactgtgattcatggttagttatcactatgtaaatcatgcaatgttgcctatttaaaatatcttaatacttgctacaaattataataacttgtcacatgttctgtgtatccactgggatatcagaaattaataggagattcctgaacattgcctatattaaattggggaaagaatataaccatgtttactttatttatgctgatgagcatttctcagttgtaaaggaatacatttatagtacaattgcttgtaaaaatccatgtattaaaggaaatataagaatactcagtgggcattttatcttagataatgagtatcttgatgttaacatatctttaataataatataaatgtcttcattattaggattatcttcctacagacagtattttataatgtttcattattattctattagcagtgccaatttacacactcaaattaattcaatatattggattcaaacccatttgcaatatgttttttcatttgtacggggaaggtctcgtttgactgtgggcctcattatgaacctgaggaccatagggcaattgatgataaaatcaattcatgaagtttttgtatcaaaacttaaaaaaactttttagtttcatccaagtaacttcaaataattatagaattgctatttatttaatgttttgtaaccattagaaacatacagaataaaagtatcctaggataagtgacattttgaggtcactatgaaagcaggcaatttttaacatatgatgtgttgaacactatagggatatttgatgtctcattgctgttctttgaattctctatttatctaagcctgtggtcatgatccctaaggaatgcttttaaaacaagaaggccaaaggcaataatagccactggtctgtaattatttatcatggcaaaaatatgattagttctgaaagcctgtctagttagagaactgttctaaacttgtttttctctagtgattctcagaaaagcagtgcccactcatggaactcttatcacttttcgaacccaggatttaagccaagttatataacacaaggaaaatatgttgagattcaagaaagaaaactatgaactatagatatttagggcatctaatcttaattttaaacaatttgttcacttgaaaaggggagaggctagaccatattttaattaaaaaatgcaaaaatataaagtcattaaatgagcattatctattcctgggttagtcaggatcctgttagtttgcagaaccatctttataggtccttcatggcacaacatgtttttcttatatgtacttggctaattagtctcccatagtgaattttaaggcatattgagatattaggaaaattttcttgactatttccttgactgggttcaaattagtgaatgattctagaagtaatttcaatatgattcagatatttcacattttatagacaaagggaatgactattggactgtcattttcttgtatacaattgtcttaagctggaactggcttgacaattagaataaattaaaatgttgattattgcatatgaaagactctatgctcttagaaagatcctttgaagaatatttgagatatgttttaatgtattttaaaacatatttggaaatatatacagataaatatcaacataaaatatattcttttaatatattttaagagaaatacattaaaagtcacttttcttccagtagtagcagtgactattatgttgaatccacatggcaaactgcttgccatgtctcataagatcataatttctaagtataattatccattctccttagactgcacataactttagattggccagtctggtaaaatttagcactgttaggagtttagttatccaggtaatttattttattaatatctggtatttctgtagcatgctcatttaatttttctgtattttgtaccattaaaacaaaggaagtcttaacggacttccagtattttgatgaattctgtagaatgttgcttccaagatggtaacatctatgaacatattgcctaagtaaaagtgtactgtggttttatgttgctttttctctaaaaaagaaaatcaataatgcatttgtggtctttttaacaaagattaggtgaattaaaataatatcattattgcctcaaaatgaagttatctttttaacattgataaagcagcagcatgattatggtcatatatgaaccagtgatgtaatttagcagcatgaatttgggggcaaggacctaacactctacttgactgaaaaagtactagctttacttttcttatattttctgatggccccattacttacaaccctgtttttatattggaaaaggtaaactgccaacacttgagtacaatggtagctgtaaaatttctataccggaggggtttggggatttaacttaatgctttattttcatagcagacagccacattgttttttgggccggcctacttggggagttggctgatggaggttatggaaggctaaagccactccttggcactgctactccttaccctttcagtcctttaaactgtttttaattatactgttaccttctaaagaaagcaaagtaaatcttctgttctaaggaagcaaatagtatttttcaaatagcgagggatacaaagctaaattactcaaaagaacacattgctgagtctgtttaattacatgtatgcaaatggtgctactgttgtacaaattgcaaatggttcataactattcttcaaaacagtctcagcaggaatttgtatatggcaacctgtttagcagttaaacttaccttaggtgctttaaagcaatttcactgaattgtttaaattttagcatattttgagagaaatgcatgtcttccttttccctcaattagttcagattagtgaggttgtactatatatttaattccagtactgctgtaggtacctggtaaaggagtaattaatgttgcgtattaggtaagaaggagcaattgatttttggttcatttggcttatcttttctgcttaagtgctgatatttaatttgtagtgaaaactctaaacaactctgtatttttatgtttatcctcttccttgagctaatgaaatcaacacatttattgatttcagaatgagctttattaatgtagttaatatgccttactaatgttattccgtgtacttggattagtacccttattgtttatgaatcaacattttttctttcagttcaaaagaacgcagaagcattagaagaaaagaagactgggcctacaaagaagaaagtgaaagaactgagaattttggatcccaaaacagctcagaatctgtgtatgtaatattttcttcgtaggattggtataggtaacggtgagaggggtgggagctgtttaatgtatttaatgaaagttgtaacctttttaaacaggcatatttagcatcttctagaaacaaaatcctgtgtaaacatgatttggttgcctttttgtcacttagccagtaaggagaaaattctaattcaacctctgtcaggccagatgaaacttgggaatagtaaagatttggaaagtaatgataataaaacactgttggaggacatagtgaaacataaggcagaattgacaaaaagtgatttttttttccttctctctagacctgggattgatagttttagagtattcactagttacattggaaaaatccttctactgctattcctttatgtctgaagtaattgcgatgtgagctacttaaattgttaaccttaactgcatttaaaaactggttagtgaatcttgaagcctttaacaaaccagtcagccattaagtataccttttctaaagcagatggacagttaaacccatcttcatttatgtaagcctttaagttttaacatactcttccctctgtcttgaaatcagaatttttggtctgtcactacagtagactgtgtttagattttgctgatacaaaaacactatgcatcagagatttccacacatcaagcatgtctaattgcacaaagtaataccatgggagcttattttgttaaggaatgtggtatagggaatcattacaataaacaaaacatcattctcatgtcagtagaaatgttgctttcagagaagcagtttatcagtagctgttgtgaatgtgtacattgcttatttgatagtacattttcaaagttgacgttcagtacttttctttaaaacacagtaggatctcaattgctggttgatttctgtcaacattattcttttagattgtggagatctcatttggtcttatgtataaggtaatcatttgtctatagagtgaggattttgttttcttttggtatggctgaaggcatatagaccttttcatgaaaaaaagaaaacaaaattcttagaagtgttcaagttctgcgtgccgggcgcggtggctcacgcctataatctcagcactttgggaggccgaggcaggtggatcacctgaggtcaggaattcaagaccagcctggacaacatggtgaaaccccgcctctactaaaaatacaaaattagccgggcgtgatggctcatgcctgtaatcccagctacttgggaggctgaggcacgagaatttcttgaacccgggaggcaaagtttgcagtgagccgagatcgcaccattgcactacagactgggcaacaagaacgaaactgtctcaaaaaaagaaaaaaaagaaaaaagaaatgttcaagttctggtgataagaacacatctgtgttctttaaaaaatatgtttaatggaacatgttgttgcaagtaccttctgaataattgttagctattctaggtttaatttgctgaattattccaatatgatatcatagatttccatttaagaaaaagttggcaggggaaattgtgagtcaatatataaagtaagtaatagtgtaccacaggaatataagcaggaatgcagagcacactgatgatttaggcactttaatttttttcttatgtgggagaattgcagagtagatggatatgattttttatttggttattttattgtctttcctgagaaatactgtgttgggtgcatctgacaatctccacactaagttcttcattgaataaaaaggtcaacttgaaataaaatctcttaagttttcatgggtcattttgtgttatcatcctaatctaaaaggcataagcatgtagtcatgaatgctattagtaggaattttattttgtgtgtaaatatgcactagctataaacattacagcccgagaaaatatgccattttgtctagatggatagagtgagtagtccatcaaatggaacaacttttgtttgttcataattctgtatattagtgacaaatttcatattttgagtctatgaaatgaaaatcagacgtttattaggactttaacatgttgatgctgttatacttttaataaaatcaaattttattttagccatctttctgggatcatatcgcatgccatatgaagacataagaaacgttattctggaggttaatgaagacatgctgagtgaggctttaattcaggtaacttggatattttccttttgaaattcattttcacagatttttttggactattctcttctcaatggagttgtaagaaaattctcttctataattagatttttaaaaagacattgaatagtttaataaaatcaggaatatctagctgtgttgatagtaaggggactcagtatagaaaatctaggttctaattctgtttctgccacttataagctatatatccgtttcagtataagcatatgcatatatagacatatcattgtccattattcactgtacatacaattacatgtacttcatcaccaaaatggctgcattaagtgtatattgttcttaccattttatgggtgaaaaacctgaggggtcaagaggttaaatagcttgctgaaaattagtgggtatttaacatacccattgttaagttgagtatctaacttttacccaactctgtttgggtacataacatgtattgctgattatggctagcactttctgtattttttatttcattgaatcctacagtaatcctatgagataagcactattattctcattttacaaataaggaaactgaggtttagagagattgcccaatttcacaaagcttgtaagtggtgtaagttgcaaagtaccagaactaggattcaaaacaatgtctgtcttgactctaaagctgttatattattctgctttccatgaacaaactgtttaatctttctaaacctctattttctcatttgaaattacagggtcattgtgaggttttaaccaaataaagtgctttgtatgataaaggactatacagagctgacacattatttgaattcttggtatgtctggccctgtctggtttaatttttgaaaggaataactgtaaagatttctgtggaagggtatagtcattgtagttttttctgtttttctttattttgttgttttttgtttttgagccatgagttggttttgagttttagaaaacatcaaatagggccaggcatggtgactcacgcctgtaatcccaacactgtgggaggctgaggcaggcagatcacgaggtcaggagatcgaggccatcctggccaacatggtgaaaccccgtctctactcaaaatacagaaaaattagctgagtgtggtggtgcgcatctgtaatcccagctactcaggaggctgaggcaggagaatcacttgaacctgggaggtggagaatgcactcagccgagcccatgccactgcactctagcctggagacagagcgagactctgtctcaaaaaaaaatgaaacaaaacaaaacaaaacaaaaacatcaaatagttaaatagcttatgctataactttaacaattttgccatattccctgcaaactctaaatctcagagaacctgcatatataatttgagcaagtgatgtctctgtggaagctcttctattttggattgtaggcttacattaaagtttacctcatatatatgtcttaaatctaggcgtgatttttaaaaataggactcaggtgtaataagatgacctatgtcatctcttccttgtttttagacctccattcccttttctaagcctttatctctttatctttttcatgtatctgtatattttacccatatcctgctttacccaccaattttgtgccttctgtttgctgaggacttttttaaagccaacttgctttccttctcagtaccagatactctgaagtttcttctcaatccttaccctgtttgatcaaaacccattttcttagttttgcttgtgggaagaaaacagtttaacatgtagtataatgtacataattggaattgtgctacttgggtacgggtgtagggcctaagtggcgagtaacttacctgagttattaaggttagtattgcttttatctagacaaatcaaatgtctgagtatcttctggtaaggaggatggatgctcctgggtagaaataattacatgattttctagtccccaagagagatgacttccctctgtcaggagaaaagactataatcactagcacctttttctacccccaattccagaacatttgtttcagtgatggaaaagtaacatcaatttgccattcatttgagctgtttaccatttatgtctaattaccatgtagcacatcgataatgcatggcattaaatgtgtatcatcagattaactttgttgtaagttctatttgattacagtgctaaactccatccatgcataattattgttttttgctcatgtagcatggttgtctcctcatagcaacaaaaacaacaaacaacaattaaggatacatcacttcccagaacttgaattaacagtagtagtattttctcttccagtatgggtcaataggctcttgctgggcagacaactgatagaatttagttagttggcaggataattgtcttacttaaaaaacaaaaaacaaaaaacagaaaaacttttatttaatcagcaagatccagctctaagttgaagcttattaataaatatcaattttcattttatttcaaaatatctaaatttaagctagaaaatgagttctctatgtgggaaaaattgaaatggcctaaaatacttgcagtagcacgtagaaacatttaaaagtacaccatatcctgaggttgttgaggagtttttaatacatgtaattatgagttactgtcaaataatgtgtactaaattttggtgacttttagaatcattattctagccttcaaaatttgtttcagtataattgaatttgatctattgagagaaaaatctaagaccaatcagtcagtgctttttaggatatcagtggtaaaacagaaatatgtatagacacacatatagagcattgacagagtaatgaaacgagcggtttgaaaaaagtgatgcatgtgtgaagggaaaaataaaagtatgttctatttgagatccttagtgcatgcaaatgattctaggtagggagtttatacttatattcttaaggaatatgtgaaaaaaagatgatcaacataaaagatagtgtattattactgcagaataatttgtaaagatatgataaagcataggttggtaacctggagttcaaagccctctttggggacccatggagagaattcagggggtcctgaacttgtatgcgaagaatattacatctttattttcattatcttctaattaatatttagcatattatttaagagtataggcaacagaccaaagtagtattaacagtacctctaagtttttcactaatagaaataataaatattttcatatcacattatagttgtggcagagatcttaaaatactgttacagtcattaatgcttcaaaattacagtacttattagagctgcgactagaaattatttttaatgctttaatcaagcacttctatcattatatcactattttggtaaatatgttgataactatttaaatgtaattggtattttatataatcctatttattttattttatcctgatatagaggttcacagaaggtgaactgtagggtagggtgggctgtggttaaggtagtcttcctggaagaagtgttctagactttgaaacactagtaggattcagttagagagggctaggataggagaatggtggccaaaggcttgaggtatataaaggatactgtctttatttttctggtatagataagccgtcatatagggtagcaatgagaaagagcgcataaaagattagtagcttggtggtggtcatattttaggggcacacagatagcaaattggtgactcacaggcattcacgctctctacctctcactttctctccctcacttctgttttatttggcctttctagtgcctaatcagtgaaattttaatgtcacacactctccggtttgccacaggtgccaccactccctattgcattttacttactctgactcattcctaacccctatatacaccagaagttttgatccctggtagacaacatgaatgctgagctattgagtttggtcatggtcaaattgtgtgcttaggaaaggtactcttagctgcagtacatcagatggcttgatgtaaagagacttgacatagggagatcattgcagtttcaagcataaggtgtaataaagccctgaatatttcagaagtaggagaaaagggaatttgggtaaataaggaatttttaaaaaaattattaattgaaaaatcctggtggtagagacagtggttgtagccctgacacaaacaggcaaatcgggtaggggagaaaatactttcagggcaagggagaaaaattttacaaaaaacattacattggaaaatgtattggaggtcagaatagaggctgagactgaaaataaggatttttggagtcatttacaaagaagtgattgttagaatatcaggaccaatggagttcttaagtttcctcatgaaaaaagtaacaaatggaaagttaaggactgcatatctggggactatacatgtcaaggggatgggagctattagagaaatcagagcaaaaggagtcagcatatcagagagatggccaggatgctatagtgtatcatcaaagccaacacaagaggcttttaaggagtgatgaataagagaatgagattgggagaagagatatttccttcgatatgtcagattataatgacttatttagtttaaatagttatttttctatagttttttcttgaaacaatctacactatataccagacacctgtattccttaagcaactgttctgtttattcatggtattttggtctctgtctcccttataagggacatctgcattcctactgggcatgcaactgtctggtgtcctatctattgttcttcttccacttgtattgttttttgtttgtttgtttgttttgtttttgacatttccttccttcctttcttccttctctccctccctccttctttcctctcttcctgctactttctcttacattcttttcattcccttcctccctcattcccttcttccttccctcccttcctcctctcctccctcccttcttttcttccttccttcctaagtaaattctttctttgatgaaagaccttaattttccttaataatacctaaggtgaaatacagctcctggatgcctccatacctggaaactacagaaatacctccatagatgtttctctacgatgcatacatgggactatgccagcttgcttctatcccccacaatccccctcccccgccccaccaataatttctacatatattggctgttttacttttctgaagcccatttgagtaaccagcactgtactcaatgtgtggtatttataggttgctacacgattatgttttctcaaatgtgatttttatctcaaaacagattatatgatctatataacttattattggataccgacagaataatcagaatgacacgaagatcatctagtccattcccctgattccaggcaatgctacacctaagtcatcaaagatagatgggtatctattgattctgcagggaaaaaagattcttcaacttccctcaattaaccagttctagagtataattattcttatagtcaggaagctcatgcatgtgtaatagtagagctcgtttttgtctcctcaatccatctttgtaatcattgatctatttacgtggctatcgaccatctgtattttatgcaggcttgtgagtctgcatgtgtgcgtgcactttacgagggttgatgactttagaagactacaagtatgtcaattaaggctataatggcattagtattgtagaatttgaaaacatttttctcttaaataacaacttgtattcaccatgttcattttcataattctttagggaaaatgaaacagtagcaatgacagtaacaatcataaaacatttctttcttatttctcatcatggtggaataattatggcatgcttttgcagtctgaaaattcttttatctataagctgctcttctttcacatctttggctcttaaataggtgattaaaaatttttttttgtttttttcttttattgacgtttcctttgacccttgtttgctactttcagtctattattataattacacatattccaagcaaatgttatcgctgcttatttttattctctctatgtctattattgattaatgccagtattttcatttgtcaccatcaccagctgtgttgttgttcacagagaaagaaaaggtagctttaaacaattaattttttcttgtactaattggattgtgcaaaatgtttttaaaatataaaaaattgagcctatggccgggcatggtggctcacgcctgtaatcccagcactttgggaggctgaagcgggtggatcacatgaggtcaaggagtttgagaccagcctgccaacatggtgaaaccccgtctctactaataatacaaaaattagccgggtgtggtggtgcacgcctgtaatcccagctactcaggaggctgaggcgggagaatcacttgaacccaggaggcagaggttgcagtgagccgagatcgtgccattacactccagcctgggcaacaagagggaaactccatctccaaaaaaagaaaaaaaaaattggccgggcgtggtggctcatgcctgtaatcccagcacttttggaggctgaggcgggcggatcacgaagtcaggagattgagaccatcctggctaacacggtgaaaccctgtctctactaaaaatacaaaaaatcagccgggcacctgtagtcccagctactcgggagggtgaggcaggagaatggcttaaacccgggaggcggagcttgcagtgagccgagatcgcgccactgcactccagcctgggtgacagagactgtctcaaaaaaaaaaaaaaaaaaattgagcctatttacatttttagcaaaacgtaagtctcactaacagttcagtaagatgcgatctcagaaatcatattttatgctgccttggacactttaaaccatggtagaacttcattagaattttgattctttcatactatatccattgggtctattgaaattagacgatggtcagggtagaacaggaatttcctcataagtgtaaaactaggggccaggtgcagtggctcatgcttgtaatcccagcacgttgggaggccgaggagggaatatcacttgaggtcaggagtttgaaaccagcctgaccaacgtaatgaaaccccgactctactaaaaaaaaaaaaaaaaatacaaaaattagtcaggtgtgggggcgcacgcctatagtaccagctactcgggaggctgaggcaggagaatcgcttgaacctgggaggtggaggttgcagtgagccaaaatcacaccactgcactccagcctgggcgacagagcgagactccatctcaaaaacaaacaaacaaacaaacaaacaaaaacaagtgtaaaacttggtaagtggcctctttttccttatataaacttccaaaatctgaactgggaaatgaaaagcaaggttataccataacccctcctctaagtactagctgtgaggctacttccagacaaaaagcattagacacttagcctaagagattcagggtacaggagtcaaggctataatgtccttgatggaattatcagagagatagagaacaatcatgatttcctcccccagctagctccctattcattttttgtagcatacaaatttgttttaaatccaaagcttattggctagtcatatatttaacaaattatacacttttgtaattgatcatatctataaaaccactttctcttatgtactaaagaggtaatcaaaacctttccttctatacataaggaataaatctttacattctttttgcaaggttctattataattctagatatcctcctatgtaaaatagaaatgtacctagttattaaatcttttaaagacttgtgatagttatagtataatctaacataatataaaatttaacatgctatggcacactttaacatagtataataacgggtataacgtaatggtattttaactaatctctttaaaatattttaggaaggcaggaaggaatacacaagggaaatttaagtcttttaatttcttaaactcagtggtagacacgtagattcattgtctttgtatccatcttcgtgtcttaaatattacacaatgaataaatttaaaagtatttagcaagtgctgaaagcgtatgcttaaatcaggtttcctctactttggcactactgatgttttgggcccatttttctctctctctcttcttttatttttgactactgtcctgtacattataggatgtttagcagtatctgtggctctacccactggataccagtagcagctccaccaccagttgtgacaacccaaattgcctctagactttgaaaaatctctggggtgcaaaattttccctggctgagaaccattgtcttaagaattacttttatttctgaagtatatgtagtaaagtttcagaatttaatacgttcccaatcatttgcttttattttccgtgtttattataaacttcgtgacaggttttggacatttaattagtataggtccaaacaaaatgataccatacatttacaaattctatatcccaggaatggaaagtactcatgttaagctctgattctgacagaatgcattcctgttacgttgcaaataccactagtcaagcattgcttaaagtacaggtcataattgttttccacctgtgaatacaggcaatcatatcagtgtgaataggcttttttttttcctttaccacatagtatttacatttatagtttaatagtgctgagcaattcactttacaccatttttaaaagcttatttgtttttgttttgttttttttaaatatgtcatttagataaatcaaataatatcatggtaacgacttcttctctgaagtgaagagagctgggtctgaatcccagctctgccactcaccagccatatgaatgggagaaagttacctaacctctctgagtccattttcttttatcttttaaatagctagtaagtttattgaacggatcaaattaaataacacatgaaaaagtcccctagcacattgctggttacatgataggcgcacaaagaatgtcttttccagtgagtaggaacagtacagttacaattggtattttgaaatattttccttcaaaacttacaattgaatagtcagccctcagttttctatgttaatggaaagaattatcagcagggtgataattctcctggggcttcttcctttctctgtactgtctgaatcccagaaatagagatatcaaatagggacaaaggaagtatccaggagtagtgtactatttttgaggggactattcagaaacctcactttaacccctttgatctttatttttcatgctttatgttgtattttagttcatttgcatgctgacaagagaaacgtagtcttcagagtagacaaatataattgaatgacaataaactagtaaggggcctctagataaagaaatcaaaggaatgtgaaagcaagagctgctttggggggactgcagtaggtgagaatgaggactccagaatgccatcaaaaccttttaatatttatacatattctatagatttttaaatattccacttaaataaatgaaacaaaagtttatccatcaattgtttccaacagctttaatgtgttgttggatttatattactgtaaattattcatgtctttggtgttgtaaaatttagctttcaatgcttgtattattattaaaaactgagatgaggctatcataatttgaggtccttaaggcaagtgatctgaaaatgttttaggaacctggtgtttttgtagttgcatattttttgtttagattttgttttattttagtatactgagtgatattagaatcatatattctatatttagaatcatttagaatatatgagaatatttgaaatcatagctatataaaattatcaatatctaatatgaatgaaattgtgtttgtttagtttgagtattgctagaaaacattttgtagaaaacgaagtacctaaaaagtaacaacatgaccttttctgaagttttggcagtagaagaatatagaaatcaaagtacctaaaagtagaaacatgaccttttccaaaggtttggcagtagaataatttttgtttgtttgtttgtttgtttttttgagatggagcctcgtttagttgcccaggctggagtgcagcagcacagtcttagctcactgcaacctctgccttctgggctcaagtgattctccttcctcagcctcctgagtagctgggactacagaccaccgcccggctaatttttgtatttttagtagagatggggtttcgccatgttagccaggctggtctcaaactcctgacctcaggtgatccgcctgcctcggcctcccaaagtgctaggattacaggcctgagccaccgcggccggccaagaatttgtcatattaaataattaatcaggaatggtgtgacccattcagaataactagttaggatttaatatcaactttgagtatttgttctaataaagaattgcaaaatatactaaatacttggggactaacaaagctagatggcagtgctaaaatgtggcttcaagagtgttttcagttgatcagaagtaggagaatgggattagtatatgacagcaggcaaaggggagagttgttagatgggagtaacctatagaggtatcactttacaggaaagaccgtaagcaggattccctcctaggaatgtctagaaagcatatgggtgaaagccaatatgatagggagaattctacctgatggaatgcttaaaatatctttttttttcttctcttcaaattgtggaacctttcatctatgaagtacttactaaggtgtgaccattcccttcagccttatacacattgtgctcaaattcatagtatgtacatgttggaacactattcaccctttaaaaagaaggaaatctttgaacctgcaggacattgtgctaagtgacataaggcagacatggaaagacatatactgtgtgatctcatttatacagtatatagaacctaaaaaagtcaaactcatagaagcacagagtagagtggtggttaccagggactagaggtgggagtggggattgggagatattgatcaaagaatatgaaatttcagataggaggaatagttcaggaaatttattttagaacatggtgatgatagctaataacagtgtattgcagctttgaaaattgctaaggtctattttaaatgttctcatcacaaaaaattaagttcgtgaaataatggatatgttaattagcttgatttagtcattccacagtgtatacatatatcaaaacatcattttgtacaccataaatatatcctttttgtcaattaaaaattatttgcctttgtatctctgtcagaatcagaggccaccaaaattaaaactaaagtaagctttataaattattcatttcccttatttcgcgggaggagaaaccaaggctcagagaggtttacatcacatagtcaatctgggatcacaacttggttcataagatgctcaatttattgatttttttaaagcccattgtttgacctgtttttccttgctgtggtatgcaggtgggcgagcgggttggggagtttactgctggacagcaataaaaagtagtaacagaaagtttactaattaaaaacacttagtgcaatctctgtcattggaagtcagagtagaaattaaattatcccttgaaacatcttcttccagtattagatgacattataaatgtcttcattgacattcattattgtttgtgttgtgaaatatataattaggtgccaaaaaatacttaattttacttaatgcagtataaggggcattggattccgtttctgcattaataagcagcattttagtaaaatgaaagggtagctcaattactaataagaccatcatttattttatcccatatgaaggattcagagtgacagaaccatttaatgaagtctttcagctttgtgagaaaaataagagtacatattttggccttcatttcataatttttcttcagtgtatatagctgaatagtgttgaaaaattagttgcttcttgggaaaagcaaagaaggtgtctgcttttcttccttgagtgctatgactaattgctacattgtctctttggagtttctactcttcggcggtttatacttaaaataccactctcagtgtagtggaaaaaaaattcttttgggtttcagtcctgtattctgtatatgaccttgggcaagtcacttttcttcttttagccatatagtttttgcctttagaaggggggaaatgtatacttataaaaattggttattatacaaattaaatatgagcatatgttaaaaacccttgcaaactataaaatactacacaaattgaacacacatagagattagtatcttagacatttatttagctgtaacctgtcactctttctggccatttatctaaagagaattaacacttaaacattcaactattacttgaaagagtatcccaaaaagaactcatagtcttcatccttcccccaaatgaaggcctatatctcctggaatttttttcatcccctctctcttctttgatcccagctcatcatgcattcttactgattgaagattttctcacctcccatgcccataggactagactactattgttttctagttggtctttgtctctagacttcctccagtctagcacatcacattacttgattcgactaggcattctttttcctccatcaattcattttcattcttaagaagtgattgcaatgattgccacctgttttcttctgtttttaaatgctgtaatggatctctagaaattggagagtttctcagagtcttgattttgaataatctgtgcattacgttacttacatttgctcttctccatgcctttgcacctgtccttccatcctttaggtgtcttttttatcttttaaaatatgacttaaaacctactttctcttggaaatactccctattctgtaaactagactgaacattctctccattcttcatctgctcatttctactgtgttattcttaatcttttgaagtgatttttgaaaaagatgtttgcatgtgatgcagacattctgagctgtatcataagcattctttgtattggtcattctttttacttgttttcgaatcagatgcatgatacagagttttctttatatgataatgttatatcatgtgatttggtgatattttcaattagatattttgagcctgttaggctagtcccctctacaaggctatattgaatgggtgagcactctatattaaactgactttcagatttacagatttccctttcttgaatatttagggctgctttatctctcaaagatttctgagaattataagaaccacccaatgtcctttattgaataaaaggtcttcatgaaagtaaacataaaaattccatacaatatcaaataaatatttacataaggttttgattaacgcttcgttctaaatatttctgtcatagatgactttgaaatttcttgtgcattgagagatgaaacctatcctcatctacacagtttcccgggtttcatctgcctattttgggggctttggttcacccaagagaatactgatggtcttcattagcctaagtgcatgcagtcagtgtgttcggtacactagatccaaacagaacagccacttggttctgtttatgtaggttccatgttgtatataattttaaaaatgaaagcgtgactacttccagatgaagagattttccgtcagtgatgagtagcatcgtaaatagggaagctttgtttttggctgccctaaatccatgaggaagatttgaagtattacaaagacaacagatgctaaaacagtatgcttctcatgtgaagttgtgcttcccctttggaccggaggtgtcacaggtctagagaagagttgagcttccctaaaggagagcttgggaatgttaggcatcctccttagatcctgaaagcatgggcttatctgatcttagggccaagtctcctcagaagagccaacaggttaaatgtcatcaagagggtggactttcagaggatgagtaactagttggtggcacagtaagcagtcatatagaagtgactgcttagagtgggactacatctgaataaagccaggataaactctgctcaaccaacataaagccagtcattggaaaacaaatgtattgggtcaccatatattgtcatatatgctacttaatcattttatttttatggaatgtggcatatgttctagatcatctttacatatgatctatctcattgcatttcatttgatggtagagtggtggtagagtttgcctgatgaatgtttataaataaacacgaacacatattgctagttgggaaaataatcaattattttattttattttttttttggagacagagtcttgctctgttgcccaggctggagtgcagtggtgccatctcggctcagtgcaagctctgcctcctgggttcacgccattctcctgcctcagcctcccgagtagctgggactacaggtgcccgccaccatgcccggctaatttttttgtatttttagtagagatggagtttcaccgtgttcggcaagatggtctcgaactcctgaccttgtgatctgcccgcttcagcctcccaaagtgctgggattacaggcgtgagccaccgggcccagcccgaaaataatcaattcttaagcattggagtgaagactgttatttgctttatatctgttagaaacagtgtcccaggccaaatacacttatataggttatatgtatagataatttgaatactgcttcaaggggaaaatatttcaaacaaaactagatttgtaattgttgtaggatttctttgatttctacttgactagctcccctcagttcatggtacaaatgaatgactaagagtaagaattgttcgtgatcctctgattgtctctgatcccttttttttttttttttttttttttttttttttttttgagaaagagctctggggcagtgggctagaaaggggtgctcccctaggaaacccccaggccaccgctgcccgccacgcccgggcctaatgcccaggtgccccagggctcaccgcctctccagtccctgtccccctgatctcattctttctacactcagttgatgattctctttgtgaaaatgtatgggatgtttggaaagggtccccaaaaagccaaagcaaacccaggagtgtgtctatacattacaaaagtgaagggtcagtatctagatgatggtgaccagctgaaaaatgtccctgaatggctcatcaaaagaaatccatattgaattggatcagattaaaggaaggctaagtcccaaattgtaaaattttaaggcaacaatgtaaactctcccagagtaatcaaagactatctgagaacagaaggttgaattaagattaagaaaagggtcatttgagatacgtctctaatatttaggctgtgtgtgtacagttcaaagcatagtattaataaaatgtaaccatgggtgtgcacgttaccattactgtgaagccattgtttacccttctccccagaagaaaccactattctgaatctgaggctcatcaaccccatgcctttcttttgccatatatggatgtgccccaaaatatatgttatttagttttttcctttgtttttgttttgagacaggatattcgctctgttgcccaggctggagtgcagtggcacaatcttggctcactgcagccttgacctcccaggctcaagcgattctcctatctcagcaaccccacaactccctgctttccacctcctgttccccacttagatttactcacatatttaacttttttgtatacctttcttcttatatgacaaaacttccttctaggatcattttacttctccccaaaacaagtctgtttattttatttattttaatttattataattatttttagagacagggtctcactcagttgcctagcctggagtgcagtggtccaatcctacgtcgctgcagcatcagtcttctgagatcttctcaccttggcttcccgagcagctgggaatacaagcttactaccatgaccagcaaatttttaaaagctattttagcgatgggggtcttgctgtgttgcccaggcttgtctcaatctcctggactcaagcagtcccctatctcagactccctaatagctggaaccgaaacaagtctttttgaaagacttttagtgagattctggtcatagcaaacactgcttttgtttctctaattattttttttcacccttgttctgaaaatatattttcactgggtatataattctagcttgtcaattattttttctcagcactatgaagagattatttcaccatattctgggttcagttgttaactgagctgtagtctaaattgacattccctgggaggtaatctttctattctacctaggagtactaccaaagaataatcactttaaatataaattatcagcatatatttttacaactaggtagtttaaattctaacccaaaacttgcatggtggagggcgggggtgttgccttgtgtttagaagtttccagcagagaagccccttatctccaatcccagagtcaaggcaaaaccagacacaattctttactgttttcttctctaggcgggctttgttttttctccaaaataaccccttttctggaggtattaccttttggggttctgtaaaagctctagaccagtagagtttggtagatgttcctacgatagtcttggacttcagtgtctggttatgtgtctggattagtgctttctttttattttttttcccattggggagtttggggggcaagtaatgagaactttttaaaaatgtcttgccaagttagcttttcatctgaagatatttttaaagaagtctattcagcattttaggtgttctgtaaattgacagttcctctgggtaactaatcagctatattgctggaagcagaagtctattctaaagtatctctatgactctgttattgggaagttgagagaaacattagatattgataatctgccaccatgttcaggttagtgtatttaaagttctgcagatgacaagcgttgtttctgcttaaagaaaaaagtgttagcttgccagatgtgtcaaaatgtccagggtattatggatgctccattttgactttgtatttctttagtctaatggataacttatactttgttttcgatacaggcacctttaactagtacttaaatgaaaacagagaactaaataatgatagccgatcatcatgtatggcagtttctattataaatattttgaactaattgaagtgatttatttggtgctgtaatgataggggtcttgaatatgaggatagaattcagctttggaagcatctgcatgtactattttataataatgaatcctagcattggtttgtggcagtttgtcatggccgtgataggatgatatctaatgaaagcagaatatagcgttaacagggtatcatatatctgtcaacctattttgtctgttaaaaatctattctaggccaggcacagtggcttacacctataatcccagtgccttgggaggtggaggcaggagaattgcttgagcccaggagttcgagaccagcctgggcaacatagtgacaccctgtcactataaagagttttttaaaaatcagccaggcctggtggcataagcctgtagtcccaactgctcgggaggctgagttgggaggattgtttgagcccaggagattgagactgctgtaggtagtgattgtgctactgcactccagcctgggcaacagagtgagactgtgaaaaaaagaaaaagaaagaacgaaagagagagagagagggagggagggagggggggaaaaagaaaaccagtaaaccagttaggaaagggtaggtatatgtaaaataggtgaaggatggatatcaatcagaggaaagcacgccaaacagaaagacaagttctcaatcctgcccaaggatttaatttgcagcttggctttcaagctataaactgtcttcggcctggagttggggaattggggtttcaccaggtacccacccgcgtctgcctaagcatttggctgcctcctgttgctatcattacatttagacatgggcatacatactttggatgctgctattcaatactcatagtcattaatttattctatatgtcctactttttaatgcttaatatcactttttatgtttaatatggtttataatttttattttagagtacaaaataggacataaacaaaataaaaggtaaatagcatcaaaggagtacttttcataattatcctttatactgtaaatcataaattatgtagaaagcaatacatgtattttgcaaataggatcatgacattagtgggagtagaattttttacatataatcactattttttctattatagtagtaaatatatctgtgatcttcactgatctacttagtacagggctagaaccccttgaatagtttaattgaatttaaaataggaaatgtttagctaccgtgtaatttccctagcccagatttttggctgtggaatggaaaggaagggttgaacctgaaagagattttttttaggaaaaattgtcagaagtgtgactgaaaggtaattgccagtttgaaagcttagaagatgaaaaggatgccagttctgttggcagaatgaagccattaggagacgctgataaggtgtagggatgggtcagagtgaggatgagttctcctttagatttgttcagtttgagttaatgatgggacatctgggtgggaatgtcagttagaaacatggagcttgaggatgcctaagagtagtcagggctggagacgttcatttggcattatcagcagtgaggtgatattgatcatgggaaagtcaatgcgccttctagggaactgagtataatctgaatgttaaatgtcagagtttcaaatcatttctttaggatatgtttctctgcctgggctagattaaagattagataggaaacctttaaatccccgattatttctaagacacacttgttacttcaaggtcaggaattttctcatcgattttcaatgcttgtgtgttattttattaactaatgtgtttttgaaaatagtgactgcatgttgagggattgaaatgctccacccccaaatactttagtggtaatcagcattttaacatacttcagtatgtatgtcgattcttggagtcaaatgcaagagttttggaaatgttaggaattttatatcaaaaggagaagattgtaccatcaccacctgacagaaaatgtattttggatcaaatggaaggcaaattactcagtcatatgttgattgtgttccattgtgtaaacaagaacatacacagcccttttggccctgtcatctttatgagggcagaatctccagaggttaatgtggtggtagtcacgtggtagacatccagtatatattggcagaatggatgaataaaacagaaaataagtatagaaccaagtactggcatgaaactgtcatttcatttgaagaaaagtaaaggaacacatgatttaagaacagtaaacacatacacagtgatttaagccatataccataaaaaagttctgaaaaacatgggtaaggaattgtgttttctgaccaagcaaaatggggaaaagatgtgttatgatgatagagatttagccaagggacttttagggaaatgtttctttttcttttttttttttttttttttttttttttttttttttgagatggagtctcgctctttcacccaggctggagtgcagtggcgctatcttggctcactgcaagctctgcctcccgggttcacgccattctcctgcctcagcctcccgattagctgggactacaggtgcccgccaccgtgcctggctaattttttgtatttttagtagagacggggtttcaccgtgttagccaggatggtctcgatctcctgacctcgtgatccacctgcctcggcctcccaaagtgctgggattacaggcgtgagccaccgcgcccggccaaggagaacgtttcttatctagatttttaaaaatacacaattgtcaacataagttaaagtaagacattacatatatatataatatatatataaatacattttttataaagaaatattagccccaatccgtttatgtggaaaatgatagtcttaatcaaaatgaacctaacgcagttcttctactagtaaagtgacttaatgagatagaagacaaaaaagaaaggttatgttttggcaagaaggaaagggcattatggttcaatacctttacttaactaacctttaagtgttcaattaacatttaaaggaaataaagttttggaagtattacagaataattgcagaaatgtaaaaagtagttaaaagcgtgtggtctattcgtagaaattccttcacttaacactgacaatcatcagaatgtaaatttgtgatgcgtaaaagatgaagaaaactctgctcaatcaatgacatagttgctgctttctcttttgctgttttctttgtgaacttcagttcattgacattttctaggataaaaccttcatacttatccagaattgatcttttaaacacaaatcctgaaatatttgaaaaaaaaatatgcacagtagtaagcagcagcaggtggggttgggggacggcggagaaattgaagggcttgtgccttgaaactttccaggatatttgcctatcaactcacagtttgtaagaatctgttgtacttaaaaatttatcacttctagcctttactactatgaacagtttttcacttatagcgagcatagagggtagtcttcgactattaactcacctttgcagtttatttagagaacagaagcaattgtagtatcaaggaagcattaaattcaaaagctattttaattttttttaagtacagagttttggggcaatatgaatctaacaattttattgcctagcctgatctgtgtcacttcacctgtatttttcttgctcttgctcatagctgctgttgcaggaccctgattcttatcaaaagtctcaacattagatgtttctagaggtctcaggaaatagcttacacattctctgaattaattttgccagcttccatgtggcaactgtgggttcttgttttgatcctctcccctggggacaactgtgtgtgggaagaggggaggagtttcccacggggcacagctggtggtgtattgaagccttctaggtgccaagggtgtggggtgttctctggcaaagtatgggaacatgtattttttccctgctttcctttttaaatgtacttgattagaggagtaccaaagcagtgctcttcacacagttctcctctccacagtactcagacatctgaccacgttggggatgaatagtctgggcctggaatcacatccaaaaaacaactacagtgcactcagaatcaccctaactctttccaaattgcaggttttctcactggactaatcttgtctgcttgctgcttgacttctctccctttacaaaatgtctttcctgggagcccccttagtccactacacaaacagacttcaggctgattccgaggactctgtatatcagtgtcaagctgtgccttgaacccctgccttttttccatattctctgttggtatgcttttgatgagtaggtgaagtggaggtaaatgagtaccattacatctctctctcctctgtattatcttccttcctcttttatttaggaatttatgggaatgaaaaaatactcctatccaaccttatactacatctttgtctacaacgtttagtatgtacatatataaaaaatcagatatgtttaggcattgactacaaggaccacttgcaacatgagatcctacaggtaggtgactcataagagcaatatgtactattgtagtagtctgcatctgccgcacatttgagagtgagttttattctaattcgcaagtacaacttactaaacagtggcagttacataagcttaaaactcataagatgatattcagagtcagaatacatccaaggccactaaatgtgttaaatatttcatacagctgaatagagaaaagatatgtcacctcccactgtggcgccttcattctgaaaataacaggttacctatagctaggagaaaaataaaataacaaaagtttcacattccaagctaaaattatattttaggcttgattcattccacaatacttattttcccagttacagcttaaaattgaggtggagatttttaaatatgcagaattgattttaaataattttgattatcttaatctttctaatttagtttcactgtggtgaaaattattcaagttaccaaactgagtctttgtttttcttaataacatacatacttcacacaaaaaaaaatcaatagaaacagtttttaaaaacaattgagtaatttccatgcatcaaaaatatttgaaaaaatggaaataataccttggtatttacttaccttcttattctataaaagaaaataatactaatggagcaaaatagtggattctcttgatttcatttcagtattcatatatgtggttatatccatatttatattttagtcaaagggtgcgatattttaaaacttgggtctcattaattagatgataggtgccattgcaggcccagagtttaatggaaaggcaaaattgagtgggaggagggaagagacaaatggggagaacaaaagggtacttatagtaggggtatagtacagttgttttccatgagacttatgttctgtgtaccctaccctagttatcttttcattgtggaaaaataggtaacataaaactaaccattttaccctttttacgtgtataataaagaagcattcattacatttatgttgttgtacaaccattaccactatttccagaactttgtcatcatcccaaacagaaactctaaacctattaagcaataactccccatacccttctacccccagcttccggtaacctcaattctactttttgtctctaaaaatttgcctgttgttgatacttcatatcagtggaatcatacaatatttgttcttttgtatctattttgttttactaagtgaaatatttacacatattgttatctatgttatgacatgtcaaaacttcattcctttatgactagtagctgggattacaggcatgtgccaccacgcccggctaatttttgtatttttagtagagatggggtttctccatgttggtcaggctggtctcgaactcctgacctcaggtgatccacctgcctcggcctcccaaagtgctgggattacaggcatgaaccactgcacccggccactggcctcttcttaagagggaactaatcatattcgtgagggctccactcttatgacctaattgcccctcaaaggcgctgcctttaaggataatcacgttgaggattagatttcagcataaggattttggagggacacaaacattcaattcataagaatcatcaaatttgagcatgcatcagacttcatcacttttgcttgattctccattaaaaataggattgtattgtgtacttaaatatagacattgtagataatgggagatgttgtacaagccaggtgtaatttataagattgaagattattccaggttttgaaaaattatgaatggtagagttgatactttcttttttagtattattgtacctaagcaaattctacatagtatttttctgtttttagtttagattgactaattattgtgactggaaataaagcttaaaaattattctaaacacggtgaaaccccgtctctactaaaaatacaaaaaattagcccggcatggtggcgggcgcctgttatcccagctactcgtgaggctgaggcaggagaatggcatgaacctgggaggcggagcttgcagtgagccgagatcgcgccactgcactccagccagggcgacagagcgagactcgtctccaaaaaaaaaagaaaattattctatatgtttaagtcccagaattttactcggttttggaatacgatttattcttatgtgatcttttattcaatatgtatatactatattgtacaaaaaccaaacaagtttatacgttttattcacaatttattgtagttcatttttaggtcaaattttggaggggcggggaagggcggatactctggtaccataacagaaccacagtcagaaatgtactgtcctagttaatcactttcataattgttaatgcatgtttaaaaattctaatactaaaacactaaacttttatacttttatttctttttagaaccttgtgaaacatcttcctgagcagaagatactcaacgaattagcagagcttaagaatgaatatgatgacctctgtgagcctgaacaatttggagttgtggtatgtatccaacatgagggaccacaaactcagctgggaggttaacacttgccagaaacagtgaaaagacaaacatttcagttgtcaattattttttcattactgtattgctacataatttaatataatattggctgtcagaaaaaaatacttttttacctattattatttgtcatggcattgaaaaataataaaatattcgcattcataaaatacttcaaaatatctcaggggatcttttgaataacagtgccaatttttaattctattaatatatgcaaacagtatacattattattatatgggctatttttctttccatttagatcttaatgttagaatttggcctccaaaaagtaggttaaaataaaaggataattactagataattagcaaagtactagagactctttttctagggtatatgtcgtgtcagaaaaagcaaaaggattttcagatttcatatagagtgtcattaattgatttaaagcttaaaatgtgctgttttagctgggaagaaaatcttatacatcatgtctttaaatcatcatgtagttaaattattattggaatgaattattttttcttattccacccttcatattaaggggtacaaaggatgaataagtataaattttgaattcaagattatagttatattttaagtattccccaaactgactattcaaatagttgacaaaaaacaaaaacaaaaaaatggcaggaaagagggcattatgatttatttaatttcttggagaaaaagctattttttacttaggtggtcagtgcaagtttgtttgctgtatgaataaatagttccattatggtcaccaactttaccctggctccctgaacattttccatttgcatactaaaattttaaaattaccattgaacctaatagtcaaacattttcagcgttatccaaaatattctataagcttttaaatagtataatatgttagaactgatccaatttgataccttgcagtttaaaaatcctgtttaaagtcaaactgtgctagatgggactgagcatgttccttttgaacatgtgcaataaatgctcacccatatttagagtttattaattttgagacatggcattgactgcacttatatagaaggattctgtcaaattcttgcaaagaaaatcaggaatgtatgtttgggatcagatagagcatataatggtatctgagaaaggtatttctcttatttttgaacaaggtgaattaatcaactaaattcgatagatatcatttgttaactaaaagcaatttagcacaacattgagtaatacagttatttagatcaaagtccacacttgaagcctaagctgcttggattcatattataattgaagcaagggtatataccctctgagaattcagctgtgtcatgatggttatgagttttacagtaggtatactacacaatttctctgaagccatttttttttttctgaatgcagtttatcttggaagatgtattagtttgccaagcaagtcctttcaagaggcatatccttggtaccacactgaggaaatgaagtttggggacgtaaaaagcaatataccttctgaactaaaagcaaaatagaaaatggaagagatttcttgtttatgcacataaccataaataattctgaggctgtgcatacatgaagtaacctagtccccgtatttactttcaccattcttagctacatgtctgggggtggggggcggaaagtcaaggacattacaaactagtttacactatgtaaattacctaagatagtatcaatcaggatttgcccaataaagtttagctgcattcacatcaaggaaatattttttaaacaatgatatactttagtttgttaaacgtgtactttgcagtgtttagaacaatatcatgtattaaatagacagtaaataaatgtttatggaattgaattacaggacaattattaagcctaagtccgagcctgaaattagaaagtagtatgatttaaatctgtaacaatagaaattttgctaaaacatatttctctaggtgtatgctgaaattcaattcacttctgtgtgtatacatccaaacactttttaacccttaaacatatatcaacagcctaatgtgaggacagttttggaaattgtttaatagaatcatctgcagtaatgagagaggctccaaactggaaaggctcattgcctctgctcacttctcttgttaacattattagtgtatttatcacatgatttctatatggaaaacctccggtgtctccctgaatttacagaatgaagctccttcgcattctcactgtatctctgactgtcttgctttcttcctttctgctccctttggtgaagtgagtcaattggtatctttttgacattttagcctttatttcaatcagactctcactgccgttttaacagctatttcactcgctccctattctgcgtcctttcatttttccatagtggccataccatacctttccttctctcctcaagtcttctgtctcctccccattcttttaacttaccacgaacatcctaacctgttacttgccagagaaaaaagaaagcagtttgacttcaaaacctccaatatttcttctacctacaaagttttctctagctatataccttttacttattctctgtcaagcctcagaaaaagaggagctccattatcattaacattattgttgttgctattagtatggatagaaacaaaataaatattgaggacttaatttgtcagattctatgagaagcatgtttacttccaccaacttatgtattcctcatgacaaaccctacgagtttggcactattaatggctccatattaaggatgaggatgccgggcgcgttggctcatgcctgtaatcccagcactttgggaagccgaggcgggaggatcacctgaggtcaggagttccagaccagcctggccaacatggtgaaactccatctctactaaaaatacaaaaattagctgggcatggtggcgcacgcctgtagtcccagctacacaggaggctgaggcaggagaatcgcttgaacctgggaggtggaggctgcagtgagctgacatcaggccactgcactccagcctgggccacagagcaagactccgcctcaaaaaaaaagaaggatgaggaaactgggcccaaggaagactagtttacttgtccaaggttacatagtaactagtagtcacagaattcaaatgttagcagtctgaatttgtagccagtgctttaaccactgtgctcctgggttgtgggtatgtgggtgtgtatgtgatgctctaccacatgctaatcttctcacttcagttttgggcattgttatgcactgcctactttaggtggtagtatctcttgcctgctttccttctgttagttattttattacttcctcaatttgtcagtttccactctgccctgctcttcagaaaaaaagaaaatcttcagtcatttgctgcctggaaaggagtggatagatgggtggatggatgaataaaaatccttcctgactgaggtttctgcttgctactgccttctctccatttcctagcatcagtttttttcaaagatcagtctcctttttctctctgcttccttaactctcattcactgttcaaccaatggtgatcagaattctgccttaaataatgcattgaaattgaaataagaaaggcccttaaatcctgttcacatccaaaatacacatcaaatatactcacttctctgtctccatcaccaccaccttagcccaagccagaatcatcgtttcaattaaccattacaatatacatttatcttgtttttcccgctaccacttttgcccttctccaaatccgtctcggcacaacccttagtaggatgtttctagagtgtatctgtattgcatcataatttttatctgcttaaaataccagtgctgttctatagcactaaagctacagcattaacttcttaccatgacctagaagatactatctggtctggcacctgcccacctctcctactttcatcacctgctatttggcctcttgctcattatgcctcagccacattttatttttgaacttaccatgttctttcctgcttaggaccattgcacatgctgctcctttactcctgcttgctgcctccctctcttgtttatacttcaagtcatagcttaatttttgctttcccagtggtaccttcatttgcctttcagtcagaaatagatcttcctactaaactctcccagattaccttttttcttttcctttctagaaatcatcctggattttaattaaatgtttatatatgaggttacttcttgactgtctataatcccaactatattgcaagttctataaatggatgaactatgttgattttattcacgtgtgcttaacaaatatttcttgaatgcatttgcatgaatggaaaatcaagtggactctttcagtcccatcttattctgtatctatatggcatttgataacataaaagaatttaagctcctttttgaaacctttcctctccttcttaaataataaatagtatttcctgattttttttttttaagagctgcctcttaaagctcttaaagaaagttctctctgtgtcccccagggtggagtgcagtggcgagatcatacctcactgcagcctcgaactcctaggctctagtgatcctcccacctcaacctcctgagtagcaagttccaccatgcccggctaatttttttaaaaatttttctgtacacatggagtcccactgttttgcccaggttggtgttgaactcctggcctctagcaatcctcctgcttcagcctcccaaaatactgggattataggtgtgtgccaccatacctggccttatttcctgattttaatactctaaccctgtgtagtgccctatagagtttccttgattatataacttcttagatgataaaaacaaaatctcatcagttaggggtgtaaatatgccagaaattagattactcttgcagtattcattaaaataatgataatgaataattaacaaattggctggtcatggtggctcacgtctgaatcccagcactttgggaggccaatgcaggcagatcgcttgagcccaggaattcgagacctgcctggccaacatggcaaaaccccgtctctacaaaaaatacaaaaattagccaagcatggtgctgtgcttgtccagctacttgggaggctgaggtgggagaatagcttgagctcgggaggcagaggttacagtgagccgagattgcaccactgcactccagcctgggcaacagaaccagaacctgtctcaggaacaaaaccaacaacaaaaaaacacaataaaattgacaaaactgggggaaattgtgaaagaaagaaacttatctaaggcagtgactgggacactaagctttctctaaccttttgggtttttttagcagccacatcattaggtttgcttataatcatgtgcaaccagttggaaaaaagagaaaaaaaaagaaatagaaaaacccagagacttttcctctgtctagagacagatcctggtaagggggacatgctcgctcccacatattgtatgatcaataatcttgtttagggggtagattggctgcatagcttcccactgacttgtcctccaacctacctcccacagaattgaatttggtacatcattgtaattatgtgctgtacctttactagggaaaaaagcacagatttttgaaagctctggcagttagaaccctcagcaggagcttttagactcttctgagtgtctttgcagctcagctgttctcaaacctcagagcaatggaagttcccacttgtcttgcacaggggatggagacccatactgtgtgtatctattaaactaacacatcttctgaggaaaagaaggcaataattaattctcttagtaatcgtactttgtttttctgacttcaaaattatccatatttttcaattaaaaacatcctaaagctataatctaacaaaaaatgttgaaattggcttgggcgtagaaatcttcataataggaagcacagatgatgtgatattgcggacagcacatttaaattttttttacacaaatatatgaagttgggaggagaggatttatgcatatagttggaagtacaactataaatttactgtgctttttaatttttttaaagcctcataagagcttatgagctataaagatagcttaaccaggtgaaaagaaaattcttaaaagctttttttttccttccacatatcatcaaaggcaattagtttggatagaaaattgtaagtcctctgttccattaatatcaaatcatttttcacttttgcatattcagtgtgaaaattgcatttttctttattttatatgcctgcatttggagtattaagtgttttgatttgtaatgccctgattgtttctattttcattacttttgtaaatattagtgctagttcttacttctagatatatattcattttatctgaggaaaaagctggtttaataattttgagatcaggtaaaagaaaactcaccatgactcattctcaaatacatgtatttatattcttatccctcttactaacttcttataatcatttttttgtgacagaatttcttatttccatcagcttttgcaataaaacaaggtaaaataaaaccacctgaaaattgaatattcaaattaggtcagtaggtgtcaattaattttgctattgattggttttcattaaattttttaaaaatcaaaagttaaccctttcatttttcccctccacatatcactaattcctaacaccaccatagaaatttttatggctgtgtccaggcatggtggctcatgcctgtaatcccaacactttgagaggctgaggcgggtggatcacgagatcaggagttcgagaccagccttaccaacatggtgaagccccgtctctactaaaaatacaaaaattagccaggcatggtggcgggtgcctgtaattccagttactcaggaggctgaggcaggagaatcgtttgaacgtgagaggcggagggtgcagtgagccaagattgtgccactgcactccaacctggatgacagagcaagactccatctcaaaaaaaaagaaatgttgatggctgttcttggcctcaaacatgttttcagaaaggtgttttaaaattcttgcctaactttttagtgtgattcttctgagtttatagtgccttttgggacacacaatgttattgtattctgttctagactaaagacaagtgaatggttgttgatgggtagtttccacatatttttatctttggggaaatattctctaccagtacatcattatttttcttttttctttttctttttcttttttttctgagatggagtcttgctctgtctcggcctcccaaagtgctgggattacaggcgtgagccactgcacccagcctacatcattatttttctgatgtagaatcagttttcaacactcaattttttcaaggcttcaattcacagattaagtatggcccttttctctcatgacatctaatgtacgaacatttggcattgactccatatagttggtacacttgtattgattattttttccaggcctggtactggatttgctacagaaagtattagaatgagtataagtaggagaggttctgccctggaggaggttgttgtctcaaagaagataacagtctttactttataaggtgtcataaatgcccctgccttatttccacaactccaggcagaaatctggtcagtattgactcaatctcatttctgtaggcagttctgccttctattaaacttaagtccattctcctttaatgtggtttcatgatcattctttttgttatagtcacagatacaaaaggattctgtatattcaatgggcaatggatcaaaagagtaactatttggaaaaaataccttgtagcaaatatatatttgttacaaatttttctgttaattctaatgaattcttaacattatattttgaagagacggggggatcagtttttctcccatatgttaggccttaatggaatatgtcttagaagtgaaaaggaaagatgatagaaataaccctaaaggccacacctgaccataggagtgccatgtggccatctccttttccgtcacatatgatttttacatttgtgctcttttcctttctcggtggattcgtaggttagttgggtagtagatcaatattcatgagctgcgtaggtactgaagtgtgtaaaattcaaattatataaacaaaactgtgtctaactctttggggaaataacccacttgtagttgctctcactaaagctgtcaatgcacttcttttatttttttttaatatagtgaagatcagctaaagaaatgagagccacttgatgtgatttgatagacaagtacatcgtaacacaaataaatcccctacataatacaataccctggtcagcatcccacagcacttcaaggaatgaattataaaacaaaggatgccagtcaactaaaatgctgcaagggaccacaactaaatacaaacacaaatttcagcagagtttttattttatttacttatatcacttaggtgcactcaagtgcctttatgagacatgagccttttaataattgtatctgtggctggggatgttgctcagtgcttcctactatttctaagcttagttatctaggacatttccttccatatccaaatcctctgatggagttgcaactgtttctatcagtgtacactggtctgatcgtaaaaattcacacttatggttgcaaaaattctgtggttatgatcaatatgtactggtttgtggcttttgttaagagatgcacatgtatagcttgcctcctacatcatctcttgattttgtaataatacaattttaataatgacatttctaatagtagatgtatattatgaattaaaaatagctaaataaagcatgatatttacagtggataatgagagctgttcttcactgagccctggaaatatatttcttaattttgaatgagagaaattttacgttgggtttgggggaaaagataaggaccccggtttcttcatactgacaatttctgaagatgaataaagaatgtaataacaacaagaactattgttttagggtgtttacatcatgtcagttactatgacaggagtgatacacatagtatcacatttaagttctaatgcatcgtgtatagatgatttaatgaatacattttcatgatgaggaagtaacttagaaactccaggtaacttgcagtaggtcatacaactagaaagtgaggcccagtgaggtcacttacatctgaaatcccagcactttggaaggcccaggtgggcagatcgcttgagccccaggagttcaagaccagcctgggcaacatggcacaaccccatctctgcaaaaaaatacaaaacttagccaggcatggtgacatgtgcctgtagtcctggctactcgggaggctgaggtgggaagatcgcctgagccccgggaagtcaaggttgcagtgagctgtgatcaccctacagcactccagcttgggcaacagagtgagaccctgtctctaaaaagtaaagtgacagaagtgtggctcaaacctatgtctgtgtaactacagtgtcgctgtttctcctactgcagcttacagtatgggtctggagaatgcagataattgtttccccctctttcctgggtttagagaaaaaaattctcctaaatcctattctttaagaaaaagctgtatggggctctgaatttgggctaagattgggccttggcggtattgttggggtgacctacctggaagctaatgaatgaccttacatgtacttcctctttccccacatcagcctgctgttatacctcttgaaactatatgtcctcttcttgacccagcattttactgaatattatgtttcctatttatatgaatgaagccattcattcattttacgatggtttattttcaaaatcacttttcatctttatcatctgccatgtatcaaaccttgttgtaggagatgaatcaatgaagaatttttgccagatcaaagggcaactttgaaccccttacagtatacaacttcttctgaaaagcaggctgactcatgatagattaatatctagtaatactggttcaacaaagttaattccctaacatttctggtttgacattataactgaagacattattttgtagaagtaaaatattactgtcagctattaattttgttgaatagacaattgtcctacttgggaaaagatctggaaaatagtcagctaaggagtgctttaaaaatcaatcagcacatattgatatactcaagactctgtgctaggtgctccacaagatgcagcttttgactcctttctccttttttttctctatgcagtctctgtatcaatgaccttacctcccatagcatctattcagataactcccaaatctgccaactccaatacttctaacccctagaactatagtttcaaatcctagcagatatcataataataacaaaaactcaacatgtcaataaagcaattttattatttccctatcatggaggtatcattttattattttttagaggatttgagagggatcaaggagaacatttagtctatgttagtaatccaagcttgaagtacataaaattatgagtttctatatggtgagcatggaaaataagggacgactctcagaaattctgcaggttaaaatattggtaaggattggtattattataaataacattgtgtttactgtgacttgaatatcacttcaagatttggggtcttgaatgggaaaataagagcatcattgttagaagtaagatgccctatttgccgggtgcagtggctcatgcctgtaatcccagcactttgggaggctgaggcgggtggatcacaaggtcaggagatcgagaccatcttggctaacacggtgaaaccccgtctctactaaaaatataaaaaattagccgggcatggtggcggctgcctgtagtcccagctactcgggaggctgaggcaggaaaatggcgtgaagccaggagacagaggttgcagtgagccaggattgtgccactgcactgtagcctgggcgacagaacgagactccgtctcaaaaaaaacaaacaaaaaaaaaaagatgccctatttgatgtctgagaagatggtcagctgaatttacttaaatgctaatacaaatttttcgtagcagccaagcaatacttttcctttatggaactagtgctttttactctaccttcccacagctgtagaggcagagcctaaaaaagaagaaagtaaacgtatggatcatttattttgactcccttcttttcatcaaaacaagaccgctttacaggaatttctcccactttacgatggggaaactaagaccagaaaattaggcagactgttttcacacagtcagctcacatgacagtttctaaattcagtctcatttgacttagttgctgctaagctacacctacctgcccctgctgccttagtccctgattggcttactggaatttaagtagcagcaggtcagggaaagcaaatccatctactctcattctctgaaacaagcaaacaaccaggtgacaaactgtaccaaattagcacatccttctaccttcattattgccggcagacttcaaactttggagccatctttgactttctcctgctataactggtcggttactaagtcccatttattcttccttaattctatcttttatatccattgttttctttatcttcctactgtcaacatgctacctcattacctgtttcttacaccattttgctaacttcctgatggtctccctgccattaatctctccttcaaccaatcatacttactgctcctaataagactcaagaggcagtgtggggtagcggttgagagtctggggtctgtagcccaaaggcctgcattcaaatcttcaggtttccaacataaaatttgattttgtgcaagttacttactatttgtttcacttttctcatctttggaatgaaaataacgataaccgtttcctaggattgttttgagaatcaaatcagttaatatataaagcaaatgttgaaaaatgtctggcacaaagtacttaataagtgttaattgctgttagcattgttaccatcattatcaaagcatactttggttatgtaatttcaattggagctgatatttttataaaaatatcaaatccatgttctctgagtttgtaggccaaacattgtaggttaatacaaaacatggaaaggataagaatatgattgcaggcacatgatattgggaccaaagaagactaaaagcccacatatgcctaagggttttgttccttgtccatctgggaccaagggcaccctggtgaacatggcccctataagctctgcaaagtatggccaggagagcaagtgcatggtcactagtagctgctcaaagtagctctatagcttttttagtcatcagggagactaaaaaactactccctaaacgtaaaatgatagaaaacctgcttcagtgctagtgatggccagttaccagtaaaaggaaaggaaaaataaagtggggagggatttggagacagaggtagaggcagaaatgaaggcagaaaaatatatagagaaactcagagtgattcccacacaaacatacacaaagagacctgcaaattcacggagacatagactttgatgcgattagcttccacttctgcggcctttacctggactctttagatacattgtttccaattctacccctaggtatgtatgtcatatatacctagcctataaaccttttctcacaccattctctctctctttacttttctcacaccattctctctctttactccctccttccttccttctttccctttctttcttttttttttttttttttttttttttttttgagacagggtctcactctgtcgcccaggctggagtgcagtggcacaatctcggctcactgcaacctccgcctaccaggctcaagcgattctcctgcctcagcctcctgggtagctgggattacaggcactgtgccaccaccaccatgctaatttttgtatttttagtagagacagggtttcgccacgttggccaggctggtctcaaactcctgacctcaagtgatcctcctgcctctgcctcccaaagtgctaggtttacaggcctcagccaccgcgcccggccactttttccttttagtgtcagttctatgtgtgcttaaatttacacatgcatgcacacacctatacatatattttttcatgtgtatttcctctactgtgaagccttcattaatcactgtaatcataagagtttaaagttttttcttcttccagtgaacacctccagaacttaatttctttttacctatctaaaatcatgtgctggctttttcaccagcaatagttttcaaggttctatgttgagtttcagactatattgtaagctttttgtgaataggtggcgtgttttatagttgccatgtgagtactgaagaaatagcagtacaatttgtataataataccctgaccagataaaaaaaagtgagtcataagtgatgagacctacaaaaatacagtaacaggtagatatttcatcatacttttgtatatctgcctgtgaaaagcatgaaagcatataggaggattagtagaaggcagaggttcatatttggagaggcagatgttcatggttaatgggcaaattcgaagaagaaaaataatgggctatgtcttgattctgtattagagtagatatggtctgcccaacagctcatctgctgcttttgaaaggtactttgtggtttaaaaacttttgtttatgtcgtcaaattctcttcatgttatctgcagatatgttggtgtctaatctgtacttggcatttgtatttaaggaagtaggctatatatacaaaaccaaatataattaggaatgttaataatttattttcactgtgtgcatgtgtctgtgtgcgttcatgtgtgtctacctctccccgacctccctcccagaattcattttgtgaaggaaaactagttgagtaacttggagctataggaaattaaaaactaaaacaattattatcatagtaactataccaagtggaatatttaatgtgcaccagtgctatgaaacaagtaattaaaaccaaagttgaactgtattgaagaaaaccaatgtagaattcttgcataatgtacttgaaagtaagttcatgtgattttactatcatctaattacttaacagcagcatctgtcaagtaggtgaaattctttagaaattctttagagtatatataaatagtatattttatgaatagaaatcataagtttaaaaattattaaatgctcaatcagagctagtcttctgatttcaaacagcatagtaataggtaatttcttaggaaatgttccagttatattttctgtcatcatgtacatcttttatctgcggcccaactattcactcaactcaatttcatgtttataaattttcctagttcacctcagggacagattttggcagtttgaatgctattgatggctaatgattatgcaattaacatatagcaactgttcagcttctataatattttattaatgccataaggatgatttatttttttaaaaacctgtatagccaactgctttttaaactttgataaactatttctttggaatgtttaaaacaaaaaagatttttaaaatcccagagcaaactgactttatgcagaaatgttacagtgttgtctatgaaattatccccactaaagagataaaataagaggcattaaatgtatattctcatagggtatttcttatcttacagatgagctctgtgaaaatgttacagcctcgtctcagtagtatcctgttcaagctcacatttgaagaacacataaacaacatcaaaccaagcatcatagcagtaactcttgcctgtgaagaactgaagaaaagtgaaagctttaacagacttttagagttagttcttcttgttggaaactacatgaactcaggctcaagaaatgcccagtctttgggatttaagatcaacttcctttgtaaggtaagatgacattttataatgctaatttacaacaataatcttcttgtctatgaaaggtgatactgcaaatagcaatcgtacataaaccacaaaattgtatgcttaaaaagggtgaattttctgggatgcgaattatatctcaattcaaacaaataattttttaaaattttagtaaaatctaaaagacttgaatattcttttggaatacagtacttaacatttgctgattacattttactgaagtttatagacaaaaaaatcccacttttataaactagatgcagtattggccaggcgcggtggctcacacctgtaatcccagcactttgagaggctgaggcgggtggataacctgaggtcaggagttcgagaacagcctggccagcatggtgaaaccccgtctctactaaaattacaaaaattagtggggcgcggtgacgggtacctgtaatcccagctactctggaggctgaggcaggagagtcgcttgaacacgggaggcgggggttggagtgagccgagatcatgccactgtactccagcctaagcaacagagcaagactctgtctcaaaaaataaaatataaaataaaatagatgcagtattatatttcctttacattattacttatatcgttctaaaaagtatctgacaagctaaatttaatgagataaatagccagaaatttatttttgaatatagtttgcttattctactctaagataataatactcttcaatgtcaagtagtgttgtacactggtatctggtgcattaactaagaggtaaaaaagaaaattgaataacaatcatcttgttttgattggatcatttaataatatttttgagacttatgaaaagcaaacaaagaaacagagaagcccaaaagtgcttgtatatgtccatttttaggctagagcaaaccaccttattcaaagaaaagatctgtctgttatagaagcctgaaaacactctgaggtgaaggcctgtaagaaagctagagacgaaaataaatctgaaaacaagcaatctgtctttgacaactcaccattctttcactcttttttttctctcacatctgaaaatattgcagaactttggttagttcttgaagtatattataatgagaatcccaaatctagcaatggatatgaatttcttttctatacatgcattaaattgatgttcattacatatacatggactagcactttgatatgtatcaaaaatgatttgatcttggtagttctaacccaaatagacataaagaataacacttatagataataataggatgtacaatagaattgtgaacatctgtttactcctgatatatttttgagggctgtaaggaaagagaacaaggaaaatacagaagattatctggaaatgctggattttgtgaagaaaacatttttacccccatcttcttgtgatatttggggacatgtaaaatcatttcataatgccagagggaataaggcagtgcttgtaataaactgtactaaatcatgccagatttataggatgaaataaagtatttaggacttcagcattgtattgcataccatatccccaatgttaatagagtcatctctaccatggtgctacttgcctagagtatatgctatatgcacactgagtgaatctaaaagtgttcttgcttgacaattataaagagattataagttaaaatatcatcagaaatttgtattagatacctattttgcatttaattcatataaaaatatttaaaaccattctaatttgaagaaatatgtaccttataagtgtcttaatttcacactattcaaattaattacatgaactgatttctttgaagcaagaatgaataagtcatttatacataggaacaaaaggttacgttaatctcaccgaaggattttacagttacatcttatattttggagagaggcttctttctgtcatctacctgtcaaataaaagttcttctacacaacgctgatctgacatctatcactagaggtatgctcaaaggattcagcacaaagatttttgccaacttcaaataaaataaaaaataatcttgcgggaaatactatcatgtagcaataggtgttccaaaagtgaaagaagtgaaggttttaaaatctgtcccccaactcaccccccacttttcagtaagatttttatcttctgggaaattttctaggaaaacagttgtcatttagaaagagaaatatcatacacatgcatgatattcccataatgtataggattcgaaggatgttcctggaatacaaaggattgtgagtaaatgtaaatgtctaaaatgacagaaattttctgaagcacgtagaaatagttagcttagttctgtattatgtttgaaatagaattaactagctactgatgtatgattagctagaattgctgtttaatttcagttgtattatgaaagattacttcattgatttttcttagtgattgccttcttaaagaaaatagcagggggaatttccctcatagaacactgattatggttttaaaatgataccatttactctcctaaatttttctaatgataatttcttttctcagtgattttaaaactaatccagtgcttttaacaagaagctatagagtatgttaaaatattcacctaggtaaaaaggaggcatgtggttaaacttatcagatgtatcttgtagtaaggtaatataaaaatttcagatggtcacagttggctgttatggtatttgggaagaaaaggaaaacagatggattaaccaaaatgtcaacactaaagggtatcattattgtaattactaccttcaccacaaaatgctttgttaatttgcagcagtgaattatcactttgtgagtcaccaaaccagtgtgctgaactgtaataaaaatcatttcaatgaagatgagctcccaatgttagcttagcctgttggttattaaaattctaaccaatagaaatgctacacttcaaggccatttgtttgttgttttttttttcagtacgaaatagcatatataatctgcataaggacaaaacattttaaaatacttagcattccctatatactaagctttgtgggtttatcaaataaggatctttgtttgtaagtatcagaacgtgactctgcctgattcaagcaaaaagtgaaacttgctggaaggatatgaagtaactaagccagaaactgaggaaagactaaagaacttgccctttaaaagaacagcaactgtgacagctttgagaattcaggtagcaggaatgaatgaaaagtctttttaggatgttgcctttgggatatatcagctccaaccattttccttctcctttccctatgtttgattcaaattcaaattatgaagagagcctaatgagcccggtgtggattataagaacaccccttgttcaagggagagcaaaaaaccctgattgacagtgctaccaaaactacctgccatggaagattggttatgccctaaagggtgctgttaccaaagatagggctaccaaaggttaggagcaggtaaagggatatcaggcagctctaaacaaatacaaaataaaacagatgatctattcatcagaggcctaccaacaatagagaagatacacagaaacctcaagaagcttgtggtacagttgagcagccaggaaatatacatacacaatattatgtaatgtcacaaggtacactgtcaatgagggcaaaaataaatggccactgagattagcagtagttcaggggaggaaggaatctttggtgattgggcagtgctggtaaattgaaaaagaagaatcttgaaggataggtaggattaagaatctataactttacaaaaggggagaacattgtggcttggaacctacgttttaacttacacttttgtcaattactagccaaattttcctgactaagtcacttaccttctctaaatctcaatttgagattgaatatttcttgaatatttctcccttcacttcttgtatctttttttggatttccttgcattgggcttcacctttctctggtgcctccctgattagcgtaataaccaacatcctgaattctttttcaggtaaatcagggattttttttcttggtttggatctcttgctggtgagctagtgtgatttttgggggggtgttaaggaaccttgtttggtcctattaccagagttggttttctggttccttctcatttgggtaggctctgtcagagggaaaatctagggctgaaggctgttgttcagattcttttgtcccatggggtattctcttgatgtagtactctcctccttttcctatggatgtggcttcctgagagccgagctgcaggagctgcagtgattgttgtctctcttctggggtctaggcacctggctctgggctggtactgggggttatctgcacaaaggcctgtgatgtgaaccatctatgggcctctcagctgtagataccagcacctgttctggtggaggtggcaggggggtgaaatggactctgtaagggttcttagctttggtggtttaatgttctatttttgtgctggttggcctcctgccgggaggtggtgatttccatagagcatcagctgtggtagtatggagaggaaccggcggtgggcagggccctagaactcccaagagtatgtcccctttgtcttcagctaccagcatgggtagggaagggccatcaggtggggcaggtctaggcatgtctgacctcagactctccttgggtgggtcttgttgcggctgctgagcgtgagattcccagctcaatggagttgtgtacctaccgtggattatggttgcctctgctgagtcatgcaggttgtcaggaaagtgggggaaagccggcagtcacaggcctcacccagctcccacgcaatccaaagggctggccccactcccaccatgcccccactaacagcaacgagtctgtttccaggcagtgggcaaacagggctgagaacttgccccaggctacccacctccgagctgtgaaagaaaagggctttagttcttcccctgcctgtagagtctacacagcggattcacgccctccactgagttctggccaggaggcttcttgaccacttcaagttgttacaaagatcagctggagactttcttctccttgtggcttttccccttgtgcctctggctgccctccggaaggatccctatggtgccaggcaggaatagcctgcttggggacccagcgaactcccagggcctttcctgctgcttcctctacccctgtattttgcttggctctctaaattgactcagctccaggtaaggttggaaacttctccctcaaactagaccttcggtttccccagtaggggtgtgtgttcggtggtggaggatctccctttcccacttcgcaatttgggcactcacagtatttgggtcctgcagcagcagtccccttccttcagagggtctgtgggtcctctcgggattcctggtttatccctgcagtcgttttggagctaaaattcacaacgcaagcctccgcacgcttctctgtccatccgagttggagctgcaatctagtcctgcttcccgtctgccatgatcctcccacaaattcataaactttcttaaaacattatgagagttttttgtgggtttttttttttttttttttttttagctcatcagctatcattagtgatagtatatactatatatagcccaagacaattctccttcttctaatgtggcccagggaagccaaaagattggacacccatgatctagaatatctataacatgtaaagcctcatctagaggccattacatggtattagtgacaaagtatcataccaactatacaaaggaaacatccatctccatccatttcccccatagaagttgttagaaggaaagtaaaataggttcagctttattgtgaaatagaaaattactgcagaaaatatgctttgtaaagaaaagtgactgctgtctatggtagtaaaatttggaaatctgtaatccacacacacaaaagaatctacaaaagaccttagaaaaaagtcatatgtaagtacacgcaaagttttgcagtgtctaatcatttctagctaaaataatgtggactatgtccatataaactcagaatgtcagcatatgaatacatccagtctaacctcttcagtccacaagtgagaaaactgatgcttgtagaagcaaaatactttagtcagtgtattgttcagcttggactgacataacagaaaccaaaggctgagtggcttaaagaggagaaatttattttttcacagttataggactgaaagcctaagatcaagatgccagcagggttggtttctggtgaggtctctctccttgggttaccatatggccaccttttcaccgtgtctttacttgacatttaatttactgttttcttcccctttgtccttcacaagactcagaactcgtcaaatttggatgtatattttattctgcattatatctccagtgtctattatatgtgaagctctcaatatattactacagattgaaagtcagacaatttgattaaatagaggatttgttattaatactcagcatgtgttaacttgttttttaagttagaacattttgttcctcacagatacaaagggcatatttttgccagcaaaactgttgaatatgtaactgtaagattttttatgctttatttgtaaagacgcaaaaatgtgttgtttgctgtaaatctaaatcagcaactcattattaaatatgggttattaaataaattaacatgagactattaatttaaaaccaaagatattttagaaaataatcactataggatgtactgaaagggaacctagcaacgatcaataaatcctggtcaacagtccatgcatttgtttgcctgtgtttttatagtttataaagtgttttccttgtgattcagggaggttaagtattattgaccccattttgcaaattagaaaactaaagcccagtgaggttatataatttgtccaagattcaaaaactagtaaaggtacaagttggggcttacatacaggttttctgtttacaaaattgtgtagcaccctgcctcttattgcattgtaacaatgtttggttatacttggctcatttcaaggaagcattatagaaccaactctggcacttacagtattctgaaaatggggaaaacctcatgtgaattttcttggctctctggcatgaaacttggaatccatcttttttattttaattcagcttggtgtaactgtaggcctatcaataggaagtttctcatcttgtaatagattttaatgtatccaagcagcagagcctatatatttgtaataaaatagcatctaataatttgaataattgtggagctatcccttggtgttgtatagactgtcagagtattttagttttgtgtaggcaaggttgactgctgttttcaatattttacaaatgaggatctgctctccagagagatgatctttacccaagatcacttagtgatgaaggcagagttaggatccagcttttcctgggactcaaacaaatgatttcagtggatcatgctattttcagaattttcattgactcttttgcttcactgaaatatactttttcctatcagacaatatttagcattaattgaatttgagggagatgtggttgataatttgctgagaagaaaatgactttgtgggttataatttgtcttgaaaaaaattatgtgaaagggaagattagactctcgatcatttatggagggggatgaaatgttaagccctatttccaaacttttatttttctccttgggggtcctttaaactttcctttctgtggagctatttgtgggaaagagttttcatttggtgatctctcctagtcactggttgctaatcagtgatgcaagattctatgctacaccaaatgcaaaggaacatattcatggtatttgcatttaaaaatgtcatcatataatatagtgacatgctgtaccatttgttcataattcattaccagtggatacaaacatttcaatttaagggtctgtctgtgcctcattatattacgttgaagcaagaatattcgctatagtttagacctctgaaataactaagcaccatggaatgacacaagaacaggatatcattcttaattttaaatagtttcctttgttcagcttatgtgatggttgacctttatttaagtccattgtgtttcattgtactgtgcttactgagctctcatcattgagaaccactgaatagtttcttgagcttaaagatgaatgttacactgttgtgatactatgtcagtggtgacattctggattcagtttttatagttgtgtcatgggtttttgtttcctacactttttcatgtaaatcaatacaccaaaatatgtaatttttcaaaggcaaccattaatactacttaagttagtaaatctagaagtatttaaatgtatagaacactaaattttttaaaggaaagaattctccataaggtcttttaattgctgtatgttattcattgtgtattctaatgcacatgccgttgatctgtgcatatggacttgtgcacgtaggcaaatggtaatagtagaagattgcttcagtcatctgatttctccactaaatcaagatacttggataccagctcagaaatccaatccaaagtcctcacctctaatgcccttcattgccatttaaaatctgaaccaaacacaggccacttcttttgagtttatcttctttaaaatgcagccctctaagagttggaaacagactatcatggctccttgattttgtaatcctatgaatacgctactgtgtgctttgaagattgtccttcaattagcaagtcagtgctttatcccacttctaagatgtcagctacctggtctccttgtgtgtctatatagtatagtggtgcacatacagattgactacttaagtagaaagaaaacttgatgaaggtaatatgtgtctctgtcttatgaggtgccatcttctaaaatgatagcctcaatttttccaaatggtcatacatcttctagatttatattaatgtggagatgcatgatatctttcttgttctctgtagcctacattaagaaattgaaatgagacaaaacactaactttgtggtaagctaattacagcagagggaaaaatatatgatcatgtcaggcataggaattaacaaagtttatagatgtattttaaaaattgctatagttctaaaagcttatgtgtctcaaaatatctttttgaaaacttgagctctgagtgaaagaaactaactcacacctttattctcctccttgcctcttaaaatatagaggtcccgtgagcttatttaaagatctttttctctaagttgaaatattcattaatttacattcattgctgcaaattagctagtactttaagtgtaacacttgtttgttttctcagaatttgattacatctgtttagacaaaatcatcacatttacaatactataggttgtgtgaaaacttgattatactccaaaattttcagtttgttaaattctctagagaacaatagtttgtaaatgtaatttgtctgatgcagacttgattagtattccttgtcaatactgactgctttggagactcatgggatttttttctattattcttatgtatgttaaaattttctgttgcctattacacacacacacacctccctttacctgtgattattaatatcgtgaagcctatgctgctatctctgattttaacttatatgttacagttatgtctgcctcctagatatctagataacttgctgtgaggtgtatatatgtatatacatgggacatacttgccttgagtactagtaatgcctcgttattatacacccctctgcaaacacatgacctttttgttatggaagagttttcaacttttgaaagttttgtattaggggaaggaccaaggaaaataaaataagagccagatgaagccaaaaagggtgtgtgtgcatatgggtgttgagtaagagagacagggagatagacagagacagagagattgagacacagaatgagagaaagataatgaaagagtgagaagggttggggtgattttcacaattggataatcagagagaaacaggattgagttaaatgttcctttgtatacatcaattgactcataaagagcattgaaaaatgcaaactggccgggcgcggtggctcacgcctgtaatcccagcactttgggaggccgaggcgggtggatcacgaggtcaggagttcaagaccagcctggccaagatggtgaaatcccgtctttactaaaaatacaaaaattagccgggcgtggtggcgggcacctgtaatcccagctacttggcaggctgaggcagagaattgcttgaacccgggaggcagaggttgcagtgagccaagatcatgccactgcactccagcctgggtgacagagagtgactccgtctcaaaaaaaaaaaaaaaaaaaaaaaaaaaagaatgcaaactaagaattaccaaattatattccttatcttctaccaataataagcattaaaaagtcaaccatatatatttgtgtatagaactgtaatgaagggtataatttgttttctgtagagaactcacctgtggcttagtttttgactcattaaatacagatacattttcaggaaataagaaaattaatgcatctgtattttctttcattttaaaaaaattatccttatagagtaatacaaaaaaagtaatcaaattaatgctgtgtcacagctatacttgttgaagtcgttgtgactaaacaataatagatacagttaatggttgaatagtataactggcagagatgaatactcctctagttaacaaaaatacattttttttgttcttgatgaataccccatatatcaggagcagcaataagcattttcagcgctagagcagacaaaaaatgatgatttatggaactagctgtaggtcttacttagttcgccatgaagactgttttcatagaggatttaaatgaacccagctggcttcgtattctgtgaattgctatagtcgttttctgagtataatcttatgactgattttgtaattctcacagtaggggaaagttgacaacatgaatggcatttagtgaatataattagtaagtctgaaaacaaaggcttttttattctataaaagctctgttcgaaggagattttgaccctgtatgagactgttccaaaaacatagctaccatgactaagtttgaccagtcatcttacaagctgattttcctgttaaatgaagccttcctagtgaaggcattgcacaaccttaacaaggagagctcatgtccatggaaggaagtttataaagtagcagttgatactaaaataaagctctgtgataattttagagaatctaaggattatttatatacatttaacgactttttagtgagtacttgtgcagcaagttggccacatttattgagcctttaccctctgtggaaccttgtgctagatgctttgtggggataaagagaagtaaaacatacatctccagtccttgaggagcttatgagctagatgccagatatagaacattgtaatgctaaagcaagagacagggagaagtgtgtgtggggacaggcaaatggattttatataatagcacacatgaaaaataaattatgttgctcataaacactggctaactaaccacaagacaagaaagcgcatactctgttagatgatatctatactgtaaagctgctccacttctttggaaaggaaggaaaaaacaattccagccccatttccaagatgtacttttcttctcttccccaaacaatgtcttcagttttgcttttcctgccttccgtcatggggacaagcacaaagccttgccattcattattttcttatcttttagtcttttttgaattttaaatctgaattatcagaatgctctcttcccttttatgctacaataaaagtatctttaaaactgcttctcaagttcctaacatctttctacatatagttaaatattagtattttaaattttttggataaaatcaatacctgttcaaaaacaatagtataatggtactacttataactattgtatgtctgtacccctcccaattcactaattagtcacaaaagtcaaataatttccttttgccagaggatatcatgagattgtctagataaataagaatgaagaaacttgttatttaatgttcagtatgagggatcactccaggatgcaagtaacctactatgaggaaatataagcttttcagaggctatttagggaaaggatctcaatatttcagatttaagcaactagctagatacacatattaaaacagaatcctctacttagaaacctgtgctgagggaagtggaaaagtattgtaagttatattcaaagacttggggacagatgaacatgcttgattccaaggatatttcatcaatcacagcctggcccattcagatcactttatgcttccaaatttcagctttcaaaaagtgtacgagaaaggctagggttactcgttgatttcttaaagcatcttcttaggactttgtttgttgtattgttattttgttagaagtaaaatgtattcatggccaagagagacttgaacctaacctataatttcttgtagtaactttactgaggtttttaactgacatactataaaatttactcattttaggccaggtgcggtggctcacgccaataatcccagaactttgggaggctaagtcaggcagatcacttgagctcaggagttcgagactggcctaggcaacatggcgaaaccccatctctaccaaaaatagaaaagattagctgagtggggtggtgcgtgcttgtggtcccagctacttgggaggctgaggtgggaggattgcttgagcttgggaggtggaggttgcagtgagccaagatcgcgccactacactccgcctcagagacagagtgagactgttacaagaaaggggtcctgatccagaccccaagagagggttcttggatctcgcacaagaaagaattcagggtgagtctgcagtgcaaagtgaaagaaagtttattaagaaagtaaaagaataaaaaatggctactccatagacagaacagccctgagggctgctggttgcccatttttatggttatttcccgatgatatgctgaacaaggggtggattattcatgcatcccctttttagaccgtataggataacttcctgacattgccatgacatttgtaaattgtcatggcgctggtgggagtgtagcagtgaggacaaccaaaagtcactctcatcgccattttggttttggtgggttttggccggctcctttactgcaacctgctttatcagcaaggtccttatgacctgtattttgtgctcacctcctatctcacctgtgatttcgaatgccttaaccatctgggaatgcaacccagtaggtttcagcctaattttacccagctcctatttaagatggagttgctctggttcacatgcctctgacaagaccccatcttaacaaaaaatttactcactttaggcatacagttagatgaactttgttgtttgtatacagctttggaacctccactgcaatcaaccagtgtggtttcctcatgcccctgtgcagtggatccccactcctagctcgagacaactgctgatttgttttaaatcaccatggtttcgccttcttctagaatttcatatgaatggaatcatacagtaatagagcctttgtgttactttgtgttgttagtgacttttttcacttagtgtaaagttgtggcatgtattggtagttcatttttattttgaggtagtattccattgtatggctgtgccacattttgttcatctgttcatcagctgatggacagttgggttgtttctaaattttctattatacttgttgctatcatcatttatgtataagacataaattcatttatcttgggtaaatacctaggagtgggaatcctgggtcatatggaaagtatagttttaattttaagagagactgtttttcaaagtgtctataccatcttttcttttcttttcttttcttttcttttcttttcttttcttttcttttcttttctttcttttcttttcttttctttcttttcttttctttcctctttcttgtcttgctctgtcacccaggctagagtgtagtggtgcaatctgagctcactgcatcctctgcctcctgggttcaagcaattatcctgcctcagcctcccgagtagctgagactacaggtgcacaccaccgtgcccagctaatttttgtatttttagtagagatgaggtttcaccatatagggcagggtggtctcgaactcctgaccgcgtgatccacccacctcggcctcccagagtgctgggattacaggcatgagccgctgtgcctggccatctaccatttttcattcatacttatgattaaattaaaccacaatgatggatttcatatttggaatatatgaatatatatgaaaagatatctcatattcatgagactggcaaaaaatgttaaattctgttaatataaagtagaggtaagaataaggggcaaagagaactaatggtgagagtataacttgctaaattcattttggaaaacaatttggtactatcaagaaatgttaaaccatgcacagaaatgccccttctagtgtatacactagataaactcttaggtaaggaccctggagacatatacaagaatgatcacataatcaaataacactatcaacagagtgaaaaaaaggcaacccacagaatgggagaatgtattcgtaaataatatatttgataagtgattgatatccgtaatatataaagaactcccacaactcaaccacaacaaaacaactcagttcaaaaatgggtaaacaaattgaataaatatttctccagagaagataaacagatggccaataaacacaggaaaagatacttaacaccactaatcattaggaaattgcaaatcaaaaccacaatgaaataccacttcaaacatactataatggctactatcaagaaaacagaaagcaacaagtgttggcaaggatgtggagaaatttgaacccttatgcattgctggtgggaatgtaaaatggtgcagccaatgtaggaaatagcatggcagttactacaaaaattaaatggaattaccatatgatccagcaattccacttctgggcatatacataaaagaatcggaagcagggactacagatgattgcataccaaattcatagcagcattattcatagtagccaaaacatggaaacaacccaaatgtccattgagtgatgaatggataaacaaagtgtggcatatatacaatggaatactgttcagcctttaaaaggaatgaaactctggtatatgttatattataatatgaatgaatctccgtgatgttatgctacatgaaataagccatatgaagaaggacaaatactatatattccacttatatgaggtacctagaatagtcaaatttgtagagacaaaaagtctttgtttaccaagggttgggggataaggcagatggggagttaatgtttaatgggtaacagtttcagtataggatgattaaaacgtcctggagatggatagtggtgatggttgcacaacagtgtgaatgcacttaacctcactgaactgtgtgcttaaacatggttaaaggcaagcatggtagcccacacctataatcccagggctttaggagactgaggcaggattgcttgaagccaggagtttgatagcagcccagataatatagcctgtaatctcagcactttgagaggccgaggtgggcgaatcacttgagcccaggattttgagaccagcctgagcaacatggcaaaaccccatctctacagaaaaatacaaaaattagcacggtatggtcgtgggtgcctgtagtcacagctactcgggaggctgaggtacaaggattacctgagcctgggaggttgaggctgcagtgagctgtgatcatgccactgcactccagcctaggttacagtaaaatcctctctcaaaaaaataaataaataaataaaaaagtgttcacagcagcattatctgtaattatatccaaaacagtgattccctcacaaaaaaaaatggaaaccagatattgaaaatgttcgatgagataatatgcctaaaatttataatatttatatggtcaactaatatacagcatggatgaatatagctagaaacatcaacatggttaaatacctcactcttaaacagctgctcttcagtgctgaattctaattacgcttttgtaatattctgtgtcttagaccttcaaagtttttcataaatagctaaaatcactaatgttaagtgccatttaatgccatttattaaaggttaaaacctttaaatgcgatttattatttatctacagtgtatagacagagcgaatgagtcctatggactcttttggtgctagtgacaatctgaagctatgtacataaaaaaaaatattccatctactctcaaacctcatacatataaaacaatttaagtaaaatgctcatgacaataaaagttaaaagttttagttacgtgcttaacccatgtctgagaagaaaccatctaacaccaacaaacattcatacttgtaaactatttctataccaatttaaataatttgatttttattaaaactattctcagaagaatttttatttggtaagccaactatagacaggatgattaaaagcatatgaaagtaccagaacagcttttctttgcatagatatatttcattaattcattctggcctttcctaaaaccagtgagtacaaatgatggttaatttgccactggtcctggcaatgcaggctaatgcacatgcaggtcattctccttggataagtggggctagaagggaaaatgctgagaaggggagcaggaaggacaggaaacagaatttgtcttgtctaagaaacttagcagcacaaatgccctgctggtccggaaggtggcaattgagatgaatccttattccatttaatgttgttacggtttcaagtttcagctctcctttcacagattgctaccataaattaggctaacaagtgtgaaacttttaatttgcttgactatacaattgatattatctgtttccttttggttggaaatatcattataataccaaactaaagggtgtaaaaaagggactatcaggcctacataaaggatgaagacctctttccaccgtaaattacatttggctgaattagtgtcagccctagtcatgtagtgcccagaaaagcatttttggtgacagatttagaaataaagctgggaaaacatgtattaaacctgtccggtcatagctacagaactaatgtctttatggtaattgcaatctttaaaaatacattatctttttcaatgttactgcagtgtgtggtggtattaaagaaagcaataatttgtaaacaacccttggcagagggcacagaacttaattttgtttaaataaaggagactaacattagaattcttgtgctgtatcaagactgacaagcagtagtagctgttttgatatgtgcactggagcattcatgattgcttaaatattaactgttccatgaatatacaaatataatagggaaaaaggaagccatgattaatgaaaattttcactaaaagaaataaagttgaattatatgactgtactggtggtttagatggttttattccattgactcaaccagatctcttcactgagtttcagtatttcttttcaaggacaattatatatgtgtattgtgtgatgttgctatgtgttaggaatgtttccttgacacagaaggattaggcaatttttttttttcctgagtacagcacctgttgataagtttgctgaagttcatgtggccattcatgtaaatccaaaaggaaaggggggagatccaaaagggcttccttcagatactctagagatttgaacttttatctcacatttaagttttaatatgctttaaagatagtcttccgttaatgtgtgcagaaacatttcctttagtgatatccacgctgctttactacttcatttcttatactctttatgcaaaaatcagtttttgtctcagagcagtttacactctacagcaattcatgcaagaaaaccaggtgctcctcccacacattcttgcatgtttccagaagagaactaactgttttgttttttcttttttcttttttttttctttgagacggagtttcgctcttgttgcccaggctggagtgcagtggcaggatcttggctcactgcaacctccacctcccgggttcaagtgattctcctgcctcggcctcccaagttgccaggattacaggcatgtgccaccacgcctagctaattttgtatttttagcggagatggggtttcaccaagttggtcaggctggtctcaaactcctgacctcaagtgatccacccaacttggcctcccaaactgctgagattataggcgtgagccactacgtccggccaagagaactgttttctgtgccactctgcaactgaggtcaggattgctttgggacagggagccaaggtccgctgctttgttcctatataatgtatggtaacatatgaacctagccccattctcactcttggtcttcaacccgaaatgagtatgatgacaaatgaaatgcagtatcagcatatgccagggccatggagcaggaatgaagcttccttccttgattgtcttctttacatacacccaccatagtctgatttcatacatgtaaactgtttggcatagaggtcaagcaaggcattaggttatttagatacaagaacttttatggcaagcactgaaacccgatgtctgcaacttacaatttcagaatctgattcaaactttctgagtaaatatctaagcaacaatgcagatttgcttgagcaggagttggaaggcatgaataatctgctaggttatctagtccatcactctgatgatacgtagtagacaagacatactatagcagcatttaagtattttttcaatacagttttaggtgaaggatgaaggacagtttagaacactgaagagcaatgtatctggaatcttcacagcatggagcatactgtttgtctcatctacttttggataggtagctgataggttatgataccaatcagtcttatttttatgtgaattaatcaagaacacttagagcaattctgtccttcagatgccacaaattgctagataatttctctcttattttaaattgacactaagcattgaaaacacgttgacacttcaactttttatatgtaaaagcagttgtgagaggacctaggcaagctgtagacaattgccaagcatcttctcccctggaaatttatttgaaagtagcctagtgtctccctagtggcatgcatcagaatcacctagaggtgatatcagaagttttcccctagtatattcaaactcaaattgctggaccaaaccctcagagtttctgatttagttgatttggggttgggcccccaaatttgcatttctaacaagttcccaggtgatactgatattgctggtccagggaccagggattgagaaccaataaagtagcaaatgctcatgaattcttgatttttcattcttatttcttccgttgcctgatcccttcaagcctaattatgctgaacttattcgggacaataattagaataatttttgtcactaacctcaccattttccagctgccagctctgctacctcctgtattatctggttattatccacagtcaatatttggaataaattattcgttcacattacctcttttttctgactacccattccttttaattttgaatcctttgcactgtattctaacagtgcttgaaggtcaccaaagattaacatcaagtcagccctaattatttttggcctgtctaaagaatttattcattcaacatttactgaataaaattgatatagtcctcatttttaagcagttcacaatctggtgggtgagactagttgtgtacacaaaattatatattgtggaataagtgctataactagagtatatagaaaccgctataggagaacaaagacagaatttagtagttttgctttgttttgttttgttttgttttgagacagagtcttgctctgtcacccaggctggagtgcagtggcgcaatctcggctcactgcaacctccacctcctgggttcaagcaattctcctgccccagcctcctgagtagctgggattacaggcatgtgccaccatgcccggctaatttttgttttgttttgtttttttgtagagatgggatatcaccatgttggccaggctggtctcaaactcctgacctcaggtgatccgccccaactccttgacctcccaaagtgctgggattagaggcgtgaaccaccacacttggcctagaatttattaattctattcagggaagttgagaaaggcttattactagtaactacgactctcctccctttccacacgcataccatcttcatcacccatgacagttcaatccagtaagtatatcttaaattccaagtgtgcataaattgccgtgctttgttctggcaccaacacctattgagtgtgggaactagatcaaacaacttatgagctctatcttatctataaaagtggcatattcgtaactaactcactgaattgattttaggatttaaaaaaaagcacttatgaaagtgcctgagttataggcacatgatagataggcaacaaatgttggttctcctaccccttaaaagaggaataggatattatcacctgatgaaggaagaacagtatgccgaggtcaggaggaacataagtaaatgggtagaaatcttcacccatttgtgcagtcaggaggaacataagtaaatgggtagaaatcttcacccatttgtgcagtcaacaaatacagatagagtgcctattgtatgctacccacttttctagatgctgagtatataaaagtgaacaaagaagacaagaaaactctgtacttgtgtccagcatagctgaagtgagtgtgggaacttgagagaggataatagctagagataagatcacaacagagtaggagccagagggatttttagtttatagtgatgggaagctaaggtaggctctcaacacttcttatctggatgatgatggtacccatgataacatgctatcttattcaattctgcaaacatgtctgtgaacataggtgcttatctaatgctcattttatagataacaaacctgagacatggagtattcatgtaacttgcccaaggtcatacaagtagtaaatggtagggtcaaggttcggacctggttctgtctgaatccaaaatctatgcttaataattattctgattagaaatttgaattttattacatgagttgtaaagaaccatttactttttttaaggaagggagtgacatgatcatatatatgtttaagaaccataattaggctaaatcatataggataaaatgaagcaaagagaatggaatggttatgaccatcttttcatagtgtattttcacatagctaacacttctgtttaaaatttgagctgccatccttttcctaatgccagttcactctagagttatttccctcattctggacatgatacaacattcttttaatcatcgggacttaaagcttttggagtctttgatttttccctttccctcatcttaatattcactgactaaatcctgtttttccttacaatctctcttgaatttgccctttttttgtcttttctacacataccctagttatcattttaagtatatcagtctttgacatttgccaccaaattattctcctatgtcgtttcttttctatatcattttgtattttctactaaattctaagcttaaggccttaaaagtaccatgcatcatttatctcttatccctggtgttcagcatagtcctcaactcacggtggattaaagaatgtacttctccattcatatttgctttgctcctaacctgcctcccctaaaaaaatgtacagtgctacatttcctgagtgacaaattataactttattctggcattcacttgcacctaactctagcaaatgtgtgttctggaaaagtttggcctttgtagtcaacctctgtgtgtgtggtggggtcatatataaacgcagttatacatatatatatatatatatatatatatatatatgtatagaattaaatttaggagtattgctctatagcccagaaaagttggagtttagagaagaatctgcattcggaaacatttattgactatctagtattttctaacatcctcctaggcaccatggattcaaaaatattaccaaagcaaagtctctagccatgtaagagctcatattgagtgtgagagactactatgttgaaatgtttacagtgaatgaagatggccaaaaaaagttattaattgcttctaagatagagaagtcttcagaaatgacatgggagttgagtagtctgaaatgtgagtaggtattttcttggcggataaaaaggaacaaaaaggaagggcgtccacacagagagagctgttggtgcaaaagcacagtggcatgaaactgcatggtatgtttaagcagttgtaatcaggcagacagcagcaggaggcaggttagaaaggtagacaagggtcagctcaagggagtgtcttgtatgcaaaatcaagaacttttcttttccagcagatgacaggagcctttgcaatggatcttttgaatggactctaattaccattgagaaattaaacatttgaagaataacatctatgcggttaggttaaattaactgcagttgtttatttggagaacaggacgggaatgagaagggaactttcactctgtgagaggttgttacgtacagcatagtgaccagttattttcagttcccactgaggacaaagcaagaagaaataggcttacatctcatcagaagggaaaattacctacagaaggggtccttcacagaaagattgaatgtgactgacgtaggtcattaaaatgttgtctgaggctctctggctgtgtgctggtttctgtgtactcaaacagcccaatttcaaagacatggcaagactgaaggttttgaagcttgaatgaggatatttggaataaagaaatttcttatgtgtcaattagttattgagaaattttgctatatacctaactaaattttggagatgtacttgaacatataaaatatatgtagtatctttcataatataacgtttgtgtgtactaggaaaaagaaatgatcaaaatcagctgtagaaacacgtgtcctattaaaggtattttgtattcatgtaccattttagaaagttattaaagattaggtagatagaattcaattaaattcagttattaatctttatgtgtaacatttattggtcagatgattaaattaaaattgctgtatatggtttattaactgatgattgcacctgatcagttaatacagtgactcactcttgtcttattttcattatcatccagtgataactgcgcttattaaaataatataaaacttattttagctttttcaaatatttcccatttctagaactgctgtttgtgttattgtttgaagatatataaaagaagattgtagagtgaccattttgttcatccttttgcatcttataaaaataagtcatatatgtctctccctacctgtcatggctggagagaggaaaaacacatacagggatgcaaaaaggcactttgcttctggctagagcaaaccttgaaatgcatacaatataaccaccactaagacttaggcaatctaggcaactattaattggatatttcatgttaatgtaaaattttaatatgatttcatattaaacagctatcaaatggaaatcaattctatttcttaataaactaactcaaacattttggaaatgacttgtacataatcagattagattactcttgttctaccccaagagatgtgtatatccaactagtacacttagaaaagcaaattattggataaatgtctttaaccagtagaactgatgttcttagttgccttctgtgctgacattgaacaacacgatagggcctgagagagatacaatggctaatgtgtgaatggcatagacttggtaagagagactgaaggcatgatataaagtaattaagcttcaataagtaaaaaatattttccattatattttaatattatatatatatatattttaaataattggtctaaggcctctcacacatagagaaaggtttaaaagaccacccatttgtcgtgatttcctgccagtttgaaccattaaaatggtctctgtgtgtttttttttttaaaaaaaaacaacaaatattgcaatacattaagcagcttgtctcccagaccaactaagatacttctcaacttgacaagacaaacatttggccatgtttgcccatgctttgaagggaatattatgattctaaaagaaatacatgcatagtctgtctaaaagtcttttatcatttcatcaaagatactaatacatttaactgatgttgtgctttatttatctttttaaaatgtaaccattaactcttctaaattttgtaacaaattaaattgttagtggaccagatactgaataaatatttattaataaatacaatttttgaaaattaagcacttataagtatgcatgccaaaaactgaaatgttttttaatacaaaacaatctaacacatgtgacaaagaaaaaaaatcacccataaaattgacatatgagcacagtgctatttttctgtttttatatttcctttccagtgttagccatgtgcgttttattgtaaactataatgtacttgtacaatttgatgtcctaaaaaactaggtgggtttttgttgttttgaattgtgttcttttttaaaaaaaaaaattgtttttgtctccatttatgttatgactccaaagagtccataaaatacataggaatttcctttcctttgggaagatgtacctgcaattttttctaagcacttaatgtttccagaattttaggatttaggtagttagtgaacttctaaggaaaaagaaaatgttaatttcctttttatttggaatatccggcatactcttaaaaacgatgcactttgtaaacacatcacacagtaatcccaggtaaagacctctctttaggaatgtgagcttcccattgattcctctacagctgctatccttacttaaggaaaattgcccttgaggtttgtgttgctttttgttctttcagcttgtccttgagttgtgtcatttctaccttaaagtacttaaaagtgtttagtggatcagcatgataatgtaaaattttaaatatttttcctatgtgggataaagtaatccccgaaattttgaaagaaatcattgtgacctcttgaactatcaacattatgcctcctgtggctgtttggttgtttggaaccttgagactaatatttcttctaagttgtttacatcacattgagatgcaaatggttgttaaaaacctgtagaacaaaacagatccagtgtgggcctgatttattaaatgctatgtttttctttcttagtcactcaaacaataaggattaatttactctgttacctaaatatcctgtacagccttttcataaacctgtttgtgaaaaatactcatttattctaaacagagtaatccttaaagctaaaaattccaaatcagtatgaacatcagtggacaaacccatcatctaaggattatagaattataacatccaatagaatgagaaaacttgatactttatgctgtatttatgctttgtttctaagtaaatccttgattttatttgcagcttagtctagtatgagaattatattgcagcactagattttctttttttgtgtgtcctatgctttaaagatttttaccattctaactgtggcatctcttttgttgtgtgtctgaaaaggaaatacaatatgtaagcaaataaaatttttcatattatcaggattgtatggtgagattttttttaataactcagtataagcacaaccttgagaattattttctgatggtccatgcaagtagaggaggataaaatgtgcttgctcctttacattaatttacatcaacaatggctagaaataaatataatctcacaaatgaatctaacttttaagaacatatttttgtaataaagcaaagaacagaatgatgataaaataagcacacagtaacttgggctattatcaatacttaaatggatgttcttctctcatgaaaagaatagttcattttgccacaataatttagacatttttgaaaatacagattaaggtttaatttggcacttttactggtcatcttacttgcttttaaaatatggagctccttttaaaatctagagcaccgctactagaccacattaagaacctaccccaaagttttaaaaacattttaaatgggttataataaattcattcatttcacttgtttaaaaaagtatttactaaaaaattactaaaaaatgtgttgttgttttctcccagatcagagatactaaatcagcggatcaaaaaacaacccttttgcattttattgccgacatttgtgaggaaaaatatcgagatatcctaaaatttcctgaagaactggaacacgtagaaagtgcaagcaaaggtaattgatttataactactttgagattatctcttgcctatatggtttaaatggaacaattaaagaatctgtaaacattattcataaaagtattttttgtttgtttactgataaaagaaaagcaggaaaatagtttccattagcttatatttgacagcatactacattttaataacctattttgtcttacatcattttttttaccactgctacgttattaaagctttcatttctctgatcagataatatgtttgtactttcatttgataaacatttaagtggatattgtttgcaaaggaaccatactatagggctcttggttatatgacaatgattgtgagagtttttgattgagtgtggttaaaatatagtaaatgagaaaaatgtgtgtatatatacatacacacaaatgtgttataaaataaggatgcatgtgagaaatgctgcaggaaaagataatgtcctatagttgagatgaggaggaaagtactcttgaatgggtgggtaagagaaggcttcatggaagaggtcaaaggtgaaatatgaggttagggttttacagacatggaaaagaggtttgctttccagagagaaaacaacatgagcaaggcaaagtggcagaatgttttaggacaagtgaagggaatggttgactctgaggctggagcagtaaggtaggtatctctgagacttcagtgtcaggctaaggagtctagtcttgatgtggtaagcagtacagcatcattgaagggatagaatagacaagccatggctcctgtgaggaacaggatgtttgaaacaaaaatgtctctgagattttaattcagggtaattagctttgtcagtaagtattatctacttttgcaagaggttgaaaagtgaaagaaaagaagattaaggaaacatttgctgaaggtgagattatgtgcgagaagaagtgcattttccctcttagataagagaagtacaccataaatcttatacttgaaattacgctgaagtaatttcattctgtaactctgaggacttttggtaaggacttcatatatgtttctcaagtttattacaaaccatataaacctgttagtttccttttaagttaaaaatagtgaatctataaaacccagaatattctttgaataacattgtgcagtggtcatctcagccagttgggtattgtcaatcaaatcctcaacatatttctttaattttaccgagtttgtatcgttttgtggtccaaggagcaaactaacacaaaaagacaaactatgattgtattgtattatttattttctttcgttgttttcaaaaaattgtgaaatatgatggaaaattacacaaattacaactataatggcaactttctggtaatagctcttctaaagaatttatctttggatttaaaaatacagctttctgactagaagcatatttactaacatgtggctaatgtgaaataataacattttaaacatttgtgttgtaatttgaaatgtatatatatatatagcacaaaaaagaccagttattaaattagctcattttgttgctattaatactttttgattgccttctaccagaatttttttctaagttttctttgttcaacatgtataatcaatttttacaacattttggaaagaagtatgtcaataatatatctatatatacacacacagtgccacacatgaaaatatatatatttatatgtaatatatttactatacataaataaatatgtaccacacacttatatcaatcaacaggtatttatataaacctcaatcaacagttatatatatgttatatataaccataggtatttacatgtgatccagcagttccactactaggtatttatccaaagaaaaagaaatcagcatatcaaagggatacctgtaccccatgtttattgcaacactgttcacaataggtaagatatgaaatcagcctagatgtctatcaatggattaatggataaagaaaatgtggtgtatatacacaatggaatactattcatctgtaaaaaagaaataaatcctctcatttgaagtaacatggatggaactggaggtaattaagtgaaataagccaggcacagatagacagatattgcatgtttttactcatatgcaggagctaagaaggttggtctcatagagatagagcgtagattgatgcttaccacaggctgggaaaggtgaagggtagggggatgaagagtggttggttaatgtgtacgaacatacagttaggtggaagaaataagttctggcctggtgcaatggctcacacctgtaatttcagctagttgggaggctgaggtgggaggaacacttgaggccaggagtttgagaccagcctgggcagcatagtgagaccacccccatcagaaaattttaaaaattagccagtttcatgctacttgcaggggctgaggcaagagcattcctcgagcccaggaggctacagtgagctatgatcacaccattgcactctagcctgggcgacagagcaagaccctgtctcttaaaaaaaattaaagaaagaaataatacgtcctaatgtttgatagcagaatagattgactgtgggtaggaatgatatattgcatatttcaaaatagctagaagagaagatttgaaatattcccaacacaaagaaatgataaatgttcaaggtggtagatacgctaaacaccccaatttagtcattacacattctatgcatgtagcaatatatcatatgtaccccataagtatacaaatattatgtatcaataaaaaacttaagaatatatagatatttatatatgtgtatatagcgtgtatatatatatatatattttatatagttatgtagtgagacattcaataatcttgtacactttagccactactgctactgacaaaagtagattgtagagcccagccttttgggttagacactataaatttctttctttctttctttctttctttcttttttgagacgaagtcttgctctttcgcccaggctggagtgcagtggcacaatcttagctcactgcaacatctgcctcccgcgctcaagcaattctcctacctcagcctcccaagtagctgggattacaggcgcacgccaccatgcccagctaatttttgtacttttttagtacagatggggtttcaccatgttggccaggctgttctcaaactcctgaccttgtgatccacccgccttggcctcccaaagtgctgggattacaggcgtgagccaccgcaccaggcctgacactataactttctaatcctagctctactacctattagttctataatttgagctaataatttaaacttctaagattttgtttactcatctgtaaaatgagaataataacagtgagattaaattagttaacataggcattgcatccagtaaaatggtatagtttatagtatatgcttgacacatagtaagtatgcggctgttgctgaactactaccagtagtagtagtagtagtagtagtagtagtagtagtagtagtggtagtagtagtagtattgatataccactaaggatattatagttctttcttttgtcttattagaagggaacaatcataaaatatcttatagttcctccagtctcagtaagtatgtattatattcaattctatttgtttgtttcctattcctgggcttttggtaaatccttttatatatttttttctttattttatttttcctttttaattttttgtatatcaccaacttcctttttccaatccatttcaagagcgaaatctctctgctctattttgatcattcctgattttgtgcattcttcctgccagtgtattcaaaagactgttgccaaaaatcctcttcttatatcactgtttgggccatatcaatccctactctcaaattattttgactagttatttttctttccctatgaaattcagactgagaattctcaactcaaaaagatcttacgcacattctgcctgcttgcatccctctttcatttcctcctagttctcatttcagtatacccagacatatagtctcctgagccatttttattcctttataataatcctgtctctgtgtacgatttcatgctgcatcctctggctggaaatttcacctgccctgtactctaagacaactgactgtcatttgccaaatctctgttcagaatctatttcctttttcttcttccttttttttttttttttttttttttttactaaagccttaggagaaaatactttttgtattagtctgcaggaagaaacaaagcattgtaaaaggtcaagccaattacctcttatttatatttaaatacttttccttggtatttgagtctaacttgtcttgtttacttaatgtacatttcagccctgtttgaatcacactttatcacattcaggactgtgtataacatagcaaaaaacaaaaataggtcaacactatataattcattttatttgatgatggactatctctttgtaaaatgatcccgttctcttcaaaaacaaaaacaaaagattgtctttttttttttaaactggagtgatatagataagaaaaaactaattcagttaatgaattatatagctaatattgaaagaacaacttgattactaccaatatcttttttcatatttttgtgttattagaacgcacatacctactttgatagagtaagatcttttctgtgtggtatagcaaataccaaatttattttagttcagtactaaaattccaggcatcaacattactggcaaaggggaaaaaaatcaccttgaagtgaaaggcaaacaaaaagaaagaagtatgtgggttccatggaaaaaatcatcataattacatttattccttgtaaagctaagctgctaaaattgtgtgcttcttggaaaatgcaaaactatggtataaacttggcatatttttctagacctctgtagctcaaagatagtggggaaaaacacatcatttttacattaaaacagatatgtattatggagtagaattcaaaatccacattaattttaaaaataaaacagatgacttcaaagaaatttcccacttgtagcagatccctacaggattattttcagtcttctcttccattaggggtactttggtgggaaaagtttatgaagcattgcctgaagaattagagagcagttttgttttgggttaagtttacgtatttatttatttagtttgttattcagttagttagtgactattgcagggaaaagggaggaaagtaggcaaggtgagggaagagagagtatatcacttccttttaaacattgtcataggccgtatgaagttcagaagcaaattgtataatgtaactttattaccagtaaagttaataaaataacattgctcttgtcattttattcttggttaaattataaatctgtgggtcatttcattcaagattggcataccaattagtctttagagaaagaaaatggttgttacagagactttgatgcctttaaaacattgaattttttttttcttttggtgaaccacaattatttttttccccaatgattaattttaaagtttatatatatgtatgtatatgtacatatgtaaacttatatctaatagatatatattgtataaaacattgctggtttactagacatatttgatgtctttttttccccctgtggctatcactttaattttcagctttaaggattttttactgtttgatttaaaaccactcctgttttataggttgactccaggttttaaaccaaatggttagtaaagtttaattaaagctattttattcaaaagggggaaattatattaatgtatttgaaggtattatttatcctgaggtttgcataaatccaaaatgggtttcacttcagttaaattggtgccatcctacaagataaaagctagttaagtttcttctgaacagtgctaacttttttatgaattaaataaattattataattttaacaatcaactataccttttgatatctgccatgtttccatgtcatgttagttaccgattagctgtttatccactctgactttttcacgggattaataacaatggaagttctgattaaaggcaatgttataggggaaaatctatggattcattccatagtagtatttcttttttatataaaagaaaaaagtaaaataatagcaaagttaaaaagtttggggggaagaagaaagatgaaacaattccagaaactccacagctggttgaagctttagagattatctagtccctgctaaaagggacccaagatgacatttcatccaaacttattttatagttgaagaaactgagatgcagaatgataaaggacttgcccacgatcacatagctgggcagtagagtccatgtacatttggagaccttgtttagagttattacatatatttcatccacatttttacctcctttgtggtcgaaaatatgcaacaaagactcatgctcacatactggaaaacatatagaaagtagatgctgaccaaataaaaaacttactggaagtataaatgctactttctctgtagttgtccataatctttctagctccattttgacagaattaaccattcctttctctgtgtcacagcagccctttagcgttattggtaatagagcacataccacatttgcactttttatttaattatttgcttctatctgtacctcctcttgagtttcttagtaacaaagactgtattctttttgtccttacaatctcggtgctatcatagcacctcagtcggaggggctcaatctatggccataccaacctgaatgcacctgatattggaagctaaacagggtcctgcctggtcagttcttggaagggaggtagaagtgcttaataaatgcttattaaattaattgcatatcattttagtacagcagtcatatttcaaaataagacattgtgggaagttgacaaatagagagtaacagtctgaaaattactgttcactgtaaatttgagaggagaaacaaggtaaattagaataaggaggacaccggtatttaacaatatttcccagtccacactttgcttcttcaagggaaatggtgaaattggaaacaatttgttaataatggagaggacctaaacttatggacgccaccaaaccacaaaggtttatggtgaacagtaaggaccaagtcataggacctaatgggagtgactgtctcaatgtgaaatgtaactaactgctgaaacatctatgtttaatacctgaaaaaaaaaattgcatattgtctgctattagtttcattgaaaaatctttgagttttttagtaatctattaaagaaaaatctgtggaacaaaatcctgtttttagagtgtttaacttttacttatagtgacttataggacctaagatgcaagaaagtattaaactaaggtttcctaacagatttaaactttgagttataatctaactttttagaagcacagaatgataatataccaatgtgacaaaatgttagtagaattgaccttacttaaatcttagcagcctgagtaaaactgagtatacatattactacattattttaataaaaatgttaacttgtttgttcagcttggtttggatttttttcatatataggatttcaggccgggcgcggtggctcacgcctgtaatcccagcactttgggaggccgagatgggcggatcacgaggtcaggagatcgagaccatcctggctaacacggtgaaaccccatctctactaaaaatacaaaaaagtagccaggcgtggtcgcgggcacctgtagtcccagctactcaggaggctgaggcaggagaatggcgtgaacccaggaggtagaggctgcagtgagccgagatcgcgccaccgcactccagcctgggccacaaagcaagactccatctcaaaaaaaaaaaaaaaaaaaaggacttcaagtaacttaaacaatttttgctgaacgaattgtactctatcaatagcaacaccataaatatgttataaaatttaggggaacgttgttaaatgttagggaatcaaatacatatttatctacataaattttccagtctgtaagacttctttcttcctcactctcaccaagtcagtcctaatttttctaaacaaatgactgtctttaaaataagagaaaaaataagaggtctaaaacagtcacagaatttttttttattattatttttatttttggtaagaacacttaacatgagatctaccctcttaaatttttaagtgtgtaatacattattattgactataattacagtgttgtacagcagatctctagagcttattcatcagttaaggaagataagctcaggaaaatgtatttttaatgtgaaatgtcaaaaggacttaggaaagaaagtcatgttttcttcttgctgttcagtaatctagtcattaccaaacaatgttatcaatgcataacatataaacatttcataattcattttcatttctagaggaaactagtgagtaaaaacaatatcttcaggtagcagtgaaaggaagcagagatcatggccgtttggatttgagtgaattctttcaacacaaatcaatgattttatagacatatataggtttttgtcagggttccttagcttttgcatctcaaaatctatttttgctagggaactgtataatagctcatctgtcttaccctccttgtctcagagcccaggcttctgtgccttttccaatctgaaaagcctcctccttgtctctgtccttttgagcctcatgtatctttttaaaggcccactttaaattccaccactctataaaaagcttctccaactattctacctttcaatggcttctcagtttcctccataatactttgaaccttttagctgatcctgtactctcttgcactacagtgtaaaggtttctgtatttatggctgcatactggcatgatgctttctcagttatgtatgatatcattagtctgctttttcaggacaaaatctgtgtcacagtgttacagacaaaatctataacacagtgtcggcataataaattcagctcagtgaatgcttattaaacattaacgtaatccttgttgctttctttattcaaccctacagtgaaattttctgggtgcttggagtaactaaaatatatttgcagatatttaatttcaacttcttacacattaaacaagtagaaaaccatgtcttcaaaaacatattctttaaaagtgattgcttagggcaaaagtagtctatgattttagaattcattataatagttattcttagggtgggttcatgattggaatggaatatgtaggggcttctggggtgttggtcatgttctgtttcttaatcttgatgctagttacatgggtgtgtttagtttctgcagattgattcaggtggccacttatatgcacttttcttaatgtatgttttacttcaaccaagcggtttttaaaagccagtcattcagatttttaatatgtgtaatatgaatagtgaggatggtactacattttaattcagaaggtcctcttgcttttacccatgcttagttatagtgatcacatgcattgtataagtgtaaataggcagctgctgtcagagttaatctgatgttattctaaataattattgttaggaagttgtatgtctcctaaagattttatccaaacaccttttttttttagtctaagagtggataggtgtactttattttaaaaaaagaaagaaaaagagccaccaaccacattatgtaccacgtgaagatcatggtaatctatatcatacttgtcaatattatgctgtcttatatgtcattgaatccttggcacttactgacctaaaatattcaccaataacctgtcgctgctgtcatttttattattttatctttgcttcaatgtcagtaaaaagaatatataggaatattagtcagctttagctcattgtggatttaagcttgttagttaaaaagtgaatattcgtatatcaaatgttctaatttgattgactcctgaagtaaaacacagggacatacttgatacaagaggttgaagtactgatactgagtagtattgtcaaggggggagatgtgagagtaagggaagaaggaagaaagacaaatgaagaaagaactagctttctgctgccacagcagaatcataagaaaagctggatcatgccctgaatggagactcccttgtactactatggaaataggtggaatccaggaatcaacttggttaccattattgtagttttcatcaccaccagtccctctgatatattcatcaataaggatgagcctgcttaagagatgtagggcttagggattggggaggttaccaaacagtatcagagctacctgagcaacaccccacattttccactttttacacgttttgagtgtagcttgaacacaaccaagtcatgggcagtaccattgctgttgtgatttcttgaaattaactggcatcttttgctggaatttggattctacaagttgatgagacaaatttagcaaatataacatttccttgtgccaaagttatatgactcaaactccttaacagtattttcatgtaaaacgatcagaggggaggtggcagttgtagccagttttgcattgccataataaaataccacagattaggtaatttctaaagaaaaaaatttatttcttacagttctggaggctgggaagtccaatatcaaggtgctagtacctagcaagtgccttcttgctctgtcatcccatggcggaagggtggaggggtagaagggtcaatgagcatggatgagagagaaacaagagagagtacaactcgcttttataacaaatctaatcctgtgataacaaatccactcctgtgataaccatattaatccatttttgagggcagagccctcatgacataatcacctcttaaaggccctatttctcaacacctccatggtagggattaattttccaactcatgaactttgggggacacattcaaacaacagcactggcattttaagtttaagattcattgaagtagtgaggagaaaaccctgacttctactggaaactagtagctctgtggcaaaagattctggtatagtcataatctgaaagatgtattcactggaaataatatgtccagggatgagaatcaggacacacacatttgagttccagctttgttaccagctacttttttggacatagtttggccatataacctctcagtgcctatttcctcatttgtacaaaaattttcttaatttgaaaaatagcaatggtaatatctaggctacttatccctcaaggtggttatgcaagtaaaattagatatgcaatatgaaaatgccatatgaaaaaggtgttacatataaaaaattattattcaagctagtatgaggatattaattccagttgattttgattagattttgtttattcagtccagtttaaaaaatgaaggtcagaccaggcgctgtggctcacacctgtaatcccagcactttgggaggccgaggcgggtggattccctgaggtcaggagttcaagacgagcctggccaacatggtgaaacctcgtctctactaaaaatacaaaaaaattagccgggcgaggtggcaggcgcctgtaatcccagctacttgggaggttgaggcaggagaatcacttgaacccgggaggtggaggttgcaatgagccgagattacaccactgcactccagcctgggcaacaagaacgaaactctgtctcaaaaaaacaaaacaaacaaacaaaaaaatgaaggttagaattcacaagttaaaatataaagctttctgaaatgatgtatgattttattaattttagtttttctacatattcttttactcttttccattttggacacttttaaaaataagactaaaaacataatcatgaaggctcatgttattttaaatgacatctctaagctttcatggaagaatcattgtcccccatttaaaggttgatcataaaatttccaatatcctattttgttaggatatctttttccttagcatgtataaacatggaagaaaagataaagcatatagtattaactgaatagcctaagtaattgatagtaaaagtttaggggcaaataaaaaaggtatgaatataaaagattattataataactaataaagatgataaataagtagaaagccaggtcttcaaaaaaattttcttttatgtgcattttaaaggagtagattctgcttgaatttgtagcagaaaacctgaagctaatgtttatgctcggcactgtttcttaattatgcatttgctgatacctaatagtgattatagtaaccactatcatttataaagggctaagtgccaggaattatattaagcatggttttatagaaaaggagactgaggctcagaaacgtgaagtaaagtgcacaagatcacacaatgaataagagcgaatattttttctacttccgtgtctcttgttctttccactataacatggacaataatatcaaaaacataattcaaaaggatataaaatatgaaaattttagttataaatttaatataaactgataaagcagtataaaccttggtaatgtccatattttaatgggaaggtcaattattataattagaaatatctaatcacatcatataaatactgctttgttctaaaacttcagtaaactcttaaatatataaaagtgctatctttagaatttagggttttactcaattgatttttccttctacgtgtccacagagaatagtaacatacattatgatgaggagaaagaataatcatctctgttgcacaccctttttgaggggtgtggtcctcaactaaccacatctttatttaacgctattcgtatgaggaactgcggctgctaaattgttcatttgtatcccttggtttaaatgtgtcagttttcttcagttatctattctctggaagtaagtgtatgctttaaattaatctgtgcacttattcatgtatcttttaccattagaaaacacactgaatagatattcttcggaggaaaatgaattgttgatatctcagcttactcagaaattcagtagaaatgattcttaactcttaaatgggaaaatggcacatggatagaacattttcgtaggaaaaacattccaaacgtatttagcctcaccagtaatggaagaagtgcacatgaaacaataaaatataagtttcagctatcaatttggtaaaggttaaaaaaatcaaactatatcgtattctcagcagtagtacaggtggtataggtgagatgcttatgtattaattatttgcttctctatataaattattgattatcacaaaatcccatacataactatttggagattaacatgtgaaataggccgggcttggtggctcacgcctgtaatccagcactttgggagggtgaggcgggtggatcacgaggtcaggagttcaagaccagcctgaccaacatggtaaaaccccgtctctacgaaaaatacaaaaattagccgggtgtggtggcacccacctgtaatcccagctactcaggaggctgaggcaggagaatcacttgaacccgggaggcagaggttgcagtgagccgagattgcaccactgcactccagtctgggtgacagagaaagactctgtctcaaaaaagaaaaaaaaaaaaaatgtggaatattatacagtgttccaggatttagaggacctggaagtatgcaaagatttatcaccttgaaatttatgtgtttttgaatgtatgttattatttttattatttaccttgtgaatctttgctacaataacttgtagtcagaagtctgagaatattggcatccttatgaaaaatgcactgaggaaaacagacaccatttttgcagctttgagactctgctatgtgcgtctcaccatacttcttggtaataaaagtctctttaaaacacactcaaaatacctacttgtaactagcagcttttttttaaagaaggaagactgatgtatatggctgtatttttattatatttgcatgcactgaaatataattattctgaagggaattaaaacaggcaagtgatttcaggaagtggatagagtttaaacatgggacagatcaaatgtataggaaacaagtggtttgtggtaatgattggtgttacatctttcaaggcctgataccattgacatgtggcggtgagcagcatatctctgacacttttgcacagttagcaatgatgttagacagcagttcttcctgaaataagtgagccaaatgccagtgcagctaattggtttacttgggaaatgctattcaccaatataaagcctagaaaagtgaaatttcagtatgcaccttataaactccatcggcatgtagataaccaactaattttgagttacagttggtccagtaccagaagtattgtatggtttatctgaagggactatacagaattcatcactgatatttaaatttttctctatgattgttttatgaaagcagcaaggcaggttatagaattctccgtattgacagatctttaataaataaactttaataaatgaatcaataattggcatagaattaacctccagaaagacacatattgcttagccttaaaagacatttttgaaaaaatgatttacggatacaattttaactctttcattgtactgtcaaaccttattttataattaaaatcctccatgatctggaatctcccttttattaacagtggctaaggagccatagcagtgagactagaaaggagagaaaagattctggaaaatgtgggacttaaatatgtgtgcattgtgacataagtagtggatgagggaaccaccgatggggagaaaaattgcaaaaacaagagtaatatttgtatgcagatatccacctatacaatatatgtgataatttgaaattacctatatctttttttttaaccacacatgattccctgagtagatttcatttctagtatcagcagtgtcatactatgaacgctcaaaagtaaaagttttagaataagctgtaatttcagatccaataatctcagttaaatttggaagaaagtgtcagaggtatttgaaccagagcaactccattttgaatgagggctaggaaaatgaggctgagacttgctgggctgcatggttaagggaacaaattaataatgtttactggccgggcgcggtggctcacgcctgtaatcccagcactttgggagaccgaggtgggcagatcacttgaggttgagacttcaagaccagcctgtccaacatggagaaaccccatctctactaaaaatacaaaattagctgggcatggtgacgcatgcctgtaatcccagctactcgggaggttgaggcaggagaactgcttgaacctagaaggcagaggttgcggtgagccaagatcgtgccattgcactccagcctgggcaacaagagcgaaactccatctcaaaataataataataataatataataataataataataatgattataataatatttactaaacagacccagacttgggagtgtccagatgtcctgatatctggagaacaaaggcattcctaattttgctttaaagataataatatcaattcttgcaaaatatagtaattaagaaagttaatcctgtatcacaaacccttgtagcaaagcacatctccccatatatataagcgttgtacctacggtagatgcattcctcctcttttgggaatgtcctactctgtctatggagtagctgttctttcaccactttactttcttgataaacttgctttaactttggactgcggactcaccttgaattctttcttgcgcaagatccaagaaccctcttttggggtctgcatcgggacccctttcctggaacagaagtacatagaaaggaaatgtttattctgtcagtccagatttcaaaacaaagtgtctagcagaatcaaaccattatcatatttgtattttgtgttctgtctatatttctgttctcaaaactaattatggcatttgatatagttagcgcagaaaagtatacgccgagccttactctgatgttaaatgcttgtggagttcaaatattttgtaaaatactatttacctttctacagatattaatcaaggtagaattacctctctctaaatacagtcttgtctgaagtaaaatcccagtcagtttattatatatcaaaagaagtaaacagcttttttgcttgcttctctaagaaccataatcagttagtcatcttcattctattgccttagtctggtcttccatgatcttaaaaaatgggaaatgactgtgattaatgaagctatttggacgatgatatttaagatgataattgcatttaaatgttatattgtttaaattatatgcaaatatctgagatcaaaggaaacataaagagctctattgtcccataagtagtttccaaattctgctagaaacagttaatatgtttgatcggttctattgtcttgtccagattcttgaattctgtttgtgcaaactggacttgaggggagtatctacagacagagcagcatttctatcactcctcggcagtgttctcttcaacagtgcttattgccagctatcgaaatgtgcagtgtgtgtatgactaagagtggatgagtactgtaacaccttaattacaaaataaatagtgactgtcactgttgctttttatagagctttctgactcaagtgcttggtttcctctgattttttaattatttgcatgaaagaaaaaagaaatcactcctttgacattcgatggagggaaaaggaagagctaattaaactgttgtggaacattattatcctctttagttttacactgacaattctaatgcagagtcactttaaatggctttgcaaatcggaatttgctgggccctttattatttctccaaattcactgaacaagtccattcacagggatattgaaaatgcaaagtaagtccagactgaaatatcatttatttcatgaaacattcattagcactttcagtagctgaagataaaggaaaaaatgtttcacagggagtcatgagagattaatatatacagatttttaaaaacaaaacacagaagtttgaaaaaccatcaggtattgctttgaaaggaatatagagttatatggattttgaatgtgttgaaaaatggcttaaatgtactgagctattcacagcccttggcttttactttttatgtgagttatatctgaacaaaaattttattatagtcagtgttgttcatgctgctatagttaaggttgtcagcatttccattacaaacccactatttcagttggggttcataactcagctttagaagtcaccctgggctaaaggttggcaaatgccttttcaacctgtggtggtaatgatgggtatgagtgtggttaaatatgtagtaaacatttaaattaacatatattacttcttatgttatgaaatattttaattgaataatatattatggttctctgattatagaaactgtctgaggaatgttagctttgtcagtataattgattcagggttaaagaaaactttttttcaatctaattagtccttgtagccaagaaactctgaacatatcttggagccattagccaaacacttcctgctaccaatgagcgatggcttgtaaaaggcactcagtaatatactaacattactgccaaacaactggttaattctgtccaaagattagtgtgtgccacgaggattgaaaagttaaactgacaagtttgagattttgcatacaaccatagccacatacgcaggtaggtaacagattttttaaaatgaaaatcggtttcttttgaattaatctcatttttctggttataaaattaattatttttcctagttatgaaaattaaaatattttagattacttagtaaaaacggaaaaattaaaacagagtaaagaataaaataaattacctataatttctcaaaccagtaataacgactggtaacatgttgatgaatgtccttctgatctttatattatacataaacacagatatgctacaggactgccagcttcatatgcccactgtgcagcagcagaccaatacactgactgcagggttgcagcagaggagtttaatcacaaggcgccaagcaaggaaatgggaggaattctcaagccttgaatttgtttccttgagggattctgggcaagggtgtttaaggggattcataaaagacgggggcggggcggggtgggggctggaaaatttggtgttgtgatcagtgggggcagggaggatgaaatcataaggatgtgtaactgcttttctccaagagtcagcttcttactgggtccaccagaccagcttgattccctagttttgttgatatgcagaacctcctaaagaagcatctcagacaaaaggcttatcttctcacaatgtctgagattttatctatagaaccggaagagaacagagaatcttgtgacaaaggctatgttatcctggggtggtaagtagaaaccagttacaaggaagtgggccaaagggcaagctggcttaatgattgctgctgcaaacctagttggattttattttattttatcttattattttattttatttttcttaaacaatttcattaaattatcttgggaacagtgtcagatatatatatattgctaaggcatactttctctggctgcccagtatcccactgtatgaaatgtttaacttatcacctactgtcgtggatttcgaaatctggttaatgatttatcttagttaatcttagttactttggaataaaaatctgatgaaacctttcagcagctagagtttgctcaggatcttggtcttaagtctggttttagccatttttaggtatgctagttactgtatcctccaaatgttaataatttataattttgattccaaaaatagattaaacacatagaatttattatatattgatcacagagagataccatataccaaacacttaaattccattggcatggttacatattgaagcttttagtgtaaatggagcagactttaaaaattaataaatttggaacatatggaatgatcatttcctttgaattcttcttattttaacttgaagagcaagggaaaaactttcttgcaaaccacatttttccctttaaggtttttgttttttgtttttttgttttttttttttttttcctccctagggaggatatagtggcgggatgcagccggggactctctgtaggaacagaatattatttaatacagaattccatgatccgaaagacctggatttcaatctcaactctgctttctagttatgtatgtgattttagggaaggtacatgacttatgtgagccttacttttctcttccttatgatgtagataatacttgggtcaatggtgttataaatattagatggattatatataaaaatttacttatttgttgattggcatatagctggttccaattaggtaaaaatgatgaaactatgttatactggacttcaaaagttttttgtgggttttttgtttttttttcttgagaagtctcactctgtcacccaggctggagtgcaatggcacgatattggctcactgcaaccttcacctcctgggctcaagcaatactcctacctcaccctcccaagtagctggacccacaggtacatgatgccacacctggctaatttttttgtatttttggtggagaagggggtttcgccacccagactgggaaaagttaaattgagtttagattcatgcgttaaggctgggaagccattgcctactcctgagcaggagagtgatttaatgaaagtgctattctaggaaaattattccagcactgatatcaaaatatctttaaaaggcaagcagtagctgggggtacattgcttttgtctttctctaaaattcatgattatcaataaaagaagactgtctcattacctctgttttagttaagaagctgccagggttttaccattatgttgcagtttttaatctttaggactcatgttattctttacttctgtaacattatagtctcttcatctgtaatttttataagagatatttggaaccttctcattctgtcctccgaagtttaacttttccttcttgtatgcatctcttagtatctctttattattgctttttatatgacttcttaatagctcttcttagtatttcttcttaatatctcttaatattaccttaatattatcaatttcttgagaattatcttccaatgcactaattctctttttttctccccactaattctctctttacctgtatctagcaatcttttcgaatcatctattaagaagcagtatagtgtggtggttaaaagcaaagacttcgaagccagacttcctagattcaagtcatttctctgccacttactagctgggtaatgctggtctagtttcttaacctctctgtgccacaatttcttcattgtcaaaatggatataagagtagcatctgcctcataggtttattttagtattaaatgagtgatgaatgagtttagaatagtacctgtcatatagtaaattttgaatttttctgtttttattgaggttttattattgtagtatctatatttttcctctcatcccctccccctctcttcttctcacagaatctccctctgttacccaggctggagtgcagtggtgcagtcactgctcattgcagccttgacctcccaggctcaagtgatcctccctgctttcgcctactgagtagctgagactacaggcgtgtgccaccacacccagctaatttttgttttttgtttgtttttggtagagacaggatttcgccatgttgcccaaactggtctcaaactcctgggctcaggtgatccacccgcctcagcctcccaaagtgatggtattacagacatgagccaccgtgttccttttattgatctattcattcttttttttccccgtctatttcttgctttatggtgcccctttctttcttcatttcttagatccttatgaacatatttaaaatattgttgttctgatatttattgtttctaaggtatgaatttcaccctttgttatttctgctgactttgtatcatagtggtttttaatgttcatctgattcgcaatttcttcactgagagctcacctttagcagaagttttctttggaagtttcagatgctctgggttgtagaggtaccatatgggatggtttcaatttttctgtctttcctaaattttaccagtttttacattaatttttatctttctattcttttcctttcttttctttttctttgagacagggtctcgctctgccacccaggctggagtacattggtgcaatcatggctcactgcagcctcgaacccccctggtctcaagagatcctctacccttcagcaactgcccccacccctacctcgccatagtgggggctacaagcacatggcaccacgcctggctgatttttgtatttttttcagagctggggttttgccatcttgcccaggctagtctcgaacttctgggatcaagcaaactgcccaccttgtcctcccaaagtgctaggattataggtgtgagccaccaggcctggcctaagttttcaatacatggtctccacacaggttggtaaggcattgaagtttcacctttatacccatagactgatgtggctaactttttccctgctatctttcaggaagtgactgaagcttttctagacttagttttccagatgagaccacccttccaggctcttagctttgtgcagggatctcagttccagctcctcatgtacaagaagcttgtgacataaattctcttccctatgcagatattaaaactctagtctctatgcttatatttagttccttattcctcttagcctgttgcctttagctccctaacagagctttgactttgaattgctactttctgtctggcccctaggaatttgccattcttaattttgagcttggcttttttctttaagttttatacagaacaatttgactagtagtagcttttcacattaacttattcaccattgtgtttggtagaatattgtcaggaataacaatgtaaatttaccagagatatttctttaatgagtaaattggctcaatgtatgcattaattgattcataagtctttgaggatctctgatatcaaacaaataagcaagagtcactaaaatcaagaatttattgagaacctactttaacccatttttaaggtcactactgtgtcagttccatttcaaagctagtctcaacctttaaaatacttatactctagttagaggcaaggaataaatacatgaagtacaatgaaaagagctaagtgacaatgcaaaacaaccaatccataaaactgtagatcagagtcatctgggctgaagtaccttgttctgacaggtcatacaactgtacttatccctataaatacctaaggcaaaaatacctatttcttacttcctgcaaagaaattatataaaattatctttcccccaatctttactgtctgtcggcaaaagtgaggcagacttatggttctgagtgagcactaccatttaaaagaaaaaaagaaaagaaaaaaagagtgtgaattgccttaggtaaactgaaattgtcaactctgagccaaaacaatgcatcaaatttagaaatgtatgtcttcttatacattgactttactattttcacatgtgtgacttttaacttttcagataatgtatacctattatcagctttctcagtaaattgtttacatcactgaccattaattcttagaagtccttattgctactttttttggtgttcagaaataaattaaaattctcttctttgttcttttacctagtagtgttttacaactttttgaaacatgaacgatgggttaggattttatacaatgaatgatatgaaagttggcttgaatatatacaccacaaggtttgccgtatggtcctctgtcaaatatctgttctcaagatgccccaaggcatcataaaaacaaaatggaaaactgcaacagaagaccaagaaagaaatattttcaggtaaatggtaaagcagggagatgacacatttcgtgcattgtatttcactctttcaacaactatggattgaatgctgaatttgtgccaggtattttataaactgggcacttgtcatacagtggtgatcaaagtggatgtgatcactaccccttgtcacagtctcataggagagacagacaattaattatatagctctagacttaatatgctaggaaagaaacagagtggatacaataatgggtaataatactatatggtgggtgcagggagagggctccttctgatagtgtgttcagagatagcttctctgaagagtggccatttaggtggggacctaaaggctgagtaagaggttgaagtattttctgttggcagggttagagtttcttgggagacataaaatagtttcaaaagaagcattaccaaaataagagtttttataccttcacctgtgaattatacgcttttgtttgtttgtaaacattttattttacaactctacatactctgatgcaattctgtattttggagttttgtttgtttgtttgtttgtttttgagacagagtctcgctctgtcacctaggctggagtgcagtggcgccatctcggctcactgcaacctctgtcccccgggctcaagggattctcctgcctcagcctcccaagtagctgggactacaggcacgtgccaccatgcccagcaatttttttttttttttgtattgttagtagagacgcattttcattatgttggccaggctggtctcaaactcctgacctcaagtgatcctcccgcctcggcctgagattacaggcatgagccaccatgctcagccctctgatgcaatttgagaataaacaagtatagcaagtataagcaaaaggcacaaggtattctgcatagttaaaagtgcagctgcttaaaaaccatcccgtcttctctactctctctctctctctgtcctcctcctcctctttttttctttctctcatattcgtcttacagaatattaaatctgtttccatattgcttggtcccttccttcatcttaagagagatgttaatactgtgcgttcattgagaataaccaaatggatgttagcattgttctttatttaatcttaagtaaaatattgtttttttcttaaaaaaaatacatttatcaaaatttatcttacccttatcaatctcaatacagttgtctttacattaacttctattagttggctattgtcctatgttttatatattcagtaattatataatatggaacaaaagtaagatatcattgctgaatgctgttttatggaaaaagaaaagcctttggcattaatgtaatatatactcctgttgattaatactttgaatgtctttctgtgagatatatacaataatgcccataaaatgatcaattttgataccattctgatgcattaaagatggtgaaataaatgttttaaaaagactgggagatgcgaatacctattttttgaaagcaggttagaatgtaatgcataaatgggcaaatgaaaataaaagcataaacacatagaactaccagggctgttgaatagtacctgactcaggtctcttccctccagaaagactataaaaaaacttctaggcaaaacagttgtgtttcatattttttaagtgctggttagtaaagactttaaaaaactcattacaaagtatttcatgattacagaagaacatgtaatagatagtatgtaaggtataaagaatagtgataatttaaaatcccacgaacttagcacccagctaaagaaatacaactttatcagtgctctttaatgccctgtctgttctgagatcctgtattcctccccctgctccaaacggaactactatcctgaactctgtgtctgttgtccctttgtttttctttatagttttactgtatattatgtatacataaataatctattgtctacttttcctcagttttgaatctttacataaacagaattgtaaaatatgccttattctgcaattagtttttatttttcactaaatcttgtgtttctgagattaactaatattggtgcatgtatctgaatccaattcctctgccacatagcgtttcattggatgactataccacaatttacttagccattctcctgtcaatgtacttgtggtcgccccctccaccaagtcttttgttaatataaacaaagctgacgagaacaatgttttattttgcttcctgatgcaaatatgcaagagtttcctctagggcgctattctgaaacttttttttttatcttagaacctctttactcacctaagaattgaggataccaggaacttttgtttacatctgttaaatgtatcagtatttattcaattagaaatcaaaacagatcatgttaaagcatcagaatatataagcacacattccattaaccatcaaagcagcggtgggcacttgaaacatgagtggcattggaaagttttgagatagagactctggaaactactgtacactctttcaagaatgagagtacaaaaggcagatttcttagtactattatgaatgtagttttgacctcatggacctgctgaagggacctcagagacctgtagctttcatagaccacacattgagaactattgttccaatacaaatctaaggttagaatcattaggtcattatgtctcttcaattactagataacatcaaatatttttctaaagcagttgtactgtaccaatttataatatcaatagcagaatatataagtacttcctttggtacacattctagccaacatttggtcctgtcaaacttttccatttttgacaatctagtggtttaagatggtgtctcactgtggtttcatgttacatttctgtgatcactaatgagcctcaaaatttgtattggccattaaaaagactgttaggtctttttctgatctttcttttgggttgtttatcctctttaaagaaaattctttcaattagttattgaaatattacagatacaaaccccttgtcacttatatgtcctgcagatatttagaaacagttgtggctagtagtagtattacttttaaaaatgtgccttttaatgaacaaatgaacagaattttaaaattagacagtctttttttttttttttgatggaatctcactctgtcactcatgttggagtgtagtggcatgatcttggctcactgcaacctctgcttcctggtttcaagcgattctcctacctcagcctcccgctgtagctgggattacaggcgggtgccaccactcccagctaatttttttgtatttttagtagtgacggggttttaccatgttggccaggctggtctcgaactcctgacctcaaatgatccgcccgcctcaacctcccaaagcgctggattacaggtgtaagccaccacgcccagcctatatagtcatttttatcagtcatttcctttagcacttagactttttgtattttaagtaaccctttctaccttcagttcatgaagatatttttctgtattttcttttattcattaaaacaacactttttgattacctactactatcagacacagttctaggtagtgtggatatggcagtgaaaaaaatacatttaaaaaaaaaccctagactcttagagcttacattctcgaagtggggaggaaaacaataaacacatatgcaagtatctcttagtctcttcagactactgttacagaatactatagactgggtggcttaaacaacagaaatttatttctcagagatctggaagttgggaagctgcagatcagggtgccagcatggtctggttttggagaaggccctcttcctgttttatgcatggccgcttcttactgtgtcttcacatgtcagagagagcagacaggaagcaagtgctttcatgtctttttataaaaggcttgcatcaggtggttggcaataatgaaaaatgtccagattcttaacgtgaagttaaaaattcacaaattgattagaatccacccttatgatctaattatttcccaaaggccctatccccaaataccatcacactagggactagggtttcaacattggaattttgacaggacattcagtccatagcagcatgattttgtatgaaggatagtgataaatattatgtagaataataacgtcagtgagagtgccaagtggtcagaggtggggttctgtaggacagaacagcaaagcacaaacttcccaaggcaattaatgtacttggagagtttgaggaaaaggatgaagtccagataactagaatggagttagcaagaggaagcgtattaggagatctggttgataacagaaacccagatcacctagggcctcctaggccattttaaaggcttgagcttttactttgagatggtaaggcgatggaaagttttgagaaaagaaatggcaggtttttaaaagatcactctgtctcctggtttgagatagtctatatgcaagcaagggacaaaactaggggaacatgtaggaggttgtttcagtaattgaggcagaaatgatggtggcttgcatcaggtggtggcagtagtgaaaaaatgaccaaattcttgatatattttgaagcttttatttgcaattggccagtcacagtggctcccacctgtaatcccagcactttgagagccaaggtaggcaaattgcttgagctcaggagtttgagactaggctgagcaacatggtgagacctcctctttacaaataattttttaagaaacgaacagggagtggtggcacatgcctgtggtcccagccacttgggaggttgaagtgggaggatcacctgagcctgggaggtcgaggcagcaatgagccgtgatcgtgccactgcatttcagcctgagtgacagaatgagactctgtctcaaaaaaaataagacaaaagtacccaaaacaaacaaacaaagatttgcaaattgattaaatatggtttgtgagaaaaacagagtcaaaaatgagtaattcctttttttgttgttttttgttattttttgacatgagtaactagaaagacaaagttgtcatttagagagatgaggaagattgtaggtggaacaagtttaggtacaagagtaagaagttatttttgaacatggtaattttcttatgtccatgttcaccacatagggacaccaagaaagcagttagatatatgagtctggacttatggggagaagtccaacctggacatgtaaatctgtgaggcattagtgcacatagtctttgaagccattagactggatgagattaccaaaggattgattatagatagaaaagggaaggggcctggtgtgtgatccatgacatactataatgtttagagttctagaagatgaaaaggaaccaacagaggggactaagcaatgaccggagaaataaaatggtatttaaatcatatcctgcaagccatctgataaaagtcttttgtaaagagagtgatgaaatttcttaaataaaatgaagtcaagtgaaatgaagacagataattaaacatgaggtctgacaacatgagcctgacaagtcctgtttggatatagtgttggggcaaagaacaagattggaggagattgaagagagaagggaggaattggtaataagaagtattttcttctaaagctcttaaattttcaacatgttctttaaatacattgctttttacctgttacaaaagtaatagtgttcattgtagataatttaggaaaaacttaagaaaatattttatatggtccaaaaaactaactataaccactgtagatattttggtttatagcattggagtccatttttttctgtgcatttttataaattcattttctaaacaaaaaatacattatagacatatttacatgattttcttttttaaaaaattatttatttatttatttatttttttgagatggagtctcgctctgttatttaagctggagtgcagtggtgcgatcttagctcactgcaacctctgcctccccggttcaagcaattctcctgcctcagccccacgagtagctggaattacaggcacgcaccaccacacccggctaattgtattttcagcagagcccgggtttcaccatattggccaagctggtcttgaactgctgacctcaggcaatccacccgcctcggcctcccaaagtgctgggattacaggcgtaagccaccgtacctggcctatttacatgattttctcacgtaagaatgtaccatgtttgtctttccttagtatttttaatggtagtgtagcgttatattatgtattacggtttatatgtagccaatatcctattattaggcacttttcaacattttcttttagaaacattgcagtgagcatttcaatatgtaattatagtctttcattagcatattcttaaagattttgacaattagcccactgggatatgtccagaagagaaatactctgataatggtcggtctgcaaaccttatcatacatacagagggcttaggaatagttgtccacgttgcaaaaattgtaagggttcagtggaagaggaaagctgcccagcagcagaaggtagtccttatagggaagggcagttctctgacagaagaggccttgtccatagaaaagatatgggtagaattgcagcagttgtttgtatgtgcagcagttttttaaataagaaactttccgggctgggcgcggtggctcacacctgtaatcccagcactttgggaggccgcgacgggcggatcacaaggtcaggagatcgagaccatcctggctaacacagtgaaaccccgtctctactaaaaatacaaaaaatcagccaggcgttggggcgggcgcctgtagtcccagctactcgggaggctgaggcaggagaatggcgtgaacccgggaggcggagcttgcagtgagccgagatcgcgccactgcactccagcccgggcaacagagcaagactccgtctcaaaaaaaaaaaaagagtaactttccatattttattgaattgtaggtcatgtaacgaaggttttccatatatctcataggcacaaatataaacattgtatgcattctaaaatcaaataaacacaatctcatttatatatgtctatgcatgtctgtgttgtagttgaggaactttagtttatatgttatactaatagtttactgaatataagtttgaaatatttttctagaattaaggagtatttttaaatcaacttagaattctattttctgcaataggaatatgacaaacattttctcttttttgaccataaactacttgaaccctgtagttttccatttagcttactattttaaggaatgtgataaatcaattgcgaacctttttgttttctttttcttgaggcttctgttgtgatttccagcaaaaaggtcgatgtagacggcattttacctgatgttgatgttgcttgggatcagaattgacaatcaggagtagtctctcagtttagatttacaaaaggccagataacttggatatcactactgcttatagaaacatctctatctctcttcttccttttcaaatattatactcactagatcattaataagtaagataaaatgttctttacactttcacatagcctctgaatttttcccatttaaaatgcactgcttgaaaaatcaaggggaaaacaaaggtttaaattttctttacattttagataatgaaaagagggctcaaatgaagagtttaacagaggcacctgatgggactctttttattgcatataaatagaactattcgtgctgctatttaacaatcaaaatctaaatacttcagactgaagatcaagtcccctactttcaaactatctcccaaaacttcccattaaggactgtatactctaggtgaactgaattaccttccgttcactatgcccagaatacagttttctagaaactctctgtctctgtgatattcacgtcatgtaggtttcctatgtccacgactttgaaattctaaatctaatccataatttaaggttcagttaagttgccaccctcttcaaataggcttcctggaataccacaactaaaagtaaaatctctgccattgaactttattttcatataccaagattctactacagtgctaaaacataattatgactatgggctagtcacaggggcttatgcctataatcccagccctttgggaggccaaggtgggcggatcatttgagttcaagagtttgagaccagcctgggcaacacgacaaaaccccatcttgacaaaaaattagccagctgtggtggcgtgggccggtagtcccagctacttgggaactcagaaggttgagatgggaggattgcttgagcccaggaggcagaggttacagtgagctgaaatggtaccactgccctgtagcctagatgacacagagagacccagtctcaaaataataataataatatttatgattatgtttaattttgatttgttctgttgcactcttatgatgcatgacatatataacaaacaattcctaaatatgagtgttcctcatgaaaatcactagcatatgtggatgcatacttatatgtatttttggccttttgattgagtattcacaaatcataagtgttccgcttaggagtacttttaaaaagtgaaaaaagggctggacctggtggctcagacctgtaatctcagtactctgggaggccaaggtaggcaaattacttcagcccaggagtttgagagcagcctaggcaacatggcgaaatgccatatctacagaaaaaatacaaaaattagctgagtgtggtggcatgctcctacagtcccagctactcaggaggctgaggtgtgaggatcacttgaccctgggagaagctgaggctgcagtgagtcatgattgctactgcactccagcctgagtgacagaatgagaccctatctcaaaaaaaaaaaacagtgaaaaaaggagttaaatagaatagtatctaatggtatctaaagtagcagttaagcagtagagtaacagttgcatttattaaggatttagtatataataatttttattatataaaattattatataataaaaatatataataattatattatataattataatatataaaattgttatataataaaatatataataattgcatatgcgcatgataatttttatatgcactcatctcctctgtacttcacataaatcctgataggtaaggtactattattattcttactttacaaatgaagaagctggaacttggggaaattatgtaacttgcctaagttctcatatatagtcaaagacccccaagccttttaaccactttactatgctgaaaaaagtcagaagacgtagcaagaatgtaaagttttgaaattaagtcttaggacacagaaattatgttagaaattatacttgggtttcaggattacattctcgtgtgttggcaaggaggacgctactagctgagtaagaaatgatgtgtgtgctttatgactttattatgtgaaagggtactaaccatagtagagggttacattaatgtatctttagttgttgtagatattaatgggagaaaaggatttataagagctttcataaaacaatttgattcctttatgcctctaaagctgttttcccaggaaacattaaaattgtaaataatgatttatcctactgtggggttcttcggaaacttaactcttggggttagatttctactggtgtgtgtgtgtttaaaagagctattaataaaactgcatatacattattccattgtggtgttttaattatttttgattgatcctgctttctaagctccaaattagaacaacccctttaaacatttattaggaagaaatatctgaaccagtctgacctgacatttgtagacatcatcttagggctgttctccccttagaggatagtaacttaggactatatcagttacgtctggtaacgatatgccatgtctgtgatactagcatgcatttctataaggaaggaagagatggagggagagaggaatttgttttgaatactctgaaaatgtctagccagtggattataattaccataatcacagtttttggccatttggatgaaagaatgttgttcatgcccatactgctagctaagacagtcatgtgcatactgcattatgaacctatttccaatagattaggaaaatagttacaacaggtttgaggcttctgttttgcaaaaaccttttatagcgttatggtctcagaaggaaccattgaagaaaataatcattaacattttctcgaacactaaatcctccgttctgctcctccaatatctcataggctgtcatctgatatcagcacttatgtaatgtcacgataggtggtgccatagttctatactgccttacattataggaaaatataaagtgttatttgaccaattgaataaaaagaagaaaaaatgtaaaaagttttctgaaccctggttttaagaaatttatgaacaactaaaaatttctcaaaggactgcatttttccattctctgttagtaaaatatctcagctgccttttgattctgctagctgcgagaatggcagaatggggcctgaatggcaaactatattatttgtaacattaatgccagcctgtttggagattaattactatctttgtattaaagtactggttgtgttggaattgctgcctttttaaacttccccccaacccttggtcatttctactgatgatttgcagtaaaatagctgacaactgcctatgattagtttagccagatgctacttgctctggtaaattcattttaagcatttgacaagactgcaaagattagtgccagctgagcttaaaatatttttacagacgaatgatacgtgaaaagtcagttacttttcaggtatatgatgactatgtaaattaactgacaacatatcttctttggtgtttatttgtgaatcatttatctactttatagaacaattggtagagttatccttcacaggtatattcagaagatgtcaccaaatggagtgctttcaagtttttgtatgttattatgttgtcctatgaattgcctgtgctccaagacttatagaattgcagggtaaagttgggaatctctggattagagaatgaaaataaaagtgagaagtcttttctttagctacttctaccattcaacatcaagaaagaggctcttactctcaaaacattgttcttaggaatggccatcaaataaatgccttagttacagataacattgaacaatgatgagtagtttattggtttttcacctttcttcattctttgccctcttttattattatatctttactctttctcttatgccctttttaaaaagcatgtattatactatagaaatgtttcctattagtgattaatgtgataaatttgattagttgaataaaagcaaactttgattctagattttatctatttcttggtatccggcactgtcaaatacagttgtccctcagtatccatgaaggattggtgtttttttgtttgttttgttttgttttgttttgttttgttttgttttttgagacggagtcttgctttgtcgcccaggctggagtgcagtggcgagatctcggctccctgcaagctccgcctcctgggttcacgccattgtcctgcctcagcctcccgagtagctgggactacaggcacctgccaccatgcccggctaattttttgtatttttagtagagtcagggtttcaccgtgttggccaggatggtcttgatctcctgacctcgtgatccgcctgcctcggcctcccaaagtgctgggattacaggcgtgagccaccgcgcctggccgaagtattggttttaagacctctgcagattccgaaattcgtggatgctcaagttctttatttaaaatggtatagtatttgcatataacctatgcacatcctcccatatactttaaatcatctctaaaccacttataatacctaatacaatgtcaatactatgtaaagagttgttgtactttattgtttagggaataatgacaagaaaaatagcctgtacatgttcagtacagacacaaccatccaatttttttcccaatatttttgattcgtggttggttgaatttatagatgtagaacccatggatatggagggtggagggcctactgtatagttatctctataggttttgggtagtttcctgtccttcacccagctgagtgtgaccttgtctattagaatcatatatactgttctggaataagcttgagatgttatcttttctaatctcattttaccaatgaggaaactgaggtcctacaatttcaataattagtcaaatagcacatggcaaaaaaagtggtttatataggattggaccctagttttcttcaccttccagtgttctgtccactttttggacttcgtacatttgaatttctttatactttgctgatttcactcaccaaacttactgacttacctgacttctgaattatactcagaacaaaacacctgtatgaaagtcttcagtggcaccccattttcttttccagttttccttcccttctttcatctctccctcccataaggtcttcctttttccttcattactgcattttttaattcatgtagaatctacaattttcacttgtagttttatttcaaaatttgttaattttttctacgtctcttttttgttatagctctgaaaagcctacttaaaaaaaaaaaaaaaaacaaaaaccctgctaattggcttttcttcctggtctattgaataaagcactagatagggaataagaaaaccttgatgcattttcttaccttgaccagtgacatgcacactctgtgctctagttttctattaatatcaataaagcggtatttatctgtactgcagagttatcaacctgatttaattaaaaaatctagatatgggccaggcacggtggtttgcccctgtaatcccagcactttgggagaccaaggagagcggatcacttgatcccaggagttcaagatgagcctgggcaacatgacaaaacagtgtttctacaaaaatacaaaaaaagttagccagttgtggtggtgtgtgcctttaatctctataatcccagctgctggggatggggggccttggggggaatgctgatgcaggaggatctcttgagccctggaggtcaaggctgcagtgagctgtgatcacaccactgcgctccagcctggctgatagaacaagaccctgtctccaaaaaaatctagatacatttggggctttctcagagaatggtgcacagaaaatagaaaacggtattagcgttttaagatatggaaaaaaagataattgttttgatattgatggttattattactaatttttaaagactagtatactcctagcttttcaagacaatgatgaagcaatcctgtacctgtgacaggcctatatttctctttttttttttttttttttttttttttgagacagagtctcgctctgttgcccaggctggagtgcagtggcacaatctcagctcactgcaagctccacctcccgagttcaagcaattctcctgcctcagcctccagagtagctaggattacaggcgcccaccatcacgcctggctaatttttgtatttttagtagagacgaggtttcaccatgttggacgggttggacaggtctatatttctttccgtgcttattttacaactggtatggtctgaatgttctccaaaattcatgtgttgaaatgtaatcgtcaatgtgatagtattaagaggtgaggcctttaggaggcgattaggtcctgagggcagagccgttaaggatgggattaggactcataaaatggtttgagggagtgggttcattttcttccactcttctgccatgtgaggacacagatttcattccttccctagcatacaacaataagccaccatttcttggaagcagagtagccctcactagatgtacaatctgctggtgccttgatctttgacatcccagcctccaaaagtgtgagaaatgattttctgttgtttacaaattacgcagtctgtggtatactgtattagcagcacaaaaatactaagacaaccatcctatgctttagattaaccagtatttaccatataacttgtaaatcggtgttagtggtggtaatgggattactaatgtgcatgtgttaacatgttcattggttcaatgcgaggctgtgatcctgtactctgagtgtgccttttttttttttttttttaattactttaagttccgggatatatgtgcagaacatgcaggtttgttacataggtatacatgtgccatggtggtttgctgcacctattaacccatcatctaggttccctcccctcacctccccaacaagcccgtgtgtgatgttcccctccctgtgtccatgagttctcattgttcagctcccacttatgagtgagaacatgtggtgtttggttttctgttcctgtgttagtttgctgaggatggtggcttccagcttcatccatgtccctgcaaaggacatgacctcatttctttttacggctgcatagtattccatgatgtatatgtaccacattttctttatccattctctcatcgatgggcatttggtttggttccttgtctttgctattgtaaatagtgctgcagtaaacatatgtgtgcatgtgtctttatggtagaatgatttatattcctttggatatatgcctagtgtattagtacattttcatgctgctgatgaagacatacccaagactgggaagaaaaagaggtttatttgaacttagagttccacatggctggggaggcctcagaatcatcacaggcactttctgcatggcagcagcaagagaaaatgagaaagatacaaaagtggaaaacccctgataaaaccaacagatcttgtgagacttattcactaccatgagaacagtatgggggaaaccacccccatgattcaaattatctcccaccaggtccctcccataatacatgggaattatgggactagaattcaagatgagatttaggtggggacacagagccaaaccatatcacccagtattgggattgctgggtcaaatggtatttctggttctagatccttgaggaatcagcacactgtctttcacaacggttgaactaatttacattcccaccaacagtgtaaaagcattcctatttctccatagccttgccaacatctgttgttttgatttgcatttctctaattatcagtggtgttgagctttttttcacatgtttgttggccgcataaatgtcttctattaagaactgtctgttcatatcctttgcccagtttttgatggggttgtttgtttttttcttgtaaattccttgaagtttcttgtagattctggatatcagacctttgtcacatgggtagattgcaaaaattttctcccgttctgtaggttacatgtttactctgatgctagtttcttttgctgtgcagaagctctttagtttaattagatcccctttgttcattttggcttttgttgccattgcttttggtggttttgtcatgaaatctttgcccatgcctatgtcctgaatggtattgcctaggttttcttctagggtttttatggttttgggtttcacacttaagtctttaatccatcttgagttaatttttgtataaggtgtaaggaaggggtccaattttagttttctgcatatggctagccaggtttcccagcaccatttattaaatagggaatcatttccccattgcttgtttttgtcaggtttgtcgaagatcatatcgttgtaaatgtgtgttgttatttttgaggtctgtgttctgttccattggtgtatatgtctgctttggtaccagtaccatgctgttttggttactgtagccttatagtatagtttgaagtcaggtaccatgatgcttccagctttgttctttttgcttaggattgtcttagctatatgggctcttttttggttccatatgaaatttaaagtagttttttctaattctatgaagaatgtcaatggcagttttgttgttgttgttgttgttgttgttgtttttgatgggttcttgctctgttgctcagactggagtgcagtggtgtgatctcggctcaccacgtcctctgcctcctgggttcaagtgattctcttgtttcagcctcccgagtggggattacaggcatgtgccaccatgcctgggtaatttttgtatttttagtagagatggatttttgacatgttggccaggctagttagtctcgaactcctgacctcaagtgatctgctggcctcggcctcccaacatactgtgattacaggcatgaaccactgtgctaaatatgtatctaaggtggcatgagtatatgtgttgttgttgttgttgttgttttgtttctttgagacggagttttgctcttgttgcccaggctggagtgcaatggtacaatcttggctcaccgcaacctccgtctcccaggttcaagccattctcctgcctcagcctccggagtagctgggattacaggcatgcgccaccaccccagctaattttgtatttttagtagagatggggttttgccatgttggtcaggctggtcttgaactcccgacctcaggtgatccacccgcctcggcctcccaaagtgctgggattacaggcgtgagccaccacgcccggcctagagtgtgtgtttttaacaaaggccttccttgccacatcctcattccagtcctagtttagttaatgtgacaatagtagtcttttgcaagataaagattataagtaggtaaccattttagcatttgatgcactttacagattgcaagcaataatatgctataaatttagtttttataataagatcatggtgtgttaatagatcatattctgtaggatagttatagaaagtttttaagtactcttttaaggccaagattcatcaaccatttgcttatcctctcactatttgctgtaatttgtcagtatccttcacaataaaaatagattatgacataccttgggggttcagtgaaggttaggacaagttagggatccaggtaaagcttcagagaggtgatgtaatccccttgatgagattccagtagattaagatcttagtatggcttgtgggggctaggcatgataggaggaagagaagaggttggaattctaggtagaaaaaaacaattaaactgagatataaggtaaagaaagtacagagtaaagtacagagtaaatttgaggagcaataagtagtccatcttggctgaagcataggatatgtgtatagtactgagagaaatcctgtggtggaagaagtttgagactatatcataatggcctcgaatgccatgttaaggattttcaattttatttagaaggctgaggggagaggattgaagaattttgagtagcagaggaattttatcaagaggttgttttgtgatgattgataggaatcatcatcatcatgatatgaataaaatggatagagtaaaaattgaaggtggaccccacttattattaggttactgcagtagtccatgaaagaagaacctaaaccagagtagatgcaactgacattaggaagaaagactcaacagtaatttatatttttatgtggccaggatatgatcaaagacaattctgagcctgaataacttgctgaatagggatgcattttttgccttttttaaaaagaggagagcagtagattcagagaaaggttcctggcttggggagaaattatttttgaacttctctggtttgaagtatacattgagtatatagctagagttgcttaatagggagatgaacatatggtactagaattagaagaagggtgggtatcagtaattacctatttttgcaactgtatctacaaagataataattaaaatgatgagattaaaagagatcactagggcagagagtataagaaaggaagaaagataaggaaagaactttggtgaatacctcatttaaatatagaaataagagttatcagagaagctgggtggggtatttatgccgaagcagtgtttagaaaacttatggaagagaaaatttcaggaaagaaagggttaatcagcaatctaagtttttaaaaacttttgcgaatttgtttttattggggtataagacatgggttggaaaatgtcagtttggggtatgcacttgtctccaggaaatatctatcctcatcttcccgggatgatttttggaactttttctctttaatggagctgctcttgctgccagcacaagttcactgctggctggctcctccttggaagataattttctcctttgttttggagacacttaacaagtggattaaggatttaaaagtaggttatttgatttgttggcctaggttatattgctgatgctgcaagaataattttaataaagtggaaaggacaaagttcatattgtaaggggttaagtagttcctaggtgataattaaatgtagtcaaatttgtatagattgcagtcttttcaaaagtttaacattgcttatttttgtcttcataatattaaaccaggtctatctaaaattttaatatcacatgcaagaagcattatcattttgtagcagatttttaaagctgttatttcagattttgaactgatcagcatgagacagattttctttagaaccatttttgttctggacaaaattcaagctggatattactgattactctgaaatgcaaatagtgctattttgttttacagctatcatttaaaaagccatgtactcattaagataaatatgtgcagcatgaacaacaaaaaaatgagaaagaaaatggacattatttgtattttgtaggctctctgatatggaactgaatgcactaatcttcaaatactaatgagcagcaaaaagcaatttgccagtgcacaattaacttctgactggcttctgttgatatgtagtgctataaccccacaccaggtgaacttcccattttttgagattttatttgaccagtatttataattgtggccaaataatgagatgattattatgaaataatgttatgttggagtaaatcatacttacatggagctcttattatagtttctctatttaattgtctgccaccagggccttgagcttttattttcctctttccccttctgctcttcttgccttttcccatcattgaagaaacaagggcctccctctcaattctcaatttggaaacctgctagtggcatgtcttagttacaaacactgtgttttatatcatgtggttatgttcgtcacttatctcttctttctgttaacttttattctattactgtgtcatgtcatttatatgtatgtacgtgtagatacatatacatgcatatatatttacattcagatatatatgcatcccccatgcatgcatacatatcatacagtagtggagaggaggttgtaaagcataaagtttacctgttttgctcatggtttattgaggcagattttgtcccttagctcagatgagaaaatccctactccacagtcataagctgaaattctcaatccagccagatattttgcaaatgtgcctctggtgcctggggagattgagttaaagcatatatggctcagtgagaccaatcattgtgattggcaaatgaactcaaaacactatcttagtaatgttaaggcagttgggaattttatttccacaacatgcaaactaatactctgaatgagtagcagattggaatatggtaggaaactttgaaattgtgattctcaaataatttagcctaatgcttgtttcatagaattatgaaatcttgtttattgtaaggaaccttagaggatcatctaatttaatcactttttctaatgcagcggcacgttgtataatacccctgagaggtaaatgtccaatgacatggaattccttactttgtctgggctcctgctgcattgaaaatatattctttgtacttggctggatgcggtggctcacgcatgtaatcccagcactttgggaggccgaggcaggtggatcatttgaggtcagaaatttgagaccagcctgaccaacatggtgaaaccctgtctctactaaaaatatttaaaaaaacaaaaaaaaagaaaaaatgacccaggattataggcacccgtcaccaatcccagctactcatgaggctgaggcacgagaatcgcctgaacccaagagacagagattgcagtgagccaaaattgcaccactgcactctgggagacagagtgagaccctgtctcaaaaaaaaaaaaatatatatatatatatatgtgtatatatatatatgtatatatatatgtgtgtatatatatatgtatatatatatgtatatatatatgtgtatatatatatatatgtatatatatatgtatatatatatgtgtatatatatatgtgtgtgtatatatatatatatacacatatatatatatatatatatatatatatatatatatatatatatatctcacttcttcatactgaattgagatctgtcctcctgtcagctctcactcagttccaccatgggggcaatacagaatctgagatttatctcttcctcatgacagttatttaaatatttgaagcactttccattttgtttacttttctaaagtacttttctatggtacctatgcatactttgttaaccatttcttgattgctgactcctccagaatgttggttattctctcttacttattataatttgtcaatgccccttctaaaatgtcatatgttatttaacctaatgcttcaaataaagttttacctttgcatgatacaattgaacaatgccttatacattgtaggttcaaaggtcaaatctttgaagtataggttcccatcctaaattattgatgacagttttttagcttttatagtaattgcatcttgctgtgaatgcatgttgactctgtggtcaacgaaaaacctcattcctttttttcttttatttttataaacacaaactgcagtcaagttagattatcccaaatcccggacctatataaatgatttaaaaaaaactaattgtaagattttcatttatccctgataaatttaatttttgtttggtttcagttcagcactgctacccattacaaaattttgaatcctgactctatcatctagcatattcgcagtccctttgggttttgtgtcatttgtaaatttaacaagtataccttcaaacagcttcttttaagtcactgatttttttgaaaaaggaacaagaaatgcctgcaactaactaccataaacctcctactggttgacaccaatctaattattaatagccttttaatttaatttttaaaccaaattaaaatctacccacctgtactaatatccagttcttatgcgtgttcctttcccacaatggtatccacagagaatttacccaaaataaaaatatgttatgcatttactttccagttgattttctctaagaaacagttgccagtagtttggcatcagttattttacataatccatgctacttcttgatttttagcatgatgatttataaatttatgaagactttgggcatacccaagcatgaggcagagttgggagtgcttcattttctttaacacaattgagaaaagttgatatttttatcaagacatttgttaaggaagaaacagggaaggtataagaaatctaaataaactggcttgcatactacaggattctaatctccctctagctaatgcagcctacagggcctagcccattccacatagagacctatggaaagtgaggggctttgccttgactcctcatttccactattttggtctgcttccatgttttgagtgtcatttgatacacatcatccaagataatcagtctggattttatgactgttgaatatagtacaagaaaagttatgtccttttgcctgtttacgtaaggaccactctcttaattcctgtttctagaatgaaagaaatgccttttctcaagttgattgttaccaggaatgacttcatattgtttgcgagattccactctatccatatgcttgtggccttttcccatacagagtcaatagtatagtaacttaatacaacctactatcatggaattcatttagtaggaattatcagtttgtaataacagggaatatgggcacaaattgccacttattctggagaaagtgatgagaatgtattagaggaaggagtagggatttagggattgaagactaattaagtagcctttttttttttttttttttttttgcaactgtctctctctgttgcccaggctggagtgcagtggtgctcactgcaacctctgtctcccgggttcaagtgattctccaacctcaacctccctagtagctgagacaacaggagtacaccaccatgcccagctaatttttgtatttttagtagagacaaggtttcaccatgtttgtcagactggtcttgaactcctggcctcaagtgatctgcctgcctcggcctcccaaagtgctgggattacaggcgtgagccaccatgcctggcctaagtacctatattatcttccatatgaaatgtgatgagtaccttaactagtttgtagcaatgtgattgaattatagacagttcgctggtaaaaataggcaaatgataaaatataagagactggggaatataataatcaatataagtaaggagtttttggaaatcaaaaattaagagaactaaagtgtttgtgttacacttgggatcatataaacagaatgctaatgaatgaattgtaggtttttaagggttattttccaaacttagcaaggtaattaacatatcatgctaatacaaatattaatagaaatatagatatactttgagcagcctgcagcctacacctactttcctagagctattgaggttggagagcaaggtgaaaatgatgggtttagatttagttctggattactctgggtgaagattttaagcatgtagttagaagttttacctggagagatatttggaagttgccaaaaagataataggtaaattcaaagaaaagtctttggagtagaagacgaagattgcagataaaatcttagagaataatgcctacctttaggatggaggttgaaaagaacttgccaagaaagagttacaaaagaaaaggaggataaccaaaatctgtgctttatctcaggagccaagagaagaaagcatttttagaatactagggagtaaaacaacaccatcagtgtccacagagaaattgagaagaataagctgctatcaggcctttaagtttggtggtgacatagttatggagatatttcatagaagaggttgaggagactgggaaaggtagattggaagggctcacttaatagaagcagtagtggaggaagcagaagcaatggaccgtccaatacgaatagtcatgaaggtaaggaaagagctttactgtttcttcttcccatttaactgatagctcagtagataaaaaaggagaacaagataaacttatttgttgaaaaattactagaagtttgttatattgtttaaattgatttcaacttcagactgtttaataataagtacatagtttaaccaccataggaatgaatttgagttctttgctctgtataactttaataacagacagatgttagtctttcagcaaagaaacaaaggttgttccctaaattactttagatttacaatgcaatagagcattttaattacattcatatgtgcagacttttaaaaaataatttttaaatggtttattatggtaatagaagcacatttatgccacatcatgcaacacggaaagcatattctctctgttgagtggtgtaaaatgtttgtggcttttgcatctcacatttcttgctttagaagtgctactgtcatttacattctctagtaatccaattgtgaattttatggatatatatgagcatgtgaggacagggtgccagtggaaagctaagaaaaggagaaaggtaaataacagccagagaagttggcaagattactttttcttcaccgtgccaagacagctattttagctgaaaatgaggaggatgggaggtgcacaggaatttagttagatatagaaagagaaaagctgggcaaataattcaggtatgtaagcaagttcaagagatgaatgaagacattattctgatgtctgaagagcggaggttaaaggaaaggttgactaaccaaaaagccttatgtgaacccagggtaatcaataactgcgcttgattagaggtcttgtagcagtggtatatagaagaacagaagaaagatgtggcccccaaggtcgtatttaccagagagaacagtctgagaaacaagccacaaaagaattggtctatgaagcttttctcagaatcagtcgtccccccccctccctccctcccaccctccctcttcccttgctaagtaatggctggacactacagaagtactgtatattcctgggtttatcttaggatatggatagtgaattacaaatgatattttaacccatctattgccattgatatgtaaaaccattttctttattaaaaattgccaatccctatgtccaatattataaaattaatgtctctactaaatgaagaaaaaggttaaaaaataagaagcaatttttaaaaaatccctctttttgcctagccaaaaagaaaaagaaaacaaaaagtgagtaggatttattgtgagaaaatgtaacctttaaagctggcatgctgtttgagttacctgcctctgaagggcaaggccctagagagatgcttaactaggcaggtatgatgattgcagtgcccttagggcaagagcaaaggcagagattgtcaacacataggcaataaaggctgcctactcaaactctgggcactcttacttggcttgttaagttgtatcctacgtgcatgagtgttttggctcaggagaaaaactctagtgctattagaaaatgtctctttcacatagacagtatcaaaacggctttattagtcttaaataatgaaaaagtagcagaaacagatttagaatttaatctcttggtttctaggtttctcgtcacttgcttcaccactgatgatctgctctgtttttcaaccaaattctttgtgaattcatggcattggtagccccattctttgtgtttgtacaatgcactagtctccagagtgtgcattccttgaatgatagaggtttttagttatagtggcatgggccatcactagggtagatgaacagatttgtgattctaggatattacgccagtccagattgggaaaagttttcaaaggtttaaaggtttttctgcgggctgcctttgtttcagcagagtggagagaatttaaaaacatgtacccttaataggaccaatagagtttaaactatatattgtgtaacttttagaaacttttcaaagtacatatcttagcaacttcagaaggatgacataagggtcagcctcactggggatgctgtcccatgttgctccttagttagcaagacattgtaaatcggccaggcatggtggctcacgcctgtaatcccggcactttgggaggctgaggtgggtggatcacgagttcaggagttcaagaccagcctggccaacatggtgaaaccccatctctactgaaaatacaaaaattagccaggtatggtgtcaggcgcctgtaatccctgctgaggcagagaatttcttgaacccgggaggcggaggttgcagtgagctgagatcatgccactgtactctagcctgggtgacagagtgagactccatttcaaaaaaaaaaaaaaaaaaaaattcataggtactggactctagaaggtgaatcactgccagtccttcccccagttcattatctgaagtcacaaggcaaagttctttctcctaatcccataaagtcctcgtcctttccccacctaattctgtgtgcagtagccccctctttcaaatgctaagtggacctgactctcatacagagaaataaaaacgggctgggcgcagtggttcacgcctgtaatcccagcactttgagaggcccaggcaggcggatcacctgaggtcaggagttcaagaccattctgaccaacctggtgaaaccctgtcgttactaaaaatacaaaattagctgggcttggtggctcatgactgtaatcccagctacttgggaggctgaggcaggagaatcgcttgaacctgggaggcagaggttgccgtgagccaagatcatgccattgcactccagcctgggcaacaagagggaaactctctcaaaaaaaaaaagaaaaaaaaaagaaaaatgtattgcttcttggccttttggctaagatcaagtgtagaaataaaaaattacacatttgttggatttgttccttcagagttcttccttttaaaatctctagtgggatagatactgagaaagcattttgtatcttccctgggaagcaggcttaaggagagtagtctcactcttctctcagctctaggaaagtaggtgtaggctgcaggctgctcaaagtatatctatatttctattaatatttgtattagcatgatatgttaattaccttgctaagtttggaaaataacccttaaaaacctacaatgcattcattagcattctgtttatatgatccaaagtataacacaaacaagatactttttatactttagttcgcttaatttttgatttccataatatcgtcagtttatacttaaatcttagggagacaaggtagaagaaagaaaagtgactggatagcagcatgagctttgctgccctccaaataagtgctgaaaagatgagtatgagtctactctaatcatctcaaaaggaagcagtgaaaaactgaacattagcatgttcatgaacctaatagtaaaatggccacactgaaacaagaatttatcccagacaagactctttgccttaccacaatgaaaaataagtacttttgctgagtgcagtggctcacacctgtaatcccagcactttgggaggccaaggtgggcagatcacgaggtcaggagtttgagactagcctggccaacatagtgaaaccccttctctactaaaaatacaaaaattacctgggcatggtggctcgcacctgtaggtgctcgcagctacttgggaggctgaggcaggagaatcacttgaacccgtgaggcagaggttttggtgagccaagattgtgccactgcactccagcctgggcaagagagtgagactccgtctcaaaaaaaaaaaaaaaaaaaaagaaaagaaaagaaaagtactttttcaaaagtagaagttctctttatctctacccctaatgcccagtaatacccttaacactaatacctgctttttaaatccgtgcatatacctattttgtaaagcaagagagtatctaaataggagttgagccatagaatgtaagagctagatgcgcccttagattccatttgctaaaacactgttctgtgaaccagtgttaacctgtgaagttttcatcagcctgtaaatgataatttaaaacacacagaaatttaagctcaatgtattcagtataaagaactactcctttattctgagattatttcttttacatattttttcatgataaaatatcctacttttatgagatgacggtgatgatagatggtaggaattttcctcttaaaataatagcctaatttggcagtataaaaagtgcctcccgattttttgcagtttctgaaaccctaacacctgagaacaactggtctagtttgatctccttatttcatatttgagaaaagtaaggcctaggagaagttaagagagttacttaagactcactactaagaaatcatggaattaaaactagaacctacacattcatattcctagtccacagctctgaataaagcaacaaattccctctctttttcctaaataatacattatttctttctttttctttttcttttcttttttttttttttttttgagacagggtctctctctgtcgcccaggctggagtgcagtggtgccatcttggcccactgcagcctcgacctcctgggctcaagcgattctcccacctcagcctccttagtagctgggaccacaggtgctcgccaccatgcctggctaattttttgcattttttgtagagattgggtttcaccatgttggccaggctggcctcaaactcctgagctcaagcaatcctcccgcctcagtctcccagtatattgggattacaggcataagccaccgtgcccagcccacatttctattcttaaattaacttgaactttgtcaattttatttttcttcttttaccagatttatacttcctatattttgatgtgccagtacttcattgggttaccttcattatgcagttaatttagtttctcaagcacattttaattattgatttctcttattttattaaagtgaattaaaggtacatttgtcttgccaaaaatttaaggccttttattgtccttgtactaagactaagttatctcccagttggtatcatttaataaagacattgattgcattctacttggttgcattctactggtgctggaaaagcgatttcattttctggtgaagtttatgctgacaagttgaatggaaaatatacttgtataatacttttaattacatgttatatgcatttatttattttgctctttagcaggattttagcatcctcacaaaatattatatgactcaaggaactacctactcactttgctttctctgctggaagtaggcaatcaagccaattggaaaatttaaatccgtggattatgggttctaatttctggcctataaataagttagttttgtcataatattatatatttgtataatactttatataataaacacttctttatttctttttggtattcagtgtatcttttacatacattgtcaggctttgttttttctgaaaacactgtgaggacatatttgctcactctcattttgtggatgacagactgaagctcagatgccttaagtaatgtgcccaaaacagcagaactagctaataagtcgcagagtcagatttagaacctcaggtcatatgactacaagtcttgcatttgctccatatctctgctctacggtaatgtttctctttgcatattagtattaaaaatggcttctcccttccctaccagataatggtatgattcttagtaaaacatcccatttccattttaatatcctagaaatttttttttttttttttgacggagtcttgctctgttgcccaggctggagtgcagtggcgtgatcttggctcactgcacgctccgcctcccgggttcaagccattctcctgcctcagcctcccgagtagctgggactacaggcacccgccaccaagcccggctaatttctttttgtatttttagtagagacggggtttcactgtgttagccaggatggtctcgatctcccgacctcgtgatccgcccaccttggcctcccaaagtgctgggattacaggcgtgaaccactgcacccggcccctagaaatattttcaaattgttgaatttgttttagtgatttcacctgtccagataacctaccttaaacatcatgatgagaggggaggggagaaaataaatagtattgttatagagtttaagctagaattaagtataaaatcataaacaattaaatgtgattaaatgaaccattttatagcttaacagtatacaggcacatattatttatgtcagcaagagaaagagcccacattattaggaaagcctattttttagatcattcaaaattgtttcctaaactgtataactaccttcctcaaggatggatttacttaatcaacagttctgtaataattggttaaaccatttggttggggagtatggtcccaaccttaccatattctaaaataaattttgtaatgattaaaaaagcaaaagctaataaaatgaatcaataaaggacaacaaaacctaggtggctattgtttagtcttaggatagggctgggcttactgagcatgaaagtttaggagaaaacctcatgtaaattttgatagatatgtgtcacttgatcaattccgtaatttaaaaaaagttataaacaaaattaaaaagtaaatgatatcttctaggagatagctgaaatatatataacatcaaaatatattgtataatcatacatttggggcatcataatgaatttttaattaaatattaaagtgtaacttcagcattgtcccttgaagtataattggaaattgccattgactagtctcactggtaaaatgagaaatgattaaaagtggatagattaggccaggcgcagtggctcatgcctgtaatcccagcactttgggaggctgaagcgggtagatcacttgaggtcaggagttcaagaccagcctggccaacatggtgaaaccccgtctctactaaaaatacaaaaattagctgggcatggtagtgcacacctgtaatctcagctactcaggaggctgagacaggagaatcgcttgaacctggggggtggaggttgcagtgagctgagatctcgccactgcactccagcctgggcgatagagcaagactccgtctcaaaaaaaaaaaaaaaaaaagtggatagattgctaataaatggaaagtaatacaaaaagtctaagcccgcactggcctaccatgttacaaatttttaatgttgaaatattctgttcgacatattaaaaaaataaaagggaagcaaataacattatgttgttaaaaaaaaaaaaagaagagtaagcatccatggggcagtagtaaacgtgattgttcatagagcagaaaagcttatcagtagctgggtagttaacttagaagcaaataaataaaaatgtgtgtgtaaagagaacacaagttaattatttgacatgatgccattgtttttcaaaataaaagcattctttgcaagatttaattgcaataaatgactaaaatcataactgtattttcaaatatgagaaaaatatgaaagaatatgacaatgatatcttcagaagctactaattattggaaacacatggggacaattacacaggctagcaaagctcggtagcttatcactggatccagaactcagaatcagagttgtagtgatacacatacacacacacatacatacacacacacacacacacacacacatgcacatacgtgtgtatagttttgttgtattgcagtatatagagaaagaacaataaaaagggatttttggtattatatcttacctttgctcattcagttccatgttactgccttcttatctgctctgaagccaagcaggatataacagaagattgtaggcattaggacatcatcagatgctaacagaaatttgttgatagaaaatatggttctagtggtataaaatccacaaaactaataacgggatttgtcatcaaatgttagtaaacacagaaatggtagagataccaggaaagaaataacatgaaatgcttcaattatgagctagtactggaagtttgttaaagaaaaaaagggaaaatgttcactctgacctttaccaacaatttctttctagattgaaatataggaaatgagccaggtatcactgtatagttattttaaacgcaatttctatattgagagtgtatatttgcagctggtacatatctgattttcgtttggaaaatgtaaatgaaaaagggtttttatttcttttttttcggttttttttttttttgagatggagttttgcttttgttgcccaggctggagtgcagtggtgtgattttggctcactgcaacctccgcctgccgggttcaagcgattttcctgcctcagcctcccaaatagctgagattacagacatgtgccaccacgcctgactaattttgtatttttagtggaaatggggtttcaccatgttggtcagactggtcttgaattcctgacctcaagtgatccacccgcctcagcctcccaaaatgctgggattacaggtgttaggaagttttgaggaaatacataaaaaacaataatgtgtaactggtaaaagaaaattaaatgaaaggtaaatacaagtgaaggccagttcttgttctgccattgcctggctgctgtactcactatactcatatactatctctattccctctcatgtgccaaaagaaaaatggtaacttaattcataaatttatagtgaggactaattgtgttccccatgagatgtgttctgagtcacatggaaggttatctgtacattcatgtacataagtatatacacatatagacacaaatcataaacagaacttcctaatactaaagaaattatgtgcttacattttctatatatgcctcattttaagaatagtgcaaattcgaatatcttaggaccataagaaggagaaacactgtgtgattcttcatctcatataaggtagagtgtaagttattcttataaacttccttcagacatctaacaatcgatcacatatgtaagaaatttagttagcctattttactggaagataattctatagtagttcctgagctatatctgcattttaaagtatatttactgtgccttgcttactatagatgacatttgtttcagttctcttgtttaccaggggcatggtagggtgatatttatatatttgatttgcagaattagtagcttcagcttaacaaatggctgctcttcagccttttcccaaggttaagtttgaagtgttcaggtcattttatgattttccttgaccacaaccacgttggctgtcaagggctaagattttactaatttgaccaggttgttctttaaaaaccagttattttaattcttttctctatttccccagccttgtgtatttccagttgagtaaaaataaatagaaaatgctattcagtattctaaagcaagccagttatgtttgcatcacttagacagctttataggactcagaaagagagactgtcagattcatgagagtcagctgaaaactatttgtttctttcaaaagacaaggggaatgaatgattctggtgcatgtctcatgaatgttgagaagctcatcttatggttaaaaagaaaaactcattagacgactctagagagatatataagaaacctaaggattctgttttatttacctaaaacgttcctggtcaaatcagtgaggtatactaacaacaacaacaaaatacacacacacacacacacacacacacacacacacacacatatgtgtatatacatatatatatacacgcatatgtgtgtatatatatattaatataaggaccatcagattttaatataccctttaagctaaacttgtccattgttacacgtggtcacagaagtttttctatgaaaacttacgaagtggatgaaactaggacttatttaatttgaatatgcatattatacatatataggcacaaatgtattttaatttgtacttaatgtatttgcaattataataaataaaagttcattcctatgtaaaatattatgaatttacagaattaccaacaatgccttaagtatattatttcttctgatcttttattccattaaaattataacatctttaagctaatgatccatgccagctactgcattttttatcagttagcacagtgctgactatagacaagtaagtacctgatgggtttaatcacatatattgaacttcaactacatagtttaagtagtgtggtcttctgttatcgtaaagtcacagtgattttccagcacattcatttgatattttcatccctgtcagctcacaaatcccctcatactttgacagcattatactttgttaagaaaggaaagcaggagatatcctttatatttcaaatatattaggttgacatgtgagccatggccaaacttgattaaaggtgaggggaagtgaatgtagaaagaagaattcacaagcagagaagtaagtgctttgggagggtggggtcagggcaggcagtggatgggaggaaaagcacctagccataagctaaggcatgtttcagaggaaggcagtgctgagtttttctcttaccctattttttataatctccccttataatagttagccaccctcaatctaagtaatcttcccataaggtggtttttttgaggattatattaacatatgtatatgtgtgtgtgtgtgtgtacgtgtgtgtatctgaacataaaaactgataatacatttcttataaaataacttgctttatcatgttgtatagcttaaattgcttttattccatatatgtgtatggaatatgtgtatacatgcatatgtacatgtacacatgtatatgtatatgtgtgtatctgtatctttttattaatatttgccaatggcataattctacactccagtctctcaagcaagcatttatgtaaagcttgatccagggatatttctttctttacatcatgttccttgcttctttgttgaagcaatttctatttttccttcttttctgatctcccgcaatgttctagttcttgtgaaatattagttttctcagcactgaagttgaaaactttccatataccaactgctgttttcagttctgatttcaaccagggcttggtggaggagtagggtagggaaacttcctgaaaccttgttgatattaatagcaacttaatcctttggcttctactcagatttcgatggactgtacattcatgctcttatctttgaatcatctgacactttttcagccatgaagaaatcagaatatttggtctgttgtatttcctttctaagtactttttaaaggttacctacttttaaaagagctagaccaagtatagtaaaagtatacaccttttcattttggggatggaggagccaagatggccaaatagaaacagctccagtctgcagctcccaacgagacaaatgcagaagggaggtacctagttgatctcattgggactgattagacagtgggtgcaacccaaagagagtgagcacaagcaggatggggcgtcgcttctcccaggaaggccaaggagccagggacctccctcccccagccaagggaagcagtgaggggctgtgctacccgccccagatactacgcttttcccacgaatttttgcaatctgcagatcaggagattccctcgtatgcctgcactaccagggccctgggtctcaagcacaaaactgggcagctgtttgggcaggcacccagctagctgcgggagttgtttttgtaccccggcggtgcctggaacaccagcgaaacaggagaaccatctactcccctggaaatgtggctgaagccagggagccaagtggtctcgctcagcaggtcccattcccacggagctcagcaagctaagaaccatctggagtcgagctgggatgatcaagcttggtgatagggagggtcatccgccattactgaggttttagtaggtggttttcccctgacagtgctgagactgacaggtttggactgggcggaattcatcacagcgtggcaaagcggctgtggccagaatgcttctctagattcctactcaggggcggggcctctctgaaggaaatgccacagccccagtcaggggcttacagataaaactctcatcttcctgggacagagcacctgtggggaggggcagctgcaggcgcagcttcagtggacttaatctttcctgcctgccggcttcgaaggcagcagctgatcctgataagggggattcttccagcacagcgcaccagctctggtaaggctcagtctgcctcctcaggtgggtccatgacccccatgcctcctgactgggagagacctcccaacagggcttgacaaatatctcatacaggagagctccagctggcatcaggccggtgcccctctgggatgaaaattccagaggaaggagcagataacagtctttgctgttctgcagcctccactggtgatacccaggtgaacagggtctggagtggatctccagcaaactccagcagaactgcagaagagaggcctgttagaagaaaaactaacagaaagcaacaacagcatcaacaagaaagaccccccccccaaaaaaaaccccatccaaaggtcatcagcctcaaagatcaaaggtagataaatccatgaagatgaggaaaaaccagcgcaaaaactctgaaaattccaaacaccagaatgcctcttctcctccaaatgaacgcaacacctctccagccagggcacaaaactggacggaggatgagactgacgaattgacagaagtagactgcagaaggtgggcaataacaaacttctctgagctaaaggatcatgttctaacccaatgcaaggaagctaagaaccttgataaaaggttagaggaactgctaactagaataaccagtttagagatggacataaatgacctgatggagctgaaaaacacagcacaaaatctttatgaagcatacacaaggatcaatagctgaatcgatcaagcagaagaaaggatatcagagattgaagaccaccttgctgaaattaggtgtgcagacaagattggagaacatagaatgaaaaggaatgaacaaaccctccaagaaatgtggcattatgtgaaaagaccaactatgattgtttggtatacctgaaagtgatggggagaatggaaccaagttggaaaacacacttcaggatattatccaggagaacgtccccaacctagcaagacaggccaacattcaaattcaggaaatacagagaacaccactaagatactccatgagaaggtcaaccccaagacaaataatcatcagattctccaaggttgaaatgaaagaaaaactgttaagggcagccagagagaaaggttaggtcacctacaaagggaagcccatcagactaacagcagatctctctacaggaaccctacaagccagaaaagagtgggagccaatattcaacattcttaaagaattttcatcccagaatttcatatccagccaaactaagcttcataagcgaagtggaaataaaatcctttccagacaagcaaatgctgaggcattttgtcaccatcaggcctgcttttcaagagctcctgaaggaagcactaaatatagaaagggaaaactggtaccagccactacaaaaacgtaccaaaatataaagaccaatgacactatgaagaaactgcatcaactaatgtgcaaaataaccagctagcatcatgatgacaggatcaaattcacacaaaacagtattaaccttaaatgtaaatgggctaaatgccgcaattaaaagacacagacgggcaaattggataaagagtgaagacacatcagtgtgctgtattcaggagacccatctcacatgcaaagacacacataggctcaaaataaagggatggaggagtatttaccaagtaaatggaaagcaaaaaaataaaaaataaaaaataaatagcagggattgcaatcctagtctctgataaaacagacttttaaaccaacaaaggttaaaaaaggtaaaggagggtactacctaatggtatagagatcaatgcaacaagaagagctaactgtcctaaatacatatgcactcaatacaggagcaaccggactcatcaaacaagttctcagagacctataaagaaacttagactcacacacaatgatagtgggagactttaacaccccactgtcaatgtttgacagattaacaagacagaaaattaacaaggatattcaggactcaaactcagctctggatcaagtggacctaatagacatctacagaactcttgacaccaaatcaacagaatatacattcttctcagcacttattctaaaatggaccacataattggaagtaaaacactcctcagcaaatgcaaaacaatggaaatcataacaagtctctcagaccacagtgcaatcaaattagaactcaggattaagaaactcactcaaagtcacacgactacgtggaaatcgtacaacctcctcctgaatgacccctgggtatataacaaaatgaaggcagaaatcaagaagttctttgaaaccaatgagaacaaggagacagtgtaccagaatctctgggacacagctaaagcagtgttaatagggaactttatagcactaagtgcccacatcagaaagatgggaagatcccaaatcaaaaccctaacatcacaattaaaagaactagagaagcaagagcaaacaaattgaaaagctagcagaagacaagaaataactaagatgagagcagaaatgaaggagatagagacacgaaaaacccttcaaaaaaatcaatgaatccaggagctgattttttgaaaagattaacaaaatagatggactgctagccagactaataaagaagaaaagagagaagaatcaaatagacacaataaaaaaagataaaggcgatatcaccactggtcccacagaaatacaaactaccatcagagaatactgtaaacacctctacacaaataaactagaaaatctagaagaaatagataagttcctggacacatacaccctcccaagactaaaccaggaagaagtcgaatccctgaatagaccaataccaagttctgaaattgaggcagtaattaatagcataccaaccaaaaaagccccaaaccagatggattcacagctgaattctaccagaggtacaaagaggagccggtaccattccttctgaaactattccagacaactgaaaaagagggactcctccctaactcatattatgaggccagcacgatcctgataccaaaatgtggcagagacacaacaaaaaaaaggaaacttcaggccaatatccctaatgaacatcaatgcagaaatcctcaataacatattggtaaactgaatccagcagcacatgaaaaagcttatctaccacgatcaagttggcttcatccctgggatgcaaggctggttcaatatatgcaaatcaataaacataatccatcacaaaaatagaaccaatgacaaaagccacatgatcatctcaatagatgcagaaaaggccttcaataaaattcaacgtcatttcatgttaaaaactctcaataaactaggcattgattgaacatatcacaaaatagtaagagctaattatgacaaacccatagccaatatcatactgaatgggcaatagctggaagcattctttttgaaaacctgcacaagacaaggatggcctctctcaccactcctattcgacatagtattggaagttctggccagggcaatcaggcaggagaaagaaataaagggtattcacataggaagagaggaagtcaaattgtctttgtttgcagatgacatgattctatttagaaaaccccatcgtctcagccccaaaactccttaagctgataaacaacttcagcaaagtctcaggatacaaaatcaatgtgcaaaaatcacaagcatttctatacagcaataatagacacacagagagccaaatcatgaatgaactcatattcacaattgctacaaagataataaaatacccaggaatacaacttacaaggaatgtgaaagacgtcttcaaggagaactacaaaccactgctcaaggaaatgagagaagacacaaacaaatgggaaaacagcccatgctcatggataggaagaatcaatattgtcaaaatggccatactgcccaaagtaatgtatggattcagtgctattcccatcaagctaccattgactttcttcacagagttggaaaaaaactactttaaatttcatatggaaccaaaaaagatcctgtatagccaagacaatcctgagcaaaaagaacaaagctggaggcatcacactacctgactttaaactatactacaaggctgtagtaaccaaaacagcatggtacttgtaccaaaacagacatatagaccaatggagcagaacagagacctcacagtgtaaccccacacatctaaaaccatctgatcttcaacaaaactgacaaaaaaaaagcaatggggaaatgattccctatttaataaatgatgcttggaaaactggctagccatatgcagaaaacagaaactggaccccttccttacaccttatacaaaaattaactcaagatgtattaaagacttaaatgtaaatcccaaaaccataaaaactgtagaagaaaacctaagcaataccattcaggacataggcatgggcaaagacttcctgactaaactgccaaaagcgatggcaacaaaagccaaaattgacaaatgggatctaattaaacaaagagcttctgcacagcaaaagaaactagcatcagagtgaataggcaacctacagaatggaagaatatttttgcattctacccatctgacaaaggtctaatatccagaatctacaaggaacttaagcatatttacaagaaaaaaaaaatcaaaaagtaggcaaaggatatgaacagacctttctcaaaagaaatgtggccaacagatacatgaaataaagctcatcataactggtcattagagaaatgcaaaaccacaatgagataccatctcatgccagtcagaatgatgattatttaaaagtcagcaaacaatagatgctggtgaggctgtggagaaataggaattattttacactattggtgggagtgtaaattagttcaaccattgtggaagacagtgtggcgattcctcaaggatccagaaccagaaataccatttgacccagcaatctcattactgggtatacacccaaaggattataaatcattctattataaagacacatgcacaggtatgtttattgcagcactatttacaatagcaaagacctggaaccaacccaaatgcccatcaatgatagaatggataaagaaaatgtgacacatttccaccacagaatactatacagccataaaaaagaatgagatcatgtcctttgcagggacatgaatgaagctgtaagccatcattctcagcaaactaacacaggaacagaaaaccaaacaccacatgttctcactcataagtgagagttgaacaatgagaacacatggatacagggaggggaccaacacacactaggacctgtcatggggtcggagtcaaggggagggagagcattaggacaaatacctaatgcatgcagggcataaaacctagatgatgggttgatgagtgcagcaaaccaccatggcacatgtatacctatgtgacaaacctgcacattctgcacatgtatcctggaacttaaagtaaaaacaaaaataaaaaaaattaaaaatgaaagtatacacctttttatcagcattctttaactctgtctcttccaagctacttctaaaaatgacatgttgtaaaaagaccaatttatttaaatattggaatgattgtgaatatagttatcatgaggtcctaaaatgctgtttcattttgattgtggaggttagtagggaaaatggatacttatgtcataggatcttttacgttgaaagacttggatcatacatgaaaacatatatagaggcatacataatgcatataatcagatgatcaatttataatatccttatatcttagccatatctattgtaatgctgaatgataattaaacattcatttagcatttgacacatcttacgctctgctgaggttatgctaaaagaaattttttttaaattgatgaagatagtatgtttgacagaaaaaaatcaatatgagtgtacctatcaaggggcaggcaatgcttttaaaatgctgtgggtcaggaacactcaggcgtatatacttgtgacatattaaaagcatcctttccagtaataatatcgtttggcagaattattttaatggcctgtgatcctgattctataattctattaccaattaccttgactctgctttcaaaagatgctttaagttttagattctggtattctgatctcagtatctcgtagtgacctcctgttatctactcacttgctactgccagtgtcatggaccatgaattgaacctactgttatcttatggaattttggcactctttctaatcaatcctttgtcatgctaacagtatctttattgttgtttttggctaaattaatagctaaactaggtatttgcatgttttgtctaatcgcttatgaagaaagtactttaccaatattgtgaaaaatgttaccagtcgtatagctttaatgccatgtaacaatgtttacagcgttcaattgaagcactttaatattttaaacccaagttagattgaaagtactcattcagcaagcattttagggattttatggacatcttttaagatcgtctgtgggacgtttgtaacaacagtaatcgcaagaatggcgatgatgatgatgatgatggcagctcacatttattaagctcatagtatatgtcagactctattctaaggactttatatgaattaattcatttaatctttaccagaaccttatgaggtaagaaccatccaattttagagatgtaaatactgaggtactaagcagttaagtgacacgcccaaagttagaaaactaggaagtgtcagagccaaaattggacccccactttttttcatgcctctgattgagatagtaagattttgtcttaccttctgcccagtatttgattaataaaccttatggagcttcacaaaagtaatattttcattaagtgttgcttgtcagtcatgatccatatatgcagaggactaaagagtgtgcaatgatgattgatttttgtactgaaattctttcttttattttgtcaaatgaagaaatttgtcacaagagtgaaccggggccaggtgcagcagctcgcgcctataatcccagcactttggaatgccatggtgggtggatcacgaggtcaggagttcgagaccagcctggccaacatggtgaaaccctgtctctactaaaaatagaaaaatttcccaggcatggtggagcacatctcaggaggctgaggcaagagagtcacttgaacctgggaggcagaggttgcagtgagctgagatcatgccattgcactccagcttcagtgacatagtgagactctgtctcccccctgcaagaaagaaaagtgaatcagcatggaaatgaaaacgttctagtgtcttttcttgtaattattttttatatccatccatccatctggaattcactgtgtgtccaatactgtaataagtgataagaatataatagtaaacaagacatggtccctttttcaaaaaacataattgaactcaggaagagaatagaaacccatttatccttgttgattatatattcacctacctgaaggcagattaactctgaaggagtcaaccagttctgcaatttagattgtaagaataaattttgcttcaaaatagaatttaatttgcttaatttgtttcagtctgttttcagattaacttggatctaattaatgcattagctactattagataaggagtgcttttctgtgttcgctacttttgccaaaagggaatgactgacaaaatcctatataaatttaaggtagaaaatagtctattttctgtggcaatatatatttagaaaggaatgtatagactttctgggtgttttgagataataaaatattctaacaaatgttcttacaaaaaatatcttttgagtaggatgctcattctgttggcccagaattaagtggactattatgtaagcctttgcattatttcaatttttatcacttattttttaaacaacattaaggcaacaaaaggatgtttctgatatccctctcccagtaatgtaaggcagcggtgaggggtttttttttggtcattattttaaggttcttttccccagtctttatcaataggtaatgtttataggtcttcatttgcatttattacccttaactttttaaagtatgatactctttctatgttgctacccttactacataatcatttctaattattatgtaatcctgactcaaattgatgtaccaaaatcatcaatcagtcttctatagagcacagagacctcaaacctttcattattaaacataacttaacattttctgtcttcatgtatctttttatctcctccctttgattatttccttttagatgtaccaagatctgtaaacatttttctactcttcaattttctagaaaaattgttttccaggaagattgtatcaatgtatacaatcatcaggaataaataagcatatgagtttcatcacagcctcaaaaacagtagttttatgtattttatgttactttgacttccaaagagggatagcaagaactgctcataaaaacaagcaaatgcccaaattcaataaaatataaaagtaaaaatgagacattttaaaaaattgtgccaatacatataaagtggtaagctttttgttataacttaaattcctatgactctgaatgaaaaatattttccttttttaattaactttgtcacttcatttgtgaatcgacttcatatgtccttcgtctattgattaagatcaaattttaaccctttatgtagcttgaattctttatataacaaatatttgttgcaaatgttttcctattctgtttattttaattacagttaattataattatcaagaattataactatgacttgatatgtttgtatgttgaaatagtaaggtacttattctcacttaatttttaagtgaactaattgttttggaatcatatatattaattgagtctatcggaactgatactctatactaactgcattttattgttaggaccatttataatcctcttcttaatgattttaacggaaatcacttcttttttttatatttataagcatttagtatattaatctgaatgatgaatacaaattctttattattctgtataccttttgcacatctgaaacatagtattataaaataaaaccttagctttcaaagtcattgtctctgttaagggcttgacaatccaaatttggaggtcaacaaataagcattgacttttcactcttctttgtaattatactataataatctcaatttatgtcaaggaagtgtggatgactctaacttttggaaaaacaaattaccaggtagtataaagtgtgcaaaagaaaaacagattaatgtttcaagatattatttgacctcttttacacatcccttactactgttgacacacttgactttgatatatttcttaaatctttctttcagaagtaatcaagttatttaagaggaaacctttcgatgatagtgtttgttatctctgtgttcatctatttatcaggaaatcacttcttaattagtatagcttttagtatatcttttggacatgtcacctttattttcatttctgttataggaaaatgtcttgagttaagtacatacccgaagctagaaatgtctccatttaaaaaatgtattctctattttgttttatccagcattgtattttccctggctttgttcattctgctgtttcacaaacactgtgtgtttttatgtggttataacaatgatgagacattgacttatggaattaacatagacacatggaaaatattttatggtactgacataaaaagaaaccagttctgggccatgattgagaccgggagctactgaggttcaacagtttctattccacagagtgccattttgtcccaaatgattgatgacattctcttgccctattctccacagattataagaacactgttgcaatctagagcttctgtagatacccgcttcattaagcatgatcccaaaatgtcatttaatttatttcttagattgaatgtctcattaaactttgatgaggccaggagctactttgggctggacttgttatgaagcactcttatcttaaaattttgttctgtccctgttggcaaaggaaatggacatgacagtgaaatcaatgcacagtgcactttatctttgacaaactgaaatattgttttgctaaaataggcccatggggtagggagattaaaatcacacataaagtagatcagcataaagagtaaatatacaaacttatacagtctttggtgtaattttattttgtttaaactgactttgccccatttggacaaacataacacatctacttgattaaacaaggtactgatctccctcagcctcatttgaaaagaaacattttcttctttttagttataagaagtgaatatatataagatgaagtcagggcatgagtaatgttctatcagtttttagtaagaggtatgtctcaatagttgtgttactcaccttgtggaataggttgtgtcaaaacaagaaaaaaaaaactaatagtatttgtattttccctttggtgtccattgtagaatcaggagcatagtcatagattggtataggcgggaggtggagaaaagcaggtgattccttcagtagaccaaagtgaaaacaacattccttgcaaaaaaggaatttagacattggccagccctaggtcatgctgggcattggagtataattttttgatgcttccttaggtttggaatcaccatcttgcaactgatttttctctcatggctcctgcatcctgccatgttgccacactgcacacttagaacatgagttccacccctgtgtatgcttcccttgattccacaccagaatttgccagctcttctttgatctttcctgagtctttatacagcatattaaagagctgctctgcagtctaactctgaaaatcagtagtgtcatctagcatattttatactgttgcctaagatgtcttgggttcgaaggttctcactttgttaactgccagtttgctacctaatcaaatttgcaactttgaagattgcccttgtgtacagggttaatgtcagatttttagtattaaaaagaaacgactaagaaaatcacaaaacagatacctataataaaacaattgtcctaaaggattatcagcctacctccatgtctgataacagggcaagaaaagaaaatctgagaccatttcaatatgtattttgctaatatcttgagattccacctttccatggaatgataaattttagttctaaaatcatttagaattattaatgttatttgagacaatatggtatgctcttctttattgtgccttctattgaaaataaaatatcccttcagcatctaaaatgtcacttgaattaacactgtgcaatagcaataggagtagataaaactgtcagaaaatgactgggcaatgagacaattattgcagtttattttatcaatctttatttcagagcatgtaaaagtaagtaatgattttgagtctccattttgtgggttatttgagaaaaagatatgttagaacctttcggtttgtgtttttggtataatcataagctgcatgatttgcaatgcctgattttggttctaccttgtttaaatagcttagtttatattatattaattttaatgtagcctcaaccaagatcctattcttacctttctcactaaaaaactgtatagtattaaataatgtgaatcttagggttttttgttttttttttttttttttcaaattgtggttgctaaaagatacaagcagtgttgggtgagtcaggtcatccatgggatttagtcatagaaggacctgatttttatttcttcctctgcaagtaaccagttatgtgatattagacatgtttataacttcttgagacattagtctcctcccataaaataactgtaattgtcaaaattgttctatttagggtgttgctaaaattaaatgaggcaatctgcataaaaaccgtgctttttgcatactcaggagtatgtgatttatcacatttatgtagcttttaaaatttgtatgtaagaagtcattggttaaatagttgaagttttggatatttttatcattatacaatcattattatggtttaattttgtatatatgctttaaaggaatggatgatatgtgtagaaaatgcagtttcagtttgtggaacttagaattgtttttaaaatgtggaattcacatgaagatttgataatagatcaatgttctgttctctgtagaaattacatcattatagggaaaggaattgcacttgtttttgttgtttgagtatatgaactttaacaaggcaacctgagactaatttctaagatatgagatgaaaatgtgttaaaataatagacatatttcagactctgacttcagttgaaaacatagatcccatttttatttctccaaaccagaggaggaaagactgcttctttcctatttttttccctttctatgctattcatcatagcctcttaaaaatgcttctgttttcacttgttcccagattaagaaatgtgttttcattgaaatgttaaaatatgcagtgtgtcacattttgggttaatatcatcaagacaaacaactaagccagttctttatttcctgtcaaattgctgttagttaccaaagccaactaaatactattatatgtcatgttttagaattgtgctttgctttatcagatactaagatgcagcatactggtttgcatctcttagcaatgtttccaaaaccgtaactgtattaaatattagtaaagggctgaatgtacttaagcaatatacaaatgtactcttgatttactgtagagaataattttgttaaaatggttgtattttcatttttatagattcaatagataaacagttattaagcatctatatatcagacactttgagagtacagataattttgtgtagtacctgccattcagtatcctacacatagtaagggaaacagaaatctgaagaagtaaattaccatatagcatattcactcatattaatattaacctcagtgctatggagtacagtggacatagcaaccacctctgcctgttcaagtccaggaaatctttactgagcagctggttttaatcttgatctttgaggatgagtaggaaattgcccagtaaaaaagaaagtgtaagggcggggaattgcatgtgcagaaaattggagtaatgaaaggaccctaacatccatatactagggagtagctagttataggggcataaaatcaaatcgctgctacttgataacttgaagaccaatcttctgttctgacattccatagatcaaacttatataattgtctaatttgaaattgtacaattgtataatttgaaaacgacatgttttcagtgaaaagtaagaacaaaaactatttgttttatctgtgtgtgcatgtgtgtatagtgttaaaagttgtaatgtcaacaggtcatggtggcacgcacctctactcccacctactcaggaggctaaggcaggaagactgcctgcgcccaggagtttgaggccacagtgagctacaattgtgacactgtactctagcctggacaagagatctcatctctaaaaattaaagaaaaaaaaaaaagttgtaatgtcttcatatttaaaattttcttagaaatttcctttaaaaaaaaaatgggtcctggctgggcacggtggctcatgccctgtaatcccagcacttttggaggccgaagtgggtggatcacctgaggtcgggagttcaagaccaacctgaccaacatggagaaaccctgtctctactaaaaatacaaaattaggcgggcagggttgcgcatgcctgtaatcccagctactcaggaggctgaggcaggagaattgcttaaacccaggaagcggaggttggggtaagctgagatcgcaccattgtgctccagcctgggcaacaagagcaaaactccgtctcaaattaaaaaaaaaaaaaaaaaaaaaaaaatcctaaattttaaaatgacgattataaacttgagtattgattttctgttttccttgagttagacagagtttttttctgacaataataggtacagtttagataagaaatgcttaacttagtcaaattttagtaatttcagtaatgaaaatgatggagttggtttagtctcctataatcttgcttaagaaaaaaatcccctggtattcagtttatatatagcatgcaatctagatgaataggtttaggttttgtttggtttttaataacaacatgcataaaggaaatataatgatctcatcaaatctgtctccttctgagagacagtagcctactggtctgcctctcaggatccttctaatatagttttcttggatattaggtggttttgtttcattgaatctcagcagtttattgctttagaggctttttactgagttgggtcaacattccacattgaggagatttttctttctaatgcaagaattcaactgttattaacagtggtatgaatcattcatgtacactaagaaggaaataggttccagttgtttcaaaaactgttaatttctagttctaaccatcggtagctttgtgaagtgaatcatatcactgtctgtggaaaagagaaatgggaattaagttatttgctcaccatcagccatgtcattattgaagatgaaagctaaggagataaatcctccactcagttttctgtcatttatccaataggtcttcatatgcccctttagccatgagactgcaaggtggtgtgggaacctccgtactttatattaaagtctgttagagaaataatgggagtttggctacttgtttgtgccattaagacactgctaccctctgctgcctaagttaattacattccagtagtgggaaaaaaatgcatttgcctatatagacaccaatggaaataaacatatcgttcatacacttacagagaatgtacgtgtactgttgagagtgaggaaaaattgtagtttatagctgacatactttaaaatgctttgtttctaaagatgcaagtgcgaaattgatccaatatgttcagcagtcaaatattgagatcaaaattgctctatttcctttattcgtgtgtccgttaacaaccctttctgataatgtcagagacttattcaccggcctcaactgccgaaagaattttaaactaacagccgatgtatcagtctaaggactggtagatttacttgagaaatgttatgtatggtgtttcttagctataaaaaactatgtatcctgttatgtaaatacagatactattgaggcctttgaggcctcaattaatgaatcttctgtgggaaacatcttttaaaatgatggtgactgttgaagatatttcttatacaaaggagtgtcatatggattatacgtaaaattgttaactcatactacacattttcttcgtttttattcttcattatttttgagacagtgtctctgtctgttgcccaggctggagtacagtggtgtgatcacagctcactgtagcctcaacctcctggactcaagggatcctcccacctcaacctcctgagtagctaggaccagagatgtgcaccaccatgcctggctaatttttttttttttttgtagaaactgggtctccctatgttgcccaggctggtctcgagttcctgggctcaagtgatcttcccgccttggcctcccaaagtgttgagattacaggcatgagccacagcactgggccatattttctttaagaaagcagtatatttttgttaagagaagaagggggtatataggaaagaagaatcagcatgtaacatttgtatgatcctgacagaagaattacgtgatataggtaaaatatacccatccattaagccccttctcaaatgctggcccttcattggcaatactcctagtgggggcaacagtattttcttttgaaatgtcaaacacttttattgtaattctgctgtggcacttatcgattttccgccttgaactatttgtttgcttgccttgtctcaactactgtattagagtctaatttcaggaaggaggaatgtggagagatgtaggacagaaacttctgccatacctaacatagtatttctgtcacatagtaaacacttagtactatgtatggaattgaatttaataatattaattggtttagcatgaaaaaaattatgctatagtgtgagttaaagaagctaagaaggacagaaataaaatagaaggagaaatatatttgatgctggtcttccaagttgcaataaaaagagctgaaattatgcccatcaccattaccttccctgtgccactcttgtgtttatcagtacagagggtcaaggccacatttaaaactatgggactgttgcgtctcacttcaaattcatctggtttccttgggccgaatgggaaagattggtagtttaactcactgtcatacaaactccaacccctacttaattccgttggtcccctgctttggaagctcacctgctgcagtaagaaaggaaaaactgtgcctctgttccccagttttttgtagatacttaacctgccaccctcatgatcacattctaaagctgttctgctggcagtcctcatgttctgctctgaatctgccagcttcatcactcccattacactctcccatgtttcagaaagccactattctgtccatgccctgagggaaggagagtttttttcccatcattttattcttgtccccaaataatcaaatatttcctcacaatttcacataggtattcattcatacattttagaaatttaaaggccgggcgtgttggctcacgcctgtaatcccagaactttgggaggcagaggcaggcggatcacgaggtcaagagttcaagaccagcctgaccaatatagtgaaaccccgtctctaccaaaaatacaaaaattagctaggcatggtggcaagcgcctgtagtcccagctactcgggaggctgaggcagaagaatcgcttgaacccaggaagcagaggttgcagtgagccgagatcgtgccactgcattccagcctgggcaacagagcgatatgccatctcagaaagaaaaagaaagaaagtaacaacgcaaacttattttttgaaaaagaaatttagaatttcttaaaatttaaagccaagacatgctctaggaatacaaagaagagaactcctaatttctcctgtgaaaatttaggacatgcttttctttttttttttttgagacaagagtctcgctctgtcacccaggctggagtgcaatggagcaatctcgtctcactgcaacctccgcctcccaggttcaagctattctcctgcctcagcctcccaggtggctgggattacaggtgcctgccaccacacacagctaatatttgtatttttagtagagacagggtttcaccatgttgaccagactggtcccaaactcctgacctcaggtgatctgcctgcctcggcctcccaaagtgctgggattataggcatgagccaccgcgcccagccaggacatgcttttcatgtgagatgacatttgagctggttttggaaagtaacactataaaatgcacatgtaatgaacacatatgtaacaagttattggaatgatcttagttgttactgagaaatctcaattatatgcattttattcaactgatttttattaattttagcatcttgatctagtaggaaaaatcaaatactgcctgctaatacaagaaaaaaaaaatcaaaccaaatacagttgtccttttgtatccttggaggaactggttctataactgctggagataccaaaatttgcagatgctcaagtcctgatataaaatggcctaatatttgcatacaatctaagcatatcctcctgtatactttcgacatctgtaggttacttatgatacctaatgcaatgtaaatgccatgtaaatagttgttatattgagttttaaaaatgtgtattattttttattgttttgttatttttattgattttcaaaaatatttttgatctgcagttgtttgaatccatggatatggaacccatggatacagaggcctgaatgtagatattctaacagtaaattttcttatctgtgagatactataactcatacttaaaacaataagttatctgggcccttacaaatacagacctctggtagagagtctttagagaaattattaaaccttcatataatttgttgagtgtaccatgaatatgttttgtgtgtatgaaattagcagagtagcataggctacgttgtggatgaaaaatgttttatgtgcttagcacattcctctgaaagcaagtcatggagaaagaaatataattatttcaatagaaaaaatttaaaactctgctatattttaatattttagtgatttatatgatataagcatacatgcacttacgattttgcttttttatttcttttcacaagattgagaaaatggagcaacacttcactatttttcttatagggataatatgggcaaattaaatgtaaattgttgactctgaagtgaggggattatttttgttgctgtttcagggaaaacataaataaaagaaagtgaatagatgttatttcctactttagaaagtttgaaaagtaaagataaaaaaggaaaattgtacctatatccattaagttttataagtgctataatgttgccatttttttcagaaaatcatattttaaagccacatcttaattcttaggaattctcaggtaaaattataataaaattcattgaataaatatgattaaatacactagcttcacatgttcctttcttcaggactatcaataataaaatagatggaagtacagcgctgaagagaaactaccctggcaaaagtatatgcttacccatagttgtagctttattgttttcccaagatagacttttcatatttctgcaccttcatttttcatcttactcaccaattgcatatcttttatagatgtcagaatgattagatttagcgtctgcaaaatactcatcgttgagaattatagaccacttagaagattggcaaggacaagttaaaactgaaaataggcatctcaacaggcatgcaaaatcatagcagtgattcagtaaattctcagagatatttcccttttgtgataggaatggggggatagtttatattttgagattctttgcagaataaacactgggagcagaaaattacacctatatttattgccaagctgcatttgttatataatgcattttcctcctccctagatgtaccccaccttctgtcaaaatgttatttctttggctattctttgttgcatgtagttcagttcaggcctgactcctaggattctgcaggtttttttgtttgttttttttaacttcccacccagggaagtgaaagttctgttttaaaaattcctgaatgtgtataaatttcattctgacaagcccactttttcagtatgattttatcagtgcttacaagttttagaaaaaaaaaaaaaagaaaaagaaatctcagatgacctttaatgtcataactgaacttgggttttgaggagagcaaagagagcaacaatttgaagatgtaggtttactagtaaacacttctgttccaccatctgctcccccaccaccccatcgcagattacagtggaatgagataccagggtggggccagaggggccgtggtaaaatggggatgaggtgagagcagggaaggtgatgtgggagcagatggcagctggtgaaagaggcactccatggcactgttggcatggttacagagaagtagatgtcctaacatgctgtgccaattttggaatgtttcaaactctactttgtaacttgtggcctcaaactaaactcattggctgtgtagagcttctcctgtgacaagcagttcctataaaagcattagtttagttatattgtctaacggctgcttaaaatatattcgtgtgtgtttgtgcgtgtgttgtaattaatctatggaaatgtaaaaataaagtatttactgtccttggtctccaggtgaataataattactacatattaacaaccctgataataatatatatgtaataatgaaacagttttgctgtaccatctatttgtgtaacaggagcaaatattgttaaaaacagttcattggattttgttgttgttgttgttgctttacatcagtttataaaagtcatatgagcatttgcctgtctcatctttagatgaatttttgttttccattaaacaaaaaaaaaaccgaaatggcctaatttaagttgaactaggtcattgactaaagtcttatttttgtctaaaaatgcatccattgcaaatgttactgccatttctagtgtctacagtgtccttagaggatatgcatagtgagttgatttgaaaagtttttggccatatggcatggttgaagcaaaaacgtattgtgttaggtcaaaccatgtgtaattgctgatgccacacaatttttttaaatataaaatataaaatagcatttttttgtggttcaacctgatatatacatttttaaattccttattctgaatttgggtaaaaataaataataacttataaaacacgtgtatgtatatttggtcttgcagctaaataagattatatataattttccaaatcttcggagagtccagcttaattaaaaatactatttgcacaaatgttgcggtttgtctctgtagaagctctgagagcattcatttaatttattaacccaagtttctcttgctaatacatttactcagaagtaactctgctgtacataaaaatagttgattcaatagagaagtagctaaacaattttttgttgttgttgttaagtaaagggattaattcatgttagtcactggaatgtcttgcttaaaatttcctccaaaattttttgttcaagttttcattacacttttcccgcaatttaacaaaaatgattttgctccttctttttttttttcctgaaactgtttttagaatggaattaactgattctataaagtacacaaatgattggtattaaatgtctgtctctttagtccacaagtgtttagttttttgaacagagatgaaaattgaattgggctttgtaccaaagatttatatttagataaagttattccaatggtattcaaagtgttaattgtatttctacagcaaacttcatcgtattacaccaaagcaaataccatatttgagatgcatctctaccacatttagtcttgttccttcattttgtttatttcattatttgaagtataaagggagggtctagatgatgatgatgatgatgatgatgatgatgatgatgatgatgatgattgagatggagtttcgctcttgttgcccaggctggagtgcagtggcatgatctcagctcgctgcaacctccgcctcccaggttcaagcaattctcctgcctcagcctcccgagtagctgggtttacaggcatgtgccatcatgccaggctaattttgtatttttagtagagacggggtttcaccatggtggccaggctggcctcaaattcctgacctcaggtgatccaccctccttggcctcccaaagtgctgggattacaggcatgagccaccatgcctggcccaagtctagattattgaatagaaaaacatgatcctgaatgacaaaatgtgtctgaccaaagtagatttacccatgcacagaaatcgaagtcaatttttagtgataagaccccatattaaatatgaatcatgtcttggatttctcctaaattcgctttaacatataatgtgacataattgttaaaggaaggtctgaaagtcatataatccgtctttattcattttcatgcttaaactaacacacaatgctagtataatgtgaccctttaattctgagataattttctggagattatagtttggtttgtggtttttgttttgtgttttatttgttttggggatgggatctcacactgttaccaaggctggcatgcagtgggattatcaccactcactgcagcctcaacatgattggatcaagggatcctcctatctcagtctcctcagtagctgggaccatagacctgtgccaccatgcccttaagctaacattttatttatttatttgtagagatggagtctccctatcttgtctaggctggtctcaaactccttggctcaagcaatcctcccaacccagcctcccaaattgttggtattacaggcttgagccactgagcccagcttgttttgtcttaaagtacaaaaggatctcttgtccttaagtgttccttagatctgagtccaaagcaaattttccttttttcataatgtttattttaaatgaagaaatttgactgttatatatatggctcaaatttttactctaatttctagattgtttacctaagtatcctatcactatttgcagattcacttctaactctccctaaatttcaggccactagtagtgtttttcatgttttttcaaataggaatgattcaaatcgacttatatcagcttatggttttttgactgtttttaaccccccaccagtttttgggtagaaaatggtagatcattctataccatttaaattcaaacatttttaatttatcttagtttctgatatgttttcatttactcgattacatatttctgcaaatataattgaatataagtcaaaatatcatttttcataccttttatacttcctgtctctattttttgccttatattttctaattttctatatttctaatttctagggcaattgatatttaataaacattctctattgtgtagtaaagcttgtatttctaccgatttaaattagtaatatcctattagtttaaacaactttaaaccatatctcaacttttcatagttagttgttttggggtcaactatgaatgaatagaagaatctttgtattagcaattcaagaagcagcaattatgtatttctgagttttttgtttttgtttgagtctagttcaaagtagagaaagttattgtttactgtttttttagtttaaaattaaatgaaaaagatggatatgtcttgaatatcaagtggagtagcatgtactcagaaaaagcaaccatttcctgaccaaattagacccttattaacgatagcacatgatgctgtttaatttgtttggggtatgctcttaccccaattgttaattgtcagtttctgaaaataatcagttttcaacatttcacggtttttcaattaggctatggcaacaaatgccattgttgctaattgccagagtttagtcagtaaaattatgatatggtctttctttaactattatcaggtcacttagtatctgcttcatctttttacgctttaataaactaagcagaagattgagatcattagatatccaactgtaatttagcactgtcaagattaaggaggggattatggtcattaggagcaaaatggtttcatttatggactgagaacaatgaggcccatcaataaaccactttctgcctctaatgatcttacttctctctaattgtgtgctaatctaacaacaaactcattttcttctttcattcttgagggaaagattgctaaacagaaatgctttgcatatatgttgcttttacttccttaagttttggtgtgtgttcatgaatgcagtaaattatttctaggtgaacagatatgtctcttaagggaaatatgctatgttctcttctagtttatcaacatatttttgacagaggaatagattttctgtgattagatgtgctttattattagtaccatcttaatccttatttgagtcattcattgtagaaagagatctgtcttataaaattaccaactcaaaatatctaagtgtgctaagaatcgaaaatgatctcagtaaagtgggtcataagggatatatctcttattgggctgtctgccattctatcacctttatgatagaagttctctaaacccacctctttgtagccacattccttgagaaatcaatgcttgcacttcactgaatttaacatgttgactgaggcccaaggcactctgactgtttgcagctagtagaggatccttgagtacaccctggtacttctgctctcaacatttgagattttggcttatcatgaatcaattgtgcttattctccaaacctcccttatgtggcagttgtactttttggtgcagttatttactctaattaaatattatgtgaaccaagaaatggtgcttaaaaaaaaaaccttgccatttatgcaaaaatgatgttgactgcttgaaaaatacttgctaaagtcattttaaatttactctctaattaggtgtgcgtaaacaaacttaaatgataggaactcattccaaaagccttctctaattagatttcttcatgaatgtttaaattctagaaacttaattctagaaatcaatctagaaactggtttagagggtacccttcgtgtatgggttatatgcaaggaaggctctgcagatacccaactggagcctaactcacataggatacctcagctctacatcaaaaagggtagcaagtgaatattatttatactttttcatttaagattttaacatgtatatcatgtcttctggatacctactttaactgacctctttgattaattgaccttgcgtgattttctaattatatttattagtcatgcttagtgtattaaaaactttactgctgctcactcatatccactagaaatgttaacttcatgttctgagtccatcatttctctcctttctacaacatagaaatggacctattgggtgtttatatattgaaattttttttctcaacatgacctcaactcccataagctattgtcattttacccaattaatgtatttttaagaaaaaaacctaaataattgaaagcatctgtcttgtttctgttgtaaatattatgttatcaatagtacacagactatctgcaaaagagaatctgatgatgacctgcacataattttgttggcaatcttaattttaacatcagagataaatatggagggcttctggtggtgcctaagcatagtaggtcctatgagaaaaaatattacacagctgctctagaggaacttacatgcttattgaatagataggattaacagataagatgtacttagcaggataagagactcagatccttatggtgcagggcagactatagattttttaggcactaagagaaagaagagctaaaacgtgtcattatagtaccacctcccaaatgttacccatatctaatgagtgaatgaaagaatggcccaggaagacttggaagtctgtagttgttattaatggaatgttccttccactgtaaactggagtgtaagattgtaaaaaataaatacggcattaggaattacataatatgacttgaaacatgccaggacttgtttctgaagattgaggaatgagtatacgttttttgttttttgttttttgttttattttgttttgttttgttttgttttgtttgagatggagtctcaccttgttgcccaggctgggtgcaatggcgcgatctcggctcactgcaacctccacctcccaggttcaagtgactctcctgcctcagcctcccgagtagctgggattacaggtgtctgccaccaggcccggccaattttttgtatttctagtagagacaggatttcatcatgttggccaggctggtcttgaactcctgacctcaggtgatccacccgcctcggcctcccacagtgctgggattacaagcatgagccacctcacccagccgagtatatgttttaaagtatgtaatgtaaatactcaggcagtcagtggagtcacaggaaaattccctcaaggactttaatcagcagaaatgtttgtgtatttgtgtgtgtgtatatatatgtatatatgtgtgtatatgtgtatattccagtagttacagttaatgtatatgtcataacaatacagaaaatgttaatattaaaatttatgtcacctttattcattcacctaatataatcagaattgacaaaacatgttagctattcatggcactgaatggagtattctgagcacagtaggaaactcacaaaattggccaggtgcggttgctcatgcctgtaatcccagcagtttgggaggccgaggcaggtggattgcctgaggtcaggagtttaagaccagcctggccaacatggtgaaaccctgtctctactaaaagtatttttaaaaatgagccgggcatggtggcaggtgctggtaatcccagctactcgggaggctgaggcaggagaattgcttgagccgggaggcagaggttacagtgagccgagatcacgccactgcactccagcctgggtgacaaagcaagacttcgtctaaaaaaaaaactcacaaaatcaataaagcaatgtgggtcaacaggatatgtgaatattataaggatatttccctattctattcatttattatttagtacttcacatagtttattcttagctgattagtgattaaaccattagatagtaatatgtttgttcatttcacccaatatatatttactcctactttgtgcaacacaatatactaggcccattgagaagtacaaaatgtaccccttaccttcaaggacgtgacagaaatataacttttttgataaaatgattgcaaaagatttaatcagggtgacactaagagaatgcttttgaagacttatctcaaacaggtcttagtttattccaagtcttacaaagtcaaagttgcataagtcttacaaagtcaaagttgcataagtcttataaagtcagagttgcaaagtgaatagtgaagcaaatcaagaagatttttttagatcatataagaaaaggtaataatcaaaaagtaaaatccagttgctgaatttaggttagttaatataaggcatgattatgtaaaactgactgtaaaattgagatccagtttttaaaaatccaagttatttgtaggcaaatgttaaacaattaaaaaaattttttttcaatatttttgagacaggatcttgctctgtcacccaggttggagtgcagtggcactatatgagctcactgcagcctccacctcccaggttcaagtgatcatctcacctcagcctcccaagtagctgggaccacacgcatgtgccattatgctatgctaatttttaaatttttcatagagccgagctctcactatattggccaggctggtctcgagtttgtgggctcaagcgatccccccgcctcagcctcccaaagtgttgggattacaggcatgagccactgtttctggcccttaaactatatatataattaaatcctgcccctgattttatattagaaaattcagcaggtgcacgcagcaaatcttagggggaaaatggtagttttcctaatacttaaactttagctgcaaatacatgaggccctggatcctaaaatcattggggtcatatgctagattctgtgtgtatggtagaaaatttgaaaatactatttttgtggggagagaattcatatagaaaatgaagtctgttgacgtatggtaagtaagacaggcgaaaaaagtgttttgcaacttcgcttgttgctctgatactactcattagtgtatgctcacttttttctttctaagatcataccctttattaggcagcaatattcttctaatggagaaaagaaaatgagcagtttacaattatgtaaataagacatagttttttctatttctgaaaagtaatagaacttttttcccctaaatgaataaaatctcaaataaaattagaatccctgtacctcactactcattaaagggtgacactagtaacaatttgtaaagaggaaactgtagaaatgcaataaaagaagattatcttagcaaaattgagatttctctctgtatgtcatgctaaaaatgtagctgagagctggtctttgcaagatcaatgtgggatctatgcatgaaatgtgatttgcatatttaaagaaacagtttaaatcatagcttataacccatgccacagagagaaagaagtaatgtaatgctgttgtacccttgtccatctatgtatagctgagtccatgtgtgtgccaaaagggcacaggtgcacttttaattccccagagacaataaggctggtatgtggggtttataaaagcttttccttttcatgttcaccatggcgattgtgactattttttatatttgggatagcactgccatttcccactaatttgtattagttaaatgtgttcaattctaaaaacctcttgattcatgttcaggatgttagtcatattcattagtttctaattgcattctgtaacctatggtagctctggggacttcaaatgtaattgaaggttttaattttaactcattgaatcaagtagtgatatggtgacatcagtgtcttaagaattttttttttctggaagcattatgtgatatggattgaatgcatgtagaacagttgcagtgttccaacctttaggtgagatgcacttcctaaaagtggcaattgcaatgcacagacaaaggtggatgccaaaggcattttgaaaatgattgatgagacttggtgactggctggttatggttaatacaaaagataaagagtaaaagctaactctgtggttttaagcagtgacagctggaagagtagtaatgccactggggaaaacaggataatcagaaacagatctggtttctgggagaaggtggtctgctcaggtttggatatgatgcttatgaagacatgggacactcaattacatgtttaattttatgtgagactagaagaccattcctcaaataaaagattggggtttgggtatagagatttgggcttatatataataacaatataagatttcagcttatatataataagatataatatattgttattatatataataacaatattacatcttattatatataacatattatatattatatataataagatgtaatattgttattatatatgataacaatatataagatttcagcttatatataatagcaaaagccttgatgtaagagcaatgcattaagacagggtttatagagaaaaaaacgcgtttatagagatcttggggaatgcttccatctgaatggtgggaaggagaatagaatgcagcaaatgaaacaaaggaagagctgtcatcttgctctataaaagtatttagcatgaaagagatctctatttggagttaaagcagtattatggtattggcctcaaacaatttttccatgtgtcaagtagtaatttcttttcaaatattgataagaaatcttcacagatattacaataaatgtattcagaattcttatatactgtgggtctgaaatcaaccataattatttttatgagttgacaaaattataataaatgcaaatatcctttgctgtagattagaggcatttttggaaagtttcctatgaaaaatattttccatttactggggttttctttctaaatattccctttatatgtagaaacttaaaaggaaagagccagagatctcttttggctccatcctcctgccaagcacaattttcttattgcagcatttataataccatcaactaaagatttttatattaaaaacattttacaaagagtcacagacccatttgtatgttttgttttgtttttaaacggagtttggctcttgttgcctaggctggagtgcaatggtgcagtctcagctaactgcaacctctgcttcccgggttctagagattctcagcctcccaagtagctgggatgacaggcgcgtgcctccactcctggataattttttgtatttagtagagaaagggtttcaccatgttgatcaggctggtctcaaactcctgacctcaggcgatccacccgccttggcctcccaacgtgctgggattacaggtgtgagccaccaagcctggccagtttgtatctttataatgaccccaccagatcagagaggcaggtgatattattcctgttctacaggtatgaaaactgagactcaaagtggtttaggtgtcttgcccaaaggcatatgtaaaggaagcgggaattgggtcttctgactccaagaccagctttctttttgctgttactgtgctgtctcacatttgttatacattccctgaagactcctgtgagggaaactttagaatttcatcaaagcaaatcctaaaggtacatgataaatttgttgtctgttttattgagtaaaaatctgtctagtcagcagtccatacgttaggtcagaggtctaaagtaattgtttactgggcttttttggatacattctgaggcatattaattctttcaggctttttttttttttttttgagtaaattactcttgaaagggttcttattggtaccctctagaggttcagaagagttaattggcttacaaaacatatgtggatcgaacttggggaatagttcagtcatctcttaacatctggatgtactgttttattattttaccattatgtatttgtatctgaaaactgcagccatttaaaaataaatatggtaagtaaacagtatgtatataattaagaataattcactgtagctcttcaagtttacagcactgttaaaaataacctggtgtatccatgtaacttatgaattcaatgaaatttaaataactgaaaaacaatttttacagtaacatgccattcacattttgaaaatattaccaattattttaatattatctactttgaaaatatgggaaacaaaattgttcatgatgtttgtgtgcacatcattcaaagaaccaaaacaaaatttttatcaatctgcattccctcagagagataaaatattgctctgtgaaaatctgattttcaccatatgctaatcataccctcttccacagacctcttctcttacttcctcctgaacataaccttccatcaaaacaagaaacaacacaaaaacatcctccaagaaaaaaagaaattacaaaatacaaaagcaattcacaaagccagaaataaatgtttatttagttaaaaaaaataaaaagatgaatgttgatgacttcaccattgaaaatgatgcctcaatatacaacttggcttcaaagatccttagccttgatttggtcatcacgagttattctctccatttcagcttcccccatagcatgtaaacatcagactttgtcatcacatatgacagtgtagctaccaccaagatctcaagctctgaatgtgtccttgtacccacaaccatcctcacatagcccttgcctctggcgcctgtttttctgttgccctcattatgaccttacccttacccttcctcatcttatttatttattgttaagacagagtctcgctctgtcacccaggctggagtgtagtggcgtgatctcagctcactgcagcctccttctcccgggttcaagcgattctcctgtctcagcctcgcaagtagctgggattacaggcgtgtgccgtcacacctggctaatttttgtatttttagtagcgacgggatttcaccatgttggccaggctggtctcgaactcaggtgatctgcctgccttggcttcccaaagtactgagattacaggtgtgagccatcgcacccggcccctctttcttttctcccaaactatttgctcccctcaagctgcatttgccatataacctacacactgtctagcactgtagaatcctcatacttgcttcaagctcccctcctttagccttctgccgtccacaccctgatattcctgttgctctgatccaatcccaactcccgcatacatgacagaagtcacacagtctacctgatgggatccgttgttccatcatttctaaccttagcctcctaatggagttggggtagcttttcatttaactctaattctgtctttttccccacaacagcaattccaaactaggtttgttctcctcaaatccctgagtctagctaccatattcccagataaacatctcttctcattcttgactgaagatgaaaaaatattcttttcatttactgccacatatctcaaagaagacattacatctcctcctgtttacaaattattttcttcctactaactcttcagtgtgttatcatctgactgatactcccatcaatttatacgtctttgtatttggttgtcttaacctccctacaataaagctccatgggggcaaagacagtggtttgttcccctcacttccttgtttgctattgcagtgctatgccattagcagaactatgtgttaactttcagggcctaaaagaacttcagataccaggttcaccttgtacttcccatacttggaaatactgctgaactaaatcttgccttattctcagcaggcagtagagcatgttggttaagaacacacatgagacttcataacttcaaatattgtctctgccacttactagttacatgactttgaagaaattatttaatctctctttgtctcaggtttttcatatgtaaaactggcataataacaagatacgttttataggatgaaatgagtatgtgcatgtgtgtgtgtttgtgtgtctgtttatacaacactgggatttgtaacttggcaacttcctggaatgtactggagtatcattttaaagcccatggtaatgacaaagagatcagttatttaggatgcgttttggtcaattctaaaaggaagctataagatgggataatggagaatttcatttggactcctccgtgttattttcagaagtgataatttggccattgagattgaatttcatgttgctttatagtggctgatttttccttttatactgactgggatacaggacctggctttgagtttctgcatgtgtctgttgcttttatattttatttatttaatttggggatttacaaaataaattttgccagcctgctttgatcatagctgtctgtggcattgtgctaactcaattaaaaagtttttttttctgtcctgttaaattaacattctattgatacattcaacagaataaacttatataatcaattccacattatagaattcacaatatacattttaccctcagaaggatgcaaagaattgttgtaaggagactcagttgcattatggttatagaggcatcaagaaatccagaggcacagtggctcacgcctgtaatcccagcacttagggaggctgaggccggtagatcacatgagatcgggagttcgagaccagcctgaccaacatggagaaaccccgtctctactaaaaatacaaaaaaaaaaaattagccagacatggtggtgcatgcctgtaatcccagctactcgggaggctgaggcaggagaatcgtttgaacctgggaggcggaggttgtgttgagccgagatctcgccattgcactccagcctaggcaacaagagcgaaactccatctcaaaaaaaaaaaaaaaaagaaaaaaagaaatccagaggcctggtggtgtatacctaggcaatccacttttgttttctctctgtttccatatcctcatgagagatctggactaggaaattgctgatatccctccccaagggggcatttttgttaatctagaacatggatcaacaaactttttctgcagagagcaagatattaaatattttagggcttacggaccacacacagtccctgtcacaaggactcaggactgcctttatagtccaaaagcagccataggcaatatgtaaacgatggacctggctgtttttcaataaaactttatttatggacactgaaatttaaatttcatatacttttcatgtgtcacaaaatgctatccttcttttgatttttttttcagccacttaaaaatgtaaaaagcattcttagttcacaggccatacgaaaacaggcagccagctagatatggcctgcagacagtagttcaccaatcccttatctagtctagccaagcaatgtatacatatgtctatttgaggaacttctatattgaagacattatctcatagtacttgtattagtgaacattttcactttcctttcccttgtttcataaatgatcactaggcatttgaatatttcagagcctttagccagattgcatgtgtatttgtgcttgtatatatttttgccagaacacttgaaagtctctgggccttttattcatctttgctttgccaaatattttcccacctgtatagatgaattaaaattttcaacagcctttctttgaacatgacttttgagaccagttgctatttaaattacacaaaagtatatttagcccttctttgtgttttattccctttttgccagggtggaaggacttttcaggaacatatttgaatagatggagaattctgaaaaacataacccagatatttatttgggtctcagagaagaagacgttttgaaaacaacctttgtggctgggcacagtggctcatgcctgtaatcccaacactttgggaggccacggtgggtggatcatgaggtcaggagatggagaccatcctggccaacatggtgaaaccccatctctactcaaaatacaaaaattagccaggcgtggtggcacatgcctgtaatcccagctactcaggaggctgaggcaggagaatggcttgaacctgggaggcagaggttgtggtgagccaagatcgcaccaatgcactccagcctgtgggatagggcgagactacgtcaaaaaaaaaaaaaaaaaaaaaagaaagaaattttatcaatttatcctgcttgaagtctttcagcgctttctcactacacttaaggtgaaacccaaattccttacggtgtcctacaagaccctacctacctctcaaacttcatctcaaatttttttttaaaatccattattttgttagtagacaaaactacataaagtataataaatttatgacatgataatgcccagataactaatcaagacttgctttatttagggactgctttcagtagtgaggaacttaaaaacatagtacaattatattatctaattgctttagtttgtattgccaatttcttatttcagggcatatagtaatcctattaatatccacagttaatgaataaggaaaatacaaccataggcttactatatcctttgaagcatcttttgtctgacctataaccctattacccaggagaaatattgctaatccaggcaacactaatgtggaatggactctaatggcttcaggactatgacctcagcactgatctcaacaacctgcattcagtttgggtgaaaattcgtggctttgtatatgttacatacctgtggacttcatgcattaaacttgttcctcaaaaactctgtgaagtgcaagaatctgcatatagtcctattaatttccctgaagagttcaggaataaagttaatgaaaaatttacccatgatcacaaaaattacactcaacaaggctaacattattttaatacagcattatagctttatggaaacactatttatgtgtacttaattcttgccaaatagtaatgtggaagacagtatctattcaaatggttcatcaatctgtatgatcttttcacaacttattgaagataccatttaccagaagtaagggtatatattagtaaagttttctttttcctttttttttcattttcatttttttttttttttttgagatggagtctcgctctatcgcccaggctggagtgcagtggcacaatctcggctccctgcaagctccacctcccgggttcacgccattctcctgcctcagcctcccgagtagctgggactacaggtgcccgcaaccacgcccggctaattttttgtatttttagtagagatggggtttcaccatgttagccaggatggtctcgatctcctgacctcgtgatccacccgcctcggcctcccaaagtgctgggattacaggcgtgaaccaccgcgcccggcgtgtaaagttttcattaagtgattgctcagataaaagcatttgtgaatgcttattcaagaagcaggtagtcgtcttgttgtgaaacagtgttcatttatcgcatctagtttgtcaaaacattgtttgacagtattgaatataaattgttttctacctgtttgttcttcgtgacctttttgcagtactatttactcaattattgtagttcacaactaaacacacctataaacatatactcaaaattccaaattttacagactagtaatttcagatttcttaaactaggattttcttctttctagttttagtcaacacgtctacattcttcatagcccttgcttttccatgattttactaatttattttaagcctttctattgttatattaagtagcctcctttgacaacctacacttttatcattagtgttctagttccaaggttaaagaagaatgcattacatagattggacaagtgaagacattagtatgggattgtcataaaggatttatcagcatttgaagctcctgacaagcttttttttttttaatttagaagaatgccattccagccatttaaataaaatctccaggagaagactattcaggttagaccaatatcaagtcgaaaagacttgacctattaaaattattccagtttgagttttaggtgggtggggcatcttttattacaaaacaaccaaatgagtttttaaaaagatttttctttttcttttttctatttttttttttgagacaagagtctctctcgctctgtcgcccaggctggactgcagtggcgccatcttggctcactgcaagctccacctcccgggttcgcgccattctcttgcctcagcctccccagtagctggtaccacaggcgcctgccaccgcgcctggctaattttttgtatttttagtagagacggagtttcaccttgttagccaggatggtctccatctcctgacctcgtgatccacccgcctcggcctcccaaagtgctgggattacaggcgtgagccaccgcgcccggcccgcaaaaaaagatttttcttgacgagaacaaaccattccaccaagactttatccagcattgctttattacttcctagtcctggccttgagctaagactgtcaagaaaggtaggagatttcagtttgttttttagcctttgatttaaaaaatcacgcatagtatttgctgcaggcagaataacacttgcagaagagacagcaggggaagggactgggattcttcaaggggcagcttgactgtctgtccactactgttggtttggtgctcaggcttcagaattttcttattgcaaattattacttagacagtttcaaactttcccttcctccttgttttctttttgttagaagtctctctttattttttcaaacatgcagtcagactgaggttttcaggctgagaacttgtgcaaatgtatgaactcagacattgaagtgtacttagcgaagttttaagagttaaatcatagaatgcagctttcatgttttcttactggatttcctctgctatcagcatcagttcagaccacattatgaatccagttgagaaaaactgcactttcttcccaagggcacatgttagaggagtaaatgatggtacttaagaacacatatttagaatgcacatttttaagttttatggaataagaattctagttgtgttttctgtgaaggtgactttttaacaggttttttttttttttccccctaagaatgagtcattttctcacatttttcttcattatagggattttttatttgggtaccatttaccgtttattttctttaaaggccaaagaagctcacagtgatgagcttttgctattgttactgtataaacacatttgcttcatttccaggtacagcgttcatgtaaaatgaaactaccttataaatgcacttgagaaagaatgcaacagtgtctattgttcaggatgcttgtaatgttccttttcttttttacatatgctttccggatgagtcactttaatggtatgccgttccgctgatagtaattcttcaactaaatatattcagttaaggaaaattacagggtacttatataatcatgtttgggcctattcacatatagacttgcaagagtaaattcttacttggtctttcttagagcaaagatgtaagaagtgctccgttaatttgtcaatggttacaatgaatagaaacatttaattcagaaaaaaatccacaaattcctggaaatgcttttatatttacatagaattacacattcttaatatggtctagacagtgtcactggaatactgtgattttttttcttgcatgcatatctgttctcttatatactgtgtaattgaagagtccttccgttcaaactcttgcttaaaatatgtatcttatactttaccttaggattatgtattagagaaagtctgtcatttaaaatgttttgaatgaggatcaggccactatcatatatttgcttgaagccagggaaaaagtatatgtatatttttcaactgaagcaagtagataaataagatatgtgaggaaagtttctcctacatataactcaagagagtacactaagcttaaaaggttatttatggagtacaaggaagaaagctataataaagaacccgatagctataatttaattttttagtgttataattcagattcagtaattcagtagcagatttaaaaaatgaaatgagagaaaaaaaattaaagtgctaccagactgactaatcagtcattgaaaatgcctgtagtgggaatttactcagatagaaaatgtttgcactgtcattaaagaccccctagtttatattagtgaactaatataatgacaggcacaaaaatataccctgaggctgaggctgtgcaaaggcaagcatttctaacccactctggtacttaaatattcttggcactacaggtaccatcatcaccctgcaacctctagtaaaaatctctctctctctctctctctctctttctctctctctctttctcacacacacacacgcacacgcacatgcaccccctacctgagaaatattagaagtagtgtaggcaaagacctagttaaatatttaaataatcataatattaattgattgccaactcttaagattgaggcaaatgtgttcaaggcaattaatgaggcaggtaaacacatattaattcttttctaatactttttttttgtctgttaccttttagacaagtctagaaagccaaagtgatgaacttttaaatgccaaggaaatacagactattgcatgggttttaatttccagaaatattatttaaatttggaacttgctaataagtctgataaattggctgttagttagtgtaattgtcactagttcccaaacctaaaattccatgtaccctgtaaaatctaaacacagaaaacacaatctaaatttagttctctttattaaaaaaagaccagctgggcgctgtggctcgcgcctgtaatcccagcactttgggaggccgaggagggtggatcacgaggtcaggagatcgagaccatcctggctaacacagtgaaaccccgtctctactaaaaatacaaaaagttagccgggcgtggtggcgggcgcctgtagtcccagctactcaggaggctgaggcaggagaatggcgtgaacctgggaagcagagcttgtagtgagccgagattgtaccactgcattccagcctgggcaacagagcaagactgcatctcaaaaaaaaaaaaaaagaccaatattacgttaaattaggccatagtagggatagcaggttggaaatgtctgcatttttttcccgtagattacatctaaatagttgtttaattcgtggtagcatgtatacagtgggaatgtgtatgttggaaggtagggtgtaggaaagaggatagtgaaatataaaatgaatatttatgtactaggtataataataagtactttatcaaatcatttaacctaaatgactaccctttaaggaagatattatcatcatcattttgcaaatcaggaaatgaaggcctagagaagctaagtcattggcttaagataacctaactagtaatatgtatggctgagattagaacctaggtctgtctgattcctaaaaccattcctaccccatccaattctgccacagcagcatatataagtaacatgaccttgtgccaatgaatgataaagagtacaggttttatttcatgatgctggccttccaggctccagaaatactgctttacatttacaatttcctgagatgacatcacttatacccctccttaagagtagtgcataccttatagaatttttgtattagataagttaatacataaaactacttagaataatgtctagcacatagtaagtactcagtaaatgttggttattacttaagaacttaagtaatgactaattctttttttttttttcccgagacggagtctcgctctgtcgccatgctggagtgcagtggtgcgatcttagctcactgccacctccgcctcttgggttcaagcaattctcctgcctcagcctcccgagtagctgggactacaggtgcctgccaccgcgccctgctaatttttttgtatttttagtagagatggggtttcaccatgttggccaggatggtctcgatctcctgacctcgtgatccgaccgcctcagcctcccaaagtgctgggattacaggcatgagccaccacgcctggccagtaatggctaattcttacaccacagaaggactagttgaaggaactgggtatgtataggctgggtagattaagaagattcaactgatacatttcttgtaaaataggtagtagacttgatcagtgctactatgaggcaaaattaggagtaatagataagagtttaagtaggctgatttttttttttttttttttttttgagacggagtctcactcttttgccaggctagagtgcagtggcgcgatctaggctcactgcaacctttgcctcccggattccagcgattctcctgcctcagcctcctgagtagctgggattacaggcgcccaccaccacgcctggctaatttttgtatttttagtagagacggggtttcaccaagttggccaggatggtctcgatctcttgaccttgtgatccgcccgcctcggcctcccaaagtgctgagataacaggcgtgagccgccacacctggctaagtaggctgatttttcttatgagtaaataaaaaaattctagtgatatcaactgtcaacaattgaataaggcacttaggatgtagggagtactctgttttagatctaatatatgcaacaccccagatttactgggcactcctttgccatctcccacctccaaacccaggctactcatttcccagccatagtgggaagttaacattgctagaaacaatttcaccaatgaaggaacaggagatgctaaggagtaagcaggtaaatgaattgctcattgtctcctctaagcagctcttttttttttttcttgagacagagtttcactctgtcgcccaggctggagtgcagtggcacgatctcggctcactgcaacctctgtctcccaagttcaagtgattttcctgtctcagtctcccgagtatctgggattacaggcgggcaccaccatgcccagctaatttttttgtatttttagtggagacggggtttcaccatgttggccatgctggtctcaaactcctgacctcaaacgatccacccgcctcagcctcccaaagtgctgggattacaggcatgagccatggcacctggcctctaacctacttttctaagttacatttgttttatctggagaccaggactgactagataatttttgggtccgggtgcagaatgaaatgtggcaccccactgcaaatttttattttattttatttatttatttatttttttgaggtggagtcttgttctgttgcccaggctggagtgcagtggtgggatctcagctcactacaagctccgcctcccaggttcatgccattctcctgcctcagcctcccgagtagctgggactacaggcgcccgcccccacgcctggctaattttttgtatttttagtagagatggggtttcactgtgttagccaggatggtctcgatctcctgacctcgtgatctgcccacctcagcctcccaaagtgctgggattacaggcttgagccaccgcacctggccaaaaagttattaagaatttcaaaatgacaacaaagtattaaacaaaatgcagggccctttgcagcatgggatcttgtacaactgcacaggttgcatatccatgaagtcagccctgacggagacaacctgagacactaaacaaccagcatttttttttttttttttgtaaagctatgacaagttctggaacttaccctcttgtatttgctgtctttccctcatgcctgcttctctgggattatatcccgctcaccccaacaaggccttaagaagtaagctctaacttaggctatgttttgcagggactcagactgtgatactctgtaacctgagtttttcaaatttaagaggctggtccaaatctcctttaatgtcacttttacctcaaaggtaacataattcccccatgcaaagataaacactttacataatggcattgtttaatgcagccataaatttctgtataagctagaattctcagattattacatctccaatattttattctcttttgttcaggcataatataaataatccattagaggggaagaatggaggagcctaagaaagaaaggtgccctttacttttttttactttatccgctttcctcacattcccatttgtctaagcatctcccgaaccacgtctatatattgttaggcagatttcaagtccctgctctctttctctacttatataataattggtatggtaacttcaaatcattatgattatatctaacctctccctgtactttcagttgtggaagtagacataaatttaaatgtgaaccaaaacttcttgaaatgtacatattcatcaataaatatttattgagtgataaatactgagcacagtgataagtactgagggaaaagcaaaaaatcaaatatagatcttaccattaggcagcttggagttttataaaggaaactgttgtttatgtatatgagataaaagacaattattattcaaagcagaaggtgataggtcgaagatcacttaaacaaacaaaaagtacatatgaaatggtagagaatttggagtagagctctggagagatttatagaggactaaagattatacatgtgaaattcgggaggacagatgttcagaaaaatattgatttattcagaatgcaactttagagtaaaagtaatttccctgggttaaaaatattctcacttattacttgacatatgtagactgctgtgtgcatagcaatttgattaggctagttttgtattgaatgattggaagatgaagtcattatcatcatcatcccctttttactagtgccattactattgtgacctaaacctggccttttagcacattttatttattacagaaagttagggaggaaaaataacttttccttttccccattttaggttcattggccacggtctctataccaaaaggcagattagcaaaagaaaataatgcagatttatttaggttttacataacttgagaggggagcattcataaggaaatgaagatccaaagaaacagttaaacctgaggttttctatagtatgtttgatgaaaaatggagaggtgtggaaaaatatgatagggagaaggaaaagtatgtgctaagtataataaactgggagaaatttaacaagacctatttgttcagatttctatgtccctttattttcagagataaggatgttggtttcctcagggtgcatatagcaaagttagctctcaggccggacatggtggctcatgcctgtaatcccaacactttgggaggccgaggcgggtggatcacaaggtcaggagatcgagaccatcctgaccaacatggtgaaaccccgtctctactaaaaatataaaaattagctgggcgtggtggcacatgcctgtagtcccagctacttgggatgctgaggcaggagaatcacttgaaccagggaatcggaggttgcagtgagccgagatatcatgccactacactccagcctggcgacagagtgagactccgtctaaaaaaaaaaaaaagccacatgagtttttgtttgtttgtttgcttttgttttttgtttttttctttaagagaaaggatcaatctgtgttgccctgtctggagaagagtggcatgatcatgactcactgtggcctcgagctcccaggctcaagcgatcctcctaactcagcctcttgagtagctgggactaggcacataaccaccgcacccagcttgcttatttatttatttatttatttatttaaggcagggtctcactctgtcacctaggcaggaatacagtgatgccatcataactcattgcagcctcaactttctgtgctcaagcaatcctcccatctcattttcttttttttaaattttttgtagagacgaggtctagctatgttgcttaggctgctctcgaactcctgggcccacgtgatcctcctgcctcagcctcctaaagagctgggattacaggtgtgagccaccacacccagcagagcttatttttgtattttttgtagagatggggttttgccatattgtccaggctggccttgagctcctgagtccaagcaatccatccactttggcctccacaagtgctcggattacaggcatgagcccccatgtggggcctacatgagggtcttaagacctgtgcccaggaaagatcagatagtccttcctgcaggtgtcatttctaaaagttcttcagcttaaaatactcaatatgccaaggcaccatatttttgggtaatgtgccctgaacttcaccatgtccgtgtaacctaaataacataagtgactggtcaatgttttgtcttcacttttttttttttttttgagacggaatttcattcttgttgcccaggctagagtgcagtggcgggatcttggctcactgcaacctccacctcctgggtttgagtgattctcctgccttagcctcccgagtagctgggattacaggcacccaccaccaggcctggctaatttttgtattttttttttttttttggtagagacagggtttcaccatgttggccaggctggcctcaaactcataacctcaggtaatccgcccacctcagcctcccaaagtgctgggattacaggtgtgagccaccgcgctcggcctgtcttcactttttcaatcaaccaagtggggaaggagaaaccttttgaataattggaatacagcagagaaacctaagtgaaaaaattcaattttaaaatcagagagaattatttcttccatagcaaactcatcctttaaataaagcaagcaatgattggtgaaccattagcaaatttttggcaaaactttcttctgcaataaagaataatttccaagcttgtcagatctaaacaaatggaactaaattggacagagctatttaaactgacagattaatagaaaaaaaatagtctttagtgttagtgtttgatttttagtctcttgaacttccatgtatatttaaggtgatttctcctcattgagttataaagatgtgcccatcaacatgatgaatttgtatctgaacagtttggctgaaatttgccaaggggttgattttggcagtctcttaaatttttcattgtaatgctgatatgtctctgcataagactaactttgcttaaaaataagaaagaatcatagtatttttctatttgtgtttcatggtcctttaatgaaaataacagtatttcagaggcctggatttaaaaaccaatgtcacaggctgtccatcaaattataacacttacctcatctttgcaactagaatcttgccaaatgctgttgatattgatagaagtgttttcatacataattggcagttatgcagcaatagagtatctataaaatagttgaaagttaaaaaaaaattacctggtaaaaagaaggtctcctgacagatctgaaaaatgtgcatgtatttaggagcagtttgaatacaatacataaaattattagttgtcaatgagagcaaaaggaaggtgcagagaatgttaggggtaattacagcaactaatgatagtgtttgagggcaggctgaatctttgtgggtatgtacgttcatttgtgtttgctggggtttgctctaaattatctttctgtatcaacagttatttttcacatctctttgaaaaatactagagatgggaacttttaccatagatattggtttataaaaatcaggatattccaacaaaagaaaaatatttgatccttttacataatttaaccttaaatcatttatagagctactaacgtgcattaataacatctctttgaaccttagtttttctttaatcttcaaattagattttaaagaatgaaatgttaggaattccgtcaataaatttaaattgaaatggattcatttgaactaatggctgagtaaaatggtgacattcccatattaaacatgataatttggtatactgtattacacattttcatttatttcatggagagtagaatttttataagcagtaattcagaaaaatgtgagttgacttcatggaactatttcccacatttaaaaaaaaagactttaactgataatgtctccttttagatgttttgtggaacacttggtaaaatattctaaatcctttgcacactgttctttagtttcagctcaaattctcaagagcaaccttgcatcaatggaacaacaaattgttcatctggaacgtgacatcaagaaattcccccaagcagaaaatcaacacgataagtttgtggaaaagatgaccatatcctttatttatttaagcattttgtctagtttttagtctctatgtctgtctgtttactaactgtgtggttagttctagatttactagtcttttcacaccatctggatgaatttgtgtatatgctgtttttctattagtagcataaattttgtttcatgatgttttcaaccagtaggcaagggaacaattagattttttttgaaggctatttctcaaagaagaattccatttgaaagcccacaggatatgcaaggtaagtcttaagaggtttgatgaaacctaaacaaaacaaaacagaatgttcttatataaccaaatgtttaaagtaaattatcaacagaaggtttttttttgtctgagattttgtgtgtgtgtgcatacattttctgagggcatgtgtgcattttcaaggacaataagaggataactaatatcactagacagaaaggactgtgaaggataaatggatacatggttggatggatagacgaattgattagtagattatatatttaaataaattgtagtagatatctgtataacattaagcatttcttgctaaataaacattttttgaaacttctagtttatagcagtatattcatataaatcataaaaatatataaaaggaaaacttgagaaatagcatttagcttgaattgtttaatgttaaatctggtgtctaaagataaactacattagacctgatttttttataattttctattttagttttcaaaagttaaagccatatcctcctcctctgggtttaaataagtatcttgaactgcagattgattcaccattttatatctttagagggaataaatactgtaaattctttatctgataataagtaaattccttcaacaactatttggcagtcaccttgtttcaaggttaaatctattgcctttttcttctgtgatatgctttattttttgcccaacttggaagttacagtgctgaactcgaattacttaagaatggcaatttagatttatgttaaaaaaaattttaactctcagtgttttggttcattaatgaatactgtgttttgtatggtactttagtgattctgagtaccttcatgaatacaaatattggcaaaataagtttgtgattgattggaggcagggaatccacaaaaataaccttgggttgcattactggccacgttaggatacctaatgtgaaggtttcactttattgctgattacattttttttttttttcaaatatgttatattgtcctgtgcctggaaacaccacctcctttttcaccttttgattttggttcttgcctcatatatttgaatttaattccttatcccctttttcttttgaacattttcttctactgttggcttatagccacacaacagcttgcaacattgagtctttgttgctcatttagaaaaagaaaagtaatttcaaaccctcatgaacttggcctggactccttattttatttctctctttatgcaggtaattaagcactttaaaatgaaaatccagagccttctgtatctgtatgttacagatgaatggttattcttcatttaagtggcactaaagtgtgactatttgtccacaaggggattgaaaactgtattaaaatgtatggggctgttactttgcatatcatattttttaaagaaacaaaataaaatacacagcaatttatttcagagaaaaaattagaatattgagttgggttggttaaaaactatgaattaatggattataaagataaaactgtggctcaagttattcttcctttgaaagacttcttggtcacccattgagagtttctatcttctagaaagagacgaacgaaatgcgtaatcattatatgtatgtatatgagttctggtgcctacctaatatatatattttttacccttctggcaatgctaaaagagaaagatattttattgtgggatacttgatcctgttttaaaaatagaaccatgagccaggggtggtgactcacgcctgtaatcccagcactttgggaggctgaggcgggcggatcacctgaggtcaggagttcgagaccagcctcaacatggagaaaccccgtctctactaaaaatacaaaattagccaggcatagtggtgcatgcctgtaatctcagctactcgggaggctgaggcaggagaattgcttgaacctgggaggcagaggttgcggtgagccgagatcgcgccattgcactccagcctgggcaacaagagcgaaactccgtctcaaaaaaaaacaaaaaacaacaaaaaataggaccatgattccatttctagtataggatcctttgtactagatgatctttccaatatttccatccagtgccaataaattgttttgcttcaagtcactggccctttaaattgaataattagggtcacaagtattggagtagtttccatggaaagtaactttagctacttaaacagtaatctgtctgtgaggactgagttcacaagctgaaaagcattcgtatgcctctggacttcagaacagcaacaatgctgtagttagcagcaatggcatgatggcttcagggcaactgaatatgcaggttggatcttcaagtcaggctatgtcctggagcaccctatatttacccttactctttcccaattttgattgaacacttaaagtatgctagacattgccaggcatgaaaattgaacagtacacaagatgatagaaaacttgacctcaggctgctgacagtctgacatttgtatgttctctgtcttgctgttcccatggcagagattatgtatggtttgttaattactatatgcctaccacctagcacagtgtaggcactcagtaaatatgtgttgaatcacacggtattatagctagagacagtgaagatcatctagtccaagcccctgcctttacttagcacttcaaaacgatactgtcagtgttaggctgtgcttatatttataaaaattttcttcatatatctctcacaaatgtatcattgaatcacctttatagagcatgctgtaatgtataatcagttttaagagagaggatccacagcttttaaagtaaacatcagaaaaaacatagacaaaaaacaaaaacaaaaacaaaaaaacctctcctttgaatggagtttccaaggctatttctagcctgctggggccaatggctttagaaggaaactcatcacctctttcttcctttctctacccaaaataggttgcttgttctgactcagaaaaaattagatggtataggagagaaaaatcagtcgttcttgacccattcgaaggttcatggctgacaccctataataccatattaacaagagcaaagcatacaaatttatttaatgtgagttttatgtgacacaggaaactccataaatgaagactcaaagaaacagggaaaaaccatgtattttatgggcagttgtgcagaagtatgactggtggataaaaggatatgatctaatggtaataagctgggggcaacccatgaaggctggttcagattattttctgtatctctgtatgacagtcttcccccaggtatggggaaaagacacctgtcatgtgaaggtctcttttttttttttttggagacggagcctcactctgtaacccaggttggagtgcagtggcgcgatcccggctcactgcaacctgggttcaaacgattatcctgcctccgcctcccgagtagctgggaatacaggcacacgccaccacgcccagctaattttgtatttttagtaaagaaggggtttcaccatgttagccaggctggtctcgaactcctgacctcaggtgaccagcccacctcagcctcccaaagtgctgggattacaggcacgagccacagcgcccggcctatgtgaaagtctttggtgaggaaggacagagctcagaaagtgatcttcctaggttttatggcttctttcaagggagaggaattctagtttctttgacttgcttcaggagacaaaggaaggtacgaaggagggagggataagttcagagacaccttcttgcttctgtggtcctcctggtgtccttcagctcaaagtattcagcatgccaaggtagcgtacttccagatattgtgttctgaaccccaacactttacttttttaaaaaagtcaaagcatcatttttacttaccaatccttgcttcttctgtcagaaaagaaacccattcttaaaagaggacttcttagacttttaaatatgtgttgtggtccattcttaacatcttaaactatctaaaaaagcacatcaaccacgatgtcgaccttactgcttatatccagttgacaaattccttaccacatttacttgcagagattttgtcaatggcagggttttctgttgcccaaaatcagcttagctttttgattgactgctggttaaatcatttccccaaccggaggacagagagtgactgagcagcaggggcaccattaacacattgacaagaagagctgacagaatgttaatgacattaacaccctgtcaactaactatcaacacttgggatttcctcatagtatgagggaagtcatttgaagtggttacaaatcaagttactgagaaggcacattatcctttccagataattcaaaacagatttggggtcttcactgcactgccattatgttaattgtattccacctttatttattaagataataatttttaagtagatgaaaaaactcacagaaccaccagtgacattgatcacctttgagaacatgccagtaacaggtttcagggagatgataatccacactttgtaaagcaaatgtcatataaaattgacaaaatagaaatgaaagcaaaaacaaccctcaagagcaaagctgttgtgttttgttttgttttgtttttaatgaacatagtaattcaggtcattttctggtgcctaaagaaaaattgagaacttcagattaggctggaggggggaagttcatcacctctgactctctccttaccctcactgtctgctcctctcaaatgcagaaaattagaaagttcaatgcaaacatttatgagactgttcagggagaggagggtacaggatttaaaagggggcattgtcagtaatacagataatgcatacattgagaagcaaattgttttagaaaaccacaaggggggccgggtgcaatggctcacacttgtaatctcagcactttgggaggccaaggcaggtggatcacctgaggtcaggagttcaagaccagcctggccaacatggtaaaaccccgtctctactaaaaatacaaaattagccgggcatggtggcacaagcctataatcccagctactcaggaggctgaggcaggagaatcacttgaacctggcaggcggaggttgcaatgagcagagattgcatcattgcactccagcctgggcggcaaaaagagtaggactccgtaaaaaaaaataaaataaaataaaataaaaaaagaggaaaagagtgctttttaaaaaagtaagattcttagcattttttgaaatatactctcttgacaatggtactggtcaatggaatttttagtttaattgaatttaaatagaaagtattatcatttatgataataataaagtagtaggccgggcacagtggctcatgcctgtaattccagcactttgggaggccgaggcgggtggatgactaggtgaggagttcgagaccagcctggccaacatggcgagaccccgtctctactaaaactacaaaaaaaaattagccaggcatggtggtgcacgcctgtaatcccagctactcaggaggctgaggcagaagaatcgcttgaacccgggcagcagaggttgcagtgagccgagattgtgccactgcactccaacctgggcaacagagtgagactctgtctcaaaatgaataaataaataataataaaaaaaacagtaataatagtaataaactgttatgaaagaaaatcaaagccagaaagaagttaaagtggtaaaggccaattttattcagcaactattgcaataggagagagaccttactatacaacgaggctgcattctgatacaacaaaggcaagtggggatttatagccaagaagcagggtggaagtcaggcaatggaacattactagaaggagatatcaaagataaggggattccccctaaaccaacttgataggattcttgctgaaggcaggcaaggctaataagatatgaagagtggaggatgaggaatttgaccatatatgaagggtggaggatttttgctaaacagacccagtaggattcttgctaaaactggactgtcagggccaaggactgagcctaagaatgaggcctagtcaaaaagaggactcaaggctgggcgcggtggctcacgcctgtaatcccagcactttgggaggccaaggtgggtagatcacctgaggtcagaagttcgagaccagcctagccaacatgttgaaaccccatctctactaaaaatacgaaaattagctgggtgtgatggcaggcgcctgtaatcccagctacttgagaggctgaactaggagaatcacatgaacccaggaggcgaaggttgcagtgagctgagatcacaccattgcactccagcctgggcaacaagagcaaaactctgtctcaaaaaaaaaaaaaaaaaaaaaaggactcagaggaacctgactaaaatttggttcaagagagagtctttgtcactgtttagttaatgtcatatgccagccattatgctaggaatatctatatctatatatctgtctatatattttcctaagtgaccgccaaagcaatactatgaagtaggtactattactaactttattttattttatttattttattttattttattttatttattttattttatttttgagacagagtctcgctctgttggccaggctggagtgcagtggtacagtcccgagttcaagccattctcctgcctcagctgcccaagtagctgggactacaggtgctggccaccacacctgactaatttttgtatttgtatttttagtagagacggggtttcaccatattggccaggctggtctcgaactcctgaccttgtgacccacccgcctcagcctcccaaagtgctgggattacaggcatgagccactgcacccagccttaactttattttaaatgtgataaaattgaggctatagaggttcaaccatgtacaggagatcacataggtaatatgtgtggttcatgagggtcagaattccaattttggtctttccgacattaaaccttgtgcttctaaccatggtattgtgctgcctccgaggttagacctgtttgaaaatctgagataagttctacatttgttccctgtgaaactgtttttttgcttccttttcaatctctctcaaatgggaaaaaaaatgttctttttgaaaggattgtaaactgatttaaaaattagctgctcacttataccatctcctccagaaagccttccctaatcatagcaatcaaaattaatttccctattccctgtatttttataacattttaatactttgattattgtacttgctggtttgcctgtactctgttcatgtacatgtacatatctattttgcatactggtttatgtactcttttcagatacagattctgattcatattttgagtacttcacaacaagcctgtaacaatgctttatagaaagtcaagtgcttaataaatgtttatttaaataggttagagtttattatataattaatataaaacttaacattatggccagtaaacagaacattagcttgtttttctggcatagcctcagtttaacagaagaaaggagtctaacatgtttcaaatgttattcttttatcatgtcttgatttaaaatgcagctattgaaaattatgtcttaacagattttaagatagaaatcacattctaagaccctgtctgaatggagcatatttttaagggtccgttagcacaaaaattttctctttgaagagttttgcttgcttgaaattcaccctgaaattacgtacactatgagctacatttttcaaactttgttcagggaattgatagacatttggtgcatgatgctaatggtgagaagagaatatattgctcagttaaaggatacataaaccctttcaggccacaagagactcatctgggaaatcatctttttcagaacataaaacggaacttaatttgtctgaaagagttaatgtaccctcaacctgacaaattctaatcgctctcaccagaagctaagttttaaaagatgtaaaaacctttctgtgggatttattcatattgagtagaaataacacaaaaaagaagcttgaaagaataaattacccaatatgaatgtggttttttgtgtgtgtatgcacataaggaacatgtagcatgtgcacatgtctattcgtagatgtaaagccattttggtatttataagactataaattggatatcataccaatgaatctgtgaatttgttttctttgctttgatttaaaatttggtaaaagttttcaattatgaaacacgtggtatcttaagcatacatagtttacaggtaataatagtgatgttagtataattcctcaagtaatatactctggtgcaaaatctcaatcatgtactgttttcataatgcagaaaaatatatcagtatgtttttgtataataaaagtgtgtttacttatttctagttaggatgtgtttgacatatagcttatgaaaagtatggcaagtaaacttggcttttcattcagtaatccctgctcttttcttctgtttttgtttgtttgtttgtttgtttgtttgagatggagattctttctgtcacccaggctggagtgcagtggcgccatctcggctcactgcaacctccgcctccaaggttcaagtgattcttctgcctcagcctcccgagtagctgggactacaggtgcataccaacatgcctggctaatttttgtatttttagtagagacggagtttcaccatattagccaggctggccttgaactcctgaccttttgatccgcctgcctcagcctcccaaagtgttgggattacaggtgtgagccaccacacccagcctttcttctggttttaaattgctttacaagatgaagactgaaaaaaaaaaaaaatacaagaaagtataggaaatcattgtttaataatcatgtaatcatgctgtcttttatgttgcaaatgtaagataggataataatgtagtacattgtctgaattaattaatgaagtgaggaatggaaaaaaatatatgacattactgaaaattatctaattgaattttaataataggattgtatgtatacctagtaagacatatatttatagaactataatcaatttgagaggatcatatctcagctacttatttaaggctaagggattcactaatggtaagaatggaaaaatcaatgaaaaatttaaaaaggccgtgtggacaagctttgcaaagatcatcagtgaggagaataggacctagtcacaaactgatgatgtctgaggagacaaagggcatgagtaactgagttgacaatggttctgagaggtaacggtaacaaaccctctttatcgtatcgaaagcaaatatctagtaagtggcttttcatatctgctaagacattatcaaatttgtgcacagcaactctgttcaattactgatctctagatgcctttatcataggcctgactcagaacctatatataaaagtaccttcaaactttagtgttctttcagatgccaagtattttacttaatccatgtgaatgaaaagatatttggactgggtatccattgagttaagctctagccttggtatttgtgaacttaggaaagactgtttacccagtcataaaattgaaaaaatcatacttggcttgcctacttcatataaattgttattaaaattaggtataatagagtgacttttaacatgccttgcaaaatggaaaatgctttgtaaaatagaataaccatttaaaattgtcatttatgtatcattctcccctaaaccgcacaaataggaaataattctatcccccaaggaaaatgttctttgtttaaaaaaaaaaaaaaaaaaaaaaaggcctcttttttccaatttcattttatctaactttaaaaacatttttaagttctagctaactttgctttttgtatgtagaccagtaaagggcacatttttcaaaatgtagtgaatgcttgtagagtaagcaggatgctaacacctcattattcaaggaatatccagatgttcagtgttaaactttgattccttacttttttcactttggtaggaaagaggaagatggagcaatagagtttgaaaattcttgcatactttatgaatgatgacattctatatgctatgacacctataaaataaagattaagggggccaggtgcagtggctcatacctgtaatcccagcactttgggaggccaaggtgggtggatcacctgaggtcaggtgttcgagaccagcctggacaacatggtgaaaccccgtctctactaaaaatacaaaaattagccaggcgcgtggcacgcgcctgtagtcccagctactcgggaggctgaggcaggagaaccgcctgaacccaggaggtggaggttgcagtgagccgagatcatgccactgcactctagcctgggagacagagcgagactccgcctcaaaaaaaataataagagccagtcacggtggctcacgcctgtaatcccagcactttgggagactgaggcgggtggatcacggggtcaggagatctagaccatcctggctaacacagtgaaaccccgtctatactaaaaatacaaaaaaaattagccggtcgtggtggcgggcgcctgtagtcccagctactcgggaggctgaggcaggagaatggcgtgaacccgggaggcggagcttgctgtgagccgagatcacgccactgcactccagcctgggcgacagagcgagactccgtctcaaaaaaaaaaaaaaaaaaaaacaacaacaacaacaacagaaacaaaacaaaacaaagaaagaaatgatcttccttccactgctccaaacttctaagacaatgtatgtgaacgctcaacacagacagaaaacctctactgatatctgcctgaggcaggcaaatcacctgaggtcaggagttcgagaccagcctggtgaacatggtgaaaacccgtctctactaaaaatacaaaaattacccaggcatggtggcacgtgccaccatgagtagtcccatgagtagtcccagctatgagtagtcccaccatgagtagtcccttgagtagtctcatgagtagtcccagctactcaagaggctgaggcaggagaatcacttgaacccaggaggcggaggttgcagtgagccaagatcctgccactgcagtccagcctgtgtgacagcatgggactccgtctcaaaaaaaaagatcaaaaatgttctgagaaaacatcaagtagacctctttggctggaagtagtgagagctgttactaagaaagagggtaaaaatcaaattctaaataattaataatattggtctaaggagtttgaacagtatttggtgggttataaattgctgaaaggcaagaaactcttgttccgtcttctccctgcttccagccaccacatggtatttgcctgagagtgatacttgctacctgccaactactgatccaagtaagtactaaagtcagaattgtttccagtattagaaaggtatgtgtgtgcacccagactcatgtgtctgatggggcaaatggttatttctttgtcttcaataatgcatttaactgttctgtggttgaatttgtaatacagttataataacttgcatttatatagtgttttaaagcttgaaaagatcttttatcttctcatgtctaaccctaaatgttctgtagcaaaaattatcatattaagttttgttttgttttgtttgagacggagtctcactctgtcgtccaggctggagtgcagtggagtggtctcggctcactacaacctctgcctccttggttcaagcagttctccctgcctcagcctcccagatagctggattacaggcgcccgtcaccactccgagctaatttttgtatttttagtagagatgggctttcaccatgtaggccaggctggtctggaactcctgacttcaggtgatccacccgccttggcctcccaaaatgctgggattacaggcctgagccaccacacccagccacatattaagtcttgcacctacttgatgttgttgaggattcatccatttcacaaatatttattggttgattactcactgtgtgccaggcactgtgtcagatagttggaacacagtggtgaacaaaaaagatacaatgcttactgtcaaggagattttactttgctaaaagagatagacattcagcaactacataagcaactatggcaggtgataaggaagagatttataatgccatgccagtcaacaacctagttacaaggactgccctccagagagaataatacttgagctgagatctgaaagatgagtaagaattaattcagggaaaaggtgaagaggaatctttacctcagcctgtttatctacaggtgtttcaaatgtttgacagtttggtaccttggcgatgatttggttagtttcttgtttatggtcttactggatttacaatcctagtggagttttaaagttggagttagaaatctctcaaattgagccaaatcctgaggacattttatgtttaaaaaaccctcttaacttttctcccccaaaagttgcttttttactattggctagggattgagtatggatatttttgaaaagctatgtcagattccgtggaaaacctaaagctctgtgaaccttgtgggagctggaatttttcagctaagaggttcgaatagatttaggtatttatccaaaccgaacttttaaaccaccagagatttgcccattactagtttacatagagcttaactacagtggtttcctctttcaacatttactttttttatttaaacagcttaatcgagagctataaaaacactggatcagtcttttcaaataaaaatgaaatgcaactgccatgcgttagtcttttagaagaagcccttctgcctgtaggcagtttaggtgttaaaatgatggctttttcaataccaaaagatctagtttttgtttgcaaggtcatatctttgaattattagtttataaaaacctggcatatcttcgaattataagtttataaaaacctggcagttcttttgattttagttacaagtgcacacgtgtgtgtgtgcacgtgtgtgtgcatgtgtgtgaaacaccaagagtcatgagatttacattattggcttgttaattaagggaagaattccataattgttttaaatcaatcacactgcacaggggacattttgcctatttgtttttctgcacatattttatatgtcattgtttatgtttgcttaaaatgccaagatgtgcttaagttagtaatgctaatattgatccaaaactctcaatttatgactgattcttcatttttttcttttgtaagtcattgctttgctttaactcttaatgttatcgggaataaggtattttaatactcatttcctttagaggaaataaaaatatcaactttctttttttattttttatttactttatttttatttttagagatgaggtctggctatgttgaccaggctgctctcaaacttctggcctcaagcagtcctcccatcttggcctctcaaagtgctggaattacaggtgtgagccaccacgcctggcctcaacttttcagtaaattaacctggaacacagaaagtcagagaaatgaaataataattccaagttatgcaaataagtacatttatgtacaaagggattgtattaggtgatcttgagcatcactttcagctctaaaaagttcttatattgccaaagctaggtagtacgttcatccttgttctgctcaaacattaaatgcttaaatgttgaattaatttcttctctgattcatcacaccagtattgatattataatattgtgacatcattcctactggtcacaaattcatctattcattcaacaaatatttatcaaaaaaaagtttatcagatacctacaatgtgccaaaccctgtttttttcagtggagattcagtgatgagaaactaaaaaaaaaaaaaaaaaaaaagaaaggcctttgagcatatattcacatatattctagtgttgtagagcatcaaaataaatatgtagtataatatcatacaatgataagtgataaggaaaataaaggtgagtaaaataattcattaaagaatgatagagacacttgtttttaaagttggccagggcaggacccctccaagggagtaacatttaggcagctgtttgaatcaagtgaggagacgatttgcgtgagtaactgagggaagagctttccatgaaggaggaacaactagtgcagaggctgtaaggaatgagcatgagtacaaacacacgtaaggtataacaggaagagcaagaccagtggctggattgcagcaagtgagggagaacgtagaaggagcaaggatagttctgatgtgaaatcatggaagacattgtataagggaaagtcattagagaattgaaaagagataatgacacaggggtgaggatgactggatgaggaagaagggaggttgtcggggtgatgaatcaagagtttggtttgagaggtgggaagtttgagacgcctattaggcatccaagtggagatgtagatatgtgagcctagagtataaggggaaggtacacattaaagacagaaatctaggagccatcgccatggaaattgtgtttaaagccattagactggttaaggtgacctaaaacacatgaacagacggagaagagagaggtccaaggactcaggtctggagtactccaacgtttaaaagtttggaagatgagaagaattttaacgaaggtgtaggggaacttaaaaggtacagcctatgtggtaggaggaagccagaaaattctgttggcctgagagccaaatgacaaaaatgtttgaagaaggatcttttgactaggctctgtgcattgattaaaaaggtattatatgtaaggcattgaacacagacagcagagaggagctagtgacttcagaaccctctaagtattttattgagaaaatgtagactcatatcatgcatctattcttttactttgttatttgttaggatagcacatgcattagatttttttcctctatcatagctgactatttccagatcaatcaaaatgtccctattaagttgtcagttacatcacagataattgccataagccattcatttcatgtttttagtatcctgtgcaataaaacgctgtgaaacactttgaacagttattcagtgaaatctcaattatctggaattctagtaagcatatatctgtttatagataaccaggattttccaaatttgagcattaaccatttgaatgctagaatatttttttaaggaaaagccttctaaagtgcattattatattgagcaccagccatgtgctaggcgttttattaggcactataactatacattcttatagcttatggacctttgtaaataggatgttccaactgttatttatttatttatttatttatttatttatttatttatttatttttgagacagagtcttgctctgtcagccaggctggagtgcagtggcacaatctcagctcactgcaacctccgcctcctgggctaaagcgattttcctgcctcagcctcctgtgtagctgggattacaagcatgtgccaccacgcccggctaatttttgtatttttagtagagacggggtttcaccatgttggccaggctggtctcgaactcctgacctcaggtaatccgcccacctaggcctcccaaagtgctaggattaccggcgtgagccactgcgcccagctccaactgttagttttttatttatttatttatttatttatttatttatttatttgagatggggactcactctgttaccccagctggagtgcaatggtatgatcacagcttactgcagcctcgacctcctgggctcaggtgatcatcccaccccaccctcctgaatagctgggactacaggcacattgctaccacgcccagctaaattttgtattttttgtaaagatggggtttcgccatgttgcccaggctggccaactgtaattcaactacatcttaatgatcttagattatcatcaattcctctcagctgctgtagagatatttatctgataatgcagtatcatatgcctagaaggctttttttctctatccttctgaaactttatttcattttttgctttaagaaggtcacataggtgctctataggcacagatgattgtttggccccttgtgtgtgaataaatgcacatatgcctctttctcatcgttttcagtcattctgtgtacatatatgtctcacagaaatactcatgcatagacacacagacacacacacacacacacatgctatacatttcagggcactatattgaagcaaatatgactattcattttcttgctcacacatacacacacatgtacacatgtctctgatgccactgaggcacctggccaagtggttaattaacctttgcacaaatatattttagaaaagttatgtggcatcaagggctacattactgttggtcctcacaacttcttaccctcaaggaattcagggatggtcaatcttctccttagaaatgactttattcggctgggcgcagtggctcacgcctgtaatgccagaactttgggaggctgagatgggtggatcacgaggtcaagagttcaataccagcctggccaagatggtgaaacctcatctctactaaaaatacaaaaattagccgggcatggtggcgggcacctgtaatcccagctacttgcgaggctgaggcagaaaattgcttgaacccgggaggcggaggttgcagtgagccaagatcacaccactgcattccagcctgggtgacagaggaagactgtctcaaaaaaaaacaacaacaaaaaaaagactttattctctgttgtcagtgtatgttaacccttttattgcatttaatttctacaggtgttagtctactattatttttgttccagtatctcatcaagtcaaataagcacagagtaagaatttcaaagctagagagggctgacaataatagaaaacagaaacatactcaatatatactcctctctcactatgaagctggggcattgcatgaccagaggagtggtactttagtaagattgctctgccaatctagtcattgcatgcagaatgaataaaaaaagggagagactgaaaacaggaaaatcagttaagagagtcaaatatttcctatgtgccgctcagtgttctgggccttcagtctcagagagtaatgaaacggatgaggtgcctgctctcatggagctaaaatttacttgggcatggaatggggtttgggattcagtgctatgttgtgctaagtgctatggaaggaaataaaaccaggttatgtgatggtgactggggagccactttaggttaggagggcctttttgtcgtggtgacgtttgagctgaggcctgaaatatagaaagattccagacatgtaaagatctagttaaaagcattttaggcagggagaatagcttgttcaaaattgtatggaaatggacataaacttagcatattcaagaaacaaaaagaaggccaatatggctggttgtgtggttaacaaaggggagattagtataagatgaaaactgagaaaaaggtagggacaaatcatgtaggtccttgttggccaggataaggagtttggagataactatactaatccaagtgttcagtaaatattattatcactattgagttgagttttaactagacagttctctaaatgagttagtcagtgtttaggaataacccatgctcacagcatcattaaatgtttactgttaattctcactgctctttctcggtttcttgcaaggcattgttgcaaaactaatttatcacatacgttcctagttggggttcttaaaagaacatttctttttctagtatgacagtacagaacatgtgtgtgtatatatgtatatgtctgtgtgtatacttgcatatactatgtctgaaaaatacttttattctgattgaccctttgtacatttctcaaataatatagtttaactacccttgagccagaaactgtgtcagatgctagagatctaatggcgaataagtcatagtacttgtcctaaagattacagtataaataatgtattcttttgatcacaagaaagcttcgtccacaactttgaaggaacaagtactggctattctcctttattattttatgcaaattattatgtttcataaggactcattgccagcatttattttgtttatggactttgaaagtaggagtttcattaactctcagtttggacagtattatctttacatgcagttagtgcagtgactgtcatcatccttattagaataccaccaggacatctggcaagatgtctaatataaagcagctatgttatctatttccaatcaaatgattctttggtgcttcgatgtcctgtaacttctccacttatgtaattctctgccataatctaatttgtaaagtggggtgggagtaaaagaaaatttagaaagaaacacagagcacaaaccctttatcctggtaaagcatctcatgtttcaatttgcagttgttttggtaaagtataaaacaagaaatatgattataaatatagtttttattttttactgtgggtaggatgttttttgactaacacatgcttttaattgcctaatctattttggctttacctttagagaaaaattactgcactttgctgcatctgtcaaaaatgacacgataattctttgagtcaaaacagggtacatgaaatgtgatttttgtttattttctgaagaatagcagaactcattttttgacacatcctttactgtggttaagactccatggcatagaacagactgcttattttgaggttgcaaagtacagctaacctacaagaataagctctctaatatcttctatcaaaccaagaaatgatctgtttcacatgcacatagaaaagaattgattttcttacacaggatgctgccacttggactgtacatagagttgatttgtaatataaattaactcaccaattatcgattgttccatctgactttgaacacattaagaatctgcaaaaagtttctgagttatcaataataagaaagctgtgtatgaaatgtaatggggtgcgtcagctggatccgagttagatattgctgtaaatgttgcttagctttgccatctgtcacatactctttttgcataatattttaatccattaaaatgtgtctttttcttttaaaaaacattagcttacttaggttacaatgaaaaccctttaagaaacagtcagtgaccactgacctttccatgtcttaagttactttgtaactgtttttgcctttgtgccccctcattaagatgaataatgacaatccttagaaacaggaaatgccaagctcccagttgcaatgctaacaagtaggaagtcccattaacttttcaacttctcagacaagaaataaatttggacatgagacattatttctgaaactacttgtcctcaggagcagtgattgaatgaactaaggacttgctttcactaagtggaatggaaaactcatgtcacagcatgtcagtttctgcttaatgaatgagatattccctggggaataaattaggcgcctcacgtacataactcttttagggtacccagacctcattgatttccttttgtagaatagtacccacgtgacttataagactcactgtacaactaaactgactgactttgaccctcatgaatagttttgtcacctgggagggtttggttagaaatggtctccaccccttaataagaaagtcagctctttgctccctgttggctcactgctctcaggccactaaatgaaaggcacttgggtgtcatttagagccatttaccaaatgaactatcttggcctgagaaagttaagcactgttgggcctggcaatttaccataatcaaagagctagagcagaaaatatgcaagatctgatttctggccaatttgtgtttttcccgtgttgctcttggcagatctctgttttgagtagcccactcttctacttctctccatgttattaatttgtaaagtgaaacaaattactgacccttgaattgtgctattacacatgcttgagtaattttatttcatttgcagagaatttcatttcatttatgtattatttatactctacctacttccgaaacaatgtgtactggcttattttaattgtaattcaaatcatctgagtatttttccaagtcctgtcctgaagaagacttgtgtcatcacacatcatttcacatttactgtgctatggtgatatattggttatgatgcaatttctctggccacctaaaaacgactgtattaacaaaacatcatgcctgcagtctaatgtaacttcttttgttgtggtgtggtctattgggaaagaacatgcaacttacagttatgtgcttagttctaccatttatgtgacctagggaaagtcatttgccacatcttgctcaagtttactcagttttaaatgtagttgttaatgcttactccccaaacctttcaaggttatggaaatcaatgcagtaaatactgcatataaaatgtctgtgaattcccatatttctccagttaacaccaggaagaataattgtcagctgaactgaaatgatcaagcagcgttcttgtattcaggcactgttcttttttttttcttttctttcttttttttttttttttttgagacagagtctcactctgttgtccaggctggagtgcagtggtgcaatctcggctcactgcaacctccgcctcccaggttccagcgattctcctgccccagcctcctgagtagctgggattacgggcactcaccaccacgcccggctaatttttgtatttttagtagagatggggtttcaccatgttggtcaagctggcctcgatctcctgaccttgtgatccacccgcatccgcctcccagagtgctgggattacaggcgtgagccaccgtgcccggcctcaggcactgttcagacaaatgagggatggagatgtgacaagagagagttcctattttgaggagccacagtgttgtggtgaaaaaggcccagcacacaaacaattataaaattcccaatgggataagtggcacaagtgaggtatgcaaaagtgtcatagctgacaggaagaggaagcaatgaactctggccaggaaaatgggaactaagtgaaaaattagggtaaaacaagataacgtgtgggaaattccttcagaaacactctgtggatactaagacacaatcttatcaatgtcatttatttaacaagcatttatgtattatttacaatttgccagacaatgttctaaatgtcttacaataggaaatcatttaatcctgttcattcaggtctgtttgctgcgaaaaggaattctagaagcactaaggaaatcctagatacagagattcctttgtcttctagtaaggaggaagcatactgggtcagttaacatccacatgtctgtgaggcaaatggttagaaaagtatataccaaaaataaatgaatgaatgaacaaactaaggaataaagacacaatgaaggagatactatttttattttttttttttttttttgagacagagtttcagtcttattgcccaggatgtagtgcaatggcactaccttgactcactgcaacctctgcctcccgagttcaagcgattctcctgcctcagcctcccgagtagctggaattacaggcatgtgccaccatgcctggctaattttgcgttttgttttgttttgttttttgaaatggagttcctctcttgttgcccaggctggagtgcagtggcgtgatctcggctcaccacaacctccgcttcccaggttcaagcaattctcctgcctcagcctcctgagtagctggcattataggcacccgccaccatgccccactaatttgtatttttaatagagacggggtttttccatgttggtcaggctggtcttgaactcccagtctcaggtgatctgcccgtctcggcctcccaaagtgctgagattacaggtgtgagccactgtgcctggcctaattttgcatttttagtagaaatagggtttctccatgttggtcaggctggtctcgaactcctgacctcaggtgatccgcccgcctcggcctcccaaagtgctgggattacaggcgtgagccaccatgctcggccttgaaggagatactattaacctcattttacatgataggaaaactgtggtacagagggactaagttgcccaaggtcacacagctactaagtggcagacctgagtttgaaccaaatgagtcaggctctagaggtggcagccttaacaaggatgctatactgcttctcccatcacccatcaacacagaagtggacatctttattgctggaatccagcactggaatcccttggtggtccttttgatctctgtttcagtacctatagaaacgacaaggacttaaccagctcttgaaacagctgactacatttttggacagttgtaattactagagagttctgaatttgagccaagatctacttttcctggaacttccacccattgatcctatgtctgctttctgacactacatagactaaaccttcttccacataactgtaaaagtattggaaaacatctcccatgcctcctgcttgaattccacattcccatgtaaaaagaaagtgacatttgagagcaattagatttcattattccattgagcatttatttatggggtgcctattgtgtgcaaattgttatacagtgtgctagcaatcgcagagaaaatgaatagcaccagattcgcatgtacaaagtatgtactctgcactaagctattccactgctacccaaaatgtgcaattatcatttaagatacaaactaatgaatagaattattgcctgcacttatttaaatcagggtttaaataagcagtgtcttgctgggtgcacctgtatacatgccttaattaccccacaggattacaaacctgtgggcagaaactgctaatacagccttgtatttcctaccacacctagcacaggttctttggcagagtaaatgagcaataaatatttttgaatgagtgagagaaatgctgtattcattaatgctgtccttcagataattgctctaaatgatgttcacatgtgatcataacaataacaaatacaattttactttgctgtttgaatttcttcaagttttgtgtgccacattaaatagcactagagaagcaaattttcccagaagaaatgtcgtagtaaaatgtttgaaagacagcaaggtaattcaacagccagaaatacagagctttatagtactgatcagtcttcaactctttttgaaaagattcactgttatcaactgagaacctctccaccaccatgtgagcccagtaaaggcattttctaggttaccatcctggggtgctcctttggtaccaattgttctaatattattattatagtggaaaatgcaacaacatcattgaacctgtaccctgacctttcagttggccttggtgtagagcatcacacagtcaaagaatcaagttcagatcagattttaatcccactacattactgtttgctctgctttttgaggagattgcaatgactatatatatatgcacacacacacacacacacacacacacacacacatgcgtacagacatacatatatacacatatatgtatacacactgtattttatatatctatggaaaatatgtatttccattctgtagtctatgaaaacttgtatgaatggggcaaggtacaatacacaataaaataataatgcccatgttaaaaacttttttttttctttaagatggagtttcgctcttgttgcccaggctggagtgcaatggcatgatcttggctcactgcaacctccacctcccgggttcaagcgattctcctgcctcagcctcccaagtagctgggactacaggcatgcaccaccacgcctggctaatttttgtatttttagtagagacggggtttcactatcttggccaggttggtctcgaactcctgacctcatgatccacccgcctcggcctcccaaagtgctgggattacaggtgtgagcccccacgcccagcctgttaaaaactttttgagtgcctatttgtgaacaagaaacctttctgctgtctcatctggcataaccttaacatcacgcatttatttgtgctacctaacataattagccatgatagaaaactttaatgtaaaagaaaagaaaagaaaactttaatgtagcatcaaatcttgaaaaatcattttaagattcagttgattattttattagccaggacctctgtgaaatgactctaggatgagaactaaaatataatggaatgggagaggttcattcattatgttagagatttggatagtgctaggcctttaattaattaacatttcattaataatctgtaaggagtaccagtaaacagcactttaattaagttcatgggtaatacattaataggtatagaaaataccaatgaagacaggaaaataattcaaatagaccagataatttataagatataggaaaataacaggaattccactggccgcatgcagttccctactcaagcaaataaaaggcagtattcactgcatacattggggtatagaaaataaacaagtacaataagtaaatatccttgttggctgagcgcagtggctcatgtgtgtaatcccagcactttgggaggccgaggcaggcagatcacctaaggttgggagttcgagaccagcctgaccaacatggagaaacccagtctgtactaaaaatacaaaattagctgggcatggtggcacatgtctgtaatcccagctactcgggaggctgaggaaggagaatcgctcaaacccgggaggtggaggttgtggtgagccaagatcgtgccattgcactccagcctgggcaacaagagcgaaactccatctcaaaaaataataataataaataataaataaatatccttgtcaacaatataatggctacaagaagcaaaaacttttgtttctggtggggcctctgaatatatttctacatatagaaatgtaagaatacaagaaatacatacaagaaatatgaataaatttttatatattttggctttatgcatcttagaaacaaaatgattgtatcatctgaatgacagggctagtaaagaacctacatttactgaatgcaaactactggccagttcctgtatttaggcatgataaatacattgtgttttctttaatcttgtctctttttataagttcagatacatgaaaattaacaaggtttcatatccattaagtggtagagcttggttttaaccccgatctttctatggtacttccaataatgatatggacgattgcatgattttatgtgtgagcacatgtgtgtaaaacaggtttggatacatttaccgtcaactaaatggtatactaatcagtgatactcagatatttttcagtaagtttcagtttaggggggatttgtacatgtaaaatggctccaggagtctgtttgactaattaggccacctggggtctcatataatagttattttaggtttccactgagtcagtacccagttatacatgttgtttgacattggtcattttaatgaatacttgagccttaggaaactttatccattatggcaataattttatatatttactcttggccttgacatcattcccaggcagaagtagaagtggtcatcatcattttccttctaatgacttaaaccaagtcatttgctgttgaaactttaacagcaaataaaactagcggtgtgtgtgtgtgtgtgtgtgtgtgtgtgtgtgtgtgtgtgtgtgtgtatagagagagagacagactggaatccgttttgtttttcctatctctaaagtgcatgaattaaaaagatactaaacatacatctttgagtttatcagttcatcaggaacacatttttgaaaaccagaaggactctggataagtacaacttgttttggttataagaaacataactagccaggcacggtggctcatgcctgtaatcccagcaatttgggaggctgaggcaggcagatcacgaggtcaggagttcaagaccagcctgggcagcatggtgaaaccctgtctctactaaaaatacaaaaattagcctggcatggtggcacgtgcctgtaatcccagctactcaggaggctgaggcaggagaattgcttgaacctgggaggcggaggttgcagtgagccgagatcaccccactgcactccagcctcggcaacagagcgagactccatctcaaaaaaaaaaaagaaaagaaacataactaaaagtcatatatcttgttggcagtgaatcagtagaatcatgtcaacatataaaggactattttttactgtcatttttcagcacaagttttttttttgttttttttttgtttttttgtttgtttttattgatcattcttgggtgtttctcgtatagggggatttggcagggtcataggacaatagtggagggaaggtcagcagataaacaagtgaacaaaagtctctggttttcctaggcaaaggaccctgtggcctaccgcagtgtttgtgtccctgggtacttgagattagggagtggtgatgactcttaacgagcatgctgccttcaagcatctgtttaacaaagcccatcttgcaccgcccttaatccaattaaccctgagtggacacagcacatgtttcagagagcaccgggttgggggtaaggtcatagatcaacagcatcccaaggcagaagaatctttcttagtacagaacaaaatggagtctcccatgtccacttctttctacacagacacagcaacaatctgatttctctatcttttccccacatttcccccttttctactcgacaaaactgccatcgtcatcatggcccgttctcaatgagctgctgggtacacctcccagacggggtggcggccgggcagaggggctcctcacttcccagaaggggcggccgggcagaggtgccccccccacctcccagacggggcggctggccgggcaggggctgcccccccaacctccctcccgggaggggcggctggcccggcgggggctgtccccccgcccacctccctcctgggtggggcagctggccgggcgggggctgccccccccacctccctcctgggtggggcggctggccaggcgggggctgcccccccttcacctcccagacggggcggctgccgggcggagacgctcctcacttcccagatggggcggctgccgggcggaggggctcctcacttctcagacggggcggctgccgggcggaggggctcctcacttctcagacggggcggctgccgggcagaggggctcctcacttctcagacggggcggccgggcggaggggctcctcacctcccaaacggggttgcggccggacagaggcgctcctcacatcccagacggggcggcggggcagaggcactccccacatctcagacgatgggcggccgggcagagacgctcctcacttcctagacgggatggcggccgggaagaggcgctcctcacttcccagactgggcagccgggcagaggggctcctcacatctcagatgatgggcggccaggcagagacgctccttgcttcccagactgggtggcggccgggcagaggctgcaatctccgcactttgggaggccaaggcaggcggctgggaggtggaggttgtagctagccgagatcacgccactgcactcagcctgggcaacattgagcactgagtgaacgagactccgtctgcaatcccggcacctcgggaggccgaggctggcagatcactcgcggttaagagctggagaccagcccggccaacacagcgaaaccccgtctccaccaaaaaaatacgaaaaccagtcaggcgtggcggcgcgtgcctgcagtcgcaggcactcggcaggctgaggcaggagaatcaggcagggaggttgcagtgagccgagatggcagcagtacagtccagcttcggctcggcatctgagggagaccgtggggagagggacagggacagggacagggagagggagagggagaacaagtttttaaaataacttttttttaatttttattttatttgagttcattcctaaaactatatgtggtagtaaatttgtaaacaaagtcaggacttattttgctaagtcaccgcagtgagttccttacataaataaggaagacacctgtttattagtcacaaagttccaaccacatcttgttttgcacttctaagagatggaatacccccaatgagtttcctttgctaagcacagagaaggaaacaatgctgatttctagactttatagctaagcaacatttatgctttcagaaatgacctcagaatcctcctcaacacagcattctaggcagcatttatcaattgctttgagttgtaatgcaagccgaaacatacttatctcctccagagtttaccacttaaatggctcatcatgaatgagaattgcctttagtcatgactcagtgtgacattaagtagtttggacataaattatttggaatatgatagatagcctttatatgagaattgtacctgatatatataaattttgctagctgcattccatagaataagagaataaggtgactagatcttcaaggtactgaagttagaaaaactgattgaaatgaaactgtaagaaatgcctaagtggtacaatctatgatcatctagaactgtttctgctagtcaatgttagatactttatcatgtgattaactgaaaatgttctttaaaaaatgccacaactaaagaggcatgtggggctgggagcggtggctcacacctgtaatcccagcactttgggaggccaaggtaggtggatcacctgaggtcaggagtttgagaccagtctggccaacatggggataaccccgtctcttctaaaaattcaaaaagtagccaggcatggtggcgtggacctctaatcccagctacttgggaggctgaggcaggagaattacttgaacccaggaggcggaggtggtagtgagcagagattgcgccactacactccagcctgggcgacagagtgaaacactgtcgcaaaaaaagaaaaaattaaaaataaaaaaaaagacactgcaacggggtgcctttcaaatattagctgaaatgctagaggaatatatcagaggagagaaagctcacccctagaagaaaatgttaggtatggcttcatagagaaggttgcattaatttcaggccttgaaagatgggtaagatggtaggcagaaactggaacagggtccacattccagctgtacagactgtatagagtttcttgagccaggataatgaatctcaaggtatgttccctgaagacctagctgagttaagagtacctggtaagtccagctaaatcctctcccaacaccccttcctactggatttgggagctatccttatgcctcccattcttaccctgttcctcaatctgaatgttgattgtcagggaacttcagtataatccacgctattacttagcccaagtgggaatagtttgtagaaatgactatagccggttgaacatttccattccaaaaatatggattaagggccatgtttctttattgttagcattctcgctctgttgccaggctggagtgcaggggcgcgatctcggctcactgtaacctctgagtccctggttcaagcgattttcctgcctaagcctccggagtagctgggattacaggcacgcgccaccacgcctagttaatttttgtatttttagtagagacagggtttcaccatgttggctagggtggtctcaatctcttgacctcgtgatccgcgtgcctcggcctcccaaagtgctgggactacaggcgtgagccaccacgcccaatcaagaagagctttttaactagagattttaaaacaaatagactttaatttttagagaagttttacatttacagaaaacatgagcacatagtacagagttcttatatcccttctctacctttcagtttccctattattaatatcttgcattagtatggtacttctgttgcagttgatgaacaaatattgatatgttaacaaaagactatagtttatatttgggttcactctatatgttatacatatatgggttttgacaaatgtatgtcatgtatccaccattatagcattatacagaatagtttactgccctaaaaatcccctatgctctaccttttaatccctccttccctccccctaacccctggcaaccactgacctttttgatgtctccataattttgccttcttcaaaatgtcatacaagttggaattctgtaaaagaagattgccttcttttacttagcaatatgcatttaaggctcttccatgtcattttgaggcttgatggttcattgcttgttattgcttaataatattccgttatctggatgcctagaaacagccatgtatttttgaaaatagctccaagacatgtttctatttggctttgcctctggcacaggttgcagcatatcagtgtagtacaatacactgttataagaatcacagacactgagataaggaagggtctgcaccactggttcttccaacagcatgtgtgtagaaggatgcgagacaggcaggctttcaggcacctgaaggacatgtctgtggtttgcagcttactgcgtgcctttaacaaagcagttcacctctctagactttggtttcttcatcttgcaaacaaagggatgtgctagatgagttctgaagtttctctgaattctgaaatttgatcatctgctctcatctccttgtttaaaagttgagaaaagaaagcctggggaaattaactgatctgaataagaggaaatagcaaattattagcattacttggactagaaatctagtctctagatttggtctagcattttttctatcatttcaacctttatgtcctgatttttcatgtaagaacttatttttcttaagaactcctgattaaactaaattgattttttaaaaaaagaaacatagattgaaagtcactgaaatttttttttgagacttttttttttttttttgagtcttgctctgtcacccacgctggagtgcagtggcgcaatctcggctcactgcaacctccacctcccgagagtggggcgattcttctgcctcagcctcctgagtagctgggattacaggtgcccaccaccatacctggctaatttttgtatttttggtagagacgggatttcaccatgttggccaggctggtcttgaactcttgacttcaagtgatccaccagccttgacctcccaaaacatgaatctttttttttttaatttgagctttgactgcatagaaaatgtccatccagtctctgtttctaaaacatgaaattctttaacgttcttaaggcaaacaatttttgtaaaacttttcaccactgatggggttgctcccccttaccacaccagatttaagaggatagtgaatatttatgtctataatagcatgtgaagaatgtggctggtgaaaataagtggaagaatatacatctcgggctgtttcttcagtttccgggcaggctgcaacacttttaacactgctagtgagaagaaaggtgagagagttagctttcctcttggcttggttgcagttaaagtggattcccgaatctcccattttctacattataaatattgagagggacataaatatagatatatggatatgtttgtttgtttttctccctcctgtacttaacaagtgtaaaatcctggaattttctttttccttacttatcacaagttttcttagtctcaatcctttgtagtatttaaccttttagataggagaggtaaataagcccacaccagataagagttacatcacagtagctataattaaggaccggcatggagacatttttaataatagacttgcagccgggcgcggtggctcacgcctgtaatcctagcactttgggaggccgaggtgggtggatcacgaggtcaggagatagagagcatcctggctaacacggtgaaacctcgtctctactaaaaatacaaaaaaaaaattagcccaccgtggtggcgggtgcctgtggtcccaactactcgggaagctgaggcagaagaacgaacccgggaagtggagcttgcagtgagccgagatcgtgccactgcactccagcctgggagacagcgagtctccgtctcaaaataataataataataatgaaataatagacttgctaaatctgaggttaaagtgaacatttttaataatcagtcaaggttaaaatatttgtttaatatggtagtcaatgaaaaaatgttctaaatgaaaacctggtactaaaattattatgtcttcaggttgcctagagaagctggtgaggcactagatattacactgtttctcctctttggaatcatatagttttgatttaattaacagagaaagtctgcatatacaataggggatagagtgtggattttacttctttaatggtttgacaagcagattgcaacaaacaaggtatttggaagcctgctagggtcccagaggccttataaatatgcagtgcacttctctgcatttccccgggtccctgaggtagagatttgatgaataaaattaaaaccaccagatctttttgtatagcttttagctatcactaatttaaactgagtaatgactattttacaggtataccttcagcagtttaaaaagcaaaggaagtgaaatgtgaatgtgttttgactttgtattaatttcctcttaaactgaaagattttctactttttgcatcatgatacgttttctttaaacctaatttcaagagtaaaactctttacgcccctgtaggattgttttatatttaatagtgctattgagactggcatgggacaaaacatgcagacaaagaaagtatttcttgaaaagtgatgtgtatttatatataaacacaacgttggaatagcatactccatttggaacaaggtctttagaattagattttaatagattaaaactcttcttatttactgtatttgtagctcttaatgattgaatagatctctgtggttccttttcaaggatttcttgaaacatactgaaattcatgggtagatcatttaaggctcctgcgccctttaatatattacctagaaatggtagaatattttagaacacatacaaagaaggaggccgggcgcagtggctcacacctgtaatcccagcactttgggaggccgaggtgggtggatcacgaggtcaggagatcgagaccatcctggctaacatggtgaaatcccgtctctactaaaaatacaaaaaattagccgggcgtggcaacggccgcctgtagtcccagctactcgggaggctgaggcaggagaatcgcttgaacccaggaggcggaggttgcagtgagccaagaccgcaccactgcactccagcctgggcaacaaagtgagactccgtctcaaaaaaaaaaaaaacacatacgcaaaaggttaaggtaaaacacaattcattgtatatacatttgcaacaaagttcattaaagtctggggaaaaattgtataatgtaaagctccttagcttgatgtataatgaaaaaatgtagatattacgttaataataaatagcgtgaataatattggcactgggtatacacttactgaaaaggctgggcttttctaatgttaatcctgaggaagaggagagtctcttgcttaaaagtcaacactggtatgttgctttcaagaaaaaaagaaaaaaaaagcattgatgagggtatgaaatttatttactaagtattcagttgtgaagtttgaggagtggaaaaactaatttgtcaaattataccctcagagttcaacagtaaactagatgaagtctcccaggcttataactagcagaaggcacctatgttttgtctttgtgtgcctatggcttcacagcggcaactgaatctcacccagaagtgctaagttgtaattcccagtagccacttttagtgctttttgttttgcgttgttttgttttgtttgagacggagtttcgcactgtcgcttgggctggagtgcagtggcgcgaaattggctcactgcaacctcggctcactgcaacctccgccacccaggttcaagcgattctcctgcctcagcctcccgagtagctgggattacaggcacctgccaccacgcccagctaattttttgtatttttcatagagatggggttttaccatgttggccaggctggtctcgaacccctgacctcatgattcgcctgccttggcctcccaaagtgctgggattacaggcatgagccaccatgcctggcctttagtgcattttttaaagaatgtatccaaataacagacaattgaattaagaaaagcacattgtcatctttaatcctttccatttatttgcctcttgatagatgacctttatatttttgctttttgacaatttctacctgaggcatgatgtaactaaaatttctaacatgatagtggtagttctctggattaatttatgctcatggttttgctttgtttctcccttaccaaaatgctcttttcagtattacacaagaaaaagatcatgatttgcatcatgatgtacatagcaaatttcatgtatgatcgtgtttcctgttccatcacatttctggcattttttttaacccactgggacattaggatgtcataacataattggatgttagacataggttgagaaatcaagggtagtggtagatggaggctgacagacaccttccagatccactttagaggtactgagtattcctaaaccagttatgtaatttgcatgtggtcatatagctagttggtggccaaatcagggatacaacatgtatgtgagtatcattctatcatctatctatctacttattgacagataagaatatacttgctttgtgtaaatgattaccctttgattttgtggttgtcacaaacacatgaaactattcatggatggacctacctgtctgatgatggtggtagtgatgatgatgatgatgttatcctaggatataaccactattctttaacccttgaaactgaggtgcataaggtacaataattcgcccaagctcacatagataacaagtttgcagggctagaaatcttactgagtttcatctgaaatgcagactttcagagagagagagagaggatgcttagtgtgccatatcttacgtctaacaatggctaatgaatctttaaagagaggactactccctagacatgagcgtgttaggactctgttcccatttctacacatttatgcttatatgagggccattgattggccaattttagcatttctttgtactcgtgggatgatatttaaaatatttaacaactgccaggcacggtggctcacgcctgtaatcccagcactttgggaggccaaggcgggcggaacacctgaggtcgggagtttgagaccagcctgaccaacatggagaaaccctgtctctactaaaaatacaaaattagccagatgtggtggcccatgcctgtaattccagctactcggaaggctgaggcaggagaatcacttgaacctgggaggtggaggttgcagtgagtcgagatcgcaccattgcactccagcctgggctacaagagtgaaactccatctcaaaaaaaataataaaataaaataaaatatttaacaactaatatgtcatgagcattgaccaatcaaaatagatgcaatcgtaggctgaactggagtctaagaggcccttgctttgccaggtaccttttagctaacaggtcacgagtatgtctggggagttctgggatgaggggctagtgcagctaggacagaagttatttaccaacttgtatgaaaatatttttttagtattttaataaccaatgcagctatcctaatgtaatctgactaaatattagcacagcatcttgcccagcaagccaagacaacagtggttgttgtgatgttcataaggacatctcttcttggtgtttatgcatgcaatacatgagagttacaagattcctgggctaggcacagtggcccatgcctgtaatcccagcactttgggaggctgaggtgggtggatcacctgaggtcggaagttcgagaccagcctgaccaacatggagaaaccctgtctttactaaaattacaaaattagccgagcatagtggtgcatgcctgtaatcccagctactcgggaggctaaggtaagagaatcgcttgaacccgggaggcggaggttgtggtgagccgagatcgcgccattgtacttcagcgtgggcaacaagactaaagctccgtctcaaaaaaaaaaaaaaaacaaagagttacaagattcccgataagtgaatgaacatgttattgagtcatggtgcaaaggcaaactatatgcatcaggcacatttttttctctcgccagcctcccaggaagttctcaaattgtgaatatttggagttagagagagagagagaatgcttagtgtgccatatcttacttgtgtatctatctcttttctaagctatgaatacctagaaggcaagggctataacctcatttctatcccagtcccctagcacagtatgtggcacagagcactcaatagttattgaacaaataaaagcattcaaccccactgatgaaaagccattctatttgtaatctagagacataaattaaagatatcagtttcctaatcttgcagaagtcattaacctagctgcaagattacttctttataaaacaatgaaaaacagtacagtgtcaccattacaccaagtgtgaggccaactggaaaatgtttataacaatcagatttgcaatgaaagaaacctggaagcaaacccagttatttgaatgaattattccccttccacctttcttgtattttatgcataatgacatgaacctttcaaattcagctttctagaatgcctgtaagattcagttatggggccgggcgcggtggctcatgcctgtaatcccagcactttgggaggctgaggcgggtggatcatgaggtcaggagttcaagaccagcctgaccaacatggtgaaaccccgtctctactaaaaatacaaaaaaaaaaaaaaaaaaaaaaaagattcagttatggtcaggctggcagtctgtataattgtttcaaatgctatgttgcatctttttgcaatagtacatcaatatgtcaggatggatactacaaacttggttattgctataatcctgaacttttaacctatatgtaggatgagcataacccgtagactaggatcaatacacaattgtgtctcctgttactttttttttttgaaacggagtctcactctgttgcccaggctggagtgcagtggcagtgatcttggctcactgcaacctccgcttcctgggttcaagtggttctcccacctcggcctcccgagtagctgggactacaggtgtgtgccaccatgcccagctaatttttgtatttttagtagagacgaggttttaccatgttggccaggctggtctcaaactcctgaccttaagtgatctgcctgccttggcctcccaaagtgctgggattacaggcgtgagccactgtgcccagcctcctgttacttctttaatatttattttgtggggattaccttgtcctacacctagatgaaaatctaggccgtttccatgacttttctgcttgcttttaggtctctaaagtttctgtgagttgctaatacaatctcagcccagaaactttttttttttttttttgagatggagtctggttctgtcgcccaggctggagtgcagtggtgcgatctcggctcactgcaacttctgcctcccgggttcaagcaattctcccgcctcagcctcccaagtaggattacaggtgggattacaggcacacaccaccatgcccagttaatttttgtatttttttagtagatacggggttttaccatgttggccacgctggtctcaaacttctgaccttgtgatctgcccgcctcagcctcccaaagtgctgggattacaggcatgagccaccgcgcctggcccagaaactattaatagaatgctaccctctagcatgctagcaatagtagcaatctaaactctcgggttttaagttaaaagtaaactgttttctgcttccaagctgggctgttgcaatgctagagggggcaaggtacttttctgctttgagaccctcctctgcaattcccttaatgtgggtaatatatttccttcagcttgccacttgcatgttgtcccagtcttctcagagctccatgccacacatattttaacaaggattctctggcggagtacgcctgaactcccagatgttcctcttggataggactgaaatacgggcacctctcactcccacgtggctcacttctagtccatggaaaacactcatgcaggtctttgccctgaaaaactctgagactacagagatcgaatcctgtctgtataccactggcatggggcaccttggcctcttcaggaatgacccagatacccctcttctgggtcccgcaacttcaaggaacacattccttttctgaatagcctgatcaatgtcccttcacttcgctcaacttgaagaatgtagcatctctgtccacatacttggcagtggggtaaggagcaagatggagcaggtgttatcatggcaacaacttcttccaaagaatgtctttcaaaatcctcttttcctccactacatttaccctttcatatttgtgaaatggatgagcaagcttccaacaaagggaatatgagaattataaaaatgattttaagaattttttggagcctggacaacatggtgaaaccccgtctctactaaaaggacaaaaattagctgggtgtggccatgcgtgcctgtaatcccggctatttattctctggcataaaaatcacttgaacctggaggcagaggttgcagtgagccaagatcatgccaccgaactccagcctgggcaacagagtgaaactccgtcgggaaaaaaaaaaaaatttgttttggggaaaattctgcatatggaaatctgtcttatacacacttttctatgtactgtttagctgatacacgtttttctatctactgtttatctgatattgccaatcactgaaaaatgcgaagagtcaaattttaatatctagttacacacaggtatgcttttgttttgttttatacctggaatgctttatatatcagtaggctatataaaattgtcaaaggcatttatgtactttgtagtgattttaggtatgggtgttgggtgctttcatttgtcaccacaaacaaacatattaccacagagtttagatgacacagtattagagtatggaatcaagctcttgtcttttgaagttgatgttgtgacctgtgtaaaaagaagttttaaaagtcaattatttaaaaaaaaaaaaaaaaagtaaagaaaagaaagaaaccagcctggccaacttggtgaaccctgtctctactgaaaataccaaaattggccgggcctagtatgcacctttaatcccagctactcgggaggctgaggcaggagaatcacttgaacccaggaggcagaggttgcagtgagccaagatcgcaccactgcaccccagcctgggtaacagagtgagactctgtctcaaaaaaaaaaaaaaaaaaaaaaaaaaaattaatgccttcacaaagacaaatatcttgtttatggtgaggaagacttaaaagcaaatctggattttctgtttgactgaaagagtctagatacaggattttagaacgatggtgattttggagtattatctgtgcagcaaaggaggaaaaacaaaacacatacaaatgaaaagtgcttctagatgatgctgagggcttggctgaggttggtgagtataaattagtattgttgctactttataattctgtgatttccttcagtatcctgcagtcaccctagtataacagcagagatagtacttgaagtatttggtccagagttagagctttacttggcagacgtggaagcagtaaggttaaaggaaattgacagggctagtaattatataatttaaatgatgaactgtggggccatgctaaattgtgaaggaagggaggccaggaatcaactaatagatggcttaaatgaaaagatttctgcaggccggtcgcagtggctcacacctgtaatcctagcactttgggaggccaaggtgggtggatcacgaggtcaggagttcgagaacagcctggccaacatggtgaaccccatctctactaaaagtacaaaaattagctgggtgtggtggcacatgcctatagtctcagctacttgggaggctgaggcaggagaatcgcttgaacctgggaggcacaggttgcagtgagctgagatcacaccattgcactccagcctgggtgacagcgcgagactctgtctcaaaaaaaaaaaaaaaaacaccgattcactctaagagcactttctcataaccttggaaagccagccaattagaactggttaagctcctcatttgtcctccttgattacctagctccctcatgaacttaacgtgtcatatatttcaggtgccccattttaaattttattgtgagcaacattccttctcttgtaacaactttattttcttagttaactaatgttttaatattgatgaattcttcccgtgtattttctaaactcaccaatttgtttttgtccagggtgttgctgcttctatggttattttgaaggtgctttttgctcaaatgagttatggactctatcaaccaaatacgggatttttgagacagaaatctgacattcagcaagggtacagaaatcttgctctctaaattgatgttaaaacataacatgtccataattaatgtattataacatttgtctataatcttcccaggtgttgaaatggtagtttcatactgcttgcctttcaacatatatggacattgtttaatccattcagaaattcagaaatattcaagataaatcacaaatacaaaacatgctgtaatgccactaatcttttctattagatttgctttaaatggtgtcatgtttatgtcttcatttacattgtccatttaataggcttccccagcagtcctgctctggtaattagctggcttatttatacctcaacaccttgagctgctacatctcatttaacttactgctctttaaagttcttgtatctcagtggttctcaaccctcaatacacattagaatcatctggggaacttttaaaaaatactgatgcctggacaccatcccagatcaattaaatcagaatctgaaagttgtagctctgagaaccatgggttcctaacctttgaccaatgccactgcaaacactgtgcttaaggtgaggttgaagcagtaaaaacaacaatccaatttttttttttttttggtttgttttttgacccagggtcttgctctgtcgcccaggctgtagtgcagtggtgtaatttctgctcactgtaacctctgcctcctgggttcaagcgattctcctgcctcagcctcccgagtagctgggactacacgcgtgtgccagcacacctggctaacttttggcatttttagtagagacagctttttgccatgttggccaggccagcctcaagtgagctgtctgccttggcctcccaaagtgctgggattacaggcatgagccaccgcatccagccagcaatccactgcttgacctcatcccttccactcttattttccttcccttggcagtaatttaaatatatatatatatatatatataattagatatcatcacattcatgggttatcaaaacttagtatttctccaccaaccctaaaatgccattggaaaatgcaatagaattctggaagtaagattgtatttgaaaattataaaagagatccatttgctttgctttcattttattgtaatgcaaagagaaacagagcaaggagactatcagcaaagacaaaggagattgaaagagcataagacatttaggaagctaaaggttgtttagcataattgagccttagaatagtttccaagggaacagggcgggcaaagctggagaggtaagcatgatccacattctgagggactttggatctcatttcaaggggtttcatcatgactggttacataacttgtgtggccacaaaaagtatgtagccagtacaatatgaaaatgtggggcccttgttaaaaatcattgagaatttcaagatgtcagcataagagtattaaaccatgcacagggctcttctaaacattggcctgtgtgtgactgcacaggacttatgcccaggaagttggccctgggtttaattatatcctgagggtgatgtgggacctaaaagatttaggcagtgacttgaggtcattgtaaagattgttctgaccttggttggaaaatggattgttggacccagagaacaaggttctacaatggctttaagaaagctagtgtatctgtcttggccgggctggtcacgcctgtaatcccaacacactgggaggccgaggcaggtgtatcacttgaggttgggagcttgagaccagcctggccaacgtggtgaaaccctgtctctactaaaatacaaaaaaagaaaaaaattagccaggagtggtggcaggtgcctgtaatcccagctactgtagaggctgagacaggagaattgcttgaacccttgaacccggcaggcagaggttgcagtgagccaagaccatgccactgactccagcctgggtaacagagccaggctctgtcaaaaaaaaaacaaaaaagctgggtgctgtggctcatgcctgtaatcccagccctttgggaggccgaggcgggcagatcacctgaggtcaggagtttgagaccagcctggccaacatggtgaaaccccgtctctactaaaaaatacaaaaaaattatccaggcatgttggcacgtgcccataatcccagctacttggtggctgaggcaggagaattgcttgaacctgggaggtagaggagacagaggttgtggtgagccgagatcgcaccactgcattccagcctgggcaacaagagcaaaaactctgtctcaaaaaaataaaaataaattttaaaaagctagtgtgtctatctccatattttttctgtgaattttaactattgtgatggtaatattagtgataggaccaggaatagcttctactaatacaacaagtaaacaaagtaaacacttttttttttttgagacagagtctcactctgttgccaggctggagtgcagtggcgcgttctgggctcactgcaacctccgcctcctggtttcaagcgattctcccacctcagcctcccaagtagctgagattacaggcacccgccacatctcccggctaatttttgtttttgtattttagtagagatggggtttcaccatgttggtcaggctggtctcgaacgcatgacctcaggtgattcccccacctcagcctcccaaagtgctggaattacaggcatgagccaccgggcccagcaagtaaacactttcatatacaatactgtcatttgatccttcaactatctggttgtcaggcaaggcatatgttattatccttagtttacagataaggaaacagttaagtcacttgccaaaaattacatgactagtgattgatgtatacaggatttgaatcagcccttctgacatttacactactgatatttctgctctattaatactgctagttttattagctacttatagaagcaattttttttttttttttttgagacagagtcttgctctgtcacccaggctggagtgcagtggatcctcctgcctcagcctcctgaataggtgggaccacaggtgcatgacaccacaccaggctaattttttaatctttatttttgtagaaacagggtcttgccatgttgcccaggctggtctagaactcctgggctcaagcagtcctcctgtgtcaccctcctaatatagaagcaatttttaaaacatccatttgtacagtatttagtagattttattaaattgtaactgaagttattgtctactgtgttttcaaagcctctcattacagagatccacatgatgaaatttgtactaccagaaagatctttatgtagaaagatgtctgttttcttttaatcagatgttaaaaattatgttacatgcatcactcttttagcctagctgccagagaacctatgtgccaatttaatacccaatttttttttttttttttgagacggagtctcactctgtcaccaggctggagtgcagtggggcgatcttggctcactgcaacctccgcctcctgggttcaagcgattcccctgcctcagcctcccgagtagctgggactacagggatgtgccaccatgcccggctaatttttaatatccaatttttaaaactagctcatacagctcctcaactcactcaagagcatgtctactattgttatcgttgataatgctattttcacattatatttaactttcttatattaaatgttataagttgcttcaaatatatttggaagcggtcaggatataaattcttaataaactaaataatagccatttggaaatttatgcaaaagaaaaaagcagtgtttaaatggctgagcaatagtataacagacttacccactcaagcttattaaagccagaattaactgacaagtcagataagcattccctaattaaatgaaagaggagaatgaataataacatgaaagtgaaaaaggatgtgtgagcctacaaaagacttaggccaacaaatctactcttagagattttctaatgtcactataaattctagtacctctgtgtcctactcaatatctctcgtgtttttatcgtcttccatgcttaggtcttgtttttattttaggcctgtctttgttgatatttctttcttttttttttttttttttttttttttgagacggagtctagctctgtcgccagtctggagtgcagtggcacaatatcttggctcactgcaacctccgcctcccaggttcaggccattctcctgcctcagcctcccgagtagctgggattacaggcatgcaccaccaggcccagctaatttttgtatttttagtggagacggggtttcaccatgttggccaggatggtctctgtctcctgacctcgtaatctgcccaccttggcctcccaaagtgttgggattacaggcgtgagccactgcccccggtctttgttgacatttctttattattattttgtgtatgtcatgactagggatttagatatttgaaggccttgtcttttataatagatataacaagtaaatttaggaactttatattttataaatagttgattatttttatagactcactatgtttagattgttttaggtgtttatttctttttgtaatttaagcacttagacttagttacactccagggaaaaacaacattcttttaatagtcttggtttcacattttcttgattctcttgtctatctttgtttgttcctaatttgtacataaatagtgattaaagttcagagtggctactgcaaaagataatgtttgaatttcaaaacttaccttatttcttttatgatattaatatgttcgaagtatcaagtaaaattttagcatttgagaccatgtggaatataagcttctatgtataggggagatcttataaaaacagcttgaaggaaggtgttcagcagaatttattggctggattgaatatctagtccaccattcacccctatatttgaatggattccttgccttcttatcctgggtaggttcgtagtttatcttgtcacatgccagccgttgttgtccaccctggacttcgcctcttaagtaatagacagcccctgactttcacccataaattatctgatggtgactggtttgcctccttggttttctttcactgcccagtgccagcctatctaagcaagatctctataaagataacatccttatttattaggactggaaagtaatttagaaacattccagttcgttggtcttaatttatggatgagaaaactgagacccagaaagaggaagtgacttacatctgtattgaataacattttgtaacatattggaatccaaacatgcagattatttctatagcactttgtctagtttttttaagaaattatatttctctttgagttattcaagttatatttgtgcatattagttacaggaggcagattagtctttcttactttatttcacacagatgattataggaatgtagagcatccacaagaaaaaaatcaatagcacttaatataacaatttagatatatcatactctattgaactttgaagctatttgttatacactatcatcatcatatttttttctcttaaacatatgtaggtcataaaattgaattgtaaaattgcgagtaatttttataatttagcaaatattcaactaatatttacggagttccaggtatgtgacattacatttgtgttttctttacgccatcactacttgatcttgcttttgtgtacgaaacacttcatctgcttttataattttcctctattttaccttctttcttcatttcccttggctgtcttcactagtcccaaaactttaatcaacgctttaacatgcaggactattagctttatgtctcccttttttgctcactctttgacacaccagccctaatcttctaaccattaactccatgtttctacctagatatagatccttaacccccgaactcagtatatttactaataaactcattcatcttcctctggaatctatttcttttaatgttaccatcactttccttagttatacaggtttatcactggtggttttcttgataccactctctcttgcctcccacatccattcaataattatcatttttaccatttgtttagcatttaccatgagcttttggaattcaaatattatcttttgcagtagccactttgaacttttgtcactattcacgtatgaattaggaacaaacaaaggtagacaagagaatcatgaaaatgtgaaaccaatactattaaaacaatgttgcttttccctggagtgtaattaagtctaagtgcttaaattacgacaatgaaataaacacctaaaacaatctaaacatagtgattctataaaaataatcaaatatgtgccaggcctttaacatttcatcctcagaactatcctatgagttaggagttactatggtctccattttacagttggatcaactgaggcacagagaaattagggaccttcctaaattcagaagactagtaaacagaagagttaagattcaaatctacacaatctgactctatagttaaggctcttaatcactgcattcagttgcttgctaaattaatacatgctgtattttcttcttttttttttttttgagatggagtttcacttttgtcgcctatgctggagtgcaatggcctaatctcagctcactgcaacctccgcctctcaggttcaagctattctcctgcctcagcctcctgagtagctgggattacaggcgtgcaccaccatgcccagctaatttttgtatttttagtagagacagggcttcaccacgttggccaggctggtctcgaactcctaacttcaggtcatctgcccacttcaacctcccagagtgctgggattacagggttgagccaccatacgcagccatattttcttcttttacaatgtatttgttcccatctagtcactttctattattaccttggcacaagctctcattacttcttgccagaactattgcagtagtagtctagccagttcccccgtctctacctccctccagtccatttcatatactttcctgagataaatctttcccaagcatggctaggtgtatttagctgtccttagcctagagaaaaatggagtggctccaaactaattaggcccttgaataatataggaattttccctactacccttcatttatcttgtgatctaagcaaacttaattacttcctgaaacaccattctctttatgtattaatttatctatgcctgaagttgtcagctttatgttcttatttatgtatattattttataattatccatattatacattatcctgtgtacatgtatctctgggacatatagctattgtatatgtgtattgcttgttttccctctgagatctttaaattctctcacatgtaagcatatgttgttgatgtattctgaaaatgttttttatgtgtcattggcgtgattgtgattttacaccataatttcccaatgtttatgtaaacattataggaactctgtatttgaatatgaaactctttatgccattagggcatttgccccatctataccttttctggttcctattttaaccagggacatgaatttgtagcctggccagctatagttataggtattggctacagaacttttttttttttttttttgagacggagttttgctcttgttgcccaggctggagtgcagtggcatgatcgcggctcaccgcaacctctgcctttcgggttcaagcgattctcctgcctcaggctcccaagtagctgggattacaggcatgcgccaccacgcccggctaattttgtatttttagtagagatagggtttctccatgttggtcaggctggtctcgaactcccgacctcaggtgatctgcccacctcagcctcccaaagtgctgggattacaggtgtgagccaccaggcctggcctttttttttttttttttttttttttttttttttttaaacaaaactaactggctcttacaagaatcagactcatgaccttggcctcattagcactatgagctaaccaagtctgacatatagaaattacacaagcgacaactcataagagaaaccagaactgtaagatggccttttggaaataattttcttaaagagcatatccaaatggagaccttcatttagcagcttataacaaattcttgatcgcagagttgcttcattttaagagtgaaaaacaatataacaatagcagtagaaattgaaagcagggaagttttcctgacatattgttttctttcttgtataatgtagatttatttagaacaggggctctaaccacctgtcagtaatatgtttctgtcaattttcctgtagatttttattcatggaaatagcactggtggcaaacatgagctagtgagtgaaagtatcctacacaattccccaaacgcctctgccagtttattttagtgttaatttttagtgcactttttttttttttttttttcagtgtggttggagcaaaacagagattaagagaaaattgctatggttctactggtttggataaatgggacaggtgccaacaattaccactggtgtgacttttccccccaatataagcattactattatgactattttgtttcctccttttacaaaatgccaggtggaatttatagagttcttattgtgaaaactaagacctattcctgattcttttctgaatttcatgactttgggaatatcctttagtttatatactacagttaccccctccataatatggggataccatggtgttaagattgatgtaagaattaatgtgtttaccagtcagtcttctagccaaacaaaaataagacacatttgcacagctttagttgtcagagaggtctggagcaattgttacatcctatatatacttctgcttgtgattttgagggcttagggtatgttgcttcaatcatatttataactaatgctgtatttttttactatttctgattgctaccttaactaaattaattttttcctcataccctgatactaggcatttggaatttagtaagtagctgaaatttgaataaatagcaaaaacggtataagtttttcaggttttttttttttttttttgagctggctagaacagacacatggattgaacatgatatctgacattgttgataatataatgagtaatatcaaggaacggtgaaggaagtgttgtagtttctaattttttcaatatggaagtgaatctactctatgataagtgcaacacagcttatctaatgctacttaaattgaaaaaaaaatgagagttccatgataagatttaaaaagtcatgtttgcaaaactcatttgaatagtcagaagtatagaaagtcgtcattaggcagctcttcatatatttgttactaaatcatctatgcagttacagattttatatatgtgtttttttcacatttaccattaagggactcttagtcctttttttttttttttttttattgaaacggagtctcactgtgttacccaggctggggtgtagtggcgcgatcttggctcactgcaagctccgcctcccgggttcacgcctttctcctaccccagcctcccaagtagctgggactacaggtgtccaccaccacgcccagctaatttttttttgtattttttagtagagacggggtttcaccgtgtcagcctgaatcgtctcgatctactgacctcgtgatccgcccgcctccgcctcccaaagtgctgggattacaggcgtgagccaccgtgcccagcctcttagtccttttcttacctgtgtgagtttatcagtgctacacaaaccaggaagaatgttaatttgctggctgcctcccttgagctgtttaccacgtttttgaggcagaatagaaaaggaaaggaacttaattgagtgtaataaactttaaaaaatctttccaggccaattgagcagtcatttcattacttttaagacaagcagggaatgatctataaagagggaaaataagaggaactagctgtgaggactaaatgaaacaaagacataaagagtacagcatagtataaagcacatggtatcctctaaatagtaataataatggttattggtaaggccttgaactaaattatgcttgaactaaatatacccaaaaacataacaattcagatttaaaaatgatgaattgcccagtgacgtttaccatcaacccctatggataagatgtttcattttagagagtgcttggtagaaaatgctagatggaaaagtcagaggattctttgttacagactacatagcttgaaatttatcttgtaataatgcattaatggaaaaataggaagacctcaatcatagattcaacttttagcactgggtgcaatgtccctcatttttgagatactgcgagattcagatgatttgcccaaggtcataccatttgttagtgaccaaagaagatcttgaacctcagacatctgatataaagttattccagtgttctttttattttaacaacctgacatcaggatggatattataaaaatagcgccaaatgtcagtctaaagcaaaatatttttgtatttcaataaaaaaatgaaaattatacattggatgaaatgtatatgactaaagtaaacaggcttttgaaatttaaatcaaggctctttcatagaatctgcataataaatgccatttatagttaatttattctatatgtcatatatttaaaatgcattcaaaatcaaatatcaagactaaattgtactccagttgaaaatccatgacaattttctctttgtctaaatcctagctgatatttgtttattgcacccctttcttttagaataatagaagcttgagaactatgcttggtaatataacaagaaagcatgattatagatataaatgatgtaacaagaattctattcccagttgtgcgttgtaagactgacaaacattggattaatgttgaataggtcatttgcaattctatgctgtttgtagagaaatcatattttgctattcttaggaacttacatatgagtttgttttggaggttttctgaaacatgaaagacataaaaaagacagacttttcctgtagcaattcatggaatacgttgtacattgttcttcctaaactacgtaactctctatgtgaataagacatcatatcctacaagccttacaaactttgactgtccctggacctcttgtgagaataaattaaagatgtcatgtctcatatattttgttatcagtgaggaaaaagaaataacattttctttttcatattttggtagagagtgcatatgattgatagtgaaatacatgcctatagtaactatttgtagttatatatagatggaacaattcagtgacgctttccaactttatcaggacctaagacttttacctttccaagtccaaagtgactaactgtaactctactagtaatttttttaaaaagcttatttaaaaaaaaaaaaaaaaacaagaagaatgtctccggccgggcgcggtggctcacgcctgtaatcccagcactttgggaggccgaggcgggcggatcacaaggtcaggagattgagaccatcctggctaacacggtgaaaccccgtctctactaaaaatacaaaaaattagccgggcatggtggcgggcgcctgtagtcccagctacttgggaggctgaggcaggagaatggcgtgaacccgggaggcggaggttgctgtgagccgagatcacgccactgcactccagcctgggccacagagcaagactccgtcttaaaaaaaaaaaaaaaaaaaaaaaaaaaaaaaaaagaagaagaagaatgtctccatagttattcataacaattgtgaaaatttaagtaattggccgggcgcagtggctcacgcctgtaatcccagcactttgggaggccgaggtgggcggattacaaagtcaggagatcgacatcgcgccactgcactccagcgtaggccacagagcgagactccgtctcaaaaaaaaaaaaaaaaaaaaagaaaatttaagtaattggatgagttgttttcgtataaattggatgtatacgtttgatgtcctcattgtgttcagcaagctaagatgtatatgtacagttaaacatgagtcatgccctctatgatgagtttaaacatttaaaccaaatatttgttacatatgatacattaagtacaaatgttttttatctatggtaccttaatttatataacatatcttaggttataaactgtttgtttataacaacaaataaagcgaagtattcaaaatggcttgtagcaaggtgctgagacatgtgaaggagtgccagattgttcttgataatttacttcccacctctgactcacttttacatggtcagctttcagagaataagcacaaagatgttagcaaaattaagggcactttaaagtttttgttgagatgtttttaagtcttaaacaaaatttcaaatccagagatttgtgggaccaaaatgatgaattaaaagagaaggattcagtgtattttctgaaaaattattcattacctatagctgatacgaccagtgccagccatgaattacctagtccccatgcattgacagctgatttacattcttgcgccagctccttatctcatagtagatcaggcgtttgagtagcatagcattagcttatctgtttttttaagatcaatagaactcaacaaaggacgatagaactgtataccccagtcaataagttagacacttattaaaccttttataaaagtattggatatggccgagcacagtggctcacgcctgtaatcccagcactttgggaggccgaggcgggcagatcacaaggtcaagagatcgagaacatcctggtcaacatggtgaaaccccatctctactaaaaatacaaaaattagctaggcatggtggtgcgtgcctgtagtcccagctattcaggaggttgaagcaggagaatcacttgaacccgggaggcagaggttgcagtgagctgagatcgcaccactgcactccagcctgacgatagagcaagactccatctcaaaaaaaaaaaaaaaaaaaaaagtattggacactcagccaggcatggtggctcacacctgtaatcccagcactttgggaggccgaggtgggcggatcacctgagggcaggagctcaagaccaacctggccaatatggtgaaaccctgtctctacttaaaaatacaaaaaattagccgggtgtggtggtgcatgcctgtaatcctagctacccaggaggctgaggcaggagaattgcttgaacttgggaggcagaggttgcagtgagatgagactgtgccattgcactccagcctgggcagcaagagcaaaactctatctccaaaaaataaaaattaaaaaataaaataaaataaaatagtattggacactcatcctctgaggaggcagtgtaactgggtgagaaaaaactctcttatatatcctttaggtacagctctgatttctgatgataagcttgctataaaacaatctattaaaaatgattctggctgggcatggtggctcatgtcccaaagtcatcccagcactttgggagactgaggcaggcagatcatctgaggtcaggagttcaagaccagcctggccaacatggtgaaacccgtctctaccaaaaatacaaaaattagccgggcgcggtgtcgtgcgcctatagtcacagctacttgggtggctgaggcatgagaatcgcttgaacccaggaggcggaggttgcagtgagccgagatcgcgccactgcactccagcctaggggatagagtgagactctgtctccaaaacaaaagatatctcctataccttgcataagcaaatgatgtgaggaaaacttgcttaattaagatcccaattttgttttggtgcttttgacactcttcatgcttgactaaactttttcattatggatttgcatttcttttactttttcttttcttttacttttcatttcttttacttatatgaataaaaggtctattcccttattggtttgaatttgggttacttggtgtctttggtcagtaaagagaaataatttgttttagcatccaatggattatggtctgcttcccaattgtttttgtttttcaattccatcctgatactggaacaacagatcatcttgtttttgctacaaacaggtgacacccaactatagtttgtgtatattgtaagacatacagagagtgttacaaattcccagtgttttcctctgtttcttagtcctgtactattcaggaattgtttcacacgagccttgataaactagctttctcaagaaagaaggttatgatatgttgttgttttgagatgttgaaattatgttaaattatgcataggaggtattatttatttattgagtttagtgctcccaaactgtattctacagaatattgttctacaggatgttacaataatgttaaaaaagggaaagaaaaagtatggaggtagtcaaggggatcatctgtggcaaataagttgtgaatgtgctgggttaaacaaagacaaacagatctattttctgcagaacttctcatgacttttaatatgctatttttattgtaaatctataaggggctatactataaaacatttctctaacttatttagccatggggtgtgtgtgtgtgtgtaatactttttaacatctcaagtatggcacacagtttgggaaaaggtggtctagctatttgttcttgtatgcaaaaggcatgggtaaaatggacacaggacaaaattgttaaaatgttgtttgtaacatgcctacagaccttgttggcaaagcttcctgattataggaaatccccattgaaatattcagggggagaaaaaaatcaaataggattattttttaaatgcattggctataacaccctgtatgttgaatgtgggaaatagactaattttagctaatatataaataaacagtatggattatatcaaacccaggacttcagaacattatgaagctgtgcataagtgcaagcctgagtattgttaattagtaaggatgtggttttcagatcatgtcatccagttataacaacataccataaacactgtccaagcattgtcagtttgtaaacgtatcatttgctgtgagttacttaaaacattcaaaaggtgtttaacaacagtaatagttgatctgagaagaaatcacagtggtcgatcttgaataattataacagcagtattaaaaccatgggactgcagtgaagctgtgatcatgaaagaacctcatgttacaacataaaactctctgtgaaccattactgagaacagaacaacactgaaaaaggcccggatagatatattgctagaaacagttgccctagttatttagtttcaaaatgaagtagcagagaatcccatatgggaaaagtacttgtacatatctctgtgatggtgttcatctcacgatgtttgattccattttgatgggtttgttgatagcatgattcctgctgtcactatgatttgtgtttattatagctgtttcctttttaataaaggatgctgttgcatataaacactgacatgaagctatcttttcagaaattgcattctgtatgctgatatagtcattgcaatgttgtaaagtgagtattttgctaccaacagagttggattatatattttaatatatcgattagtgtattttgttgtttcaatataagaaaggacctatagttatatttattttgcatttgttcttaggtagtatacacactttcaaggagagatagcacagtaggcaatacaatgtggctgaagcacaccttgatagaagaacaaataaaggactgggcagaggtgaaaatgattatgtaggaagtaggagaaagtcagattcaccatagtcgaagagtcatggcaggagaccattgaaagtcaagaggcaccatctgtcctaagctgagctgaggcagtgtctaactgccatagccaagagtaggagctaagaaatctcagaccgagaaaatagccaaagattgaggggctaggttgggcgcggtggctcatgcctgtaatcccatcactctgggaggccgaggcaggtggatcacctgaggtcaggaattaaagaccagcctggtcaacatggtgaaactctgtctccactaaatacacaaaaattagctgggcgtggtggcgggcgcctgtaatcccagctacttaggaagctgagataggagaatcacttgaacccaggaggcagagattgcagtgagaaaagattgcaccattgcactccagcctgggcaagaagagagaaactccgtctcaaaaaacaaacaaacaaacaaaaaacaacaataacaacaaaattggctaggcgcggtggctcatgcctgtaatcccagcactttgggaggccgaggcaggcagattacctgaggtcaggagttcgagaccaacctggacaacatggtgaaacctcatctctacttaaaaaaagacaaaaattagctggacgtggtggtgcgtgcctgtaatcccagctacttgggaggctgaggcagggagaatcacttgaacctgtgaagtggaggttgcagtgagccaggatcatgccattgcactccagcctgggcgacagagcgagactccttctccaaaaaaaaaaaaaaaaagaaagaaagaaagaatgggaaatgggaggcaagaaggtagggaactgtcactagggcagttcagctggttgtgctgaatagtgtttttctcacctagagctgcttttaacaacctcatacctaatggcattttaaattttatgtctggccccagaaaaaggtttgcctgtaaaataaattgaacatgattgaatagaaagtataaagaaaaaaaaaaaaccttccgtacatctggtttaattaatttacagtcctctagcaaagtgtcattaaaggcatttctgatcagatccagattggcagcaaatccaaacccatcatttcctctctccttttttgcctccccgcatctctccttcttaggttagaaaaggatctgtttgaattagccaaggatatactacgttgtagatggtgagggcagaagtacattaagcagaattcagcataactctctttggcccccagagtagcttcagggggcagggccattggtggtggtgaggttgtggggagggtttgtggtatgtagggataaccttcctggcccctttctgtaagctgtcaccagatctggaatgttcaaatcttgctgtatcactgctctttttcatacagacctatcattaccattcaggaagaatttctgcaatctatatacgttctcatttaatgggatatttacaaattctgagccttccttatctctgaaccaaattcagcattaccaatactgccaggtatcctggaacaacatctcgttttccatttccttgcaatccgtttatcattttccttcttctccacatgccaatacactctctaatttctttgtatctgggtggttatgatactgccctgtttttggagggccacagtaacaaattcatttcctcgtgagtatttgttcttacttatccaaattagccttatggaagcacttgtaacagataaacatttgctttggaactttgtgctcttaccttaaaggaactagctttaagctttgaatctgaagtaggaatagagataagaaaaaaagactttccacactaaagagacagttaacaaaggctgagaagtgggaaactctgaaaggtaaggggcaccgaattgttacatttaattggattattggatagataatgaattgtgaatggggcagtttaagataagacagaaatgtctattgagaccagacccctctgggtcttgagtacctaaggaagaagctcttattatatgtataaataaggtttttgagtagaaccccactgaaaggctgcttgctgacttgaataaaaagccactgttgaatcaccaggatgatcttgccagttacaaaacccttgccttgtgaaactaaaagtttattcctataaagtagaaatagtcatagctgactctgtatgggaaaaaatgaaatgagcatttatgcaaaagcttgaagcatgcacctgcctttcaggtttaatccttgtgtctcatttggcaaaccagttgtaccctttgtctgaaacactcctgcacttcatctgaatggaaaccctttcatttctgttatgagattgaataaccaggtgattggaggaagactacagttaagtgtgatttatagacaatagattttgccagaggagattttgaagctatgtaaaaattctttttattttttcatgatatttactaaggttttatcgatttcagattcagtctcaatataaaatagtaataacattagtggtacaaatttcattagcacatacttagatgtaagaaatcataggctgggtgcggtggctcactcctataatcccagcactttgggaggttgaggcgggtggatcacctgaggtcaggggttcaagaccagcctgaccaacatggagaaaccccatctctactaaaaatacaaaattagccgggcgtggtggcgcatgcctgtaatctcagctactcgggaggctgaggcaggagaatcacttgaacctgggaggcagaggttgcagtgagacaagattgcgccattgcactccagcctgggcaacaagaacaagactctgtctcaaaaaaaaaaaaaaaaaagaaaaagaaaaagatatcattactatagattagattggcatgactcaaccttctttagaggttagttgtttctactgagtatgtttgccatttggagatctggcatttggggagtatttgtgcttcaggtggtttgaaaggcagatcttataagtttataacattgtcatctattttcaataggtttttgatattgaaaggaatcatttccaaacagtatcactactgtctaaacactgagtagttacacatacatattagcaatgactaaaaaaatactgtttgcagcaaggttggaaagaaatagaatgatctaggcataaaccacatatcttcctaattaaatgaaacagtatttcattgctgcttaacctactcttgtcttacagattgaccttgactcaattccaggtcagaagtcttcccacactgtgcttattaaggtctctggcatttgaaatggcagagctgctctaatcttcaaatcccatcgctttactttgcttgctatactcccttttccctcacttctgtacagcctacaagtcttatgtgttaaaaagcctctgctaaggccaggcgcggtggctcacgtctgtaatcccagcatttttaggaggctgaggctggcagatcacctgaggtcaggagttccagaccagcctgaccaacatggtgaaaccccatcttttttttttttttttttttttttgagacggagtctcgcactgtcgtccaggctggagtgcactggcatgatctcggctcactgcaagctcggcctcccgggttcacaccattctcctgcctcagcctcccaagtagctgtgactacaggcacctgccaccacgcccggcaaatttttttgtatttttagtagagacggggtttcaccatgttagccaggatggatgaaaccccatctttactaaaaattcaaaattagctgggcgtggtggtgcatgcctgtaaccccagctacttgggaggctgaggcaggagatggctcgaacctgggaggcagaggttgtagtgagctgagatcgtgccattgcactccagcctggggaacaagagtgaaactccgtctcaaaaaaacaaaacaaaacaaaaagcctctgctagcagatttttgatcaacattttcttttatcagtggcttgctcaattttatttatttattttttttttgagacggagtctcgctgtgtcatccaggctgaagtgcagtggcgtgatcttggcttactgcaacatctgcctcctgggttcaagcgactcctgcctcagcctcccgagtagctgggattacaggcatgaaccaccacacctggctattttttatatttttagtagagacggggtttcaccatactggccaggctggtctctcgaactcctggcctcaggtgatccgcccacctcagcctcccaaagtgctggaattacaggcatgagccaccgcgcccggccaattttacattttttatacccaattttcattgatgcattctcaagacttaaataataatgaagtgcctgcccatatgtaatatttcctgatactccatgggctttagcggtaaggtaactttgtcatataagaacctaaaataactgtagttacacttttaaaatagcttgttttgctagtgttgctatagaaaatgctttataaataacatttcaagaactgtgtttctctgaatctccttatcgttgccagaatgtttcccagtaacttatctgtatctacaaagaaagtgctatgtttagatactggtcagttctaagtcattttcattgatgacaacattaaatataagttatacaaaatagtagatattccaactaaaattttatctcttctttgtgaaggatctgtttcagtccttaagaaatagagtcatttgaatgggaaaacctagaaacagttttaaggcccagggtatggtgaagtcaccaacctgtttcttctctgccagttctaatcttgacataacaagaaagttactggacaatcaatcatgacctttaggggtgtgggggaaggaaaagaaaagacaagtttaggcagctcctctatttctaaagaatgtcatagagaaatttaaagaaatccttgctatactttacctggccccctcctggattaactcatgaggcaaatgagatttcctcactctgaatttgcaaagcgacaaaatttccaccaaagaatcagcatgaatgggatttgaagaatggaataaaaagtgaattaaattactgatcaccctaattttcaatactcattcattcattcagcaaaaatttattaagtgcctcctaatctgctagatagtgttgtaggttctggaaataccatagtacacagataaacatttctgccttcctggagcttatgtaatagtaaggaaaaacagatgaaataaagacattgcaaagtatgttcaaaggcgataaatgccatagggtataaaagtgaagagggagtttggtggtatgttcgtattttagatagcacagagggaaagccttattgacttggtgagttctgaataaggatctaaagaaagttaagtcatgcagatatgtggggaaagagcattccaagcattccaaatgcaaagaccctgaggcaaaaagctggtgtgttccaggaaaagtaaaagtagtgagtccagttgcctgaagctcatgaatgagagggagagtcgtagaagataaggtaagaaaaattgtgaggggtggagggagttgtacacccaaatgatatagaaacttatggatctgccgggtgtggtggggtggctcgcgactgtaatctcagcgctttgggacgctgatgcgggcagatcacttgaggtcaggagtttgagaccagcctggccaacatggtgaaaccccatctctaccaaaaaatataaaaattagccgggcatggtggcaggcgcctgtaatcgcgctacttgggaggctggggcaagagaattgcttgaacctgggaggcggaggttgcagtgagccgagattgcgccattgcactccagcctgggcgacagagcgagactccatctcaaaaaataaaaaaaagaaaaaattagaaaaagaaacttgtgggtcataataaggacctgagctattatttaaagatgagaagccattgaaaggttttgagtggaggagagacatgcactcagttaggtacaaacagaatcaccctgaataatgtgttaagaacagactgataagcaaggcagatgggaagcagggagacccataggaagtaattgcaataatctaggagactattgcagtaatctaggctagtattagtagaggtgatgaaaagtagccgaatacctagatatgatgtaaatgcccagtgggttcaccttgccagctacctagacagagctgatttatcaagataggacagttgcaataaagaaagagtaattcactcagagccagctgtgcagtacaccagagttttattactcaaatcagtctccctgagcattcggggatcagagtttttaaggacaacttggtggggggaagcctgtgagccgggagtgctgattggttaggtcagagatgaaatcatagggagtcaaagctgtcttcttgtgctgagttagttcctgggtgcggggacacaagatcagatgagccagtttatctatcagggtgatgccagctgatccatcaagtgcagggtctgcacaatttctcaagcactgatcttaggagcagtttagggagtttcagaatcttgtagcctccagctgcatgactcctaaaccataatccctggctaatttgttagtcctacaaaggcagtctagtctccaggaaagaagggaatttgccttgggaaatgccgttatcatcttttttttttgggtgggggaggacagagtctcgcctgtggcctaggctggagtgcagtggaacaatctcggctcactgcaagctctgtctcctgggttcataccattctcctgcctcagcctccccagtagctgggactacaggcgcccgccaccaagcccggctagttttttgtgttttttagtagaggcggggtttcaccatgttagccaggatggtctcgatctcctaacctcatgatccgcccacctcagcctcccaaggtgctgggattacaggcgtgagccaccatgccggcctatcatctttgttttaaactataaactaagttcctcctaaagttagttcagcctacgcccaggaatgaacaaggacagcttggaggttaaaagcaagatgaagttggttaggtcagatgtctttcactgtctcagttacaattttgcaatgctagtttcaatgtcagtttgtaccatatgaaattgccaatatttgatcacttttgatcaatagaatcctttttttttttttttttttttttttttgagatggagctctgttgctcaggctggagtgcagtgtcatgttctcagctcattgcaacctcctcctccccagttcaagagattctcctgcctcagcctcccgagtagctgggattacaggtgcctgccaccacgcccggctaatttttatatttttagtagagacggggttttgccatgctggccaggctggtcttgaactcctgatctcaggtgatctgccgcctcagccctccaaagtgctgggattacgggcatcggccagtgcacccggcaagaatccataatttctagtggttctttctaactttttgaaagtagaatggatagaagtttactaaaattatacactagatgtgtgggatatgagaggagtgaaggaaaattcccaaggcttttgagctaagcacatggtaagaatagagttgtcattaactgagacaatggagagcccatggctattaattggacacttctgagctagtcagctttagtttaccgaagtctaaattcaggcagcttttggctgggcgcggtggctcacacctgtaatcccagcacttcgggaggctgaggtgggcggatcacgaggtcaggagatcgagaccatcctgtctaacatggtgaaatcctgtctctactaaaaatataagaaaaaaaaatttagccgggcgtggtggcgggtgcctgtagtcccagctactggggaggttgaggtaggagaatggcgtgaacccgggaggcagagtttgcagtgatccgagatcgcgccactgcactccagcctgggagacagagtgagactccgtctcaaaataaaataaaataataaattcaggcagcttttttgttgctgtatactagtggtcacaagtgaacactggataatatgcacaattcattgtagatccatccacattgctggcaaaaataatcaagctttcctgttacactgattgatactgggtctgtgtggtcatcttcttataagaaatatggtcatcttcatagaaaaataactttatatcttttatataacatggtttgaaaaatgtgatttcaactttgtcatcgtgctgcttctttcaacttttattgtctaagctcattttcttcattttattatattctttcatgacttcctctcactctaaatcagttaagattcagctagaatatatgttggtacatacaatttggaaagattgtctttatgttctgtgatcaaatgtgaaaaatagaaccatggagtcaaaacagagtaaggctttactgtttttttttgagacagagtctccctctctcgccccggctggagtgcagtggtgtgatctcggctcactgcaacatccacctcccgggttcaagcgatttttctgtctcagcttcccaagtagctgggattacaggagtccaccaccatgcccggctaattttttgtatttttagtagagacaggttttcaccatgttggctaggctggtatcgaactcctgacctcaagtgatccacccgcctcggcttcccaaagtgctaggattacaggcatgagccaccgtgcccggcctggctttactgttttgtaaaactgctttcaggaagtaattaaggtagatacacacaagcccaagttgaacaacattatatctcacttactttgaatggcctagtcaggaatattgtatatatccataaacgtgaaagtaaaacatttgacgatgtattttctttaggtgtattaagatataaggccaggctgggcatggtggctcatacctgtaatcccaacactttgagtggctgaggtgggaagatcacttgagcccaggatttcaagacgagcctgggacacatagtgaaaccctgtctctacaaaaaaaaaaaaaaaaattatctaggtgtggtggcgcacacctgtagtcccagctactcggtaggctaagacagggaggatcactttagccctgaaggttgaggctgcagtgtgctatgatcatgccactgcactgcagtctggaagacagagtgagattctgtctcaaaaaataataataataatggtatgaggccagttcatcacagtaaaaaataatattgtggaaaatctatagtgttgagttagattcaacttagaaattagcaaacactgataactacttgtcaaaaatgctgataatgtactttcaatagaggtcacagtatttgtctagaatgagttaaagataagagtctatacctttgctgtgactttatctttttgcctgactagtgtctctttgatatatatctttctatactgtaggggctgatttcttctgcgtttgaatttatgaggcaaatagaattggactgaaaaggtgttagagaatttagagaaatacttaaatgaatcactcagtttgtttaaatttagaaacaataaaagctgtttgttcaggctactattttcaagataccatgttgtgtatgagcataaatagtgccccaggttgctggaaggcaggcttggttttgtttttgagaaatgttttagttgaacaatttttaaaagaagaattgatccacatgtttaacatttcactcccccagaccagcctgggcaacatggtaaaacaggaaaggaagatgagaaataatattctcctattattatggaaacatacctttaatatatggccattgactgaatgcttagttttacttatcattctccttttttgttagactcttagccttcttctccctgcccttaaagaccctataagagagaaaaacaggtatacaagtcagttgccatggtgcacaactgtagtttcagctattcaggaagctgaggcatgatgattgcttgagaccaggagatctgggctgcagtaacgatcatggtgcctgtaagtagccactgcaccctagccttggcaagtgagaccctggctcttgaaacaacaaaacaaaacaagtacacaaataaagcaagtaatataaggcatgatatggcgtaacagagatgcttttgtgttttaagcatttttactggagattaatgagtggatgtgaattttaaggtgtgctccaaggtacccaaggggtttccatcaagatgcatcagaggttgctgatgggattggaaacttatcccctttacccccactcctctacacacatgctcacacagagcagctccacttttatctgttttataaattgggtttttgtgtagcactgtgaaaagaaagtgttctttttgtttgtttgttttgggttgggatgggtttgaaagtgttcttttaaccattttttttttttttaaaccacagctgtaatagaaagaacacgagctttggagtaagaaacatctgagttgaaattttagttttgctcttagatgatgcttacctcatccatcaccataagctcttccttgtttctcaattttgatcttcattttgagtatcaaatgagagatgtgtagagtgcctattgcattgactgatcaaggattcctgttagattggaaaactgtgagttctattaaactattttttatatcatagatattattttaaaaccttgagaaaagcaggttcacatatttattaagccgatgattacattttttaacttagcccaagtttctttatgtaatttggcctaaatatatctgagatcctttaagccatctatcgatatttgtacttgatcatcgcatcatagtgatctcacgatgttgagatgttcaactcctgagcccttggggtagccagtgccctctagcgggttggtttgccttagcaaccttgagcagccttgtccgtttaccctagtgtgccatgtaaataatatcatttcctaaatatgccgtgaagacattgatttaaagaagcatagatgatccttcctgttctgtttttctcctcctctgttctttctcttctcactttcttgtcttcaaatcccctggtttaaggccaaagaaatcagtagactagccgagcgcagtggctcaggcctgtaatcccaacactttgggaggccgaggcaggcggatcacgaggtcaggagtccgagactagcctgaccaatatggtgaaaccccgtctctactaaaaatacaaaaaaaaaaaaaaaaaaaaactagccgggcctggtggcgcgcaccagtagtcccagctactcgggaggctgaggcagtagaattgcttgaacccaggaggcagaggttgcagtgagccgagattgtgccactgcactccatcccgggccatagagggagactccgtctcaagaaaaaagaaatcagtagactagagggtaggcagcataagcaatttgatgatgggagacagtccatttctttttcctgtacctcaagccctatttagatagactttatttacatattaaggaaaaaaaacatgttttgacaagttgactagtttcctcctgggtttccattttccttgagcaaaatctgcaacagtctcatgtagatggggtaaatgggtttatgtgtgggggtccatgccacatgaagaagttagatgtgcactagcttccataataggaacagcaagaattgaaacagaaaggaaatagaaaccagtgcagggtgtctaggcaagatgagaaagcaaattgcttggaatatgaattgcatgatgactattgtaatgcttctattattttctgaaaagtaagaatgtctttatgttgagcttgaaccagaaggattactgagtccattctgtgttcaatctgtaaagaaataaactaaaacaggtgaacattgaaaatgttacaatgtcataatttgttttttttagcccaatcaccacttttctgattgcaaagtaagtccttcagtcaaatccattgtttgtctgtggttcttatgattaacttccttaaactcaaataacgtttgaaactcaacattttaaggatgtttttaaataagcattattctaacggtgcaaggacattttttaatgccttgccttctcttgcctaggaaatagaaggcagaattaagacttgaaacatcattttcctttcttttaagtgatgattcagtattttagttgattgtaaacagacattcctcttttgcttatgattacctgatgataattcaagttaaatcattgagataataaatctcatacattgatttgatgagagaaatcagtgttaacgccaaaccatgttgaaattggtcttagagatataagccattttgcaggagtgtgtttttgactaatcatgccagagagaaattaatcgaattgtggaatattacactttgcattcatgaaagaatgtgataatgccactactcttcaaatgcatgaatgtgactgaagggaacagtaattatctgcattcctttctactttaggagccagtgtatcctgaccttgtccgtgattgtaatcaccgtaacttgattagagattttttaaattatttttcaattgacacattttaatttatttatggggtacaatctgatgttttgatacatagctatattatgatacaaccagtttagctagtgtatccatcacctgtgcatttatcatttctttgcagtgagaaattatataagatacaatattttactgttaaacatagttaccctactgtgcaatagaacaccaaaatttattcttactatctaattgtaactttgtacctattgaccagcctctctccatccttcccttcctcttcccctctccagtctcaaccactggtctatccttttttgtttgtttgttttttgagatggagtcttgctctgtcgcacaggctagagtgcaatggcgccatctcggctcactgcaacttccgcctcccaggttcaagcgattctcctgcctcagcctcccgagtagctgggattacaggcacctgccaccacacccggctaatttttgtatttttagtagagacggagtttcactatcttggccaggctggtctccaactcctgacctcgtgatccaccagcctcggcctctcaaagtgctgggattacaagcgtgagccacaacgccctgccgcccactggtctattcttgattacagttttctttttttttctttactttttttttttttttttttttttttttgagatggagtttctctcttgttgcccaggctggagtgcaatggcataatctcggctcactgcaatctctgcctcccgggttcaagctattctcagcctcctgagtagctgggattacaggcacccgccaccatgcctgactatttttgtatttttagtacagacaaagtttcaccatgttggccaggttggtctcgaacccctgacctcaagtgatccacccgccttagcctcccaaagtggtgagattacaggcatgagccaccacgcccggccgattacagttttcaagatgtcatgtcatccttgctgttctaaacatcacccaaaattggagaaagaatagtggtaaaacagtagcgacattaaacttaggtaaagcttctcagtgatattattaatagaatcagaaataaatgacgttttcttataaggattcaaacacagaaaatcttcaagaaataccagtagctgtattttttttcccttctgagccaaaggttagattgggaggactgtattttgatagactccttacgacattttaaaataaattcttcagatctagaaagttgactctgaatattttccattcataattttgagaattttctaaaattgatgagcaaacagttatgcagtaagaaaaagattgtatagaaattgataatttgttctctttccatttatcgctgatgctccctttctcacttctacaaataaaaagtttcaaatctttgttctttgtctcttccatggcaatatagaagttataaggtaataaatcaaatttggaaaaagatcttttttcctactctaattgtagggctttaactcttatagagaatcagaacgttaaagtacttctcatataaaattcccctttttttttttttttgagacggagtctcgctctttggcccaggccagactgcagtggcgctatctcggctcactgcaagctccgcctcccgggttcatgccattctcccctcagcctcccaagtagctgggactacaggcgcccaccactgcacccggctaattttttgtatttttagtaaagacggagtttcaccgtgttagctaggatggtctcaatctcctgacctcgtgatctgcccgcctcagcctcccaaagtgctgggataacaggcgtgagccaccacgcccggccaaaattcccataatattatttcaaaatagaattagtgcctagtataacacctagtactgagtaggcactcagtcagtatctgtgtaggaaggaatagatgggacatgataaatataattgataataaatattggccggttgcagtggctcatgcctgcaatcccagcactttgggaggccgaggcaggtggatcccctgaggtcaggggtttgagaccagcttggccaacatggtgaaaccccatctctactaaaagtacaaaaaatagccgggtgtggtggtgtgtgcctgtaatcacagttacttgggagactgaggcaggagaattgcatgaacctgggaggcggaggttccagcgagccaagattgcgccattgcactccagcctgggtgacagagtgagactctgtctcaaaaaaaaaatatatatatatataattgataataaaaattgataatattaaataataataatattaaatatactcttgaaagactatgtttttctgctgctagacatactactttgtaaccaaaaaagcatacttatttgtttttgtgaaacattcacaacataaatggttaaacagcataaaggaccgtatgtttgagtgttacctctaaattaactaactgtaggcactgaaggatttccatgaacacaggacttttagtactaaaactagggggtctatcccaggcaaactagaacaaactgatcacccttaaaattatctctcaatttggccaggcgcggtagctcttggctgtaatcccagcactctgggaagccgaggcgggcggatcacctgaggtcaggaggtcgagaccagactggccaattgtggtgaaaccctgtctatactaaaaatacaaaaattacccacacgtggtggcgggcgcctgcagtcccggctgctcaggaggctgaggcagtagaattgcttgaacccaggagactgaggttgcagtgagccaggatggtgccactgcactccagcctgagtaacagagcgagactccgtctcaaaaaaaaaaaaaaaaaaaaaaaatctctcaagttgaggctgccttgaatgtaggttaagctttctggataacttcttacattaaaatttttggataatttacattacaaactgagtcaaatgaaagatcttttattttacttgaaatatataacatattcagcatagaaggagtaaaaagaaaagtataaaaaatattttcattaaaagctatgtctttaatttctgatggaattagtagagattttattactaattcatttagtatttatgagtccactatggttgtcagttatcctttatgacataatttataagattactgataggagcacattttctaagctgaaacatttagaataccattatacaattctttaatagctggagacggaaaagagagtgctagatggagaattaacctctgaatcatgttatgcactagggacttagggttacttttggagtagtatggaaacaaatttaagaatagagtgtgcagtataactttataacacggctcattttcagtgtcagagatcaaataaataatgtgaaatatagcattactgtgcagtagaaatccaaaataatgcaggtagcatatgatataggcattatcataccccttaacgcacaacaaaaggtgtttattattatcataatgttattttccctaatatttatttgctttaataaattattattgcaaaataagtaatataaattaaatgaatttacatgtcattgcattcagatttacatatatacatatgcatgtacgttcacatacattcacatatgtatgtgtttttgttgttgtgttgttatttttttttttttttttttttttgagatggaatctcgctctgtcccccaggctggagtgcagtggtgcaatctccgctcactgcaaactccgcctcccaggttcatgccattctcctgcctcagcctcccgagtagctgggactacaggcgcccaccaccaagcccggctaattttttgtatttttagtagagacggggtttcaccatgttagccaggatggtctctagttcctgacctcatgatccgcccgcctcggcctcccaaagtgctgggattacaggcgtgagccaccgcgcccggccatgtatgtgtcttaaatggctatttgccagatctttaaagttgccttccaattttggctgagaatcatcttagaaactgttttgatttcaggcatatatatacaaatgacatgctagtttatacctttaaaagtatatttgcatgtagcataatttggaaggacgtatttttattaaagtatttggattaataaatgttaatgtcaaatctaaaagcccacagcaatggagttgaaaatttaattttaactaaattttaatgtattcatcaaatatgtgttccacagtatttaatgaagatatattgtttataattcacactttgcagacccctttgaagacaataaaggcatacttttaggacagaaaatattctacatagtttgtgaattggagccaatgttctcttgagtttattcttcttatttttaatgcaatttaaaaaatgtatttagggcacatttctgtaagtttaagcatatgattctttatgggagagtagaaaaagaaatcaaatatattttgcgaggtggaagaaaagctgaacataggatatagaaggggcaatgccaaaaggaaaggaaatgaggatggggaagggccatatttttaattacttccaaagggcactggtgtatgttttataaccattcatctctgtttttatgaagcactaactccctgaagcacaaaaattacatgtgtgtgcctgaaggcatacacaaagaaaacaccagaaaccatagctgactcttagtcactggtttaatatgtacagttttggagaggtctgggagtctatctgaatctactgattttgattagtttttaaagaatgaaaaaacaaacaaaaaaaaaccctttcacatgaaacctaccactcaaaatttaagttggattagagatagtgctttgagatttccttcctgactaaaaagtaggttgttgatagcaaaagatcttttgcaactctagtatttgctgtaaactatgatatattcctacaagtacaaatagaaatattttaacatttattcttaagtttatcccagttcttttttttttttttttttttgagagaagtctcactcttataccccaggtttgattgcaatggctcaatctcggctcacttcaacctccgcctcccaggttcaaatgattctcctgcctctgcctcccaaatagctgggattaagtcgcctgccaccacgcccggctaatttttgtatattttagtagagacggggtttccccatgttggccaggctggtctcgatctgctgacctcaggtgatccgcccacctcagcctcccaaagtgctgggattataggcatgagccaccgcacccagcccctgagcttactttttaagaactggcataggccgggcacagtagctgggattacaggcgtgagccactgtgcccgccctatgccagttcttaaaaagtaagcttggccgggcgcggtggctcacgcctgtaatcccagcactttgggaggccgaggcgggcggatcacgaggtcaggagatcgagaccatcctggcgaacacggtgaaaccctgtctctactaaaaatacaaaaaattagccgggcgtggtggcgggcgcctgtagtcccagctactctggaggctgaggcgggagaatggcgtgaacccgggaggcggagcttgcagtgagccgagatcgcaccattgcactccagcctgggtgacagagtgagactccgtctcaagaaaaaaaaaaaaaaaaaaaaagctcagggaccgggtgcggtggctcatgcctgtaatcccagcactttgggaggccgaggtgggcggatcacctgaggtcaggagttcgacaccagcctgaccaacacggagaaaccccatctctactaaaaatacaaaattagccaggagtggtggcgcatgcctgtaatcccagctactcaggaggctgaggcaggagaatctcttgaacccgggaggcagatgttgcagtgagccgagatcacgccattgcaccccagcctgggcaacaggagcgaaactctgtctcaaaaaaaaaaaaaaaaaaaaaataagtaagctcagaaaaagaggctctttataggctaaatcaaataacttgttgaacctaatttttaaatttggctcttatttgtgtactcagtatttagatctaatttgactctgataataaccaactttaagtgaagcagctaccctttggtgcctacagatgactctcctttcaataaaacatatttaaatagatgacagtgatattttctatgatattcccattcgagaagccccttgctgtggttctggcaaggcttccacagcaggtgatgtggggctcatgagaggagtgccttacttactcctatagaaagctataataaaaggagcaaataaatacctcttgtagctaagaatctgatgtaccacttaatattttcaggtggcaactgcactgtcatttcatataaaattcctttcattagctataaaaaacattgcctgcctgccagctgtttggaaagcatcgtaagatcaggaaaatgacaaaacagcccctcattcgcagtagatacaatgaactagtcaaatagtacatttttaaaatctatcttttgcaaaaagaatttttgcttttcatctcatgcgtttttgtttttaatgacggcatctcaatttttgttcttgtttttttctatctaagctaataaacagattgtgatagtctgtactcaaacacaaaggttcaagagatctggaagaacctgcatatagtagagtataaaaggcctgtgcaacttagactcaaatgtatcaatgcctacaggaaaacaccacaggtcagctctttgtatattctctagtcaggtaatgataacctaaactatctctatgagactgctgaaaagttatcgaagtaaattatttttcttgtcttttttttttgagatggagtctctcttgctctatcgcccaggctggagtgcagtggcatgatcttggctcactgcaacatccacctcctggttcaagcgattctcctgcctcagcctctcgagtagcttggcttacagacacctgccaccacacccagctaatttttgtatttttagtagagacggggttttgccatgttggccaggctggtctcaaactcctgacctcaggtgatccgcccacctcggcatcccaaagtgctgggattacaggcatgagccacctcacccggccaataaattatttttcttaaacatgtatcattcatcttagagtgtagaaacattgaccctggtgatgaccattgttatttgtgcacatggctgtggatgaagaggtaaatgaacagcctccattgtccactgcctgcgtgtggaggaggctctgtggttggccttatgtctgatgagtgcaatctgcatctgcaactctgcttcttatagccataatttgcctaatagtattgctcaaggagagaaaatacatatccatatcttcaggaatataggaccatctggtgagaattacttttaatggctacattgaatattagtagttgattgttaatacagagagtaggaaggacattataatgctcaatagttgtccagtctgggcagttactcagctgtcttagacaagaccaagttttgccttttttagtttttcatcttaatgttattttattttattttattttattttattttattttattttattttattttgagatggagtctcactctgtcgcccaggctggagtgcagtggtgtgatctcggctcactgcaagctccgcgtcccgggttcacaccattctcctgcctcagcctcccgagtagctgggactacaggcgcccgccaccgcgcccagctaattttttgtatgtttagtagagacggggtttcactgtgttcgccaggatggtctcgatctcctgacctcgtgattcacctgccttggcctcccaaagtgctgggattacaggcgtgagccaccacgcccggcctaatgttattttaggtattttaggtgtggtgcctagttttcaactcttgttaaatatttcttaatgcataattctaagaggtttcatttaaacttgatctactttatttaatctaaggcatttgcagtattgtttctgttctttaatttagtaaaaggaaagttaattattgtattctttggagtaggaagtctttgtgaatttaaatatttgtcgtatagaagtctaacaaaaaatattctttttaaaatatggtcaaatacaaattgaaagcaactatatctgtagaaaatttttcataaaaatcattgactgaaggaacaaaagcatgtcattgtatataccaacccttctttatgcattatccactaaaatgacatttcaaaagattcacagtgggtagcatatggaatactccataaacactgattagatttaataatgtttgtatcactgtttgggaacatgtacaaggaatgcgaccgccatatattattaacatcaaaataactcagaagaaaagctcctaattaaagcagggttggtttagagacttagcaaaattgcagccagaaataaccacctacccacctgcccgggacttggggcttgctttcatgcatgcaaaacagacttgattcttagagcttcaagatagctgctatgaaaattataatgggctgtgacaataccattttcagcccgtccagttctgcaccaaacctagtttcagaaggacaacactactgcttgagttgaggtttcagccaagtagcatcaaaggaaagcaagtttgtggtttgcagttctgctgagctgcactcagtgactctgcatgattgattagtatccttttgctttgcaaatgtgcatatattaagttcagcattgcagtttgcaaagattcactcatggcctgccatggtaattgatgcacacctgtcctagggagcaatgtatgagtttttttgtgctttcacataagaagtctctggagtatttttaattggtcatctctagaagagggaaacaggagcagattaaaagtatacaggaaaaggaggttgttctacaagcagtttaaaaatctatttgaaaaagatccccaccacttataagctgaatagttataattaatttgtatccctgcattctaaaataagagtactcaacaggttttatttttatggacaagtatctgtgggcttaggaaatttctttctttcttgtcttttttttgaagatggagtctcactctgttgcccaggctggagtgcagtggcgccatctctgctcactgcaacctccgcctcctgggttcaagcaattctcctgcctcagcctccaaagtagctgggattacaggtgcctgccaccccgcccggctaatttttgtatttttagtagagacagggtttcaccatgttggccaggctggtctcaaactactgacctcaggcaatccgcctgcctcagcctcccaaagtgctaggattacaggcatgagctaccgcgcccggcctaggaaatttcattgttatttattgttgtttttgttttgtttttatttttgtttgagacagtctcgctctgtcgcccaggctggattgcagtggcacagtcttggctcattgcaacctccgcctccccagttcaaacaattctcatgcctcagcctcctgagtagctggaattacaggtgcctgccaccacacctggctactggctaatttttgtatttttagtagagacagggtttcgccatgttggccaggctgggctcgaactcctgacctcaggtgatccacctgccttggcctcccaaagtgctgggagtacaggcgcaagccactgcacctggcctaatttttgtatttttagtagagacggggtttcaccatgttggccaggctggtctcaaactcctgacctcagatgatctgcccgtttctgcctcccaaagtgctaggattacaggcgtgagccaccacacccagcctgttatatgtttaaccctttttccaagttgacatttccctgatactttggctttttaaatagcatacccttccccacaattcatttaatgaatcccttcttaatttacttaaaaacaaagatgttcctccagaagcaaccagtttttttctgtattgtttagggattgtgttttctggttttgtaatagtatcagaacatataggtaaatattattttggagtctagtttaatcagatcactcttttgctatagaaatatgttactagcttcttaacggccaggcggagtgtctcatgcctgtaatcccagcactttgggaggctgaggcaggtggatcacttgaggtcaggagttcaagatcagcctggcaaacattgtgaaaccccatctctcctaaaaaatcaaaaattagccatgcatggtggcgcacgcctgtagtcccagctacttgggaggctgaggttggagaatcgcttgatcccgggaggcagaggttgcagtgagctgagattgcactactacactccagcctgatacagagtgagactctgtatcaaaaaacaaacaaacaaacaaacaaaaaacaactatgttattagctccttaaattataagtcatttcattgctttctctggacctagcatctatcattgctcttgtttacatctcagtaaacatctcagtttcaatctgatttagataaatgtgattttttaagctgaaattcctaaatcagtagtaagtgtgcaaatattttaaagattatttgccatatgttattttagatacttatccctatttttctgcttttaattagaaaaaataatttataaactggatgatgttaaaatatataaataatttattaatttcattcataaaatgagctctaatatatatacttcttatatttctagactaatatacagccacattcatcattttttcctagtacattagtatttttatctaaattaattttcacccgctaatgaatattaggaagcactatacatcattaaaagtatttattccaagatgatttccccaaatgtgttactatgtaaacatactctgtttacccctccctttccatcaaaaatagccttaaggcatcatgataaaaatgatactgtatttatggacaggataaatcaaacacagtgaagatgaaagaatcagattaggcattccatttgcttactcagtatggtttctcttatgcccaggtttccatctttacagaacttattgggcatgtttcacccacactgcaatgtaactgattttcttttctctgccatctgctgttcagttaatatgtgtttggatgtgtgttttatgcaaaataactaacagtctaacattttggcacattttgctcttatgtcttgacaatgtctgggcatttgtagataaaagagatatatttttgttttacatgtaagtgagtgaaaatcactttcccccacccacctctctaaaatgagaaaacactgagaggctaaaaggaaagagcccacatttaaaaaagaaacaaacattaaatcttatttcagagtgattcaaatattgatatccagtagaagcatatatgaacaattagagtgtcttggtttttatttttttgaaacttcactaaactggacactggtgtatataacctgttctatcagttgttggagattttctctacgtctgaaagtctttagaccagccaatgactactttcaatattctgagggagtaacatgtcctccaaggcaccaggacattacaaaagggagagcacatgtgagggaacgagccgggttctccacttatggttggctcaatcatagaacttttctcttgtagttaatacctctaattccattgctgttttcatagtaactctgtgtaacacttagaagcctttgctcgacattgtcacaaagtagctctaaaatgtggatctcatagtctatctgggcacatctattggcattttttctgccctccctgcattcttagacacacacacacacacacacacacacacacacacacacacacacaccccacatgctttctctgggctctaatcaaagcctttgtataatgaattgcctaggggagaaggagaaagtcactgacccctctctcctgaacttgcacagagccatatgactactcaaacatagaaataaaaatttagatttggtgtttgtgtgtgtgtgtgtgtgtgtgtgtgtatgtgtgtgtatgtgtgtgtagagttagtgacctaaatagaagtttgcctatttcttcctttattgtggtaaaaacacataatgtgaaatctaccctcttaataaatttttgaatgtacagtacattgttaataataagcacaatgttgtaccacagatctctagaaaattttcatcttgcataactgaaactctacacctactcaatagcaactccccatttccctcacccctcagcccctggtagccacctactctctgtttctatgagtttgactactttagatacttcatataagtggaatcatacagtatttgtcctgtgactgacttatttcatggatcataatgtcctcaaggctcatccatgtcgtaacatatgacaagatgtgtttctttctttcttttttttttttttgagacagagtcttgctctgtcacccaggctggagtgcagtggtgcaatcttggctcactgcaacatctgcctcccaggttcaagtgattttcctgcctcaacctcccaagtagctgggattacaggcgcccgccaccacgcccagctaactttcgtatttttagtagagatggggtctcaccatgttggtcaggatggtcttgaactcctaacctcaggtgatctacccacctcagcctcccaaagtgctgggattacaagtgtgagccactgcacccagccttttgatgtctttgtttttaaagactgaataatattccattatatgtataaaccacattttctttattccttgaaggacatgtagattctttcaacttcttggctcttgtgaataatgctgcattgaatataggagtgcaactatctcttcaagatcctgcctttttctttttttcagtccaagagctggctttgaataacacattgacattgaaatatatatggttcctaagatcatgtaattttttgagatgtcagagacacctagagacagcaaacacattaaagatagattcacagttctagtttatatccatgtcacaaactgaacactactgaagctattttgttattgtttgttttcctcaagcagaaaattttcacagggcacatttttgtctctaacaaaggaaagaaaagaaaagaaatgtgttctttggaagtaatgccactgtattcaaatagcttcttccacataaagctaaaaatgtctttcagagttaaataatgcagtttcatatttaagacatacattaaattgatactaggaaaaaaacacaaaatccaccagtgacccagtaaaattagtaaattcttaatgtatgtataagtatatacacatacatacctacacgtacacagaaatgcatatattttagggaaaccttaaaagagaaaaggagttgctgaacagcttaggaaatacagtacaaacaaaaagcagtattgtctgcaaaaaaatttttgttgcaaaagtaatattttccttgtggaaattctggtccagagttgggctattacctatattgaataaattcagggaaacattctgaaatgtttgactgctatgattgaagtattatattaaagtactttatatcgtgaaatgcacttgttttcaaccatgcaaacagttttattaagtaggaggatatcagggttaaggttaggtttacatgaccatatgagaaaatttatataaggtgatggcatgaatggattctgatcttcaaactagacaactagaagttggaattctaatgtcaggggtatcaaacagcccacatggaaaagaaatgagagtctttaataagcaattgggttagaaaatatatagtatttcaatgtcattattttatttcagagtaacatgtctgtcattgagatagtttactgtaggttaaattcagtatgaggttgccatgtacttgcaaggttcttaaccctgttttagagatcataagacataaaagtgtgcaaaatatattcattctagaatagggagtttcctacactaaacaaccagcttaaataatatattcaagtgttttcatgagaaaaaaatcaaaatactttttatcaagatgttagtgctttcattttacctgaatacttatagaatctagcattatacagctggaaggaaccttgcagaatttctactcaaattgctttattttgtatctgctgtgagggatgtaaattccacagatcatcttgtatatatataaaaagggctaaatctcttgcctcagttcatagatcttttgaatgcacagaattggctcttatctttattagtaaacttgatttggaagacatttccttttttgttgccacttctttacctcattggtgattttagttaagtaagcaaagataaacaagaagtggaaaagcagtatcagctgaattgaaaccactacttagattgaaaaagcatgattggacactatctataattcagtataattctcaaacctaaaatgggacatttgaaaataagtgtaggaaaaatacttataaaatgggaaaaatggaaataaaatgtccaaagaattcagaaaattatactaaagggtccaatcaaacccaaatatgtacatattcattccaaaacaacagacatatcagaagtacctggtaccataaaaattaaaatacacacacactcacaaagactgcacaatataatgagaaacatcgtctcagacacttggcatcaccatttctaagtaatttcataactgtatccagttattcttgaatctgtagtaatatttcttaaactcctttttgccctagctctgtcactgttcaataaaactagattccccagggaccttccctttggcaaaattcacactgagtacagtttttgtttcattgatatttgtagtaaaatcatcctttataatcattgaaactgttagcacagactgcaggatctgatagtttgctctgtagttagatatttccagaatatcctatatttggggggagtatatcaaggccaagcatattcggactaaaggaatgtccactgaaccaacaagaatgttaagggagccttgttaaagtactgtcctgatctcgatccgattggctaagaggaagtcttcctgtccttgctccttgtacttcttactgctttgtacttcttactgctgccatgcaacctgatctccattttatcaaggagcctatatacttcaactgcctattagatttcactatcccagtatttcacagataccacaaactcaatttgtctaaaactagtcattattctctgcccccaaaatagtgctcccttacttgtttctcaagttctgataaaacacaagctcacacaaaacatactaagagtcacccaggctgtaaaactcaaggggtattgtcaatattcccctctctctagccactaatatctagtcagtcaccatgttccatggattctacttccttcatattccttttttttttctttgagatggagtctcactctgtcgctcaggctggagtggagtggtgtgatctccactcactgtaacctccgcctcccaggttcaagcgattctcctgcctcagcctcctgagtagctgggattacaggcatgcaccaccatgcctgattaatttttgtagttttagtagagacggggtttcaccatgttggccgggctggtctcgaactcctgacctcaggtgatccgcccgcctcggcctcccaaagtgctgggattacatgcgtgagccaccgcccccgacccatatttcttatatctatcccctgctttccatttgcagtactgttctgttagcttcccagatgctctccctatgtccaatctctcatctctccaaattatccttctcctgttgccaaactagattcctaaaaacaggtaaggtcatgttactcctctgattaaaaatattgataactcatcacctgcaaaggaaacttgaaaacattaacatgcatttcattccttttcaggcttatcccctctatagctccctgcttgtgcaagctaccttatctcagaatagttccagttccttaacagttctagatacattgaggccgggcacagtggctcaagcctgtaatcccagcactttgggaggccgaggcgggcggatcacgaggtcaggagatcgagaccatcctggctaatccggtgaaacctcgtctctactaaaaatacaaaaaaattagccgagcgtggtggcgggcgcctgtagtcccagctactcgggaggctgaggcaggagaatggcgtgaacccgggaggcggagcttgcagtgagccgagatcgcgccactgcactccagtctgggcgacagagcaagactccgtctcaaaaaaaaaaaaaaaacaaaaaacaattctagatacattgagacctttgctcatgctattttcattgcctggagtgtcttctctctggatagaaaaatcctttccatacctcaagatggaatttggaagttacttccttgtgaaacttcctaatgattccaaagtcaggcctttctatgtgaaatttattttaccacatgctagtttaaaaaaacaaaacaaaacaaaaaaaaaaacagagcaggcacggtggctcacgcctgtaatcccagcactttgagaggctgaggcgggtggatcacaaggtcaggagtttgagaccagcctggccaacatagtgaaacgccgtctctattaaaaatacaaaaaatagtcgggtgtggtggcaggcgcctgtaatcccagctcttcaggagactgaggcaggagaatcccgtgaatctgggaggcggaggttgcagtgagccgagaacgcaccactgcactccagccgaggcgacagtgcaagacttcgtctcaaaaaacaaaaacaaaacaaaaaaaaaaaaaaaaaagaggaagcaaactatgggctaaacatgctggtttaaaacagttttgtctgaatccaccacatactatctagatggcgatgaaaaagttagttggtctccctgaggctaatttcatcatgtgtaaaatgtagttaataatagcatatataggccattgtgggggttaaataagacaaagcttgttaagcatttagttcaatgcctgcttccttgtaagagttcaataaacattagtttctgctactgaggctctgctgttacttatcgtctcctaacactagtttataaattcagtgagggttaggaaccatgtcttatcactttactttctttttctctatttaatctctagcagtttcttatatattatcgcagcatgataaatgatgctgagaactgagtgtgaggtagggcttggggtaggaccttatctaattaacatctgtgtatgcctaccatgaatattaaataataatactgacattccaaaatatacacatcaatctcaaaaatgtttaaccataactcctgtattccggtaaacacaactatatggcaatcttaatagttatgtattgcctaacacctgttattttttaactgcctttgattctgtgtaacattctcaataatttatcaaatgtactttaattggatatttacatactgcatactcttctcattagtaggaactagcaaatagacttactatcatttagattgtattctatgcttcatttaaattagtctgagagtttttggttgttgttagtgtgtatgtatgtgttttaatttaggcaccattttttataccttaagcaaaggaaatctgatcctaccacttctttgtttaaaccttgtcaatgacttacgttttgggcaagaaagagttttaaatgcttaatagatctatagaatctggttcctgcttacctcaggaaccatctccttcctcactcccacttaactccgtagtctctagtattctaggcctttttcatcttctttgtgttcctagaatatttaatatccttccaagccttccctcatactaccacaatactccttgtggctcttaccatccaggtttgagttttagtgcgtcatctttcaagaagcatttccagactcatggcctacccctgtcccccacaagtctattaagtctcccaaatatacattcttataacaacttaagctttgcagtcacacttttcttttcttttctttttttttttttttttttgagacggagtctcgctctgtcacccaggctggaatgcagtggcacgatcttggctcactgtaagctccgcctcccgggttcacgccggttctcctgcctcagcctcccgagtagctgggactacaggcgcccgccaccacgcccggctaattttttttttgtatttttagtagagatggggtttcaccatgttagccaggatggtctcgatctcctgatctcgtgatccgcccgcctcggcctcccaaagtgctggtattacagttgtgagccacagctcccagcctgcagtcacacttttcaaattgcaatttaaaaaatgttttgtatttgtttaatgtatattttccccactcaactgacatctccttggaaagcagtaaccttgtctgaatattcactactccgtcatcagcacctagaagatacctggcacatagtaggcatttaatcaaaatgtttgaataaatgagtgaagaaatcactctgctgggtgactaaggatgcaaagctaaactctgtcttcgaaggaaggataaaaagacagacacataaaagacaagagagtgaataaagaaagtgggtagagaaaattaagagtgctgagtgtacttcttatctctctaataactaccacatttgtgactttaacaggaggcttatttaaaagcattttttttatcctagctgactcagaccatttatggaaaagtggggtcattgcagaatgtttttatctttctggtagcataattacctcctctatgttaaaaactgaggactttggttcaaaatactcaccactgactatactatctttgttatattatttaaatgtcctatgcctcgattttctttctttcttttctttttttttttttattttaacaagatctactctttaggtagtgagagagcactaagaaaatggctactccaatggggcaggaggtaaaaaagagaagcaggggtacttgatatacttcggatagtacaaatctggtgattctgatccccagaagggattatggactgatatggtttgtctgtgtccccacccaaatgtcatcttgaattgtagtccccataatctccacgtgtcatgggagggacccattgggaagtgattggatcatggggacagtttcctccatgctgttttcatgatagtgagttctcatgagatctgatggttttatcactgtctggcatttcccctgctggcattcattccctcccctgccaccctgtgaagaggcgccttccaccatgattgtaagtttcctgaggactccccagccatgtgagactgtgggtcaattaaacctctttcctttataaattacccagtctcaggtatttcttcataccaacatgagaacagactaatacatggacgtaaccccacattgggtgtcagaataacggaaaaggtgtaaaagtgaggtgactgattctcctctggaaggtttgcagggaggctgtcctagtgggctgccaccaggatagttgctactcacctgtgtcctggcctggtcctggctgagtcctcacccaaactgctctgatgggtggcagtaatgatagccatgcctcagttttataatctgattttttttttttttttttgaaactgagtttcgctcgttgctcaggctggagtgcagtggtgcaatctcagctcactgcaacctccatctcctgggttcaagcaattctcgtgcctcagcctcagaagtagctgagatgacaggtgtgcgccaccacgcctggctaattttgtatttttagtagaaatggggtttcgccatgttggtcaggctggtgtcaaactcctgacctcaggtaatctgcccgcctcggcctcccaaagtgctgggattataagcgtgagccaccgtacctggcctataatctgatttttaacagaatttttttagtctatatcttgaactattttaaagtattatgttgaacccaaatgaaaattaatacatgcattccatattatccttgttaatgcttcatatttgtaaatacttgtcaatgcatattcatcacataatgtgtggtttgtaagtttcacatattttaatattatttttaaagtacatttctttgaaatgttaataatttctaactaaaaattatccaaattaaatggaaaaattcatgttttgtttttagcattaagaggaatcttttctgacaggttttaaaaagtggaaatgctgtctatattttaatagattgtatatttgtgacttccttttatttaaatgggtaattatgccaggttgttaactaaagcttgtgtgaaggttaagtggatctcaagttgatttttccatgttcttcaacaatccagcagtaatgatatttaatatttcaggcttttaaaatgaaaattataagtaactaaggtactacctatgaagatgaaaaattgtagcaactgatttgactcaagtatctatgagctctataaactcttcatttcccagtgctctgctaatgcttattctaattctaatggaacatgttttttgtggtaacaattactccttacatcaaaattaagtaaaatgataaacagttttctacacatagcattgatgaagtgatcctactttaccaataggatcagttagagggcaagggggtataacacctgccttcagctacctgaaatagtcaaaaccaatataaatgtacattaaagtataaaggaaataacttactttctattttggtataagcttatggaggaattacaactatctcaggttgaattttaagtccatactgttagtatattactaaggaatataatctagaaattcatatatagtcacacaaaaacatgagtgataaaagctttaagagaattctatatagtgcataaataccccagtaattctgatcactgcttccctagatgagattccctagataaaaatgctttgtgggctgggtgcagtggctcactcctgtaatcccagcactgagaggcctgggtgggcaaatcacttgaggtcaggaaggagttcgagactaacctaaccaacatgatgaaaccccatctctactaaaaataaagaaattagctgggcatggtgctggccacctgtaatcccggctacatgggaggctgagacaagagaatcacttgaacctgtgaggcagaggttgcagcgagccgagatcacgccactgccctccagcatgggagatagagtgagattctatctcaaaagaaaaaaaaaggaaataaaaatgcgttgtgggacttatgataaatgttttataaattaactttccagattcatgactgagaccaaactgatttcaaattaataacattttcaaaacattagcattttaccttgcagtgttttaaaatgctgcacacattttagtttataaaccccacaaagaacacttctgttagggagaagatgatgtgattttagcttacagttatcttaaataacttcatgcttgaaaaatcagaaatatttgtctttgtagaacaaggaatttgaaaggggactagtaaaaggaaaattgcattgaatttcttattttcctctcatacttgccaagtttatatgtattagatatgtcccacttcactgccataaggttatatttattttaggttataaattactctgaattaccttcatcttggaaggtccattgttttcccagagttcttctctttaaatatttcaaggacttccaaagttgcttaaacagatgggaagaggtcactctacattttgatcctggaatagtctaatcatcctccccagagtgtcctgttctttgaagcttttgtagttgttgtcactctctcctgtggcaccaaatgccaggaaatctgggtattcaggagcaaatgccctttggctgctgatcgtaccagtgccttcagtagtttctcagggaactgtgttaggagaggttctagcattagttatatagtgtgtccataaccagctttcccgtgtcaccctaaatatggccataggcttctccctcagtgctgccaaaacacaactaagggcaggctgcctggccgagtcacaccaatcataatggtctacaatacactttcttaagtctcagttatattcagtcttaaccccaagtgaggagtaacagtaacccagatcaaatctctactgatgaaacaagctttctcctccttctccatagacaaggtcctgttaaagatatacccactttatattataaatagaaatctacaggtagctgtaaagataccttgtatctctacgacatgaaaatgtcattctgtttctagaatcaaaactgcctgtaagccaccaaatagccttgctggttttttgttttattgttttttttgtttttttttttttttgagatggagcctcgctctgtcgctcaggctggagtgcagtggcatcatctcggctcactgcaacctctgcctcccgagttcaagccattctcctgccttagcctcccgaatagctgggattacaggtaccctccaccacatcctgctgttttttgtatttttagaaaagatggggtttcaccacatccaggttggtctcgaactcctgaccttaagtgatccacctgccttggcctcccaaagtgctgggatttcacgcgtgagccactgtgccctggcaattagcctttcataaaatgcattttatagtaagtttttttttttttttttttttgtgaggcatcccactacatacatttaagtcttatttctactgggtatggtggtagatgcctgtaggcccagctactcagaagactgagatgagaggattgcttgagcccgggagttctgggctataatgcgctaggctgattgggcatctgcactaaggtccacattaacatggtgacctttcagtaacgggggaccactaggttgcttaagcaggggttacctagcccaggtcagaaacaaagtaggtaaaaactctcatgctgatcagtagtggaattgcacctgtgaatagccaccacactccagccttggcaacataacaagattctgtctcttagaaaaaaataaaaagacttattttctttaaaccgtattcttaatttctattctctaatataggagataaacaaaatggccagttttaaattttatctattgtattagggttctccagagaaaaagaatatatatatatttcttttttatataaaataagaatattttatacatctatatatagagagagagaattatggaggctgagacatcttgtcatctaacctccaagcttctgcaagctaaaaaaccaggaaaactgatggtatagttccaatacaaatccacaggcctgagaaccaggggagccaattgtttatgccccagtcccagtcccttggcccaaaaaccaggaatgtcaatgtcccagggcaagagatgatagacggctcagctccagaagagagagagagcattcacccttctccactttggtgttttatcttggccctcaacaaattggatcatttcccaccctcattgaggagggtgatcttctttactcagtctactgattcacatgcaaattcttccagaaacaccctcacagtcacacccagagacaatgtttcaccagctatctggacatcctttaactcagtcaaattgacataaaattaactattacatctactaaaatatctactagagcaacattcaggtctaaagacacaaacttaatttaggctgaccatcattctactgataaacatattcactattacatatatagctttaaaataaatatgattgaagccaaccttgttattaaaatgtatttaagatgttcagattgatgaaacgaggggattaaaatgcgttctcaaatacaatgaaatagtactgtaaaaatattctcagtaaatgagttttgctgtgaaattggtttaagattcataaaagggatttcaggtttttaagtactcaagtcagcccatgacccagccttcagtggtgtcatcctatgcagtgttagaatgagcctttactccttcaacaaatatttcttaagaactgtatagcttactggttaagaacatgggttctggaggcacactcagtttatttccatttttgtgacatactagctgtgtgaccttatgcaattatttttttatctcagaaagctgttgtgaagatgaaatgagttagtccatgggaagtcttccacagcggctcacacaatttattttttaaaaaggttaggtacagttacattgtcgttattgttgattttcatttcttttgttactgctactatttcttctctgtgccaggcgcacgtctaggtgttgatgagtcagtgatcagagaaggtctactttcatggaccatatttttaagtagggaaaggtaggcaataaacagattgaaataagaaataagaaaaatagacaaaagagataatgtcagatagtgattaagttctcagatgaaataaaataggtcagagtaacagtgatggggatggatattttagattggatagttggggaaagcctctatgaggaagtggcatttgagctgcgactgaatggcttggtgggaaagaaacagtctaggcagagagaacaagtgcaaaggccctgagttgtctgtgaccttggtatgttgaaggaacagaaagaaggttgatgtagccaggcatagtactttaaagggagaatggcatgagcttacattgcagggatgggtagcggacaaatcatgtagagccttgtaaatcatgggaaagactttggattttcttccaagtgttgtagaaagttattagagggttttcagaaaggaatttacatttgaaatatcaacagataccattttttaaaaaattcaagtagagatgatatgtagacagttgattatgaaagtgtgtgtctcaggggagagattgggataggagagatataaatttgggcgtcatcaatatagatgatatttaaagctatgtgaattgctgaaatcaactagacagagaatgtagatagagggctcaggaccaagccctctactctaacattttatagaagtcgccagaggaatccaggcatggtggctcacgcctgtaatcccagcacgttgggtggcccaggcgggtggatcacctgaggtcaggagttcaagaccagcctggccaacatggtgaaaccccatctctactaaaaatacaaaaattagctgggcatggtggcatgcgcctgtaatctcagctacttgggaggctgaggcgggagaatcgcttgaacccgggaggcggaggttgcagtgagctgagatcatgccactacactccagcctgggtgacagagtgagactctgtctcaaaaaaacaaaacaaaagaaagcaaagcaaaaaaaaaaaagaaagaaagaaattattaccagaggagaggaagtgagaaagaaaacttttcatttctgtgtcacagaaattaagagaagtagctaaatgtgtcatatgctgctgagacctaaaaagaaaaataaaggagttaatattggattttgccacatgaaggtcactattattgtaaacaatacactgctatatgaaaagaactagatatcatgccatggactattacagtgtctacattctaaccctaaatggatgactgccttttatctagctcccacaactctaaaatttgaatggtaatattgctctgcctttttgaaaaggttgttataaagaatatgggatataatggaaggaaaggtatataataagtgataaagtcttatacacatgcaaatcgatggtggtagaattatttgtactattagattataaacttcttcagggtagagattaaggctttaatgatcattctatcgaccacaatgcttagcatgataccaccccagtatcttgtatttagtggcttaaaaaacaaaataaaaatttcccacatgaagccaggtgtggtggcatacatctgtagtcccagctacttgaaaggctaagacgggaggatggcttgagcctgggagttcgaggctgcagtgagctatgattgtgccactgcactccagcctgagtaacagagcaagatcctgtctctaaaaaataatatagataatttaaaataaataataagtttttaaaattcccacattaaatacagggatgatatggagtgatgttgtccacttcttttcttacctgcagtcccatataggatttggtgacatggttgcaattgtgaaaaatttcagtgctgactcgccagccatctatcccttttacaaagtaatctctttgaagataagtgaaggatttagagattgggctgctttccatttgttattttcaagataaaccattctcagaatttttcaggtttcctcacttgggtacgagacaatttctgaaatcagtttttgttctataagaacaaatttatgaaattcggtatcactacatggacatgttttagctggtgaaaaattgtgttatgataaatggggaacatacaaattttcccttttttgttatctttggctttttctctgtgttatacagatgttgagctttctgcaatatgcaaacagtttagtaatttgcattgcaaatagattacaagtaagtgacctttgcaaagtgcttctgcctagcgagtccctggaatgaatctgttttatttagggaagagaggctagaaaacagaaatgtcactttcattctttgctaaaaaatgaagagtcttctttctgctatgcttaaatatgatgataaacattttcttaaaaaccaatatatatatgatgacagtctcaaaggtaaaaatcagaatgtttttatatgaagcattacgtgtacccttccattgctaaaaaggaaagtagagtctgtcagaaatgtgtttgttttttcgggtctattgacacaaaaatgggcttgaggactaaaagatttaatgtggcttgtcagcatgaaagaggctgttgtgttgttaatgtgaatgctaatacttacgtagcataaaaaaagaacataggaagtgggcatctcacttttaaaatcatggtgtattccataagtgtcagctgcaaagtaactttccagaaatggtctgatttccccattgacttccattatagaactagagctgtgttcccatggaaaataaatttggccccaggttataataaaacacagtgaagaattcagaaaatcttataaagtcaagtttttcaaggcacaattatcagtacttgataaaataataacaccacaaaatattaatactctatagtagatcttaaaatagtatgccccagactgcaccattatttttctatacaattccaagtctattacttttgcatctagagaaattttacttctgtgatcattattaatttttaatggatttaactctaatttaaactgttgattttgtttccttttttctttatggttagtccacttacctttttctaaaacattcttatctatgacaatcaaaagttactagccatagaagaaagaccagaaggaaatgctccaaaatgttcacaatacttgtttctgagtgggaaattttagttgatttaagtttttaatttctaagttgtaaaaaagggccatttatatcttctataatcagaaaaaatgtattataatttctataagtataaatttatatatagtgagatatctttagtaggacacatttatatatttggttcattttatgatttggtaatggtagttgttaagatcatttattccttcaaaatttttttaaaactggtaaaattagtttctggagataatagcttctacttaattttctagaacatactactcaaagtgtgggcctggaccagcaacatcagcatcacttggaaattagttggaaatgataattcttaggcccctgatctggggccccaggaaacagctatttgtgttttaacaagccctttgggcgattaaggttctaaagctacagaaaattctctctagagctacagcaaattttctttacctctctctccttctcctccctctccctctgtgtccctctctccctctccccttcatcctctcttctccctccccccttccctccttctccgtcttcctcctttcttgccaggccacttcctctcctttatagaggaaaagtagtttctcttctcacccattgctgggtttgtagctgagacctctaaaacaaaagacagattaacaagaggaaaacttatggatttatttaatataagttttatgtgacacaggagccctcaaaaatgaagaccaaaagaaatagggaaacttgtatatttttatgattaggtttgatgaagagtggacagtagggaaatataatcaggcaaagggggtatgatctaatggtaatgagctgggggaacttagcaaggcatatttgttcagattcttctctgtgtccatatgtctccagagataaggacattcttttccttcaggtataggaggagcagctctgaaatgagggtcttataacctacttcagaggcagttaagagaatcattttcttgcctgcttcaggagaaaaggattagaagatcagagagaacttcctgcttttgctgatttctcaaatgccaaggtgccatattttggggaagtgtgtcttgaaccccatcaccttcttccttctctgtttcctttcctcatgtgggttatgcatatatgtatacacacacacatatataacactcatatacagaattcactataacctctttttttttttttttttttttgagacagagtctcacactgtcgcccaggctggagtgcagtggcgcaatcttggctcagcacagcctccacctcccgagttcaagcaattttcctgcctcagcttcccgagtagctgggagtacaggcgcgtgtcaccatgcctggctaatttttttgtacttttagtggagacggggtttcactgtgttggccaggctggcctcaaactcctgaccttgtaatctgctcaccttggcctcccaaagtgctgggattacaggcatgagccactgcacctggcctcactataacctctatctctacttatatagagatgtatattaaaaagagagaaaaaaaaatatatatatagttttttctttaagttttttgccactgttttctaccttactcataaaaatatatgaggccgttttctggtatttatgcctatatgctttcatttagcaaacattttctaacaaatgttccgtgtggctacatattgaatagttctgcctaatttaaagatcttcaagtctcactaaccaatataatgactctatcaagttattttgggctaaaatgtgtcttccccaaaattcatatgttgaagtcctaaccaccatgtacctcagaatgtgactatatttgaacatagggactttaaggaagtaattaagttaaaatgagctgattagggtgggccctaatccaatatgtctagtgtaagaagaagcgattaggatacagacaggggaacgactatggagagacctcagaagaaactaaacccaccagaccctgatctcagacttctagcctccagaattgtgagaaaatcagtttctgttgtttaagccacctaatctgtggtattttaccatggcagccctaacaaactaatacacaagtatttgtgcattactaatgtatttatagaagtgatgatttaatttaatcttaacatctagtgattgattgcctttaaaaggtactgttgagccatgttccttaacaaaaagctacagctttacaaagactgcccgagaacagtatgaaaaactctccaccatgcacaacaacatgatgaagctctatgagaatcttggagaatacttcatttttgactcaaagacagtgagcatagaagagttctttggtgatctcaacaacttccgaactttgtttttggtaagtaatacatcttaaagcattgcaagacctgttgcttatatttctgaatgttttccttctattgtcattttatgttcctattgactatattgatttcatgtgacatttttttaataagaattgacagatattttatacctgtgacatggataaaaattaagttataagtcatggctggcttaacataatgtggacctaaatgaatcatcttcaatgttaagtatacatgggaaatgttttactgaaattttataggaaatgaatgaattggtacttaaataaccccaatttttatatagcataatattataatttcacgtagcgtaaacattaatatctagaacttttcacataataaattcaaatgctgtgatttataaataagtttctttcacagcctaaatgagaaactgattttgaattggactgtgtaaataacattgaatacctaaagtttctttcacaatgtgggctcttgttttaaactggaactcttgaggatcacagtaaatattagcattaattgggggtggcaattagggtacaagttatgatgctaaaaggaatcaaaggctttgctatataaatgctatggaaatacacgtcctctgcatctaacaaaggagtagcaggaagagcacagactgattgcaatagtaacagaaagatatgcataatagttgatatcaaacaggtaaaggtgtgtgtgtatatatatatgtgtgtgtatatatatgtgtatatatatgtgtgtatatatatgtgtatttatatatgtgtgtgtatatatatatatatattttttttttttttaattttttttgatatggaatcttgctctgttgcccaggctggagtgcaatggcgtgatctcggctcactgcaacctctgcctcccaggttcaagtgattctcctgcctcagcctcccgagtagctgggattacaggcacatgccaccacgcccagctaatttttgtatttttagtagagatggggtttcaccatgttggccaggctggtctcgaactcctgacctcaagtgatccacctacctcagcctaccaaagtgttgggattacaggcgtgaggacctctagcaataatccccaacaggaagatcagttaacaaacaaattcattccagtgtgaggtattcccaaagcagtactttctttgtattcccaaagcagtactttctttgtcaatgctgttgccctgtgaaatcatttgattttggtgtgacttcatctgtgagatatgaatatgcttgtggaaatcaaattgctttcatctcctaacccagggcctataacccagagcatacccgaacagttaaacaagcagctttagtcacagaagttaatccacaaacttccagaagtatgatcatatgtcttcttttttgctgaaaatattagttgatttttgtctttgacccttcatagagacacatactttttagctaacccataactagtagaatgtgttctactggcaatgagaagagggctaagagaagtagtcaaatcattttcaaaacttaaaagctgattatatgctatgaacacataagcgcacaggttatatctacttggattattttcaaaaaggacaaaacaatgaacattaaaaaggaatgatgaccagaaaatatactttagttgacacactgaaatgataaatccaataattttttttgtaacaatgtctgtgggtgaatggatatataagaatatgtatgtggctaggcgcggtggctcacacctgtaatcccagcactttgggaggccgaggcgggtggatcacctgaggtcaggagtttgagaccagcctggccaacatggtgaaaccctgtctctactaataatacaaaaattagccggtcgtggtggcgggtgcctgtaatcccagctacttgggaggctgaggcaggagaatcgcttgaatctgggaggcgaaggttgcagtgagccgctggagacagtgagactctctgtcccaaaataaataaataaataaaagaatatatatgtaaaatatataagaatacatatgattaatattgttgatctccatttagatcctaaaacactgtctgtcttattatatgttcccttacctccccaatacacagacacagagtagtagatggtgtacttgcccccccatgttgcagcattcttctaataattccagtgttacagcctgtgtgtactcatattagccatatgcctagaaggctaagaactctacttgtatcacttttcaatcataacttgttttttaaaaatgtaagaatattattgttaacgagacctgattttgtatcctggtactgccactaaaaagctgtgtgactttgagtaagtcatttgtcctttctagctatccatttctgtctgtcttttgtaaaatgaaagagttaaaggattgatctctaagaattcttttccctgttagtagtctgagtcacagttcgaatttcagagatggcagagtcatatatattacatacatatgtaggatatgttttatgtctttctgctgacttcactgcacatgtagcttgagtacagagtaagaatttttcatatattgtcactgaatgtaaataatttgatattcttatgtccagtttcatgtccatttaagttaatttcttgagaacctgttacgattaactttcaaaacaagtaatcagatcctaaatgtgtcaaccaatctgaaacacttacctaatgcactcctgaccagccattgctatctttgccttatataacagtactgctaccacttctatctacaaatctttatcaacttgctgccatgagaattaggtgtgcaacgtattaactgttttgaacgtgggtgggacatataacctctctgggcatttgtttccttgtctataaaagacggaaaataatttaagccatgtcttcctcactactatctgaaaagaccttgaaacctatgctatacagatgtagaatattattagccattctctgactatcctttccattaactactgaaaaccaacttgattttggtaatgctctgggtcacagataaaaggaagagaatggtttctctctatccatgagtggggacagacaaacaaatgcaatataatttgataagtgctgccatagaaatatgttaaggtgcgataataacataaaggaggaactgcctaactctgcctgtgttggccagagaggccttcatagaaaaagtgacattagggcccggcgcggtggctcacgcctgtaatcccagcactttgggaggccgaggcgggtggatcacaaggtcaagagatcgagaccacggtgaaaccccgtctctactaaaaatacaaaaaattagccgggcgtggtggcgggcgcctgtagtcccagctactcgggaggctgaggcaggagaatagcgtgaacctgggaggcggagcttgcagtgagccaagatcacgccactgtactccagcctgggcgacagagagagactccgtctcaaaacaaaacaaaacaaaaaaaagtgacattagggcagagtcttgaaaaatccataggcgtttgacaagcaggtttgaggtttttatacctgacctttaagtcgaagactcctaaatcaacatcaccaacttcagtcaatcctttgtgctcaccatgttcctgtttcatagtgaacttgaagtgatttcactctcccaggggagggaagaaccctgaaagattggcaaaaattgtaatcgccagaagttcccattttcttagtgctttgtgtgtttggcctcagggttcttagcactaaaagcatattggactatagatggaagcaataaaataccagtagtgctgagaagaaaataagagttctgatgcatgtgctaccaaaaattacttccaaatgagctcagagtttcatcttgggagatctatttggcatatgtagcataaacaaaatgcacataccaaaaaatcttcctccgatagagatatcctctaaaagatggggcaaatacaaataaaagaatttgacattatggattaagatctttttgaaagtaaacaattcaaatgaatgaaagcagaattggataatgtctttggaagacttctattagttaatattcctattctatattactcagctaatgaggatatcaaaggtattccagatgaatgtacaatatattggtatcaaggtatatataattagaaacatttctaaattcagaattgagaccctttctagttagtttctcagagatttcatgagtttaaagaacagcatacaggccaggctcagtggctcaagccggtaatcccagcactttgggaggccaaggtgggcagatcacgaggtcaggagatcgagaccatcctggctaacacggtgaaaccccgtctctactaaaaatacaaaaaaattagccgggcatggtggcaggtgcctgtagtcccagctacttgggaggctgaggcaggagaatggtgtgaacccaggaggcggagcttgcagtgagccaagatcacgccactgtactccagtctgggggacagagtgagaatctgtctccaaaaaaaaaaaaaaaaaaaaaaagaacagcatacaatatagacaaaattaatagcccctaaatttaagttgcatattttgtggaagaaaatcaaattccatgatacacaatggagactcaggagggttttgtggtaggaggggtgtggataatgagaaaaattacttaatgggtatgatgtatgttattcgggtgatggataccctaaaagctctgacttgacgactgtgcaatccatgcatgtaacaagattgcacttgtacttcataagtgtatacaaataaatcaaattccatatttatgcaatgtctaaacatcttttttgcttattctcctttctatgcttcagtcattcttttagttcaaatagttgactgcacaaatagtcttttttttcttttgagatattttgaatagaatattcaaaatcggtgaaccgtatatgtttcaccaccatgcagtatcttgcttaggcataaaaattaatttcagctgttgggaaagtgttcacggcaagtattatacttctataactttcacagctccaaataaattatagaaaatacttcttttctgttttaaatctgtcagtttcctgctgcttctgtgtgtttttgttttgcttttttaaagaacaatatgttacccaggcactccataaatatttgttgtgtgtgtgtcctcattctgtacctcatataccaaatataggaataaggctttgcagaattattagattcattgacataacttgaaaatgttaccgttgcttttaatcatgccagccaatttcccctcaacaaaatcagtatgtgctactgttcatttgataaactttggaacagctcctagatgagcattaaaataactaagtgttaagatgctaaatgatatcaagtaatcatagcgttttatgccattattcaggcttgctgcttctacttcccagattgactgattgattgagaccgggttgctctgtttcccaggctggagtgcagtggtatgatcatagctcactgtatcctcaaactcctgggctcaagtgatcctcccacctcagcctcctaagtaactaggactacaggcatgcatcaccatgcctggctaaatttttaatttttaatagagatgagatctcgctgtgttgcccaggcttatcttgttttcctggcctcaagcaatcctcctgcctcaacctcccaaagtgctggaattacatgcatgagccactttgcctgaccctagataacttttgaatccatccatttctctccaagcccactgacactatttgaattcctggcttcaaccatctctcgtccggactataataatgacctcctgactggtatctgtgtcttcttctcttacccatttccatttcctaatccattcaccccattttagtcagaataaaattaaaaacaaaagaaaccaaacaagataaccttagtttcctgacttaagattctttcataacttccctgtggcctcaggataaatctgagcttttttttgagatggagtcttgctctgtcgcccaggctggagtacagtggcttgatctcagctcactgcaacctccaccccctgggttcaagtgattctcctgcctcagcctcctgagtagctgggattacaggcacccaccaccacgcctggctaatttttgtatttttagtaggagacggggtttcgccatgttggccaggctggtctcaaactcctgacctcaggtgatccacctgcctcggcctcccaaagtgctaggattataggcgtgggccactgcacccgaccaaatctgagctttttaaactaaaatggtttacaaaatcaaaagagctatggttactttaaaggccagaccatctatggttggctctgaatgggccgcagtcacttagattgaactcttctcccaaattgggaaatgttacttctggaaagtagaagcagtagaacaagataatagcaagttcctaagaggaactgtgtctctcagaacaaagagaaactttggaagcaccatatgaaaattcaaaaaaggctgaaaggccaaagtatgattgtcattatgcctttattgctcccatagctggtgtgacatggagagttataaccactgagttcactcttacgttaattctcagggatgttcttccttctatcttaagtaattgttctttaaaaacctaaacttgtctgagagctccctgtgtagccatgttggcttatggagataattaattttgaaaatctctcatctctcttaagctatcttcccttttacaaggcctcagtcatgtctaaatctaaactataattggaaagtcaatgagtatatctgcatttagttaggcttgaaagactaaattgataatatacagaaaatttgattcatttattaatggtaatttacctttaaagaaatgagggtgaatttttacatgaaaggattgtgtatataatccctgatccaaaatgacttaagttgttttgacacatttttaaaccaagcacttgacattaaaaaaaaaaaaaacttcagtattataaaaatggtaggcttatgtgagaaaccaaatatattgtttaacaaagtagtgtcttaatcagtaatgtaaattctgatatctagaatttcatcatccagaaatttctattagatgcctcataagttggtgcctctttgctttgccagtaaaatggtaatattctgaaaacaaccttaagaagctgcaagaccgtgatgtgcttctttaatgatatagttttttttgtaaactagatgtctccaggtctcttcatttatgaattcagagggggtgtccttagtaacagtaatccaaatatcccagttatctcctcttttcccccactggcaggactcaagctctttacaaagtctttacccctaaaagtacacctggagtcatttcatgggtgctgaaaacgtcatctgtagtcaccagttgaaatttgctcaccaatcagcaactgagtgcctttattctagagtgatgaaaatatagcaatgaacaaaacagacaaagcccctgcctgtcctgtcttgctgtagcttcagctccattctgctaaatgctttttgcaggcaaaactgcttggggttgcctttaatgaaaatgcctatgtgtgggccaagggtacagtttcctactgctccaattttgtcatcaatcttgaagtaccattgtggtattatgttcagtgcagaagtagccatgtttcacaggacacttcataaaaacagttcattttgcatctcttctgatccctttctccttggagactaaaaactgtttcaactcctagagacctgaagggaatcctaaaatcttaagcccctccattgccctccttctccccttttgttcaagtgcctaggcatgtatcttccttttcctaggagctgggaataaataaaatgccagcataaatcgtttcatgcaaatagagccctaagggcccaccaactctctctagttaatcatatacacccagataattccctttgagctcagctgggaccaccctgggtatatagccttaggtttattttgatctgttgcaactctttgaaaataggcaatccatggaaaatatatggtaactctattaagcagaatatttgaccggaatacctcattccccagctgtgccagagagcagactttactgtattttacagatatcattgaattcttctttagaaagagatgtcacctatcaaatgttgtattctctttgactgtttactttgggccagaagtggatgtcctatttctcttatatgatttttccttgtatagaaaagctaaatatcatatcatagggaactaaaggaatatgtaataagggaagacatggtttaaggaaaactcaaactccctaacatgataaaaaaaaatacctactagtatggatggtttttaaatatgtatgcattttagattaatattataaaactaaaaaaacagttttttctaaaaatatttataaaagttgacagaattgtttatgacaagctgaattttaccctttaaaaatctgacaatataataattaacaatgaaaatattaacaaaatcagttcaatgccaccttttcctattaaagtctaataagaactagaatcaggaaacagaatgtaatatctttagttccagcaacaacgcctcatgcagaatttttcacagaagtgttccctataaataagttattattgaattatgtccaaacaccaggaagtgggaaagtgtaagataagcaatatggtatacaagctgaccttttccagaagtcttgagattggccagaggtattgattgtgatcagagcatgcctgtttcaacctaagcatgaagatccctgaggttaatactactggtggcaccctctcagctggctgaatttttcttcattctgcttcatcctgttttgtttgtccatttgctaattaatcttctgtcagaaaagatgccgtcacccctgaataaggcagtagaagggaggacttccccggaattgtgcccattgagctcctttggtatgcctgccccctcttcttctcccccctccttccagttgcctaccaacttgttcaagtcatttcctctaagaagccctccctaacttccatttcggtgtagattacccttctctgtgctctcatacctccatcttagcacattttaccctgtaatatgtttatctccataccctcgtgattaatactataattagcctactgtgggtcaaacacagtgctgatctcgaaggatatgtatgaatggcttaatgaattaatagaacaatgagtgaatcaaacaaaaaatcaaaatatttgctctccagagctcacattctagtgggaaaggcagtgaaagaacaaatagtggtaatgaaatataatacatatgtacaaagagcttgtaagcacagagcagtgaggcatttcttctgtctgatttaaggaaagcttcaaagacatagagatatgtgaactgggtctgatcattgttttgctactatatggcctttcatgttttaaggagcactttcctttttgttctcccccacctcatttggtgtttaattttaatggtaaacatacattgtctcctagttttccatgctgagttcaaagtggaaaaacagctattttgttgccagagaagcagttaccagctaattatgatgatctaaaggttatctgccatatgcttagatgagcagtaaccaagcttcagttacttcttatgactgacagttgtcctgagcaataggacaattgatgcagattatctagggcaaaagcaactgcttaaagtctgacttgcctggtgttaatttaggccagtggttctcacccaagagcgattttgcctcccaagggacatttggcaagatctagagacatttttgtttatcacaactaagtaggatctgcaactggcatcaagtggctgaaaccaggaacactgttaaccatcctacaatggacaggagagcctcccacaataaataaatattcagcccaaaatgtcagtaatgttgagattgagaaaccctgtttcaggattacctgcaaaagattttttaaaaaaaattataaaaaatcagtggaaaacaatgtgcaatagtccaaattaataagcaaaatctactagataagttaatattatatctatcatattgatgtaatattttaataatttcaaatgttaatttgatcactgtattgttacagttactacttttttctatagctttgaaacatcccagtttatatggcttgtaaaattttttaattaccaatcatgcatgtaaattgtagaaaaattagaaaatataaataccaaaaagaaaaaaaactgtcgactgcaattccactatccagagttaattaatattaatacctcggtacatatccttccaggcattttcctatgcatgtacataagtatttagattgtgaatttgtttttcttaaaataataataaaaagacttctgaaaatttaagttttaaatttatattttcttgtaaaaaggctagtggatcatgcttatatggatatgtccatccacattcagtgtatagtgccgttggttatgtcttcagttgtgattaaacatgttaattggctcacttcatgatgcccttttacaaacacctggtctttggcaccatgctaacaatcatgactactgtaagccatctgtaaagagatcggtagaatcttgatttctctttttgttttctacataataccctcattaaacttccctgtgtcaaggggccttaaatcagtaattggtgactgtccagttaggctattcacactagtgtttcttaagcactttgctgttgttctctgctgtgcactttgatttaagaaccattacttacctaaactagggtgttcttttttaatcattgcaaattgttaataatataatgatttgtaatctaatcacaaaaattcttaacaaaagcaatgttacgatttaaaatgagagtaagtgtcctatatatgtcctatatatgtgtgtgtgtgtgcgtgtgtgtatttttttcctttgtttctgtcatcctcttcttgaatcaaatttcattgtcatggaatacagtctcctaaactgctttttaaagatctgaaacatggataatcttttttttttttttttttttttttatgatacagagtctcgctctgttgcccaggctgtagtgaagtggcaggtctcggctcactgcaacctccgcctcccaggctcaagcgattctcctgcctcagcctcccaagtagctgggattacaggcacctgccaccacgcctggctaatttttgtatttttagtagagatggggtttcaccatgttggtcaggctggtcttgaactctggacctcgtaatccacccacctcagcctcccaaagtgctgggaatacaggcgtgagccactgcgcccggccatgttataatcttaataatgaggcagctactatttttgctcatatccattttaatttctgtttctgcaaacatacggttttggaatattcagaatttcctgacattgttcatggggtattgggcaaaccagagaatacatagtattcctgaaaagctaatcatccattcaaatcttgacattttgaaatggaagatgctctattattcttcagggatcttatatattttgtgctcaaactactggattactcagtatgacagtgtagttgaagtcattttattttattttttcaaatttattaatcaggcacaaaagagccaaacttcatactggagacactatagtttagaatagtgtattatttgttcgtgctcaattgtctttggtctagtaataaaaaactaaagtctcatatacattggggacatataaaacagcagtaattaacaaaacagtctgggtgcggtggctcacgcctgtaatcccagcactttgggaggccaaggcgggtgaatcatgaggtcaggagttcgagaccagcctggccaacatggtgaaaccccgtctctattaaaaatacaaaaaaaaaaaaaaaaattaggtgggcatagtgccgggcgcctataatcccagctacttgggaggctgaggcaggagaatcacttgaacccgggaggtggaagttgcagtgagccaagatcgtgcctctggactccagcccaggcgacagagcaagacttcatctctaaaacaaacaaacaaacagatgattatgtaaaatggatgaaatcgcaaatataactgtattaaacaatataacctctacatgggagatatgggttggtgttccccaaaaacttgaaactttattttgaatgttaattatttttagtgttgtgagcaatcctccttcatcaaatgacatctacgagatattatttgtgaaagtatttgctcctttgtttaaaatataagatttgtaaataaaaatttaagatgaagccttttttaggtgacagtctccttctgttgcccaggctggagtacagtgatgcagtcatagctcactgtagcctcagacccctgggctcaagctatccttccacctcagcctcttgagtagctaggactacaggtgcacaccaccatgctcggctaatcttcttcttcttctttttttttttttttttcttttttagagacaggatcgtgctatgttgcccaggctggtcttgaactcctggcctcaagcagtcttcctgcctcagcctcccaaagtgttggaattacaggcatgagccaccatgcctggccagaagcattttttaatacatcctaattatatggttgttatttcatactatattaaaagttttagaatagaatatattcaaatagatagacttgtttcatgtgagcattatttaggcaaaatatgttttaggtaactctttaggtaacagtctttaatgaataggccaaattaattttcaattattactataagtgcttgtgtatgtagatattattgctcaagtttttctgtaagtacctgaaaataattgatttaactctgcttttgaacgcactagcatattttgatgtttattcttttgtataatgtattaggatgcctttagctgcctagtgacataaaacataactaaaattagcttaagaatatggttttactctcttacatcacaagaagtgtagaggtaaggcagttacagggttggttaattcagtagcttagtaatattattaaggacccaggatattccagatatttctgttctgccatccttggcatgttggctcttggttgcacaatggctgtagttgttccaggcatcacattcaaatatggggacgtctaacaaaggagagtgtgttgtctctatgaagcttttttttcaattagggagaaaagcttttccagcagctcctgggcagattgattccttcacattttgttgtccaggattgtgccacatgcccatccatccctaaactaatcaccatcaaggagaaccttagattaatccatggctttgccagcaagtaagatggctggcattggcagcgcgcggtggctcacgcctgtaatcccagcactttgggaggccaaggcgggtggatcacttgaggtcaggagttcgagaccagcctggccaacatggtgaaaccctgtctctactaaaaatacaaaaattagccgggtgtggtggtgggcatctgtaatcccagctacttcagaggctgaggcaggagaatctcttgaacccaggaggcggaggttgcagtgagccgagatggtaccactgccctccagtctgggcgacagagcaagagtctgtctcaagaaaattaaaaaaaaaaaaaagactggcattgcatggattgggacatgcaactaaaagtatcaatatagcacaaaagtaaattgttgctcagtattatttgaattgtcaaacgttgcaaattggcaaaagaaaaataaatgagatgttatctgtgaaatatacacttgtgttcaattaaatagtttttaaaaatcttagaaaacagaaatgtaaatagaaaacattacccatttattttgaagttatccttcactgtttgcgttctgtctttcgctagaatatacttacacaaggacattctgcttttctaatttgcttgaaaagctattagtttacttgctttctttttctcattcattcattcaaggattatttattgagtgcctattaaacagtggacactgttctagccactggcattgtttgatttatttcagtaaactaaaacagattttaaagctctgccatcatggagccaaatgtggaaaatgagaaaataaactataaacataattattgggaaaattatattacaagttagaacgttaagtgctatggaaagaagaaatcataccagtggaatggccacatgacagtggctaaaaggtttcaacaatagttataaagttccattgtgcaatcaatttcttaagctaagatttagattttaacagtgtaaatgtttcctaaaattcagggatcactgagttgtcctatttagaagacttcactaggtacagttagatgatttttatacaaacccgaactatttcatcagccatgtatccttatgtgatgtagaagaaataaaaattaattctgtcccactttacagaaaaagtcttgccaagggctttattgtttcagttaaataattgtaacattatcttctggaatatggaggatatacaaatagagaactttacctagaagcccggcatattgtctacttttagacacagatcaaatttaaaaattaaagaggaaacacctgagaagaaatctgtccttttcctaatgccatttcaaaatcaatggctcttgcctttgttaattaagcaagttaaaacctttccttgttcaagagaaaacaaagcaaaacagtatttttgctattaaaaacgccaactaggccaggcgcagtggctcacgcctataatcccagcactttgggaggctgaggtgggcgggtcactttaggccaggagttcgagaccagcctggccaacatggcaaaaccccatctctactaaaaatacaaaaaaaaaaaaaattagcgtggcattgtggcttgcacctgtaatcccagctatttaagaggttgaggcaggagaatcacttgaacctggaaggcgaaggttgctgtgagccgatatcacgccactgcactccagcctgggtgacagagcgtgactctgcctcaaaaaaaaaaaaaaaaaaaaaaaaaaacctaacaaatacagattcagtctcagtcactacttcttcctcaagggaactcggatatcttatttaagaagatagacaataacatcccgaaatgggtttctagacaggaagctctgacaaaaggtgagatgtatagcaaagcatgtagtgaagtaaaagcatatttttagtgccaaaaatatgaaaaattataaggaacttacaaagacatttagttcatcttggattcctttcccctggtccttgttctctgccaactgtcagctagttgatctgataaactaatgcagtactaatgtgtcactcattctgtattacatacatgccctttaaattcaggacaatgccttaattcagcagagcaattctgctgtcaagaacttcttgcaacatggctagctgatagaggaaatattggagggaaagacagcctttcttgtacctctgaaagaacatcatatatgtagctgcacaatcttcctgggtctagaatttttccccccacctcacaccctcctcccaaggacatttcacaatttaacctgtctgttctggtgtcataatatagctttgtcaaattggcatcttcctgggagtgacctccccttcgacatggatcagagaattcaggcaacccaaaaccctgatccagcccaccctgtcttttgagaggctggaaactcaggagtttcattggcagagatgtagtatcaactcagctttgattttccctttctttctgggtgacatttacttttttatatattgtcccttaggcagaaatactacactcaccttgtaggcttagcaggatgtctacagggggttaccccaagcttactgtgtgaaacccaagccatgctcagctcacttactcagccacggagacaaaagacaattagtgccttatggtatagtaggtacaaaagaaatgttttatactccagatttcctccctactctaccttatggtatggtacatatacagcctgatcactagaataatcctttgtcataataaaggcgggatttcttggtttgattttcagtaaaaatgtctcctggtgtttttttttttttttttttggatctccttccttcaatcttaaataaagcatttccaaaggtcttacttttggtcctgcatatttttcttcctgggtagttgatatctattccaatggctcctacactttcctgagttgtgattttattattcagctctagacccaagtttattttctgttggatgcctctaactagatttgccataactacctcaaactcagcatattcaaaagggaactcattacatccttttcaactttctcccatattctctttggctgatggtacaacttgatatcttcttttccctcgctatttacatctgttcagtctccatttcatacccagcttatgcagttaaaactcaagagactctatctgttttttatgatttccccatcagaatcttaccaaagcaccgttgtttgcatgttctatattaagtctcagcaaagaaaaaaaaatcttactttcatcctcactttaacggcccaagtttcagtgtttgtcctctctccttcccatggactactgcagtaatcttttagttctcctgagcttagtcttagcactctctaaactgtatgctgctgccagatactgttttctaaaacgtaggtttcattgggacattcaccttctcagaaaccttcagtggccttccatgggtgacagtaaagcctagactagcatttggaaacccttggtaatctaactctccccagccactaccctttttctctgattggaatacagtcacacgcacagtctcccttctacctggtgaaattgttttcaactttcaaaactccatttagtggctactttccctgttatgcctttcctaataccccctgctgaactccagggaaaattaccccctatttggtatgctcatcatatttttctttttctttctttcttttttttttcattttttttttgtttgttttgttttgttctgtgatggagtcttgctctgctgtccaggctggggtacagtggtacaatctcggctcactgcaatctccacctcctgggttcagttctcctgccccagcctcccaagtagctaggactacaggtgcacaccaccatgcccagctaatttttgtatttttagtagagacagggttaccatgttggccaggctggtctcgaactcctggcctgaagtgtactacccgcctcagcctcccaaagtgctggtgtgagccatcgcacccggtgctcatatcatattgttaatgtggcttttgtaatattcaactaattggtgatgtacagacctgccttctttgtgctgtgaattcctttacagtaaatacgtctcacttatctttgaatttttattacacaacagagtgtgtggcacataaaagtaaccagcaaatatttattgattggtaaccatgtttgtaattggtaatcatgttcctactgttctagaaatctaataataaatggtcttttagattaatatttcaaagccctctagctgtctctctctgcctctctctttctctctgccaccttttcaagatctttcattattttaacgactccttttactcttcgtcaacattgatttagcaaatatttgactcaagtacttaaacttgtctactttcactccatcactctaagttgtgaaatcccaaagtgagctatattttcctggtataattcttgagcagagctaataataggcacaggaagtacctcatgtttactccattttatttctacattctagcatcaaacctctcatttgtcagcctttgtgatttactgttcacttatgattgaccgtgaccatttacatcttcattatttatccatagccagcagacacctgcttatgtcactagatttttttttctctttatgataaaaatcattagagaaggactattcttcaaacataccttcaaacatctttctactttctctaagtcttactagcttcaaagatcctttgaagaaagaattgaaaattccaacttctcttttctggggagttgctatacttttaaaaagtgtaataattctaagtttcacgggataaaattttgtcatttaaaatttcttaagtatattatagtgtcatattttatttttatgagtgcttaagtataagcacaatatgcaaaaagtaacacagatttcattgtactagagtatccatgagtcaaaagggcatacagaagtttacattgaaagaagtcaagtctaacacatgacatttattattgcaaagtgttgtataggaaataaaattcaatgtgtctgtaaatgccctaaatcctcttataagttatttgtccaacatgttaagcctaatggaaaaaaatccctttataccaataaataaggcaacttaagcagaagattcatgatgaagccagaaaaactctataaataatggggtagtacccagggaggagggaggtaaaggaaagggcagtagatcattagcacaataaggaaaggatattcccatcagtaagtaagcagtgatatttggccaaatctaggtcatgatcaaggatataatcacaagtgagatgttttacattgtgcaatgtagctggcatactcatctacagatggaatggcttgcttcccagaatgcaatcactactatataacagtgtccttattatttccagtttggaaaagaggattgtaaagcagaatatctctggttccgacctgtatcccattcaaacatgatccacgctattttgttttcagatatttttacagaccaactctctgctgtatcatacccaagatttagggtgtcaaagaaagatatgaaattgtatattcattgtatttttttgtttgttttataaactaatgactcagaaacatatacctatagagccagaatagcctaggatagaaactaaggaattctctatcggtaaaatatctttttttttttttttttgagatggagtttctctcttgttgcccaggctggagtgcaatggcacaatctcggttcactgcaacctctgcctcccaggttcaagtgattctcctgcctcagcctcccaagtagctgggattacaggtgctcgccaccaggcccagctaattttttttgtatttttagtagagatggggttttgccatgttggccaggttggtctcgaactcctgacctcaggtgatccgagtgcctcgcttcggcctcccaaagtgctgggattacaggcgtgagccactgctcctggccctctatcggtaagttatcttaataactcaggctcctggcaagttttgcctaacccttcagcagctaactaatctttcaaatagttttctagagaaagtagtttcataacttgacttgattccattgctttgccatccttaatgtaaacttctttttaattatcagagtttctctttttaaaatttaaattcaggtcctattattttgacgtgggaaactctggaagatatctaataagacttgttctttaaatacatatccacttcatgtctatggatatagttatatcccttaattcaatcttccctgagcttaattatccatcttttgttcatggtttggcatttcccaaacgttcagcacttcttttattcttcatcggacatcaggtttttacatattctttaaacagtggaggatccagatttgtgaggctgtattttgtataatttgggagcagccatttaagaaaaggaatttttttttaaaagaaatcttttttatttttaaattttagcaaaacacatggccaagtgagcacattgccagtgcccctcccatgcaagttagaagtcctaatgcttttgctcattagcttcatggtgaatctgtctctgccctttgagtcgttcatcccataaattaaccacagctcttttaaaaaggccaaactgtcaaaaagtataagcccaagtaagatattggctatcacatatgcatgctggtctggtatttacactaaattaatcagcattgtcttcattaagtaagaaatagttattgcatgcctcttttgtattaggtgctgtaataggcttatagttaagggtgcttatcttaatagaatatcacacctgaagcaaactaaaccaacagagtctaccctttctttttttttttttttttttttttgagacgaagtttcgctcttgttgcccagactggagtgcaatggcacgatcttggctcactgcacaacctccacctcccaggttcaagcgatactcctgccttagcctcccgagcagctgggattacaggcatgcacaaccacgcctggctgatttttgtatttttattagagacaagttttctccatgttggtcaggctggtctcgaactccctacctcaggtgatccgcccgcctcagcctcccacagtgctgggattacaggcgtgagccaccgcgaccagccagaatctacctttcagaggctgttaaactaagccaacaccgaagcaaatgtgcataaaggatatctatgaatatctgaatgcatgttaaatacataatggatatattaacattatatataaaatagggtgagtgcatcttgtagtgatggttagtgaagcagcccttgaagtctccaatttaatctgagggaggagaggtttaaaggtatgcttgctctataacttcattgcccttaccagcaatattacctagtggcgtgaggttaatttaaggaccaccatgaccactaagtgctatgttttcatacttttccacacctcatcagtgctcctttttttgtttgtgttgctcggtttccattcatttttgatgttttatatatatatatatttctctacatataaagattaccctgagttttcagacaacatcaataaagggaaaggtgctaccccataattactgaaaggacatcttgctgtcaatatcttggaagataggacaacaaatcatcaaacaatcactttctacttacaaaagcacaaggttctgactggcaatcaagaaggctttgtgaaaaacaaattgagcaaaaccatcttaatctacttctttgaaagaatctgttccccatactgcaaaaaaaatctctctgttcactaggatttttattccctcccatgtgacagtcattctcaatgattgaaaataataagaactagactttagagtacgattttaactgatagtaagacagtgctctaggtgggtctgggacatagagcaaaagtagactaaccctctagtgcttcttttgatgatccctaagagccatgagtgaaagaggcttgtttgtgatgcttattattgattccccagggactagaacggtatgtgacagttcatgctggataatgaatgaatgaatgtttcctgcttctcaatgaaggcataagtcactggatattaatcagcctacttttttcttacctttattgcttccctgccctcttcttcctttccctgtccctctcatcacccaaaggacagataaattttcaatggcagtatgtccagagagatttctaacacttcattaaaaaaggaattttattggctgtgtatgttccctcagaaataggatcaagctcagttaggaattagtaagatataaattaagggcaccaagcaggtagcatgcagacaagaacatacataaattcactggaaaaagattcttgatttttagtggaacagtacagtactaaccatgaattagcagtatatgaggtgtaactgttttttaaagaagacaaatcagaaatgtgtaaagtcaaagaaattttaagcctcttgttatcttaattgaaggataatgatattaccctaaatattttgggaacccttattttggatttccctaagagttatgcagcatgtgctttaggtctttccaggagtactaaatatttgtaatctgagggtgcgcttgatttttggaaatagccggaagttacatcaagccaagttttatcaataagatacatgatcaaactgagtaacaaaatatgtggtcaaaaatattgtgaatataaaataatgagactaatttcatttgattcagaggttaattcggaacgaggagtttcaattacagtgtaatagccctcaccaacacaagtttaggacttccaaaggtggctatttgtaggacaggattcagcagatatatcggaaccaatcttctaactttacagttgcacttgaaaatgttacaaaacaaatgctataatattttagaagatttagagcatgaaaaactggtagatattggatagcacatctcttagagtattgtttccagctttgtcctcttcttttttggggaggcaggtgaggatggagaagtctataatttaaaaataatatctaacaagtagagaacacccagaagaaaacctaaacattattaaatgtaggcaaattagtctctatgagaaagttattgttcagaaaatggtattgattggcttaatttaaagtcccaacagtttttctcaagggtctcttggatcccatccttcccccagtactctacaagctaagaaattcacctgcgttgcatttagggattagtttcaactttgtggaattcaggcaatatggcggttcctggggacaagctacacctccatgaaaaagttttaaggaagatattgaccaagtttctatttcacagaggccaacagacaagacgtgggcttaaaaaactgacagcttttagcgaggcataaggaaatatttcctttttgaggaggttaagtatcagaagaggttcctgagggagatcatggaaccctatccacaggcagaacattagagcaagcattcttctagagcccttcctgttctgtgagtctataattctacttgtcaaggtaatttgatattcttatccaagtctctaaggtgcttttgccaccacctaaattggtctcatcaaaaaccttattgattgtgctgcctctcccatcttctaagatggtgacagtattaaggcagtaaactcagatctcagacctgtcacataccacttgttttgtcatttccctccacctatacctccccaagatgttttttcattaaaatattgttaccagtcactttagaatttcattctgttcctttggttcaaaaaattgtaattaatttcctatagtcacttaaagcacttcgtagattttaatcaacagaggtctacattggcatgttgagctcagttgtttatcccttccagatggagataaatattctcaaatacctactaagaaaaatatgtctgcagaaacctgcagcattagaaaacctattctttgctgcagattgcagattaacttctagctaatcagagttcagcattctaatggactgtgacgggagagacagtttttcccccaacttcagatcacatgtttctgcagttgtaaggcaaattttaaaaggccttggggatcacagccagccttcattatcggtgcatgaccgctttgtaaccaactgtaagtttaatatccaaggagatttgcacataacagtcttttttctttcttcttgtttttaataattcacctttgagattctcttcaccaccatgctggtgtgcaaagatctgtttgtctgtcaaacctacagatatgtagcgcatgtgaaagctacattaattttttatttgtttcctaaggaggctgaacaataagctggttttgctgaatacaagagggctacttcagtgaacacatacttgaattcacttcagctggctccctcacctgcagcacagcagtttctcctatgattctcccctctgccaaaagggagtcacttatacaactaaactcaaggactttttgtataaaccatccacctgaacctgagaaggttttgtctgaaaccaaaagattactagaaaagctgtgtaaagcagggcgtggtggctcaggcctgtaatcccagcactttgggagggcaaggcaggcggatcacctgagatggggagttcgagaccagtctgaccaacatggagaaaccctgtctctactaaaaaaaatacaaaaaaaattagctgggcgtggtgtcgcacgcctgtagtcccagctactcaggaggctgaggcaggagaatcacttgaacccaggaggcagaggttgcagttagctgagattgtgccattgcactccagcctgggcaacaagagcgaaactccgtctcaaaaaaaaaaaagaaagaaaagccgtgtaacactgtttgtggatcctgcaagtatctcattcaaaacaaatgcctcattttcaaaattagaacacttcttttaactttggagactcaatgtaaacactaatctctacacaagtgaatttcctcagcggaatattgagctatgtcagtgtgacaaatgtcatggatatcgggcctctgaaacgctaagcactggcatttttaagaaaataaatgtagatgtcagtgaaccataacctatagatgattagaaagaaacttaccattcgaaagtggatgttttcttcaaggctgctaagattttctacaataaagaaatatgaggtgcgtagggaactatgtgtagagacgttctcggtaatttaatgttttgaaaactcccaggctgaaaactattattatgtaaatcaactagctccagctgctaattcttagaaaatggaaagagtatctaaagtttaactagattttgaccttttatgttatgaagactacaacaaggaagaaagaggaagtttgttagggggttattttttaaggtggtcagggaaggcttcactcataagacagacattcaagcagagacttaagggagatactttttttttttttttttttttgagacggagtttcgctcttgttgcccaggctggagtgcaatggcgcgactcggctcactgcaacctccgcctcccaggttcaagcgattctcctgcctcagcctcccgaacagctgggattacaggcatgcaccaccatgcctggctaattttgtatttttagtagagacggggtttctccatgttggtcaggtttcaaacccctgacctcaggtgatccgcctgcctcggcctcccaaagtgctagaattacaggcgtgagccactgtgcccggcctgagggaggtacttaagagcagaaggaacgcaagtgtaaagatgaggagcgagggagaccagtggggctggaagagaatagctgaggaagagatgaggacagagagaggtaacaggaggtcagatcacataaggctttatatgctattggaagcactatttttttttcaactatgagtaggaatagatggcctcactgccagaaaaaaaagaagggaagagatgaggacagggcttcaggggaaggtgaaaattaaagggtgggacagggaagtatagtctagaatggatatggagggaatgcaatgctgtctgtaggaagaaatgaacatagtacctcaggaatcaaagagggaagaaaatttctattttgtttggtttagcagattacctatggtctgttatacttctgtgtttcataccatatttacacaggttaataagcatgcctttaatccctgtctaactacagtatcaatacatttgttcagtgtctgttactgaggcacctaactacttgagcaagctaatcaaggtttcaattaccccagtgagaaagaagttctacttctctgttgcaatcgtagttgattggttgatgaagtatttataagatctttcataagaggaactttaaaggtcacttgtaccataataagtggaaatcgctgggaaagaaaaagtttagcagtattatagtgctgataaagtcttcagaggtactgactctcagagtctagttactgcagctgaaaattctttgccctgagcatttgtcatgactccttcaatccaatatgccctttaaacacagtgaaactatagaaaaggaatatctaatgttgttgggtgttaattaaggagtaggcttccttcctttccttaatggaaagccttaatttgtcttcagttgcagctgaaaattctaaagactcatttccaccatcttatgtaggttttttctctaatgatcaggttgttcaatttcttgttcagatgctgaaaaactcatcttgactcacactgtatcttcctacttgtaacctgatgtgatcattctcaaatgggagtgaaaaagacctgtacaactatatgagtcctgatttacttttgatattctttaagattttcacccacctttactataataacaaataaggacctcagcccaagctacaaatcaggtagaggtaacatacattgggatctgtgtttcctatcacctcttttctccttggttccaggcaagtgcaacaaaagtgtcaatagtataggccaggtgtgttagctcatgcctgtaatcctagcactttgggaggttgaggcgggtggatcacctgagatcagcagtttgagaccagcctgaccaacatggtgaaaccccgtctctactaaaaatacaaaaattacctgggcgtcgtggtgggcacctgtaatcccagctactcgggaggctgaggcaggagagttgcttgaacctgggaggcggaggttgcagtgagccaagatcgtgccattgcactccagccagggcgacaagagcacaactccatctcaaaaaaaacaaaaacaaacaaacaaaaaaaactgtcagtagtagccaaaacaattcaagcacagaatatgttaactatatgaagtagaggaaaagggaagaagaatttttaaaaagaaaaaactttttggtaaaatgatgaaaagttattgcatatagaattgcctttcctgtttcattgtcatgtttaggacatctttgggacagggaaaggaaactgctgctataaccttacctagttcactggtctggacaacctgtccattgctacctattttgcctcctgttatgactggaatgaaatgagaaccccaccaataagcaaaaagtttccacctttcatcctatctcctacttgcaatccctcagtagtgatattccagcacagctaacagcctcctatcagtaaagatgggaaaagtatcagaaagcttagcaaggcctggggtagggaaccaagtgtgggctaattctcctggtccttccgtaaacattaaggcagactaagtgaatccctcattctaagacaaatgttccctaaagaagtaaaattaaactcctattttccaaagcaattggacttttattgtactgtgtgctttattttctgagtgaggtgacagaactagagatgtttaaaaaaaaaaaaaacagtaattcccctccaaatttactacctttccccaggaaccttcatcactcagtttttgctacagtcctgtaaggcatgttgaaacttgagtaaaatgatgcatgaatttgttagtcaaaatagcaaattattctatgacctttattatttcttagatttgtcaaatatgatatcctaacaccaagaattttcccccaaaacctcctgtttattttacctctatcttttttctcttggcacagaaagacgagtcctattatctgttcaaagttggtggcttagagagtgtgtgggtgttttgtttcttcaaatttttacctgatgttgcaagattttcatatcaaaaagaattcttctttctccccagtgtgcacgcacatatgtggacatggtcctggattggaggaaatggagtacagaccctgaaatgcatgggacctttgtattgcccaaatgtggaataatataataataaccaccaccatttattgaacatgttttatgtgccaggcactgttattaatagctttatatgtgattcctcattaaatcgcaaaccaacactgtgaagtacaggtacaatcatgtgttgcttaatgacagggatacagtctgaaaaatgcattgttaggtgatttcattgttgtatgaacatgacagagtgtacttatacaaacctagatgctatggcctactatacatttagactatacggtatacgtaagcctgttgttcgtcgactacaaacctgtacggcatgttactgtacagaatacagtatgtaacacattggtaagtatttgtgtatctaaacatctaaacagaagaggaacaataaaaatactatattaaaaataaaaatggtacacctgtattagggcacttagcatgaatgcaccttagaagattggaagttgctgtcctcagacacaagcacacacattagcctaggactacacagggtcaggatcatcagtatcactgtcttccatctccatgtgttaccccactggaaatcttcaggggcaataacacacatggagttgtcatcttgtgtgataacaatgccttcttctggaggacttgaaggacctgcccgaggccattttacagttaacttgttataagtaggtgtacactctaaatggtagaaagtatggtatagcaaatacgtaaaccagtaacatagtcacttattatcagtatcaagtactgtgtattgtacatcattgtatgcactatacttttataggactggtaatgcagtaggtttgtttataccagcatcaccataataagtacatgagtaatgtgttgtgctctgacattatggtggccgtttcctcactaggtaaaaggaatttatcagttctgttataatcttatgggactgccttcatatatgtggtcccatctgttgtactacatgtcattatgagatgcatgactatatttcacagattcagaaaagagggttagctcagttaagtaaatggcccaagggcataaagcactatggtctctagaggagcttggatttaaactagatctcccagcccttcaaggccatcctgtgttcattatgatatgctgttttacttagaaagtttggattatggatcccgacttaaaatgatccatataaagaggacaatttcctattatttttactctggccataaaattacaggtaagacatttaaaaaaaatcttatcaagatgcataaaattagaattatacttatctaggaaatatggaaatggatggtattctggtcaggggttatttaataaaaattttaagtgttttatttttaaaagaggcgactgaaagaaacaatttaaaaattcttcagtgtctagcaaaaaaaaacccagaaaacttaaaaaaaaaaatctaaaagcacagtctgaattaaagcaaagaaagaatcagttgctcagagagttcaagattaaaaatgtgaaaaatatttaaaaattagctgggcttggctgggcacagcagcacacacctacaatcccagcactttaggaggccaaggcgggcggatcacttgaggtcaggagtttgagaccagcctggccaacatggtgagaccccgtctctacaaaaaatacaaaaattatttgggcatggtgtcacatgcctgtaatcccagctactcgagaggctgaggtgggagaatcgcttgaacccaggaggcggagcttgcagtgagctgagatcgcgccactgcactccagcctgggcgacagagtgagactccgtctcaaaaaaaaaaaaaaattagctgggcttggtggtgcaagcctgtaatctcagcactttgggaggccgaggcaggaggatcacttgacttcaagaccagcctgggcaacatagctgggctccatctgtagaaaggaaggaaagaaaggaaaggaaagaaaaaagaaagaaaagaaagaaactttgccaggcatggcagctcacacctgtagtcccagctacttgaaaggttgaagcaggaggatctcttgagcctaggaatttgaggttgcagtaagctgaaattgtaccactgcaccgcagtctgggtgacagagggagaccctgactctaaaaaaaattgtggaatttcccctattttgttgagttttcattaaaactactatctcagtgactcatatttagtgtataaaaagatttgcaatataatacacaccacgtttctttatattgttgccaaatcatttctctcagtatcattttcaaatccttccaacacccctgatcaacgaagaaatactcctcagtgtgatcacagtattcctctggcaccagagttaccaatttgttcaccatgacatttctaatttacgtaattttatggttatgtgactctactatcatacaacttctgatactgtaatgaactgaaagtcttgccaactatattcacgcgggtaaccagaatgatccaaaactcaaaagagaaaatgaatacattcctagtatttttttttcttttcatgagtgccaagttacagtgatatatatggaatcgtagaattaccttagatgccaatattatggtacagttgaaaatcatattcagtatagttatgagggtagatagtatcaggttggtatatttccagtcatagattatgtcctcataacttccccaaaaagggaggaagggggtttgcaaaataagtcattgaaaacagatgtggtcatttgtctgtcaatgactgaattcttgctgttcaaacttttaaatgattctgttatacataataatcacagctactatataataagcatttcctctgtaccaggctttgtcttaagtgttttatataagcattatttcacttaatctgttcaacagtcctgtgatttaagtagtatcttgattctgcagatgtggaaactaaagctcaaagagatgaactaacttgttcaaggtcacacagtttttaggataagtgatggagctttgatttgaaaccagatttttctgattccaggatccttactaccaatggttttatttctctgtccctgaaatatgccttcagctttcagtgatctcatggtgcttgtaaagtacttgagcagtcagtcatctctggaataggaagccattagaagccatgaaagtaaggaattgtttgctgtaatggtggtggtggtggtagtggtggtttatgttttcaaatatcaaggcaaggttggaagatgcttgcttcgtgtagacctgacctgaatgaggctggcatctgggctccttggaattttctgaatcagtttcatccatttcttaaagcttaattgaaataaatgagaggtcttagcatttacgtgaatttctttctttttttttttagcatatgacatttttagtctgtaggtcttatttagtgattatgcatagcaagggaaataagatttgtaatttattcactttttttttcagtaaggcaatagaggtttcagtgagagattttaaaaattaggttggtgaatatttcgtagtaaatcctagatacatttttcattatattttactcattttgtaccttttaccaacccttaacagatatgccagtaaaactgagacttttttctgtaaacatatttcttatcttgtatgaggttagtaccaaaacactttttcaattagcatccttttaacagaacactgtcctgtacaatgacagaatctaatcagttggcatttccaaccctgagaaataatgattaatgcttacttgagaatgatctttaagtactcatgagttagtgttttaaaatgtttagtgaggcttgacaagtacaaagtaatgttaatcagtcaattatttaggggattttcttaacctgaccttaaatttgctcctactgcttttgttcttttgattatttgatttttattttgtaagaattaggatgatgagaatacatcccatccctcaaaataatttttttcttcaccagcttttacatttttagaagggttaaacaatgtcttaaaaactaaagattattgatatgaaactgtctttaagatttccctttctctaagcatgcattttctatccctaatttcctaaagccagagccaagtaaaaacaccaagaggaatatgttattcttttcagcatgaggccttttcatgaaaacagcactagtgaccagaatcttattctagtctgtgttgcttgaaaaatatatgcctttgtagatgttttcatttactgtcaataatgccaaaccacagaaatggtttttttaattctgttttggcctcttaaagattacacattgccattacaaattgtgattgttttgtagttaaatctattcctgaaacatttcagatataaactgatagacctattacttgttctgttttatcctttagtagatctacattcatgttgttttagtggtgccttttgcaagcttccctctcatataaaaatttaatctctagccttattttcttctatcgcaaattgtatcactttgatttttatatgaactttttttttagttttagcatattttccagaaataataaatacatggagaatgctacagaaatagcatgattcaagttcatgtacaatataatgcctatcaataatctgtatcaacatttctattttcaaaatgtggttttgatttgggcgtttctttttgtaatcatttctactgtctttattagatgatcttagtcgatcaaaggatgcttataaaaaatcaacacagtcttgggaatcggactgccaggtttatgaaatgaaaatataggattcccagttgaagctgaatttcagataatgaataattttttagtatcaatatatcctaaatattacatgattttttttctatttaagtatgttccaaatattatatgagacatacttctactaacaaaagtattcacagtttatctgaaatgtaaatttaactgagaagcctgtattttatctggcaactctatttggaaggcatcatagtagtgaaaatgaacatagaggctaatgccaaacagtcctaggtggttgtgttacttaagaagctgtgtagctttgggtatgtcacttagcctacctgaacctaaatttcatgtataaaatggaacaaataatacctactttgcaggttttctataaagattataaagtatgtatttaagactagataatgtttaaaactcctggtacataatagatttcccttaaagagtagctgttattatcagaacaaagaagaaatacaaatgcaagtaaccagccgttttttttccctccatcttaataaactatgtgaggaatcctaatgggagcactcagcatgtaaacaacccattagattgataatataatagtccacccagatcttggtgactgtttaccaaattagagatttgaccactaataaaatatatacaagcattagccttctttctttcctctgctacttgcctcttttcatgttacttaccaaacattatatagcttattagtatcagggcctgaatatgtgatgccttttcacattgttttttcccttttgagttacaattttacttccatcctgtctttcttagacatctatttattaatgtgattaatttttattgagataatttacataccataaaatttaccattgtagtttatataattcagtggtttggccgggtgcggtggctcacgcctgtaatcccagcacactgggaggccaagccgggcttatcacttgaggtcaggagttcgagaccagcctaaccaacatggtgaaaccccagttgtcaccactggagtgggatcatactggcatctggcaggtagaggccagggatgctgctaaacatcccacaacgcataggacagctcctaccaaagaataatctagcccaaagtgacagtcgtgctgaggttgagaaaccctgctttaaaattatgattctagtatgccagtttatttttaagtggtagtctttgagttcatctacaatagccaggtacctttgtgctcctagcctattgctatggagtctaagagcacaaaaacaatgacaggagaaaggggaggtaccagtgaaggtaaaatcatttagattttgtaggaagaaatcaattcttgcaagtcaggagaattttgaaagtgtttttaaggctattttaaactgctgtgtcttttaacataaagaaaaaaattatttcaatataaacccctccaggcaaagccttgtagacgtattctcgttattgagtctttttctttagggtttctggaacaaaatagtttttgtcaaacagcttgtacatgctatgaagtatatttaatcaatcataatagaaaaaagaaacagagcagcttgatggagggaacttgtagttgatatgtctctgcattcgtgatttacctgaactcaaaggaagttgatattccagctgatcacattaattcagctttgtctaataccaactactggaatgtactcattcacttatgttccacaaataatctatccaaaataaaacagacaatagcttgaaatatgtttcagcatttctaaatattttcacaagtaaaaagctgtcatatttgaaggtatttcttttctgtgataatactgttgattgtttcctgccctgcatgattagatgtaatcattatcaccagcaccaggaccaccatcatcgccatcatagactaaaattccttgattataatatatcaggatctattctaagcactttatgtttgtatcatttttcctcacaaaactcctataaggtagtttttttcttaatctcaattttgcagataacagaaaagtacacaataaaggggataaaatacttgctgagtcatatttccttactatgtcttctcatgtgtcaaactagttcatattttaacaatacataaagtatacttattgttaaatctgtaacattgatgtccttaattttctggcaccctagataatggcaattgaagactgagttatttctaaatcttttttcaagaagagatattttacaattaattgtctctctcaaaagtatatatatgcacattcaggctgctgtaataccttcccatctctgcatatttatataaatttaaaactgtgcaatttctccattatataagtaatggaaaggtttttgtttaactttgtttatatgtataggaagcagtgagagaaaattcaaaactgtgcaatgtctctattatataagtaatggaaaggtttccatttaactttgtttatatgtataggaagcagtgagagaaaacaataagagaagagaaatggaagagaagaccaggagggcaaaacttgcaaaagagaaagctgaacaagaaaagttagaacgccagaagaaaaagaaacaactcattgatataaacaaaggtatgaaaatatttccaatttttacaaaaatgcaagaagtacaaaataattgcagttatttatttttggattataaagtaaattttcatagaaaattcacaatagtattagttacttgtgctaaatttctctcatgatgctatgtgtggtttcctatctccctacgctgagcattcaggatttttgataaccaatgcaagatgatattttgttgagatagtgtttttctccctacttttcttgccatagtatattatattctggatgaggcagtggggagggaaaaagtgggtgagatgaaatgtgaaaaacgggtatggggagataagccttagcttttaacttcattttgttggcacatgtctgttggcagtgcagtaacagttaacagtcttccttggaagcttgaacattttaagtcctaagaaatattgacagcactattacaagttgaataaaatagggaaaggcatcttgcacagctataaacctaagtacaagatgctggcatgtccatatagtttaaagtaagttgtttgaggccgggcacagtggcttatgcctgtaatcccagtactttgggagaccgaggcgggagggtcgcttgaggtgaggagttcaagaccagcctgcgcaacatggtgaaacccatctctacaaaaaatacaaaaattagccaggcatggtggcaggcgcctgtaatcccagctgcccaggaggctgaggtgagagaattgcttgaaactggggggcggaggctacagtgatccaagatcatgccactgcactccagcctaggcaacagagcgagactgtatctcaaaaaataaataaataaataaataaataaataaataaagttgttttattggttagcaagagtgactgtatattgttggtgagttgtttggtttggttggtttactttctaaagaagagagggcaaaaaaagaaagtgattggtatcaggtatctgcacactgaaaatttaggaataaaaaaagcatgcatagtctttgtcacctgaggtttagagaatttaggaacaaaacaaaacaaaatctgaataagatacaaggtaatatgattaatatggaccatgtattactgaagataacaatagtaaaaattgcaagcactctataatattgaccacatgccaagcatggttgtaagacttttacgtatttatttatttatttttttgagtcagagtctagctctgtcgcccaagctggagtgcagtggcttgatctcggctcactgcaacctctgcctcctgggttcaagcaattctcctgcctcagcctcccgagtagctgggattacaggtgcctgctaccatgcccagctaatttttgtatttttagtagagacagggtttcactgtgttgaccaggctggtctcgaactcctgacctcgtgatccacccacctcggcctcccaaagtgctgggattacaagcgtgagccactgcacccggcacttttacatattttaagtcaatcctcacaccatctctatgaggtaggtactattatcatctcattttacagatagaaaactgaggctcatagaaattaaggaacttggccaaggtcacacaaacaggaagtactagcaccaagattagaatccaagtcgtctcactatagaatctttccatttacctatgccactgtcaggagaaaatgataacaacaacaactaacatatagcacttgctatttaccaagaactattctaggaattttacatttaggaaccaatttaatcctcatagaaccctattaggaaagtactactatctcattttaaaatgacaaaactgaggcacagagaagttaagtaacttgcccaaggtcacaatgatagtgagaggtagaaccaagatttgaacccaggcagtgtgtaaccagagttaattattattatgtgtttttaagtgtaattattaattataacaatcattatcaagtattttgcagtaatgtcttaatggctaatcttctaaagtaatatccgtactgttaagtttagtctttgtacttttaaaatatataaacattttcaggaattgactatagtttatatcttccacccaggaaacaaatataacattttaacagaagaaaaaaagtaatattatgtaaaaagctgtgttaaaatagaatagtatcaacataatttagcaaacgaacttcataattagaatcaggaaaactggtcatgactgaggtcactctatcaggaggtaagcactagagtacagcatggcaatatgtgtttataggaagttatcattgaaaaggtgaagaagtcagtagaaaagttctgaaagtggctgggcatggtggctcacgcctgtaatcccagcactttgggaggctaaggtgggtggatcacgaggtcaagagttcgagaccaacctggctaatatggtgaaacaccgtctctactaaaaatacaaaaattagccaggcgtggtggtgcgcacctgtagtcccagctactcgggaggctgaggcagaagaatcgcttgaacccaggaggtggaagttgcagtgagccgagatctcaccactgcactccagcctgggtgacagagtgagactctgtctcaaaataaaaaaaaaaagaaaagttctgaaagttagctcctttatgtgcagggaggagtagtcggagaagaggccagaagagatagtaggggacaggggacagattgtgagctctctttctttcttttttttttttttttaattatactttaagttctggagtacacttgtagaatgtgcagttttgttacataggtatacacgtgccatggtagtttgctgcacccatcaacccatcatctatttctcctaatggtatctttctttcttttctgctatgccaagggtcttaatgctgaaagctatgggaagcccatgaatgtttataaactggaaaatgatgtacatagtcaggattcttagatcattttgtttttgttttgttttgtttttttgtttttgttttgtttttgtttgagacagggtctcactctgtcacccatgatggagtgcagtgccatgatctcagctcactgtaacctcccagccagaaaggtcattttgacagaagcagaaagaatgtattagaaggggaaagccctaagaaaatagaggttatgaggatattgtcatagtcctgacaagagatgatggtggcctgaactaatacagtgacagtgagatttaaaaagcaacaagaggtgtattagtcagagttcttttgagaaacagaactagtaagatgtgtgtgtacacaaacacatatacacacacagatttattttatggaattggctcaagtgattatagaagctggcaagtttaaaatctgcaaggcaggaggacaggctagagacccagaggaaagccaatgttacagttcaagtctgaaaactatctgctgcagaattctctcttgcttgggggatgtcggtgtttttgttctagtcaggccctcaactgattggatgaggcccactcacatcatgaggtacaaaccgctttacccaaagttcactgatttaaatgttgatctcatccaaaaacaccctcacagaaactaccaaaataatgtttgaccaaatatctggacattgtggcccagccaagttgacatataaaattaacgatcatgagagggtgttaaaggacagaattgacaggtgctgatgattgattggatgtgtaaatcaaaggaggcaagtgttaaagaagatggtatgcttcacagagaaagcaaactcaggaatagagcacattttctcaggagagttacaatgactaatatcattttaaacatgtttagttccaccttgtaaagatggaaaatgtctaagaagccattgtatatgtgattgtgaaactcaggaaagaagtctaaactaaccatatcggcttggggatcattggtttttatttgaacattaaagttacagtgtactagtttgccagggctgccataagaaaatgccacaagctaagtagcttagaacaacagatacatgttgtctgacagttctggaggctagaagtccaagatcaaggtgtcagcagggtcatgctccttttgaagagtctacggtaggatctgtgtcagacctctctcctagattctagtagttttctgctttgtcacagcataacttcaaccttcaaatggcattctccctgtgtgcatatctgtcttttcacatggtgtttattttataaaaataccagtgatattgaattaaaggcccaccctactttattttatttctttagagatggagtctcactctgtcacccaggctggaatacagagatgtgatcatagctcactgcagcctcaaactcctaggcagaagcaatcctcctccctcagcctcccatgtagctgggaatataggtgtatgctaacatgcccagctgctcttagttactgtttttttttcctaaaataaatattttagaacaatcacctcttaattacatagttcaacttatagcatgtgtgtttgaatgggatcaccacggtaaagtataaatcagaggttctgaaactatttgatctcagaacccatttacactaaaaatcattgaggaccccaaatgccttttgtttatctaagttgtttatattgacatttatcatcttagagttgaaactgagataattttaaaattatcgattgattcaattaaaataacaatagtaaaccttttcatgttaaaataaataaccttttaaatgaaaactacctatattttccaaaacaaaaaaagaattagaagagaaaaagaataatgtcataaatctcttcacagtctgacttaataagacagcttgattctcatacctacttttctattcaatctgattcaatatcattcttcatgtaacttctggaaaacttcacgatacactcaggaaagaatgagaaatagaaaggcaaaaaagtgtcagtattattatgaaaatagttttcaccttgcaaatccctgaaatgatctttcggggcctccaggagtcccccgccacactccagcattgctggagtgaacaatgaaaagagtaagtggttaaaaatggagcctatcggccgagtgcagaggctcacacctgtaatcccagcactttgggtggcctaggcgggtggatcatgaggtcaggagttcaagaccagcctggccaagatggtgaaaccccgtctctactaaaaatacaaaaattagctgggcatggtggcaggtgcctgtaatcccagctactcgggaggctgaggcagagaattgcttgaacccggggggcagaagttgcagtgagccgagatcacgccactgcactccagcctgggctacagagcgagactctgtctcaaaaaaaaaaaaaaaaaaaaaggagcctatccagttttgttctgagaatgtaatctttctcccacactacagcaattcctacgctcctccaagtgtttattaacctttcactgttctcctaaaaatgtgtctataacagacaaagaaagaagggcttattttgattgtgtctagttgttataggaccaacaagtttgtatgcctgctgcacagtaacagaccaataccctgagacaactgggatgcagcagagaaagacattaatgattgcagggcaccaagcaaagagatgggaggagaccctcaaatccatcccctcaaggagttctgggctgggatgtttaagtggatctcggagagtagggggctggaaaattggagtcattgattgaccagggcaagggggatgaaatcatcaggatgtggaaactgcattctttggtgagtcagcttcttgtgggatccttcagaccagctgacatcagtagtttcattggtacacagcactgaaagaatagctccaatggaaaacttaatgttttataatgttcaagttgttatctacacagcagttaaggggaactataatcttgtaacagggtctgtgtgattttgaagcaataagtaccgaacaactatgaggaagcaggtcaagccggtcagagagcaagctgacttaatgattaacactgaatcactgaatgtaccacaagcttggtttatctttttccctgctttctgtctttttttttttttttttttttttttttttgagacagggtctcactctgttgccaagactggagtgcagtggcgcagtcttgtctcgctacagtctctgcctcccgggctcaaacgatcctcccacgtcagcctccccagtaactgggaatataggcacacaccaccatgcccagctaatttttgtattttttgtaggtgtgtggtttcgccatgttgcccaggctggtcttgaactcctgagattaagcgatctgccttggcctcccaaagtactgggattataggcgtgagctactgtgcctggcctattttcttttcttttcttttcttttcttttttttgagatggagtcttgctctgttatcaaggctggagtgcagtgatgcaatctcagctcactacaacctctgcctcctgggttcaagtgattctcctgcctcagcctcccaagtagctgggattacaggcatgagccaccacgcccggccttggcctattttcatttctttctctcctttcttccctgattaatttttaaatttttatagggatggtttcatagtctgtatgtattttcatttgctaatatttagttaattaccttttcaaatgtcattgagaccgtaagataaatatccaaataagtttttatgcatatgctcagctgagtgatttgagcatgaaaaataaatttttaaaaattggatttattttttatgttttagtaccatagctctatttacgtatcagtcaaatagtaaactactgttaccttcttgactcatggcccatgtgttacaaatattattattatttattgtaatgttactttatacttggactatatgtgcctttgtacttataaatatgtttcaaaaacagatccttccattgcaagtgtgtagttttaattatgaaaatgaaaagatgcaggaaagaaagagtaagaataatagagttgggtgtctgtcaagatggagctcactgtctgagtttctcagagagtgtcttatgaaagatgctcttatcaactagatggaaggcagttgtgagccttctgagagctgggaggaatcatgatggagacatatcatatgtgaatccatggggcgtgaaagcctatggaagatgtgagtgaagtgtcatcagaaagtgatttatataactttaaatatgtccaattagaacattgtaatcttctcttccaccgaaagagagatgatatagaacatttcattgccattgcgaggtatgtaatatatagtacatagaggtatttcatgcatgggaccaaagatacataccattggaaccataggatcttacctgtaacaaaagtagagagttccctggataaagtaagtcacattggaaattacaaataactttttaaaaaagtgtacactttccgtaaagcttctatttcctatcaatgtagcaaaggacaaacacttctcccccaaccttttttttttaacacatctattgcttagtagatgtaacttagcaaaagtaaggtatctttatgtggcatgcaaaattatatacattcatcaaggagaaatatttgaggatttaattattcagaaaaataatagtataaagcaaacacaaagattatttctgtaatctacatttgatcaactgagctcagaattaagtaatgatatcatgaaaaccaagcagccagagaattatatctttcaagttaaatccataaaaaaataccatgtaccaaggctatattttgagagatttggagatcagaaggcaaatgccatgataagaaacagtttttttaattgtaaaggagaaaatagatatgattaaatattaaagagacaggcattttataaacattaagtggtattactaaaaatttaaattctgtgtgttcagaagtgaagatcagtcttagctctgctacctagctttatgacctagttctgttgccttatctcttcatgcctcagttacctcatgtgtaatataggataatgacattcacctcttatagttttagtgaagattaagtgagataattaagtacagtacaaaacacaggacctagaatatacttgctgctgctgacacgatgaaagagtcatttttatgcttcttgaagaatctagtaaaaactcaagaaatagtctccacccttaagaagttttcatttttgtcagagaaataaaataaaggtgacctagcaaacattaaactgtgtgctgatacataatagagattatttgctctttaactctatctaaaaagggaaatcagtgaggtctggtaaaattacataaagtttcatggagaaggctaaatacagcctctgaacataccagtcaagctagaccctgaaggatgggtaacatttggctgagcagaggtgaaactatccaagtaaaagggaataacatcagcagtagtgcacgtcagcacataaggcagcatgctttatgtaggatatgtgtatagcccacaggaaaatacatcaaaacgattaagagaatgggtcctaagttcaagtcccagcaccacagtttgctagccatataatctctgacaaggtgtttcatctttctgtgcctcaattttttcttctgtaaaaccagagactggtgttatttatactgtagtctgtttattgattatacgttaatggcatttggcctattaccagtccctgatagttaaatgttcagtcagtattttctgttggtgtcgttttagtgaagggtttgatttggaaaattgttggaaaggtaggatggagccgggctgtgaaagagccttccaagtcaggcaggggagttgtggcatgatgaggtaggagagctaaggtcattatgggaattcatttagggattttcaagaagtaagccagaagcacaagaaaggagaggagactacaaggaggatgtagctggaaaagaacagtgaaaggtgatgaaaagggagtgagctcatacctgattctctcttcaaaggagtttaaacctgaagcagtttgagaagatggtaacaggaaggaaaaaatttcataaaggagattttaaaagcagttggaagttgcaagcaacagattgactgatgagcaagagacatctttttaaaagaacagcacagttttaccagtagataattatatattgatatattttggcacattaggctatttgatccatccaatcaacgtttattgcaccattttccaaataattataattagagcatgcacagtaatataccacttatttaaatgtaaaattgagaaagctaatttaaatgcaacaaaaatatgctaagtcaacaaatgtactctaaaatgcgtgcaacagtatgcaaactatgtaaagtacttggtctaatctatgttctccaatgtttggctatattgatatagaggataattatgttagggaccactaaaaaaaagattaattagttctgtaggtagaagagaaaaagcttaccaaatatttgtaaataaatctctttcttttcatgtttatggaagtcagcaaattaactgcaaaatcttagaggaagcaataggaaaaagtatgttaaaatgggtattttgaaattgcaaactataagcatgattcttatgcaaatattaatttaatcaggaagagttttactcctccttgtataagattatatggaaatcagaattgcctgtttacttctagtgtcatgataaagaatgaggtaccttagatttgatgaaaaatcagtcttcagagagttgatgagcagttttgccaaataaacctaaacatttaaactctggttgatagcaattttgtttttatctgttttcctagttgtaaaataattacatcttataagtgaataaactcatttcacattatattattttgatctgaataggtcaatttatgtttcttactgtcataccccagacattaaattatagtcaccaaaattatagattagaaaactcacaaataatggaattgattcaagtagcagtaaatcacctccaataatataaattaatgaggcaatatcggtactatcgttccggcatatttttacaactgctaataaacagctcatagatgctaatacaaagtaaaacaagtttgtatgcttggtggacctagaaaacagtctttggcctagcaaagccttacctatgaagagaaaaagtgtatctggctgatactatgtttactttaagttacctagtttcctaccttagcaaagatttcaagaaatctatgtttatataaagatcagaatttttttctctttgttctctagatttgatttttcagtgaaaatttgggttttgtttccccagataaaattattcagtacagtaaagacttacccaggtctttggagcttctcacacattaagatgtttagtatgaattcgtgactttgttattttaatgaaatatctttaggtccatgttaaggcaatatcgtgtcatgctgctgccattcagtcaacatttgttgaatttctaagttcaagcattgggataaaagatattgagatgcaaagaggaggagctcccattgtagcaatcatcaaatgataaaccacaccctgctggttgaatctgctgatccccagtgacatgtaatctgtcagatctctccatcattggtttagcctgtgattgaaatgagtttacccctcttgcctttggagccagacaaaaccagttcacatcatggccctgctccctacatggtgtatccttgaacaactcatctaacctctctgatcctcgaggacagagaaaacaacagcatcaacctcgtaggattttcataagaagtaaatgagaggatacatgtaaatctcttagtacttgcctggcacatggttagcatgtaataagtgttaaatgttatccctttgataataataattatttagtgaacatatcaaggaaaattatcaatggcaataatcattacaataagatcttgattgactagcctaaaagaagtggagttttgattaatctgactttataattatatagaaagctgtttatgcatcagtctttatcatctgaaatctttctcaactctttgtacaactctcctcgcactctcccaaccacctccgcccacaaaaaaattttggctttacatgttacacaggtgaaaatgtgcagcagcatgtggcacatagatataattttggacatgtagccagcacacaatatacatttactggtagatcattaggatttcgttattgtctctgggccattattcagagcatcagtgatcagtatacactagcattggagcatgtgctttatctgtactatttccagaatacactctagattaattgaagattctagttattttttcctgtagcctatttgagccacttatcactagtaattttttttttctgaccccatactaaaataattacatttctggcttcagttctcgggaaataagtgctaaactctcattctatctgccttagcagtaaaacaaatttctacatctactaaaaatattcttttaaatgagagacaaaaataaatatgtgaaacaagataggtaatatactttagatctcattaagagttcttacattctaaatgcagaaactcagatttgcaaaaactgtaagagctgtcttcagtgtgctgaacatttaacaagatttcatcaatttgtatgtagaagatgagtaacactggcagttacaaatttggcttttctctacaatatatgcttgttgctatatatgatttatgcaactttactaggcagaaatctatgaaaatattagagcaggtaagtgaaaacaataaaactgactatataagaaattaccaaaacacattgtaggtggcctaatcatttattaaaaacatgctttgttccatattttaatattctaattcttattacagaaaagtgtcaaatgaataacagctgttatacagcaacattgcaattaattttgctctgttctcagtcaaatgcacttagattcatgtcagtaattacacctaacagattcacagaaccaacaaactgcactgaacccaactgagtctctaatgacttttttttaaattatatttggtccacccacattgaattcccgagcccctgggctgctttagaatcaggacaaaatctactgttacacttggccgggcgcagtggctcacacctgtaatcccggcactttgggaggctgaggcgggcagatcatctgaggtcaggagttcgagaccagcctggccaacatggtgaaaccccgtctctactaaaactacaaaaattagctgggtatggtggcggatgcctgtaatcccagctactcgagaggctgaggcaggagaattgcttgaacccgggtactccagtctgggcgacagagtgagactctgtctaaaaaaaataaataaataaattccgttgttacactgaatgtgcaaaaggattatggacaaaaacctttcagtgattgttaatttaattccacaagtatttattcagtgcctacagtgtgctgatctgtggtgacatatcctaatcaaagtatgattgactgataacttagcactattaacctatttcaggggttattaactatcagcctttctccctctcttatgtgtgtctgttctgtaagaaataatggttgttgcttcatgtagtcccataggtgtatgtatatactcacacaggaccgtatgtagcatataatatttttcacatatcatatataatctcttaaaatcatctatatttctttttttataaatagtcaatcctcagtcctctgttacacccctcacacatgaacaacctataaagtatatagtatcttaacttgttagtgggataaaatggaaaagaagacatcgtttaagaaagcaattatacctttgtcacaatggtattaggaagacattaaaacctaaacttagaatacctgcttgtcatatatatcaacagtaggtttcatatgctatttcgtaacagcttagaagatgatggtatgattcatttgaaaatcaaaaaataattatccttttaaatgtgcaattaactatggatggcataatacttttatttgtttgaaccagcactggaatctactttaaatgtactttaaaaaaaaaaattctttttgtcagactagatatttcagagctcctgtatttgatttagccttttctatttgctgagccctggagaaagttgcgtaggaattatttggggcatcattaaataggatggatgcatataggtctaggaagactcaggcatagccctgctgaggattggacagggtccaggaggttccttttacatccgtgtggttctgtggtataagataaccacattctcagagtatgctggtttaggctgtgttgtaatctgtaaatcatagtgtcttgttttgtttgtctctttagtcccatatttttataatgtaatccctaccccaattttttagctaataattttacgcagttgagtgtttgaagttgaagaagttttccaaatttcctgttgatctcaccaatatctacacattcttggttgagtcactaccttgtctgattttctagaacagtatttctgtgaaaggaaaatgtgttccctctagtcctcttttgtcaaaaaccctttgcacttgctttcttttgccaattgaaccttttttgaaatgcatcagtagggagagcttgcctagcctttgctagacaggagtagctgtaggtgcatttaaacaatccaacttgaaaaggggatttctctctttctatttgaaaacaattgaaaatgaaaagtgtatgtctcaggacagagtgcttaaccgacctcattctactgaacttcagcatggtatatgaaactacctcccctgtgtcttccccagtgttttaaaaagatgcttaacttgtttgaggcaactggttctgagtcagagctctctatccagcatcaccagaatccattatgttgttaggtcttgttataccgttctttgcatctcttttttcttcactcaaatagtcaatacagctttgttctaagggctatctgatcatgttttgaggggaaatcgagattgagctatagagatgaactatggttacattaacctttaaatgtaaccacattccttcccccacagtacattcacatgcagcctgtacttttaagtaatcctgtaagctcctgtggctaaagcatgttgaaagtatctattttcaactgagtaaccctgacagtagatgaaacctccaaaagatacctccctcctcaagggtggaagtgggggtaggggcaatggttggcagtgcagttttcagcctattctccctcatcctctctctttttttaagaccctagaggagcaaggtaaacatctttataaggaaatgtatgagttagctcttttaaaaccacagataagtataatcttaggaaaagagatcatgtgccctagactttagtagttaacatttcttctgaaggatgtgattttttttttttttttttgtgatggagtcttgctctgtctcccaggctggagtgcaatggtgcgacctcagctcactgcaacctccgcctcccgggttcaagcaattccaattctctgcctcagcctcctgagtagctgggattacaggcacccaccaccacgcctggctaatttttgtatttttagtagagacggggtttcaccatcttggccaggctggtcttgaactgctgaccacatgatccacctgcctcggcctcccaaagtctggtattataggcgtgagccattgcacccggccggatgtgattttttttaaagacaaagtaactaaagactaattgatgctgacataccaaagtaaaaccagaagtctgtattgaggagccatctcaaaaatttactttaagacagtatgtcttaaagaaaaaaatgtattatttaaatggaaagtaggaccatatgccaggttttgtttgttttgtttgttgtcatatttttgttgttgtttgagatgggacataagagactagttgcttgtctcacagatatggtagggaaaggaaaccttttggtggaagttagccatctcttcaatctctgatattcaaggagtacccagttttggttcaccaaatgtaagtcctttgttataagcatcctcttttatgttggtttgtttggcctgtagacagtttctgaaactaatttcttatttgcatgtaatgctttcatataatattcatctgtaaaaccatttggatttttcgagttgatacatttttatcattctgctgcacctctctcccctccttctttgggcttgttgcactgtcatgctcctcctgatgcattgcttcctggtgggtgacatcatgatttgtgagcaacccgatatataaataaggtggtgagaactgcctcagcaattcagtttctatttgaaaggcattaagcagcctctttctgttttcttacatttttctctactttgtgttttcacagttttattaggcactgtagaaggacctgtttttctctttcattacatttctgaaaatcattaggttgattcaaaatcttttggaaatgtaatgcccccttatgctataatatacctctcatactgtatacattttggtcacacccagatgtggagtttagcaataactaacaactactaatttttaggagcatcctaggaatacagatgctttcagcagtatgtttttattttcactgatattaaaggagtatttatcttagaagagtggtaggaaagcacacatgaatttggaccttaatccttgactatgtagacattgaatattcataggtgttttgtgtgctatggtaggtgtggaaatatatgtgagatcaatatcacttcacctcaatatcttcaaaagtgaatatggatatggttttgttagctgaactcattagcaaagatgccttttaaaaatagcaaaggttacagtatatataatgtatgtgtgaatatccacatattattagatagattccaacatgagtatttgtatgtgtttctgttaacaatataatttactatcacagcttatttttcaaaattccattgaagtataaagctggttagaaagatatacggcatctttttctttttttcagctctcctaaggtataattgacaaataaattgtacatattgacagtgtactatgtgatgttttgacatatgtatacattgtgaaatgattaaatcaatctaattaacatattcatcacctcatatacttttttggtggtgagaacattttagatctactctctgagcaattttttagggtacaatacagtattattaactataaccaccatgctgtacaatcagtctccagaacttattcatcctgtctaactggaactttgtactctttaaccaacatctgcccatctcttcccccagctgttggcaaccaccactctttctgcttttatgagattgacttttttagattgcacatctaagtgagatcatgcagtatttgtttttgtgtaaacaagcatacagtattgatgtcaaggtcttgtattacccaccttagaacaagacagtaggatcattatttttattcagttaatgttcatttatacttacccacatattattcatttttttttttttttttagacaagggagtctcactgtgttgctcaggctggccacgaactcctgggctcaagtgatcctcctgcgtcagcctccccactagctaggattacaggagtataccatggccctagctccacattttactcttcattcttttttagcatttcagagcatccatctggaattaactctttttgcctgaaatactctttcctttgggcaatgatagcaaagtatttgggcagagcttcttcaggaactttctgagtcaagtcagacccaagccttgtcccacccctcccccaaggcatgggacctttgcccttcttgttaacctcctatgatctttcattcctattgtcccatctcactaacagtgttcctcgtgtgttctgactcatcactttagctgattctctctcatcccttagtttacctggtttcattttctgatttagggccttgcatagtctgattgattagtctcagtttcaagtcataacctccttgctttctcgaggttcatccagccccactcccctcaccccaccccttgttaattagcaggccaatgtactaccatctttcagcctgagtttcttctgaaagaacactgctgttctctgttgatactgtagcatcttggcaggtgcctcaggaaccctgctactgtgggtttagtacttcagattcttgccatgctgcagcttcagcataacctgggaactggttagaaatgcaaagtttctggcttcactctaaacccactgaataagaaactgggtgggggtaaggggacagcaatccattttctaacaacctccctaggtgattctgatgtacactaaagtttaagaaccctagagcccaatgactcatcttatttcacaagtgtggcaactgagttactccaggtccataaagccagtttagtgctaaacagtagagccaggagtagcctacttcagcccaccaccttgtctactaggcttctctatgttacttgtgctgaacattgtttttagttaaatattagaactgagtcatgacattgctgtacatttgcaaatgagaggcttgtcctctaagctttgcattccttctgccagtgacagtatcagtcagaatcaagtagttctcagtgacaaagtgggaggatacccttggcattggactctttacagggaactcagtagagtctttgtgttgttcattatggctttggttgatgtataatatattgccatgttcttaaaactaaaacatgctagaataaactcaacaagtgataaggaatgatcatttgcatcgtgtgtgtgtgtgtgtgtgtgtgtgtgtgtagatgtattaatatttagtttgtaaaatgaattaccagagaatttcttaagtagcaatgtccctgtatattaaaatgtaactctttgaaagtgggaaggaggtagataatgagttggataactgttcaggaacacatctactgaagagcacatttacattctcttagttcctaatatagtattagtatacttattcaataattgtccttgtttgtatgtactttagaacattttgttcacccttgctggatgttctcatatcttctttagataacaagtaaacatgtctgagagtttccatttgttttagtttgacatctttgccctataaaccctcatgtatctgaactttagaggaaaggaaatctgaagctactatttcaatcttttctgctttcaattttatttttaacaaccaaacagttctttctgatgataaggaatcagagcattgagaccattttcttactaaatcatgcttatgtggatggaaaaagttagtgcagcctctaacggaagtgacttaaccagtgggaaattcttcctttatatgattttataaatacaaaagtaaaatcgcattaagaaattatcaggaatagtaactactgcataattttgaagaccctgtaatctttcagatgttataagaaacttgtgaaaaatggacaaccaagatagtttatgatgttacagatgagttttgttttaccataactggctacataatttgtggagctccttgcaaaatgaaaatgtgggacctcttgttcaaagattattcagaatttcaagatggcagcagcagagcagtaaaccaagtgtgaggcccttctgagagcagggccctatgtgactgctcaagttgcacacccatgaaacctctgtggtttacctaattgagacagttaatgagagaagcaaaatgtgcaccactttgttcctggaataaaatgaatgttttgacttgaataaaagtgagaatcttttaacaaaaagccacttctacaaaaggctcttcctgtaagtgacctcttttattcatttcaaaatgtctttttctatcaattccagcatgatctttgtcacaaataaaaaagggagctttccccatgagaatttctgtcaagaaacaatcttcttcaactctcttctgatatgtgaagaaatagttcttatctctcttaaagtaggtttgaaccttattctctgatgaatactttacatactctaagcaaacagcttcaaatttctcacagattttgccgatgagattcccatttctcttttttagtccctaatgactgaaggtatcgtatctagggatagtttacaccacattctctataagtaatgtaataggacttatagcatttcattttgcagcatatctttgggtctgtttgcacttaatgtggagttcgctttgagtaatatcagtcctttgaatttgttttatgtgatttggtttttataaaacattaggatgctctctagattatccagcccagttccctgcctctaggtgtacctgaatgtaactctgtaagacaaatggttatacagtaagtttctaaatgtcccaggaaaacaaaaatgtaatggtacagataatcctttttttttttttttgagacagacttttgctcttattgcccaggctggagtgcaatggctcaatcttggctcaccacaacctctgcctccctgggttcaagcgattctcctgtcttagcctcccgtgtagctgggattacaggcatgcaccaccacgcctagctaattttgtatttttagtagagacagggtttctccatgttggtcaggctggtctcgaactcccgacctcaggtgatctgccagtctcagcctcacaaagtgctgggattacaggcatgagccaccacgcctggcctcagataatccctatatagtgagggatgttcagggaaataccagctgtacttgtattcctggcaagttccattattcttgaatgtaatcattattctttttttaattgcagttatttgatgtgtcttattcctttacttcagtgaaagttttatttgtaaacctaaccttatttatattcttggccgagaaaatagaaagcagacttttctacccagtatagtccactgtgtaaaactcttgaaaactttctcatcacatttgtcagctgtctctgatacatagacagacctgagttaatgattgttattgtttacatttcttttttctttaatgaaaaactattgaattattcagtttttattaaaagttcaatgatttttatatttcagatgctctttagtattcaatatattcacagcatactccaagtctccctcactggtccactggttctaatatttactagaataattttatttaccatatgcttgtgtcatattggaaatgttaggggaaaaattgaattttgaatgtgaaaggtcctttcttcttttatcaaaaggaaaaaaatgcattctctgacattaataaaagtcatgctgacgttctcttacaagaaactcactaaaatgacaaagagcatgaaaaaatgtaattaggtgtttgagctgagttggttggtttgttctcctacctgataaattctaatacacagaaataaaattccagttaatgagaaagtgcaaacatggcagatatatcgatattctagataatattgtcattatttcatgtgcttacgatagaaaaaaataaatttgacttttttgcaaatattgctgggttttcctctgaaaagcactataatgagtggatttatttattcaattctcagtgagttactggctgaatcaaggttttggaaaaataaacatgtattctctatctctaagtatattaactaatctataaaggcttgacattcattaatgcttgctgagggaaaaaatgagttctagagattgtgttttgctcagtactgcataacttactttcacaagctctgcttaagctttgatttctaaatctctccccagtgaaatcatacctcaaagatgtttcattaaaatgacaagataagctccctcgcatccctatgctggagtgggggcaagggacagagttttgggagatcttgcaaaacggttcctaagctttagggaaagaagtgcaaattattgacttcagtgaaaaattgacaacatctccatggtgaagacagtagccaaaagggtgggccaactgtgtgccaagcctccgcttgtcttgatcttgttctcatggttgtgctgatgactcatgggggttggatttgtgtaatgtaggaaccattagaaaatccatgcttttcaagtaatgcattttagaaaaatatttttaaatgcatattttcattgtcataacctgcattgtacaatcttccacttttcgttccctacctcttttctatttggaaatattttctcagagtgttggtagtagttcacatggcttaattatgtctctaaatattagttcaaaccatatgaaattgttgccatttgactgttttttgcctacaaaatgacaatgtaatatggttcaatctaataagaaatatataattcccaaacagaaaggtaatatcctagtattacttaatcactttttgttgtggatgaaactcagattctaccttagttgatcattttctggctgtgagataattttctcacagattgttggcattgaaagagaactcttaaataggaaaaccctctccctgggcatccagggccaccctggaaaacaagccttaatgaagtcacctgatcagtaacctggtctcctgtggatatagttctcctgtttgcattgtacatctttagggaaaaaatgcagtatagttggttaatttatcagtctttatttttgttccagtgaaacaaaatgccctggccattctaattagatcaagagtcactgtgatgtctttgatagagctgggtgttaacaaggtttttctcagctaccagttttcaaattgttttttaaaaatggatgattaatccatccagcacttgttgatttctcccggtttgactctgaggtggaagtgacatcttcctcactttactacccaattcagagtgtaccttaaaatagcttcctctaaactggatataaagatgtcagcaatgtgtagattctctaaatatgcttttccttctttgttcaagacagtgctaatgtgagtgcttagttactaaaacaaatataatgacatttttaaagcctcacacagttggataattgctttaaagaaatcatggtacatttttttacttcctcttcctgaaatagaaatcatagtcctattgaagacccaggattccatacgtcgtaagagtataagtagtgtattccttttaaaggatggggataaatttcccctatactaaaaatcaccagctgccgtagaagtgctgagtgaaaaatggttcttatcatttctttgtggactgcaatttccccctgttgatataggctataaataggaaataaacagccttgaatgaaatcagatatagtatgcaaagatttcactgatgagtttaggtgagcaactcataaaaagaacaaaatattgcctggtcctaaatctttgccaaggaacctttagtaacctccttgctctcaaccattttggcaaataccactttttaactccattttttggagagtaacagatatttgtttttgaatttttttttacataaaaaagagtaaaaataattaagaatattaaaaattatgactgttacacgaacaagcaaaataaacatagtcttgaatatcttttaatataattagcagtttctccctttatgacatttatctgagataatttatcagcatttggactatactaaaatgaattgcttttctaaacagtagaaacttggcttctgtaaatacctgatccatgccgaaagtataatgtagaagtaggcttttctattaactattgtttgaagaaccaaaagtctatagtatttttctgtgttcttcagatatattacatatcaaacaagtaaagatttttaaagaatatttcattttactttattagcaaataattctctttatgattattattactggccatgaattcttttaatctccaaattagcccacatagaggaaaaaaaaaactacacaatttgcctatttggaagataccttacaattctctcttttacatagtgctatctattgagtaagtgcccagtggttatgcattgatagtttgaaagagttaattggaaactacgtaggagtttgctgaaagcatgattgaagcagtgatgatgaactgtatctaagtttgccctgctttcctctctggagcccactgttccaagaagagacatagttaaaaacaaatttgaaattgtaaatcttttctagttaatcccaagcaagaaattaagtgcctatttgcaagtctggctctgaccatacctctattcattttactaaaatataatgatatttgcagacagtagtgacacaacagtaactagatggcaacatagtaacttcataaaatagcatatgatataaatcatggaagtttttgaattaaaaatatcaaagaactgcaaaggtcaagtagacacatcaacttaaagcacttatgaagttaagctctaaggaatgacagtcttttaatgccactattttctctggttttaccagctttggggaggttatttaagcataatttttattcatgactttattttaaaagaaccacatgatgttcagaaattgatataattatatctctgaggtattggtgcagaattttgtaattctataccattttcttacaagtgatcaactctcatgtaattcaatggcatccatattatttattcagtaatctgtaattatagatttcctctaatgaagcaccctatgctttattgccctgggttctcaggagctctgtgggtgtcaattttagaaaatttgaaattgggaaagctatattttcccagatgaacattataaagtaatgaagaggttagtaagtgttgccttgattgtttgaaacaccaaaaggcaataccacccaatatacaattatcatattacttttagtataccatcttctttttttaatttaaaggttagattcaattaaatggtagtagcagtatgttaaatttactgtgagtatatgccttaggaagttatttatctatttattttgaagttaatttttttctattggagaacaacttctcttttacgaagtaaagtatgtaattaaggtctacctgaattttaattattagaacagaatattattaatatgtatttataaaaattgtctaaattacctgaatttagaacatttaagtttctaaagcactcattccctcatttgattccttgaatagatctggtgagctaaagtatatttatgtggtagtctttctaaaagcaatattcatttaaacttggcaagtgtaaagtatctaggcttggtattttttcttttgctattttttagaatttatgtgtatcttttctttccaaaattaagcacatgagggaagatgtataggtgtgaacactcaaggtatgtacaaaatgataaagacaagtagcctaacggggagttgaagaagccaaagaaaaatttttggaagcaacttataaaaccattgtagattggattggatctgatacacattgaatcttagaaaagaggatgatgttattaaacttatagtttagtaatgggagagactagaaacagggaattcaacaagttaatccatgtagtagtaatccaggttaagggttgagtgataatgttggagaggaaactctgattatgaaatattttgcctgtgaagaagtggtatagctgagtcatgttttaaatttggagatgaaagaatgtcaaagaccatgcatagattccaagcctggggaataatcagaaatgaaaaaattgggataagaagtcattaggggtatggttgggtggggaatttgtccacgattaaataagtcttagacatgctaaatctcagatgatgggaaatcttgtaaataacattgtttgagggtagctgataatttagacctgaaatgggactgagcatgaatagtgaggatgtggattccattccaagatggccaaataggaacagctgcagtctgcagctcctagagtgatcgacacagaagatggtgatttctgtgtttccaactgaggtacctggttcatctcactgggactggttagacagtgggtgcagcccacagagtgcgagccgaagcagggcagggcatcacctcacccgggaagcacaaggggtcagaggatttccctttcctagccaaaggaagccatgacagactgtacctggaaaatcgggacactcccaccgaaatactgagcttttccaatagtcttagcaaatggcacaccaggagattatatcccgtgcctggctcagcgggccccacgctcacggagccttgcttactgctagcacagcagtctgagattgacctgcaaggcagcagcctggcagggggtgaggtgtccaccattgctgaggcttgagtagataaacaaagtggctggggaagctcgaactgggcggagcccacctcagctctgcaaggcatgctgcctctgtagaccccaactctgggggcagggcatagctgaacaaaaggcatcagaaacttctgcagacttaaacatccctgtctgacagctctggagagagcagtggttctcccagcacagtgtttgagctctgagaacagactgcctcctcaagtgggtccctgacccccgtgtagcctaactgggagacacctcccagtttgggcctactgacacctcatacaggcgagtgaccctctgggatgaagcttccagaggaaggatcaggcagcaatatttgctgttctgcagtgtttgctgttctgcaatatttgctgttctgcagcctctgctggtgatacccaggcaaacagggtctggagtggacttccagcagactccaccagagctgcagctgagggacctgactcgtagaaggaaaactaacaaacagaaaggaatagcatcaacatcaataaaaaggacatccacaccaaaaccgaatctgtaggtcaccagcgtcaatgaccaaatgtagagaaaaccacaaagatggggagaaaccagagcagaaaaggtgaaaattctaaaaatcagagcacctcttctcctccaaaggattacaggtcctctccagcaacgaaacaaagctggacagagaatgactttgacgagctgacagaagtagggttcagaaggtcagtaataacaaacttctccgagctaaaggaggatgttcaaacccattgcaaggaagctaaaaatgttggaagaagattagacgaatggctaactagaataaacagtgtagagaagacacctgatggagctgaaaaccatggcatgagaactacgtgatgcatgcacaagcttcaatagatgattcaatgaagtggaagaaaggctatcagtgattgaagatcaaattaatgaaataaagcgagaggagaagttcaaagaaaaaagagtaaaaagaaatgaacaaagcctccaaaaaatatgggactatgtgaaaaggcgaaatctacatttgattggtgtacctgaaagtgacggggagaatggaaccaagttggaaaacactctgcaggatattatccaggagaacctccccaacctagcaaggcaggccaacatccaaattcaggaaaaacagagaccgccacaaagatactcctcaagaagagcaaccccaggacacataattgtcagattcaccaaggttgaaatgaaggaaaaaatgctaagggcagccagagagaaaggtcgggttacccacaaagggaagcccatcagactaacagcagatctctcagcagaaactacaagccagaagagagtgggggccaatattcaacattcttaaagaaaagaattttcaacttagaatttcatatccagccaaactaagcttcataagtgaaggacaaataaaatcctttacagacaaacaaatgctgagagattgtgtcaccaccagcctgccttacaagagctcttgaaggaagcactaagcatggaaaggaacaactggtaccagccactgcaaaaacatgccaaattgtaaagaccatcgaggctaggaagaaactgcatcaactaacaggcaaaataaccagctaacatcataatgacaggatcaaattcacaaataacaatattaagcttaaatgcaaataggctaaatgccccaattaaaagacacagactggcaagttgaataaagagtcaagacccatcagtgtgctatattcaggagacacatctgatgtgcagagacacacataggctcaaaataaagggacagaggaagatctaccaaacaaatggaaagcaacgaaaagcaggggttgcaatcctagtctctgataaaacagactttaaaccaacaaagatcaaaagagacaaagaaggctgtgacatactggtaaagggatcaattcaacaagaagagctgactatcctaaatatatatgcacccaatacaggagcacccagattcataaagcaagtccttagagacctaagaagagacttagactcccacacaataataatgggagactttaacaccccactgtcaatattagacagatcaatgagacagaaggttaacaaagatatccaggacttgaactcagctctgcaccaagcagacctaatagacatctacagtactctccacccgaaatcaacagaatatgcattcttctcagcaccacatcacacttattccaaaattgaccacatagttggaagtaaagcactcctcagcaaatgtaaaagaacagaaatcacaacaaactgtctctcagaccacagtgcaatcaaattagtactcaggattaagaaactcactcaaaaccacacaactacatggaaactgaacaacctgctcctgaatgactactgggtacataacgaaatgaaggcagagataaagatgttctttgaaaccagtgagaacaaaggcacaacatacaagaatctctgggacacatttaaagcagcatgtagaggaaaatttatagcactaaatgcccacaagagaaagcaggaaacatctaaaatcaacaccctaacatcacaattaaaagaactagagaagcaagaggaaacaaattcaaaagccagcacaagacaagaaataactaagatcagagcagaactgaaggagatagagacacaaaaaacccttcaaaaaatcaatgaatccaggagctggttttttgaaattatcaacaaaattgatagaccactagcaagactaataaagaagaaaagagagaagaatcaaatggacacaataaaaaatgataaagggggtattaccactgatcccacagaaatacaaactaccatcagagaatactataaacacctctatgcaaataaactagaaaatctagaagaaatggataaattcctggacacatacaccatcccaagactaaaccaggaagaagttgaatctctgaatagaccaataacaggctctgaaattgaggcaataattaatagcctaccaacaaagaaaaagtccaggaccagacggatttgcagctgaattctaccagaagtacaaagaggagctggtaccattccttctgaaactattccaatcaatagaaaaagagggaatcctccctaactcattttatgaggccagcatcatcctgataccaaagcctggcagagacacaaccaaaaaagagaattttagaccaatatccctgatgaacatcgatgtgaaaatcctcaataaaatagtggtaaaccgaatccagcagcacaccaaaaagcttatccatcatgatcaagttggcttcatccctgggatgcaaggctggttcaatatatgcaaatcaatgaacataatccatcacataaacagaaccaaaaacaaaaaccacatgattatctcagtggttgcagaaaaggccttcgacagaattctacaacccttcatgctaaaaactctcaataaactaggtattgatggaacatatctcaaaataataagagctatttatgacaaacccacagccaacatcatactgaatgggcaaactggaagcattccctttgaaaactggcacaagacagggatgccctctctcaccactcctattcaacatagtgttggaagttctggccagggcaatcagacgagaaagaaaaaaggggtattcaattaggaaaagaggaagtcaaattgtccctgtttgcagatgacatgattgtatatttagaaaatcccatcatctcactcaaatctccataagctgataatcaacttcagcaaagtttcaggatagaaaatcaatgtgcaaaaatcacaagcattcctatacacaaataacagacaaacagagagccaaatcatgagtgaactcccattcacaattgctacaaagacaataaaatacctagggatccaacttacaagggatgtgaaggacatcttcaaggaggactacaaaccaccactcaacgaaatagaagaggacacaaacaaatagaagaagaatattccatgctcatggataggaagattaatattgtgaaaatggccatactgcccaaggtaatttatagattcagtgccatccccatcaaactaccaatgacttccttcacagaattggaaaaaactattttacagttcacatggaaccaaaaaaagagcccgcattgtcaagacaatcctaagccaaaagaacaaagctggaggcatcacactacctgacttcaacctatactacaaggctacagtaaccaaaacagcatggtactggtaccaaaacagagagatagcccaatagaacataacagaggcatcagaaataatactacacatctacaaccatctgatctttgacaaacctgacagtaacaagaaatggggaaaggattccctatttaataaatggtgctgggaaaactggctagccatatgtagaaagctgaaactgtccaggcatggtggctgacgcctataatcccagcacttttggaggccaaggcaggtggatcacgagttcaggagatcaagaccatcctggctaacatggtgaaaccctgtctctactaaaaatataaaaaattagccgggcatggtggtgggcgcctgtagtcccagctacttgggaggctgaggcaggagaatggtgtgaacccaggaggcagagcttcttgcagtgagtgggagatcacgccactgtactccagcctgggcgacagagcaagactctgtctcaaaaaaaaaaaaaaaaaagctgaaactggatcccttccttacaccttatacaaaaattaatcaagatggattaaagatttaagtgttagacataaagccataaaaaccctagaagaaaacctaggcaataccattcaggacatgggcatgggcaaggatttcatgactaaaacaccaaaagcaatggcaacaaaagccaaatgggatctaattaaactaaagtgcttccgcacagcaaaagaaaccaccatcagagtgaacaggcaagctacagaatgggagaaaattttcacaatctacccatctgacaaagggctaacatccagaatctacaaagaccttacacaaatttacaagaaaaaaacaaccccatcaaaaagtgggcaaaggatatgaacaaacagttctcaaaagaagacatttatgcagccaaaagacacatgaaaaaatgctcatcatcactggccatcagagaaatgcaaatcagaaccacagtgagataccgtctcacaccagttagaatggcgatcattaaaaagtcaggaaccaacagatactggagaggatgtggagaaataggaacgcttttacattgttggtgagagtataaactagttcaaccattgtggaagacagtgtggcgattcctcaaggatctagaactagaaataccatttgacccagccatcccattactgggtatataaccaaaggattataaatcatgctactataaagacacatgcacacgtttgtttattgcagcactattcacaatagcaaaaacttggaaccaacccaaatgtccatcaacgatagactggattaagaaaatgtggcacatattcaccatgaaatactatgcagccataaaaaacgatgagttcttgtcctttgtagggacatggatgaagctgggaaccatcattctgagcaaagtatcacagggacagaaaaccaaacaccgcatgttctcactcataggtgggaatctaacaatgagatcacttggacacagggcagggaacatcacacatgggggcgtgttgtggggtggggggcagggggagggatagcattaggagaaatacctaatgtaaatgacgagttaatggatgcagcaaaccaacatggcacatgtatacctatgtaacaagcctgcatgtcgtgcacatgtaccctagaacttaaagtataattaagaaaaaaaaatagtgaggatgtgaattaagacatcaccaccatggacaggaactagaagctttgaaactgagataacttcccagaatccaagaaagcaatggccacagactatccagtgacaccttggcctgttttctgaataattatctttcagcagcttgtttcagttttatcaacagacagaagtaagtctgctaagagcacaaatatattctagttaattgagaaagaatccagagtcagactggctatttcctggagcagattattgaactgcccttaagaaattattgagggatttagatcaaggcttaaaggtaaatccttcccccttccatcttgttacatcaaatgtaaattacaatattgagttatgataatccatatcagaagcatataccttcagctgtttttctgaagcttgtgacaagagacaggcttttatacattgctgaccatgttttgtaccatgtcatcctccactactttcacattagacaagaggttgattcttgacccaaagacagcctactttggctgctctactttgtaaaagatagcctgtaatatacacctcttccaaaaggctgttctgtgctggttgaatcaatttgattatttttcttagggagtttggactcaaagacacaaagatagaaaattagttggtaaatggcagaagagaaaattaaaacagatactaagagttaggtgtacatgagtagagctcatgagtaggggagaatggacaccaagatactaaagtcgtaacattaatgagtcactaggactattgtgcctggagggagagttgtggttatatcttgaatgatccttgggttctttgtgaggcctgaccatgcagctgctgaaacctgtttccttttcttctttacttctgcatatatccttatactaacccctcatctttgttttcttgcaagccatataacatgtttatcaaaagggttatagcagtagccaattaagtaacagacactccctcttttccttctccttcttccctgccccaagccactagtggatctaatttctctaaggaaaaagaggggcaggggaagtgagtggtgccacccatttgccccttcaggtacctgggtccgaaagacaaaccagcaatggaggagggaaacactttgaagcatatgtaagattaataattaaactacaaccagaaagttatggaatcttcccaagatgttattacaggacttgaaaggaagatttgacattgtatgtctgggagcaatggtgaagaaaaccaaaaaataattttatgttcataccctcactgaggtgagacttctcaataaactagatattaacagttatacatgccctttttcaaactacttttgcttttttaaaaaagcaaaaatatataatatcatcatataaaaggaaaggatgatacactcctcaatttgaaaagggtggttgtaataaggacacataagtttgcagcagtgtgcattcaaaaaatagggtggtcacacatacacacacacacacacacacacatacacacacacacacacgagatttattgtactttaaaaataatgaacaccggatcacctgaggtcaggagtttgagaccagcttgaccaacatggcaaaaccccatctctgctaaaaatacaaaaattagcctgggcgtggtgtcacctgcctgtaatcccagctacttgggaggctgaggcaggagaatcgcttgaacccaggaggcacaggccacagtgagcagagatcgtgccactgcactccagcctgggtgacagagaaggactctgtcttaaaaaaataataaataaaaataagaaacagttaagttccggcgtaaaaaatagaataaagttgttacagtaacccccacttatctgagaaggatacactccaagaccctgcccctctgcccctgccccagtggatgcctggaccctgtatacaatgtttttttttttctccatacatacatacctatgataaagtttaatttataaattaggcacagtaagtgattaacaaccacaataataaagtaaaacaattcagcaaaataggggttacttgtaaacaagtaccaggataccatgacaattaactgatcactgagatggtggctaactgactcctgggcaaggagcatctgtagcatggagacactgaacaaagggcaccatgctactcagaaaggcatgcaatttaaaatgtatgaattgtttgtttctggaattttccatggaatcttttcagaccatagttgactgtggataactgaagccatggaaattgaagctggataaggtgggatctactgttttgccttcctgcagttatgcaaggagttggcaggggaattgattcattatttaattttataatgaaagaaagaagaacattaggattcaaaagttggattaccaaatgatgacttgtcaactcattccctgcactccaagtatcagcaaattaagagtaccagttccttcatttgccacatttttatactccgtgggctgccattactattctcatgtgtcacttgtgttacagttacctgactgcactctcataaggacagttcttgaaaagccgcttccataccatacttgctttgtgcctgtgcttggcactgaagaagacacagatacacatttgacctcctgatggtgctctggaagccaaaatgattcctttccctctcaccttcctgattaggcttgtgtttgtgtgtcttatgaagatggttagctatattttacggtgttatattctgagatggcaatctagttgaagtccataggtaaggagctaggtcttttgtagagaagctgagtttattcagtgttattcagaggcagtctcagacagcaaagcaaaacttgaaaagcagatttccccttggcttttgaaaaacctctcttctcttttttgtgactgttcttttggaactggactttatgggctctaaaatgtaaattcagaaagaaatgaatgtgtaattgttgcttcattatcttgtgtcattcttggctttggctctccaaaattgctctcttcaattgcaagtagacttatattgaatgttgatgttctttccctccttccacctgtgatgaggccttgttttactgatgtggctggtccttgccaaggtccttcagcacctcaaaagcagattgtgagatccacacatatctgtacctagcatgatttttttttttaaagacacagcatctcactatgttggcccacactggccttgaactcctgagctcaagagatcctcccactttggcctcctgagtagtggaggctacgggtgcacaccaccacatccagcaattagcatatgcttgtcgttgacagtatatgctctagagcaggggttggcaaacattttctgtaaagggccacgtagtaaatattttaggctttgtgggccataaggtctcttactgcaacaactcaactctgctgttgtggcattaacacagctataaactaaacataatgaatgatcttggctgtgtttccataaacatagggactaaaatttgaattttgtgaaattgttatgtagcacaaaatattattctttttaaaatgtcaaaatcatccttagcacatgtgctggtaaaaaaccgccagtaggctggatttaatcacaagaaatgtagtttgacttcctctactcaaggcgtctcggggtcctaaagctggttctgtcacttcacaactatgtgaccttgaacaagttaattcacccaaattaccctcagtttctttacctggccaataaaataggttggtgtggaaatttcaatataaatctcttcgaacactgcctgccatatagtcagcattcaataaatggtagatattattaatattcctacctccaaagacatctttgttttatcttttcagagattaaactcagattactttggtacatcattttgaattgagttagatttgttctttttccaaatttgttttttacttacttttcccttcacaagccttccatgctcttagtaagtaaatgattctgataagacacacggagtatttcaaagctctctttgaaatattaattatttaaaatatcgaatgtgagatttttttttccagaggcataaactggtttttctggtaagcgttaacatttaggtttattgggtgcttgtttatttatagaatgtgtaattttcatctctcaatcttctagcatataggtaactgggaaaaaatgaataagcataaacatttttttaaccaccatttgctatcaaactctctcaccttatgcaaagtgtcaaaatgtgcctttggctgaaatgtttcttcactgaaactctaccattagaaataacaagcttctctttaagatatacatacattagggaaagttaactcaccaattcagttcccctaacaaacttttaggtaacacctaccatgtagacattttgggagaaatcacttcatccatccttcatcatttatcagtttggggtataatatccacttatgacccctaatacagtatttattccatggcaaaatgtacctaaaacattaattttaaaagtatttaggaacagtagtattcactatgaagtttatctgggatttgatgattcacctcactataggaaactgttaattacctgttctggcaaggagatgagatactagaatgaatgaactctctaaccgacattttcccctatggttttaactttaattgctctgagattaattttctttttagtggataccactgtgcaaggcctcaacctgggaatgtaatgtttttctgttttgttttacaaactttcgactaccacatcatgtaattactacactgcccctagctcatcctgtggattctagtaatttcttctaagctcctgtgtcctcttttccatcttgaaagttttcttcttttgaataagagcatctgccttcattattttccatagaactttatactttctatttatgccctcttctaatctctttggaatatcttgatttccttaaacactttctggctgtaaataacttcatagactattatcttagttaccatctgttgattttccaagtcaccattaactccattcttcactcacttccaattaaaccacaaactaacaaaatcctcttgtcgcctaaaggctttctaggtgcttgtggactgaaatataagttgctgaggtttttttgatgactattgacacagtgctttgccaaatggtttgatttctcttatttctgattcatttatggttttactattactcttactgatagatattaaagtcttgcagaacgatgtgttattttcaccatattgtggtaaccttttacttagtctttattatctcctattgtttcatgttaaattctgagagttatttgtcagccgtgggccttcatgtttgttagatctcagagaagggatttttattttcctcttctttaataaatgagcagtcttcaattttgtgttatctacaaatctgtataacttgcagcacgttcttaatctggaccatgatagataccgtgaaaaagattgaatctagcactggtttttcttgcactccacttgtcatcgccttcttatgctgtcaacttccatttactactgctgatgaccttgctcacaaaacaattttgcgtttctatttattcttttaccaataatgaccaaattggccatctgactgtacctagagttctatgcagaataatatttgtcactgcaaatcaaattgtatttgtcatataattgatttctctcccaatctggtccactttgcatgctacggtgaggctgatcttaaatgccacctttgtcatgtcactgtcctgttgaagatcaatcagtgggtttttagagtccactgaagcacattcaagtttcttaaaatgatatccaagctcctttagaactttgctctgatattacctatccaactgtaactcctgtatctttcaactctgtttctctcctcatgctttatcatggataccatccatattttatttcaggtggctatgctgattcaaagtggcctcaactcttttttacccccttaaaattatgtgatataaatagacaaaactaatatatgatgatagatattcagacatatgtttcctctgagtgggcaaaagagaattttctagagagttggaaatgttcaatatcatgattgtggtggtagttacatggatgtatgcatttttcaagactcttcaaactgtacaattagtatctttccatttcaacatttgtaaatttacacacacacacacacagtgcacatgtatgtgcactaggagttcagatatttagattttattatctgtgaaccagtatgatctgttttttttttaaatctgtttttgtgtcttttacatgaaattataataaagtgctctagaaatgtaatgttttcagaggcttaagtcccatttcttccatgaaatcttccctaactcctcaagcccacagaaagcttagttttatttttaaaaatgatttcatatgtgcaagtattatctcacataaagaagggtcctactttcagtaagaagccttttgcttctatgggatcatttaacagtgattggttcatagcaacttttttcaactttgagcagctcaacttttgcagaaaactttaattatacaatctagaattcaaggaggctataacagtgaattaaaaccattatgcctcggttaagattttaggaaatgatttttatagtattggctttacttcagtaattttcaaggtgtgataaactggaatacagtcttaggaaatgagagagtccagggcacttggtgcttaagtgcctagaggagtaaggggtattctaattaataatgtttgataaaaaggaaggagagcacagagtaatttcaaaaactatgaagggtcagagattttgccctacttgcatgccaacaagttagcctgctgcagtttcagcgatgctggcagaacacacaagactcctgggtcagagacacataactcttgttattcattcatgatacagcaagcaatatgagcttcacgttcacattgttttcctttgccctccaacccccagagttggaaagcaaacctagaccagggttgggaaggcaaacctaggtggatgctgcactcacggtgggtttgtgtcattgctgaggaatccctgcttagggaacccaaatcttttataatggactgaacacaaacctgcctgacatttttcctagagggagatataacctgtctgcaaagcaaatgaacctgtcgtcttctctagaggaagacactgtatcttccaaggttgttttctgtaaaaacatccttgaaaagatagtacagaaaaaggccatcagtgcctctgttcacaaaatgtgcagaaatgtgagaaacccatagagaattgtctgtaagtaagtatgtgctagccaataggaataggcttgcacaaaggtatagcagaggtaattcatttacctagtgctaattgtaatctgtatcatctccaaacccttttgtgaaaattaagacaacacaacacaagtaaatgctgatactgaaaattaagcagcaggcattcggcatctactaaatgacaaatactaagggaaacatgaaaaagaaggtacaacccataccttttatttgatatgatgataagtagctcacacaaagcccacagatgcatgcagcccacctaagtccttagtaatatctgtgactttcaagctgagtagaaagttgcttctaaagtgttacctctcagatatgcccataagttattattttagtggctaaaagcattacaaaattttcccttgatattctttcactcagttaaataggtattgtatgttgtaaaaaacacattttttgcacgtgttcaataaagtttttgtcttttttaatgaaataaacacataaacaattttttttcttgaggttgaactcgtagaccaaaaaaaaccctactcactactaattacatctaagtaagaattaatggttctatgaacttggaagttctaagtgaactgtcaacctcaaattaaatcacatacaaaatttcactgaaatgcattcaaaatgaagagtaacttctttcaaaggatcatgttgacttccattttgttttaggaagactaactgaaatataatcaatcccatgattatattcataaaaccttgattcagtaaggttagacattttatgaaaaatactcagcttctttgaaagttatcgtggagcaaaagaaaaagtaatgggggactgaagcctacatttctttcctttaatacatcagtgatatttacaaaaattttttttttagcagaactatttggcatatatgttctcagaagggacaatattaccccaaaagggatgaatactggttcttgggaatgtgggtggaaaaacatcttagatattgcaatggtttgtagccttccaaaggaccgcggtacataaacagacgtacaagatatctgtggcattaaatgttaacaataggggtcattagaaaaaatatctaaaaagactcccagtgggaggaagacaataatgaaaaaaggttgagagacgttgctctagcataatatttcgacaagtatagtgaggtagcaactactaaattaagcaaaggtatttatttttattcccacttgactttatttattttgagacagggtctcactctgtcacccaggctggagtgcagtggcatgctcatggctcactgtaaccccaacctcccaggctcaagtgaccctcccgccccagcctcctgagtagctgagactatacatgcacatgccaccacacccagctatttttttttcttttgtattttttgtaaagatggggtttcaccatgttgtccaggccagtctcaaactcctgagctcaagtgatcctcccaccttggcctgccaaagtgctgggattacaggcatgagccactgcacccagcctcctctcaactttttgtcatatttgtttttccatctttttatctaattacaatataatagcattaaagaattttaataaaacaatatctataatgttatacatttttatgtttgcatattatttaggtaaatcataaatatattttttcagtaatttacatatatttacttttctacatagtctttataattatcatttttgtaaggatacataaaatttcacttgtgctgttgtcctcaccttcttgtacttatatatctctaaaaattccttccctgtcttctttgcaattctgcttctcctgactgcctgttaaaagttgggtttctctgattctggggaggggattaggaagacattagtcaaaagacacaaaatttcagttggacaagaggaataagctcaagagatctattgtacatcatggtaacagtagttaataacaatatattgtgtattcaaaaattgctcagagattttaagtgttctgactaccaaaaaatggtgacatatgttaaacagcttgatttagtcattccacaatgtttacatatattaaaacatcatggtagggtgcagtggctcatgcctgtgatcctagcaccttgggaggctgaggttggctgatcacttgaggtcaggagtttgagaccagcctggccaacatggtgaaaccttgtttctactaaaaatacaaaaaaaaaattagctcccgcatggtggtgcacacttgtaatcccagctacttgggaggctgaggcaggagaatcgcttgaacttgggaggtggaggttgcagtgagcctcgatcacaccactgcactccaacctcggcaacagagggagactcggtctcaaaaaaaaaaaaaaaatcatatactgggtgtgtgtgtgtatgtatatgtgtgtgtgtgtgtgtgtataatttttacttgtcaattaaaaattcttaaatattttttaaaaagttgaggttctctggaattgcatcttctattctatccttcttctaatatactttttcagggtaggtaatctcatccaccatccaatgacacccaaatctttagctccagcccagagttcacttttgcatttcggacccacatttccaacttctttttcattatttctacttatatatttcttagatatataaaatagatcacattttctcatacttgtttatccctggtcatctaaactcctctccttaatctcaccctccttctcttgcctgctaagtcctattgactgtattaatgccttcaaaatatccatcctctccattcactttgctctctgtttagttcaggatatgtgttatttagacaattatgctatgcacctaaaaatttccctgcctttttttttttttgagatggagtctcgccctgtcacccaggctggatggagtgcagtggcgtgatctcggctcaccacaacctccacctcccaggttcaagcaattctcctgtctcagcctcccgaatagctgggattacaggcgcctgccatcacacctggctaattttttttatttttagtagaatcggggtttcaccatgttggtcaggctggtcttgaactcctgagctcaagtgatcctcccaccttggcctcccaaagtgctgggattacaggtgtgagccactgtgcccggctaaaatttccctgccttttgtctcaccatcctctgagtcattctccacaatgctgtctaacaagtctttctaaagaataaatctgatcaggttacttccttttgtttatagctgatatgcccagtacagtaaccaccatctgcatgtagctattgagtgcctgaaatgtggctaatctgaactgacgtgtgcagaagtaaatatgtactagatttctaagagttagtctgataagaagaatgtaaaatacatcattttgaaaatacatttggttgaatgtttacttaatgtactaaaaatcaatttggccaggcgcagtagctcacgcctgaaatcccagcactttgggaggccgaggcaggcggatcacttgaggtcaggagttcgagaccagcctggccaacatggtgaaaccctgtctctactgaaaaatacaaaaattagccgggcatggtggcaggcgcctgtaatcctagctacttgggaggctgaggcaggagaattgcttgaacccaggaggcggaggttgtagtgagcagagattgcgccactgcactcctgcctgttcaacagagtgagactctggctcaaaaaaaaaaaaatcaattttacctttttttattttttaatattactactagaatatttagcattatttatgtggttcacatttatggcctgcattttatacctagtgaatcctgttaacttatcgaatagtgttcaagccccatatcatagaattttcatctttcatcatctgggcactaattcctagttcatttcaacttcttccagctattgagcaaagagcactgggcttggtatcagactgatctgagttcatacttgggcctctccaccacagttgaaatacatatagttcttatctcagtatgttgtgaggattaaaatatctaacaactgtaaagtgtcaactgcatataatttaattctcccaggtacattctagccataccaaactaccttcaggtctttttttttctattgaaaagagcaggtgatacttcagatgtgtctgtgagcttaatgaatgttgttttgtttgttttgtttttgtttttgtttttgtttttgtttttgtttttgtagatggaatctcagtctgttgcccgggctggagtgcagtggtacaatctcagctcactgtaacctctggctcccgggttcaagttcaagtgattctcctgcctcagcctcccgagtagctgggactacaggtgcccaccaccatgcctggctaatttttatatttttagtggactctgggtttcaccatgttggtcaggctggtcttgaactcctgacctcaagtgagccacctgcctcagcctcccaaagtgctaggattacaggcatgagccaccacgcccagcctcttaatgaatgttacaactacacaatcccctttccatgtttactcaatgggctctacttcatttttcctgttttcaccaaatattagacctgagaacctcagtgtttctcttcatttttttttttcattcaataccccatcctagagagtttattttaaaagaataaattattataacattggagaagtttcagatcaaatgcagaacataatcaaaaaatattttagcttgctcttgtcccataagaaaatgtattttcagctgggcgcagtggctcacgcctataatcccagtactttgggaggccgaggtgggcggatcacctgaagtcaggagttcgagaccagcctgaccaacagggagaaacctgtctctactaaaaatacaaaaactagccaggcgtggtggcgcacgcctgtaatcccagctactcaggatgctgagacaggagaatcgcttgaaccccggaggcagaggttgtggtgagccaagatcacgatcacgccattgcactccagcttgggcaacaagagcgaaactctgtctcaaaaaaaaaaaaaaaatgtattttcatttgtgatctcataccccatagttaattttttaaacaaagtaggatttagatttaactttggaatagcatcagaaacaatgtcctttccctcttccctccttcttctcttaaccctcttgcctgcaaattgtcatctacctcacactcacacatttagctaccctcaaggtagccacctatttagggtccttttcatcagctaggccagttaggaagagcaggctgagctcactggggattatgcacagtgtaatagagactttctggccattgacaccttgagacaaacactctaacaaatctttaaagtgtttttcatggctagagttgtcaaagataggaggagggtaaaatgttttaaatgctgtttctgttaggaatttccacgaacatcttctgagcatcccacttatggctccttaacagttctttcccataggaaaagtttagacacacagcagcattctaaaaaggaagtgggactctggctgatgtccctaaaagttaaaatgtggcctttcagataatgtggtcacctttttctttatacagtgttagcatctcaaaatggtaaaggatatggattaggtaagaattgaatgcaaatgtgttttgcaaatagtgttttctaagataatcgcagatgatggttgaatgccgaaagtattaatacaatcagtatttaaccttgtgtaactccgcttcatcaaatcacgccctgcacattgattgcattaagctgagtcagtggtttcttggttaggaatatcttataagaatcttaacaggaaggcagcagtagctgatcagctactgtttatttgcatactgagcgtgtcatcaataatacaaaagacaaggtctttaagttgaaagaacagtgggattggcatgaatttttcttaatggtgcataataagcaaagtagtctgtggtgccagaaactgacaggatccattatgttaaaacagatatatgtctttaatttaggggtattatgtaaatctgacaggagtttttccctttattttcctgtagtttaactttaattgctccaagattaattctgatttctccctttctccagagggtgatgagactggtgtgatggataatcttctagaagccctacaatcaggtgcagcattcagagaccgtcgaaagcggattccaaggaatccaggtaaaacacattccacctcacatagtattgtaaaatatgaatgttcagagcaaagtagcaacaccaaaaaaaaaaaaggaaaaataaaaatacttcctcatgaagactttttttaacagttgatctcagctcatgtgtgaaatctcagcaggcatctacatgattgcaagtttcaacttggtaaatgtatcttcaaataactgtagactttacaacaaaaatcagaaacaaggactcccactgtgtttaatattaaatattttaattgttattttatgagcatgtggtttaggtggaaagtagtttaaaaccataaatgtaattaaatcattaaaagtaattggccctaaggagatcacattagctattcacaggtaaggaaactgagacaatgcttgtttctagagaccgttttggttttgcagtgcagtctgttctctgtgatccatgttaataaagggaggagaggaacagatactccaagatcccctcaaatcccaaagtttttgtttttatatttgattagtaacagttaaagccacactatgaaaatagatctcaggggaagaaaaatcgtaaaagaagtaaaacaacctccctcacccaagtgaactggaaagttgtctactttctctgttcataccctatggtagaagtaaataatgtaatagctcctctaaggataatccaagtaggctgaactgtctacctcctctcagtaaagttttctatttgtagctcatatctttcttgaagtagagaaagaaattaggtatgttgattttaagactcctcttcatgggctgtaaagctatatggagaagtaaatgaaaaatggaaaattaatagtcaatatgtaaactctacttcatttagattaataagatttgccttaaatagcctgcaattccaaaaatattctctatttggactggaagttaccatgtgtcatttaatggaaattagtagctctcaaaaccattgtattgcaacaaacgagtgagagaaatggggcccagaacatagttgtccaggaaagcttttggcagtgatgaccttgatggcagaagacaatatatgttatattcatctttttcacatttgggtgaatcctgatggatattggataacattctgcctctgctatttatggatggtccctgagagattaacctaaagataagatttgattgagaggaaacaagtgttttggttggagtataagactacttttatgtatatgaatgcatcgtagatggcctacaaaaagggtggaagactggacgaaaaaaagaatggaagtctgtatttataagttcatattcattttgaaggtaatgctgcatggcagaatactaggagcactactcatctataactatgaggcagccattccacttatccgcagcctttgtctgtaaatgagaatgttctaccatgccatcaagcccctatcacctcttaaggaaaataaaaaccttcactgctctttcttgaactatcagagcaatagtagtcagtgaaaggtgaactgaaatcatttttgtatcaattcatttctctgttaagcagctgataagtgaaaacatgttattctgggccataaaagaactgccataatttttctaggctgtttattttaaaaatgcacatttgctaaagcccttgtctgattagtctcacacctcatactgattccagaaaaactgtacttggagagagagatcattccatggggtttctgtgagtttggtactcaagggaatatagtgttgtcaactgtgaaacaccaagaatatattcacaaactgcataattttatagtactgattccaagtaatctaaattgggatttcctttggtttgtagctggagtgcctccatgaacacatagggttaaaaatatcactcgatttagctgtggcagtcattccaagtggcagcagccaaagcaaatgtccagaggtaaaacgaaactcgaatgcagacagtggcagtggttgggaagcaccttggtcatcagtagaagagctggaagtgagggagtggggacagaaggcacagagtttacaagtctgccaaaaaactctgtctgcctctttctggaagaagcagaaccggggacttttacagatttcctccttgcctcagcccttcctagctagatcatcttttcctgctagtcccgttatttttactttcttaggcacctgatttgtttcctttccaagatcccattgacttggtattgttatactttccctgttcaacattgacattcttgatcttttccaacaacctccacttcagcatgatgagataaaagcagaaaaggctaattataaagaaggctatcttcccccaagtaaagtaaaataaaaggaaaatccaaaaaacactaaaatcagagtcaaccacaatcagcggagatgtacttactgctctgcttgccattttcattaccatcgcttatagatgggtattactgttatgtaaaatacagagctctaccattgtgtttctaattgtaatctttttatttattttttatttattattatttttttgagacggactcttgccctgttgcccaggctggagtacagtggtgcgatctcggcccactgcaacctccacctcctgggttcaagagattctcgtgcctcagcctctccagtatctgggattacagggacataccaccatgcccagctaattgttgtatttttattttatttttatttttatttttatattttgagatagagtcttgctctgttgcccaggctgcagtacagtggcatgatcttggctcactgcagcctctacctcccaggttcaagtgattctgctgactcagcctcccgagtatctgggactacaggtgcccgccaccacgtccagctagtttttgtatttttagtagagatggtatttcgccaggttggccaggctggcctcaaactcctgacctcaggtgatccgcccacctcggcctcccaaagtgctgggattacaggcgtgagccaccatgcccggccaaattgttgtatttttagtagagactgtgttttgccctattgcccaggctggtctcgaactcctgacctcaggtgatctacccacttgggcctcccaaattgctgggagtagaggtgtgagccactgtgcccggccatctaattgtaatgttttaaattttatatgtaaacaagatgaggtgatagtctgtattcttcattagaaaatcaaaatgttaataaatgatatgattagttgcctaaattataaatcgcccactctgagcctgtgccccctacccaagacctaccatatttagtaactcagaaggagcttccacatattgcctccagcccattcagcggatgtgctgtttcagttaagtaccaaaaggcatttcaaggtagactatcatatcagtagtgataattgaaaatatttttttttaataaaaaacaaaaaggctgggcgtggtggctcatccctataatcccagcactttgggaggctgaggtgagaggatcatttgagctcaggagtttgaggacagcctggacaacatagcaaaaccccatctctacaaaaaaatacaaaaaaaaattagccaagcatggtggcatgtgcctgtagtcccagctactcaggtggctgaggtgagaggattgcttgagcacggtaggcagacgttgcaatgagtagagatcgtgccactgcactccagcctggatgacagagccagaccctgactcaaaaaaagaaaaaaagaaaatattaactggtgtatcacaggccccagatagtcgaaatgtacacaggtgataaataacgactctggttgtactggtgcatactagctgaatattaacccagatcacaagctttgctgatgtcaaaatcagagattaggaaatgagcccctaaatattcatttattgtacatctgctgtgtaaaaggtactatgctgtacatgatgagggaagatgtagaaataattaagataagatttccttagttataagaccctgtgtattataggaacgataaaaagcacagaaagactacagaataaggcagaagataataagtatcatacaagaggtgttaataacatactgtgtgacttcagagaatgggacttgcatgcattatcagatatatcagaaaaataataatggaggaaaagactgaaggatgagtagggattccaacagtgagagctggagttagggatagtgggcattttagtcaaaagaaatgtcattaagaaaaacagaggcaagaaagttcaaagcatttttcaacaatggcaaacagtacagtaagaaaataggatatatatagcatagaagtataggggtaattctggaaaattaggtttgctccatatcagggagtgcttgaatgagagactaaggtgttaacttacaattctctaagcaatggggatttattgaaggcttttaagcagtggaggaacacaagttacgcattagaatatttaaaggagtataagtaatcaattaggagtctattgtcatattcttatttagagataatttagcgtgagaggagtagtcaagaggcaaagataaccctatggctttgagtatgactggctaagaagacatttgggttactaaacttttttttttttttttttgagaaggagtctcactctgtccccaggctgaagtgcagtggtgcgatctccgctcactgcaacctccgcctcccaggttcaagcaattctcatgcctcagcctcctgagtagctgggattacaggcacacgccaccgcacccagctaatttttttttaatttttagtagagacgaggtttcatcatattggccaggatggtctcaatctcctgacctcatgatccgcccgccttggcctcccaaagtgctgggactacaggtgtgagctaccgcacccagccgtaaggttactaaactattaagatcaagaaaaggagtggtgatagtagaagaaggtaaattcagttttggataagttaaactgaaagtgatagcagaacactgaggtcaagatgtccagaagatttttggaaatatagttacagatttcatgacaaaatgaattcttgagtgttctggatatagtgtggataggggaagggattgttatagggatttttaagagaaaagaaaaccaaagacagagacttggaaacaccttcactaaggggctaaaagaagatagacaaggagcaattgggcaggtaggagaatccagacattattgtcctagaaacaaaggaagagggaagtcctaagaagggaggagaggtgaacatttttgacaatgacatacgctctggtggaataaaaaagggtaaaaaaccgatgatttgctatttgggagctttctaatgactttttgaagagcatcctttcaatattgtgatggaactgggaagagaatacagagctatgcagagtagatggtgaggctatagggaaagatcatattcattcaacagttgagcagtcttattgaatgcctcctcggtgcattatactgagttaggtactgaggatacaaaatcaaacgggagcctagaggagctcacatactgtttgggaaaacacgaatataaaccatgtgatcaatttacaatgcggtcttctatatgctgtaatagagataggaacagtaagcctgtgcagcataggagttagagtaaccactcccaaccccccacctctctcctttgtgtctgtataatatgggctattctttctagcagtttggtgggtgaaaggtacatctcatttttccttcacaacctagtatggatttatcttctctgaattttgctaaatctttcttgatcctgtgttgttacagcctttgttaccacataagataataagttgcatacatttaccatctactttgtaaagaattgccctggctgtgtaattgtaagatcaaagataagctttggaggaaaaagaagcacatagagagacaccttgcaggagtgaaaatgactctttttttttttctttttttccttttttttttttttgagatggactctcactctgttgcccaggctggagtgcggtggcgcgatcttggctcactgcaagctccgcctctcgggttcatgccattctcttgcctcagcctcccaagtagctgggactacagggcctgccaccacgcccggctaatttttgtatttttagtagaggcggggtttcaccgtgttagccaggatggtctcaatctcctgacctcgtgatccaccctccttggcctccaaaagtgctgggattacaggcgtgagccaccgtgcccagccagaaaaccactcttaaaatacaaatacacaactccacatctgttttattgccaaatagctatagatacttagagcttgcttctctttcttcaaccaacccgacttttttattctttgcccactgtaagtaaatataaatgggcttctcagcaataggtggatatctaacttagcattttggctatgactggattttgatatatagttctagacattaaaaaaacacacaagagaagcattatgaagaaatgaaaccaggaaacaataaatgtattttggttttagaaccacacggggcaaccaagaaaactaaatttcaaaaatcaggagcaactcaggagacacatgatcctagttttatgtgtcagcaagataacagtataaatgagaaggtataatttaccatttgagaacagataggggacaagaaacaatgttatacaacagagaaaaagaaacctccgtatgtattagggaagaataatttcacagcaaaacaaaacccacatttccccaggcctcactgcctcatgtaaataagaaaactcaaattttgctggctcttgtctctacatacacattcagcacctcatctgctataagggatctatgaagcatttctgggagttatcagggggcatttcacagaaacaagcaaacaccaccgttcctccacctctgctataatatcatgcatttctacgcttgctgtcttctgtagcagcagggactcatggcttcacaacgccagagtttgacagtcatcattgacaaagtaggggggaaatgcctctctcttttcctttagtgcggcactccacctgtgtaccaagtagtactgcttatgcctcagactattacagataattttagagaaagagctttcaattttaaatgacaccctcccccgcccaccatcacagaggatttgacccaagatggcaagagccaaagacaagctcataacagatcccacgtaatactcagcatcatcttgatgaccaaggtctattgtggttttgtgcttgttttgttttattattactaggtcttgctggtcgttcattccaagctgtttacttctttctccctgaagataagttcttcttcatgaactttctcagtctctgttttataaatgtcagaatcttatactaccacactaagccccatttagtctataatacattcattatattgtaatatacaattaaaatctggttttagaaagtaatgcaaggaaataaataaaagcatgacattcatccaagtaatacttattaatcaaatactaggggccaggcagcagtgctagggccttggagtacaaatatgggtcttgcccttaaaaactcagagcctcatgggaaagacatatgatataaatttcataatataagtgttcaaaaagtgctaaaaagagcaactaaccgcctggagaattcaagagaggcttcatgatgaaagtggcctttgatctatgtttggaaggatgagtagtagtttgggggaaaacaagaggaataggcttttcagataaaggaaatgacaaaaacatgtgatggagatatgaaggagtaaagtggcaatgatgaaaagttagtttgttgtagcaaagagccagcagggggtttaaagtaaaggattacatgattttacacacacacacacacacacacacacacacacacgtaaatgagtttgaggctggagacagattttggggacatctgcacatatatatgtttattgaaaccttgggatcacccagaaaggacatctcaaatgagagggttgaggatggtacatttgggaattataatatttaagaggtaaatagagaaatcaacaaaggatactcagaaagaaaaaaaaattagggaagaagagaagcagtaaaaagtggtacctaagagctgggcatggaggcacgtgcctgtaatcccaactggcaagaggaatacttgagccctggaatttgagaccagcctgggcaacatagtgagaccctctctttaaaaaaaaaaaaaaagaaaaaaaaaagtagtacctggaagaccaagagtagagagaatttcagaatggagaattagtcaacatggtcacatcctatagaaaagctaggcagaatgacaactgataattgaccaatgggtttttcaactagcagattacacctgaccttttcccatgtactttcaatgtaattttgagggccaagaggcagcttcttgttttttttttttgtttgtttgttttttttttttttttttttttttgagacagggtctgactctgtcacccaggctgtagtgcagtggtgcgatcaccactccctgcagcctcaaactcccaagctcagatgatcctcccacctcagccttctgtgtaactgggatgacaggtgcatgccaccacgcccagctatttttacttatttatttattttttttgtagagatggggttttgtcatgctgcccgggctggtcttgaacttttgggcccaagccatctgcccgcctcagcctatcaaattgctgggattacaggcataagccaccacgccacaccaagagccaggatataatgcattaaataatgaagaatatattttataccttgaatgctgagatttgagggaaagaaaagtagttagaagacaatgaaaagataaattgtgtctcttttagagattctgacaggaaacgctagacacaccaaagatcttgaatggaattgtcaatcactaataattatgccaaattttactttcaaatatgtgatgccccctgcttaattcagttgcatttgttgagcatatactgtgtgatttagctaaactaccttagcatgcctagtgatttgtagttgtgtgatatgtaattcatagcctccaatgtagagttttactctcataagttaaaatgaagaacatttatggctcatacaaagagggactggattgagggtagaggagagatattcttgagttaacagggtagaagagggtaggatggaaaaggtgccaaaaatgaataggagttgggcacagtggctcacacctttaatcccagcactttgtagagccaaggcaggaggatctcttgagcccaggagttcaagaccaccctaggcaacacagggcgaccttgtctctacaaaaatttttatttgaaaattagccaggggtggggtgcggtggttcacacctgtaatcccagcactttgggaggccgaggcagggggatcacaaggtcaggagttcgagaccagcctggccaacatagtgaaaccacatctctactaaaaatacaaaaattagctgggcgtggtggcacgcgcctgtaatcccagctacttgggctgaggcaggagaatcgcttgaacccaggaggcagaggttgcagtgagccgagatcgtgccattgcactccagcctgagcgacagggcgagactccgtctcaaaaaaaaaaaaagaaaagaaaagaaaattagccaggtgtggtggtacacacctgtagtccgagctactcaggaggctgtggtgggagaatcacttgagtccaggaggttgaggctgcagtgagctgtgatcgtgccactgcactccagcccaggtgacagagccagactctgtctcaaaataaaagaggggcggggggtgggtggggccaccttaagaaaatctttgtcaacttcagaattaactggtttgcaaagggtgaaagtcaggagcaggtgggtggtagtacatatgtaattctcttgatgggagggaagcaggtggtcgaataggggcaaatcagatatccttatgctagccacttagttttctcagcagcatgagtccaggagtctcggagaaatgataaacatccaggtgatagttaataacatgagggtgggtcagataatctctggagaatgagtagagcagtgatcctaagacagaaccctggagaaaagaaacatttatggcagtgattctcagctctggccacacactggtattactttgaggtacttctaggaaatacccacgtccagttcctctctgaagcaatcaaattgaaatctataggattggagcacagatgatagcatgttcaaaaattatttagccaattttaatgtgcttccaaagttgagaaccaccaatttatgggactagctcggaatttggagcctatgaaagacagcatgggccaggcgcagttgctcatgcctgtaatcccagcactttgggaggccaaggcaggcagatcacctgaggtcaggagttcgagaccagcctggccaacatggtgaaaccccgtctctactaaaaatacaaaaattagctgagtgtggtggcagacacctgtaatcccagccactcgggaggctgaagcaggagaatcgcttgaacccgggaggtggaggttgcagtgagccgagattgcaccattgcactccagcctgggggacaagagtaagacttcgtctcacaaaaaaaaaaaaaaaaaaaaagaaagagagagtgtgaaggtattgattatggagatatggggagaagaaagctattgtggtatcacaggggccaaaggagtagagcttttcaaagagaaagagcttaataacatcaaatatagcagagattacatggacatagagtgtggaataatagacatgggagactcaaatgacatagagtgtggaataatagacatgggagactcaaataggatgtaagggtaggaggggggtgagagatgagaaattacttaatgggtacaatgtacattatttggatggtggttacaataaaagctcagacttcaccactacaggatatatccatgtaacaaaactgcccttgtaccccttaaatttatacaaatttataaacatgtacctgagaggatgactaaaataaggattggaaaggatccactggatttcactaatagaaattcattggtgaccttagccaaaagagtttcaggagaatctgtttggagggaggcgataagaaaggggtagaagtaggctgggcgcagtggctcacgcctataatcctagcactttgggaggctgaggccgacagatcacctgaggtcgggagttcgagaccagcctgaccaacatggagaaaccccgtctctactaaaaatacaaaattagccgggcatggtggtgcatgcctgtaatcccagctactcgggaggctgaggcaggagaatcgcttgaacctctgtctaaaaaaaaaaggagtagaagtcagattgcattgagttctcaagtgctattagagaccacttaatttagtgtctttttttcatcacttcatatgaatcttctgatgaagtgtgtacctgtattggctatgtaatttttgtttgtttccattttctttttatttttaaatgaaaattaaattttacttttggggccaggcgcagtggctcacgcctgtaatcccagcactttcggaggctgaggcaggcggatcacgaggtcaggagatcgagaccatcctggcctatatggtgaaaccctgtctctactaaaaatacaaaaattagccgggcgtggtggcacatgcctgtaatcccagctactggaggctgaggcaggagaatggcttgaaccaggaagtcagaggttgcagtgagccgagatcgtgccactgcactccagcctggcgacagagcgagactccgtctcaaaaaaataaataaataaaataaaataaaatttacttttgggacagacatcacatgtattggctaataagatctagctttgcattaaggaagctagaaactgaagattgctatgtagtctatccttgatcattccttgacaattagagaacaaattgagcatggaccatttatcccctatttatatgcaaaattgttctaagtaagtattgatgatgttctctatagaaatttcaatcactcacttccttgtctgttctcctacacaatattatcagctctgctgcacatttcctcattggtgatccctgcaggaaaataggagataaggtcaattctagttgacttttatgagaatatgattatagcaggctttctttagttattggaatatgtgataagttaggacaaacaattatgcagcaataaatttatcttggttgttttaagttcatgtcaaaaattcagacatgctaatgttggtagctaagctcacacaactacctgcttatttacaaacttgcaattcaggaataaatgattgggatcttatatggcaagtgcatgatgccagtctaacaggagcagacgctctgtgcatttgcaactacaaaaaacaaaaagatactcaacaggttgtcataagtaccttaaaatttctagaaaattaagtgcttttacaactaaaggaaaataaacatttattctaattggtggccttgattatgggaaagtttctctcatacaggctcatttctatattattaagtattttcctaaatagggataagaaattttaagctctgcttgctttacagcagaatccatctgctttcccagtggacatcccaagacaaccagatttacctggacatgaatgtacttctgacccttcaattttcattaaacctttagatacacctcttctgtgtattaaaatttgaaccttactcctggtagttccttttcttgttgcccattaaaatgagaggagtggaagctgaaagaaggaaggaagaaagcagtaggtatcttaagcgccacagttgttttgttttgggttttgttgttgttgtgattgtttgttttgaggtagggtcaccctctgtcacccaggctggagcacaatggcatgatcatggctctttgcagccttgactctcatgggctcaagggattctcccccacagcccctcaaccccacccccagcctcccgagtagctggaactataggctcacagcactgtgcctggctaattttaaatttttttgtagacagagtctcactatgttgcccatgctggtctcgaactcctgggcttaagcagttcctttgcctcggcctctcagagtgctaagattacaagcgtgatccactgcactcagcccacagaacccttttgagatttcagttcttctattatttcttggtatcttttgcatttgcaaaataccttgaatctaagatagtgcctcacctattccgggaagccttttaaagttatgctcaaagtcaactctcttaaagatatattgatagatgatacaaagtataaaaatactatgcttataactatattctgctgttaaaagattgtgatttatttttagcatctagcacataactcatagcatatgcttttgatacctgcttgttgaatacttcacaattattttaaaaagattgaatctacacaaaagcctgtttaatatattatacctaaagctgtctctgaagtttgaaatttgagggatggaggaaatagaaattgtattctacatcactgtaaatgaaatcccattaaagctgagtttttatgagcaagctcgcatgtcctatgtatgttaccttcacgtgacctttctactcagtaatgtttatgcttgacaagtaaagaaaaatgccgactttatataaaaaacacaatgtaactgtatgccattattcttattcttacattcattgtgtttgcatttgactgctacccctatgtcattctcaactcaaatcatggtttgttccactcccacatggctacttagagggcaaattcctaaatactgccagagaaaataagaatagagtgacaataatacccttttgtttcagctttacatatgttctcgtcagtctttgcaaatactgtgatgctctataagatggggaaatagaagttagtgaatttctttagaatatcagtaagtaaataattgcttttccaactgtcacacttatttgctcagaagaatagatctttctcgtttaagggttttattcagttctacgtaatagtatgtaagactgttataaggatttgatctgtttgtttgagggacttctggaatccaggatggtattttccctttccacttgggaaggttttagcttcagattttaggtttactggtctgttctattgtttgtctagcatagatacagtataccacaagcaatacaatactctctgggcaatgaacaggaattttttttttttaatttcatacattattcacaaatctgcagtggtttcagaaagtcagtgtatatcctggacacaaagaaatgaaaaacaaaaacaagggtatgattttcatatagttctttggaaagttaatgctattgtgcatggatttcatttttatttcagttataatacctgttcgagctttagcagccttatagttattaatcaaaagtgtacatgtttatcttttttcataataaaccgatagattatctccaaatacttggagctaaactatgaaggaatgtttgtatcaggaggggtaagcaatatgattttctgtggataatccagtgtttattttaattatgtttgtgacatcatctcagttgtctatatcagtactaccttatgtggaagagataatgagaaatgacagcgctttgtacataatatttgtggatttaattctattgtcatatcatcaaccataaacaatcatgaattgaaaagaaaaaggactttaaaaagtacttttctagtacatagattttactttatggtccaaatttaaacaaactcttttgcacctggaagaacattataataagctcagttagtagtcctaaaaacccagaacgtggaagcacccagatgatgcctatccttagtgactgggtataataaattagtgagtaattattagaaattattagaaaataaatttagaaatgaagttccaacatcatgtgtttctaggaaattattagagaatcttttaaatgttgaatttccataggatacaggttgggaaggacaaatgggaagaaaaatgtcacatctaacaattgaaataatgtttttttgttgccataaacagtattgatcagtttgcatggcttatttagaactgaaacttcctggcagaggaagatgcaaagcactgagaaaatattatgggcaagttgaatgctgtccacacagattgtaagcattatagattatccctttttcacttttttcctgcttcccgtactttatggtcctgaggctttttgcgcactactttcctcactttgttctcctgattcagaagaattttgttttatctgtttatctccctcgtaacactgtttcttttttctttttcttttttgagaaggagtctcgctctgttgcccaggcaacagagtgcagtggtgcgatcttggctcactgcaacctctgtccccaggattcaagagattctcgtgtcacagtctcctgagtagctgggattacaggtgcccgccaccatgcccagctaatttttcttattgttttttgttgtttttttttttttgtatttttagtagagatggagtttcaccctgttggccaggatagtttcaaactcctgacctcaggtgatctgcccgcctcggcctcccaaagtgctgggattacaggcgtgagccaccacacccagcccctcacaacactggttttcacctccattgccccaacctgctattctacacattagttgtgggtaagaaaaactggggggaaaaatcaggaaaatataggtgtctaagcattgtttcaagtcttttatctgtcttaagtctcagcattctgtctggtttatgggggggaaaaaaaaccaagagcgacgatacacattactccaaataaaccctctcttaatttatgtaaaattgttctaatcttggtgggggtgggggaagaagcgtttaaaagggatagataaaaattcctggatgaaattcttggttgccagcctttttggaattatgacctcatcaccactggaatttacaagtgtttgtgatagtgagtaaggcatcaagtagataattaaccttttgtatttctatattaatgatttcatcaattagtatacacaattgcaaaatgactacataattattttgctctcaaaaaagtctacactcttaaaaaaactttaaaaggaaaaaatatcttttcataaaagttcctcaaactacagtgcatatttatttacatttgacaagtgtgaatgtgtttaatgaaaaggaaaaaattctgtatttcaatatgtagaacaggttggtaggtttagcattttttatttttgtctctccaaattcagtcaaaatagttcttactaaaacaggtcatacttaaattctactctagggggagttctttattattaaggcatgtaaaacaaagaaaaaaataatttaaagcactttccttataacctaattgatatgttaatgtttttctctaatattttgaaaatatacacctatgttcatccacgtgtttttgttttgttttgttttttaaacttggaggcttgctccaataaaagtaggactctgtagtgcatgtgtttatctgtttacctaaactgaagtatggccccaggaaaatagtatatttgattgattgtgtgtggtttttttaaaccaaatcatgcaaatcattttaattatgcataacttcaaactactacttaactcccattcttgacaattaaagaggttttgttctcctaattgggtgggttataaaagttaaatgttgcaaaaaaaaaaaaaaaactatgaaagaagctcaatttcgaagtatggcttcttttctgggccctataatatgtggtacatgtcctggcataattgaaggtaaaaagggtagtggttaggtggaattcatcacagagtatctcttcctctgtctccaaagctgcttttgcaccaattagctatgaccttttcttctagccttggggtgtaagattactaggggcaacaatttctgaaatattttctttctaatattagtttaagcaaatttccttgcagagctgactattctttcatggtttctggttttctttttcttttttttttcttccgtctgctgcttctttccactaagctgctaaatctttcgctgaggaattaaatgtaatgtttctagaaacattaatagcttgtgcccttttctgagtgtcctacttcagaaatattgcagctgcagtggtattacgggctatcatttcttcctgtttctctcagcagggaagttccagctttaaggtagatctgagttcttttattcctgggctaggtctcggagattttctttttctcaatgatgtgaatgccttagtcagggttttaaaagcctattgcttctttgtcaacttatttcacattggttcactatgcagctcatagtaataatggagaccgggcaagagtataaatgaataattataaatcaaaccctcctattggaaaagcaacccaaagcagggggctgtgtgggtactgtcatggtaacctcacctctagagatggtgggtggtgcgttagctctgtatgtaacagggaaaatcctccacaggctgtaaaatgttgaaagcacggttaaaataaaaacaaaccaccgttacattttttacggtagtttgggttataggactacaatgtggccaaatgaaaaggttttttaatttgacttgcgtgtggggcagagaatggcagggctttgttgaggctccctcccttgtttatttcttcccctccaaagcatgcctgttagatggttcttctttcttatcccatttcacttgtcattttatttgttttcaatttaaatatcacgctatttaagaaatagtcactgcttttgaagtttattttacagagctgtaagttttattgagacaaaataattttctaaaaatattagttgagaaaattagctaaatccttttcaaataataaaagaaggcagatttaacttattcaattttgacatctaatttgaatcttttgtgcttgttgtcctaaaagctactaccacttgttaaatttgaacaagtggagagaacaaaacagacatagtagaatattctacttaactagctttaaattaattttagattacacagaaccacatcttcattattaaagtcagaaattcaatatatattccaaattgttctactcttctaactcctttaataatgtcaagattttgtaacaggaaaacagggaattaatattttgttatggtataaatgtttttctttctaacctaacatgaaactaaaaattattttttcccacacttatgactcttaatagctaattgaaacagaactcacatgagtaatttatattaccgactacctgccacttaagcgttaatagagactgagcaagaatataaatgaataattacaaatcaaaccctccttttggaaaagcaccccaaagcaggggctctgtgaatactgtcatggtaacctcacctttatggaaagagaaataaagttttgaaataaaaggaaataagcctactttgaaaagattgtatatcattaacaatttttgtggtttatattttcctgaataagctagttttaaaacatataaacacattaagttggaagtgaatcttactaatgccagcactagttataattcatgattagcactggggcaagctgataatttgaaaatctcacagatttttactgctatttgtacccgtctatgttaactgtaccaatgataaaataataatcaaaggactgatggcttaatataatagctattgtgttctaaatatcttttatgctttgacattaaatgtctctcttgctttcgtatctgctttcaaaaatctactacccattcctgatagtatttaactggagttattagtcctttgacagtgctgcatgctattgacagtatcttttaatttgcttaatttcctgacatttgctatgttaattttttactttgggactttttaatgccagatttgtgcttaaaatagaaaagccctctactaataagatttagtcatatcacctaagtactacagagttgtcccagatgtaatagggagagataaagaagggatcacagataataagttttctctgctttccccacaaagttattactacaagctttaagtctcagcttttattgataaatataagtacaggttatctaaggaaagcctatgcctatttataatagcattcaaatctggtgttagtaattgctttaggccacaccactccataaacagtcccaaggcaatttgaaaacaggtatttgttgcataatctgtttttattacaaatgccttttgttttatgatttttgtattaaagtaatgaaactaaataatactttctggttaactagcaggtaaacgactttatgcaatatagatgtattatattttgtgaaactaccgatggtcattcaaagggaagattgttgggaaggggtggaggaaggtagtattttcaattggttacccggcttttaacaaaacaattcctattataatcccagggaatttcatctgactaaatctccactcagacgacaagcaaggagtgagagctgcagccaaagggacaaagagtggggggaaccagtggctgaatgagtcccaccatggtgccctttagtgggtcccattgtgccgtgggttagcacttctcaccattgcttatgaaaatactcagcattgaataatgctgtatgtcttacattctactcactaaaattgcttatgcaatttcaattggctatggtatttatcatttactgtcctctgcattatatagcatggttaagcctaagaagcagctgccttttttttttttaagtggatcaagcgattgttatgtattgtgtgaatatcagttcaagtttcttgagtgctgtagcatctagatgaagggtagtaaataaacattaggctcttaaaataaaaagacttttatgcgattcttcaaattctacattgcctggaaataaatagtggctattggtcccttttattttaataaaatttagatatatccaccagctgtgagcacatataaatctgcactttaatgttaatggaagttaggcatgggtatcaagaggtaaaaatcctagaagatattataaaatcatgttatgtagctcagtttttacagtggttcgaatgtaaggggtattctacatgccataaattactatgtatacaatctttaacctacaacatccttgaataaatagctttagaatcataagcttggttagtttcttttaaagtatagggaggcggtgaatgtattttaattataaaagcctcttagaaaatctgacatggtaaaaggagctatattatgtgtacacgtatgtagctcctttggtgtttggtaagagcactagttgccactctagtattttttcccattgtctgctcaggctgttttcggtctgagactttctcatcccgcagcccccacctctgtataacttttgccctgagtccttcaattgcatagactcttttctttctcttttcatttctgaggtgaatctgggagcccttatgtcccacaatttactgaagtgctataattatggcctttatcttttattaacatacctacatgctatgcttttctgtggtagcccagaatattaatgcaattagcacccttcattaagatgtactgtccattttgaatgacagctttaagtcacaggataagcctcctatacaatgggctacttttttttttttttttaaaggaagaagggaagatttgtaatttttaagaagtgaaaacttctagaaaatctttcattgctaatcctcccaaaccacccaaaaaagagcaagttttgacgttgaaacttcaggaaatcttcatactgataggatcttttccacactttaaaaagttaatccttaagttaatcacaatgaagacaccctgcttatttcctacagtggctaagaagataaagtgagatggtgaatgtgaaacttctttgaaacttttaaagtgtatttatttaaaatttgaatagagctttaaagtgtttaaagattattatcaatactatgttaaatcaatgccacttaaacccttcagtatcttcccatttcttctaggagaaatttaaattttttacagtagctcaaaaggctctgtgtgatctgacatgtatgtacattacctgccgcatctccaacagtccaacgctgtgagaaaatgtgatatccattacatttgaaccacaagactgttgttatattagaaagggaagcattgttttggtgcagatatcttctagtattcatctctcaaataagtctttttggtaaaattaagcaggattttgacattagaagacatgatgccgaatttaagttgtatgatgattattttgatgttattatgaaaataagtgcaatgttattggtttcatttatttctattatataattgattaaaataatgaacaattaaaatgtaagcaatgatttatggggtgcttaactcatagcagtaaatatagtatattgaacttacagttgcattgcctgttagacactatcaatatagaataagtctgatattttctaaatggaacaattagaacaaaccttattttaaagtgtgcctttccccatactccatgttccaaataattataagaaaacctactgcttctgttattacacgtttacaaagcaatagaaatattgcctgtaacctggccttcatagttcaactttagacttctttttttatgactacatctatactgtggaaaatgttttattttcctaggtaagctatgctattgtagtaaaatttttgaaaggaaaattattttggatcaaggacaagcaactctagcagttcagttgtttttttatctcattatttttcaatctaggaaaaatatttaaatatataacaccaatattttgcttggatagattgaagcttcagatgttttagttagaaatggactgcaaaaataatatctcttaaaaaaagaaacgaatatagtcaaatatgtgtctaagaaatacaacttgtgcatacatcctatagtatctctataaagatttcatcttgtttttctgattgaagtgttcattactagagacaaatgtatttttaagtcttgtgattagagggggccacagccatcatagctctattagaggcagaaatataacattaatattttagtgtttcatttgctttcatgaaacttatgaacagaagctatcagtgtctagggtttatcttcaaatgacaaatttagcattctgtaaaaagtgatactaggacttcctgctgaggtcatctagagtttgaccatccttagaaatgactgtgggtagattcttattctcaagtgctagaggttcttgttctctttttacattggattttgatggtgaccaacatgactgtgaaaaggaattgtaccacatgaagagatacacttatagaattacaaattggtcagtgccccttttctagtattccagaattatctgactaaaatgattttgtttagttccattttctaaaagttaaaacacaaaatacaatggacgtaggcttctgaagtgttctgagtcacccacgtgaaaagtcatggctaagattgtttatgtccctggcacataatatgtcgtcagtaaagatttctagaatgaataaataacttttccaaataaatgctctgttttatcaattacatatccctcttgtcttccttcttttcttggccaacttctttgaagtgtactgccatcatatatttttctcttttaaaatgttttccattattaaaggtaatgtatgttcattgtagaaaatgtgggaatgtgtaaaatataaagacaaaggaaaatgcatagtctcaacatccagaagcaaccacctttacattttgtttttttcttctatcttgtatttctatgcatattttacattgttcatattatactgtatacaaagttgtatatactacttttccacctaaatttataagcatttttacattaatgaatatcttgataagtctccttttaaatggttgtatattatttgaacgtaagaatgtatgatattcactccatccatcccttaaattagaaattgaatttgtttctttttttttgctaccataaataatgctgttgtaaacatctttctacatatagtacatatactatatgtagaaaatcagtacagcttttccctagaagagattcagaaagtaaatgacatgaggattttttactacttactagatgcaaagcatgattaacttgggtcaagtcagtgcataaaatctgtaatcactgatttgaatatactatatttacattctttgaacaaatattttaatatttattatagccaaagcctgatggtacaaagatggaccttaccccaaaggaatatactgtctagtatgaaaagagaaacacaataaattaaactgttaggttgagccatatgacgttgttgtttgacctatgaaaatatttatttcatgtgattcaatttaaaataatataggatgataaggataatattgaagcaagtacatggtggcttgggaacacagataagtaagtaattagatcttccgaagagagataacacagattattgctgcttattcagcagaaataaatttaaacgagggaacttttatatctgtgtaggtgtgtattagaaagctgctaggtcaggctcatgcatcagatttatggtattctgtaacattgcagcacaggaacacttcacctctctgaaagtccactcttccagcaactgtacctacctggaaatgctatctatctcttcaaaatatggcagtaaacctgaaagtaagcaaaaacaaaaatatccctcaacaggcgaaaggaatgtgatcaagtccttaaaaagcagcatgtagacttttatcaaaagagagtcttccaagtaccttactcaaaatctatttattatgttagacatagttctatcaaattggattttctatttttttcaccgtccagcaaatgggaaacagcatacataccaggattgagaggtagacagatactttaagactcactggaagcactaagacgtgatagttaatatcttgactatagtggaagagatgaaataattatcaaagcagataatatcttaaaaaacaaaaagcagaatacagactgtataattggtctcaactatgtaaaaaaaagaaataggtatatatatacgcagctgctaattaaaaaattggagtgaaatacaccaaaatattaatagtctttgtggctataccatggtatatgagtgatttgtacttccttcacattttttacaatattcttcagtgactctctgctgattatatcattagaataaataaaataataattggctgggtgcggtgactcacgcctgtaatcccagcactttgggaggcctaagcaggcggatcacgaggtcatgagatcgagactatcctggccaacatggtgaaattccatctctactaaaaataaaaaaaattagccgggtgtggtggtgcacgcctgtagtcccaggtactcgggaggctgaggcaggagaatcgcttgaacctgagaggcggaggttgcagtgagccaagattgcaccactgcactccagcctggtgacagagtgagacttcgtctcaaaaaaaaaaaaaaattaaaattaaatttgtaaatgaaaaagatctttgagcatagaacagttttggtctatttagagaagaaacaaatagacacacctcaaatatgccctacagaccttgtaggtacagcacagcacagtatttgatgttcatgataattatgcgaattagcaaaaatgtattttcaatagattgtccttacggaggcagcaaagtgtacaatatatcttcaaaatatttctatacaaaatggctaagataaaaattgttgctatttaggacgtatagactctctgctatccagatcaactcactgtgtgaggtttctggatagctgagatcctattttagcttttctattttaaaatgaaattactcaacagctatttgtcctattaaattatgcaatattattatatctaagcttcctgttctaagtgtccatagctatttgttgaggcattattctcagatgggcatggaaacaaatatttatctgattattcttttgtaaatggcccagttatatgttaaaatatatcttttttcctcaaatgtgatgtttctaccgtttgatgttgcctttgttcgttgacccttgcttttttcagactttcactaaataagagactatttacatatttccaaacgattgcaaaatattaaaatcaaatcataaattattcaagctattggggaagtttcctgtgaaaacatatacaccataaagaataatgtatttagaatatctccctgttggtagtattacaattgaagcacagttgttgttactcattcctctcctcttacatgtaataatcaaataatacaacaacaaaaccaaatatagtaaaaataaattcactgcccgtggggaagaatcttaaatattacctttattgtatatgtttgaagtatgtttgtagctttagttgcatcttcatcactccttagcagtctccttgttcattgtttactgaatcatatgcctctgctattcttccagattttctctattctctgtagtccctcaaactgaaacttgcacctgacagttttagtaaatgaccatctttttcaagttcccttcatttccctcagtgtcacttcccgaggcaaactttgtgctcctaatctcattcctcttacctccttcagaatcatgcttctttccttcttaatgtctttctttaaattgacttctttctacagaaatgctcatgtcctccttgaacttaaaagcaatcctcaggccgggcgcggtggctcacgcctgtaatcccagcactttgggaggccgaggcgggcggatcacgaggtcaggagatcgagaccatctggctaacacggtgaaaccccgtctctactaaaaaatacaaaaaattagccgggcgtggtggcgggcgcctgtagtcccagctactcgcaaggctgaggcaggagagtggcgtgaacctgggaggcggagcttgcagtgagccgagatcgcgccgctgcactccagcctgggcgacagagcaagactccgtctcagaaaaaaaaaaaaaggcaatcttcagtgataaaccaaacaataaataaacagagtatgtccctaagttactatcctatgtctagctggggagaaaagacatggacacaccaaagaagtaagagataagatatgtatataacaatatttgtgtaccatgtatgaatttgcaggcactaatacccattgatgagctctatttggctattgggactgtgcctctcctaattgtgtggcttggttggaattgcttcatctgatgtggaacctcaatagtcagtcaatgatttgttgtctctttacttattcactctttattttgaaattttcaagtatatacaaaatacaataatataaaaaaaactcatgaacccagcttccacaatgatcaattcatgatcaattttgttttctccatactgctactcttggatattttgaaacagctctcagacattatgtttttttcatctgtgaacgtttctgtaagcatccacaaaagatgaagactatttctaacgtaaccaaatactattatcatatcttactaagaaaaaaaatccttaataacaaatatctatttagtgtttacatttccctgattatctgctttggtttttttgttttgttttgtttttttgttttttgtttttgagatggagtcttgctctgtcactcaggctggagtgcagtggcactatctcggctcactgtaacctctgcctcctgggttcaagcaatcctcctgccaaagcctcccgagtagctgggattacaggcacccgccaccatgcctggctaattattgtgtttttagtagagacggggtttcaccatgttggccaggctgttctccaactcctgagctcaagtgatccacccctctcccaaagtgctggaattacaggcgtgagccaccacgcccagccaattatctactctttttggttagtatgaattggaaaccaaacaaagttgattcattattatggttctgttaagtctctttttaacaatggaatcccccttgtgttaattatcaattattcatcaattgctgcataacaagttacctttaaaacgtagaagcttaaaactacaaatgtttattatttcatagtttctgtgggtcaagaatttgggagcagcttagctgagtgatcgtttcagtgtctctcatgagattgcagtcaagatattggaccgggctatggttgtctctgggtctgaggctagaggatctactccaagatcagttcttcactatacgggcctctctatagagcttcttgactgttgctatggtctgaatgttttgtccccccaaaatacatatgttgaaacataatcccaatgtgatagtattaaatggtgaggcctttggaaagtgattacccttataaaagaggctcaagggagcatgtttgctccttcagccatgtgaagacacctagaaggtacctctgtgaaacagggaacgagcccttatcagataccaaatttactggtgccttgatattagacgtcccagcccccagaactgtgagcaataaataccactgggtatgttgttatagtagcccaaatggactaagacaagcatctttacaacatggcatctggcttccccaagagtgagtgatctaagagagaaagcaaagaggaaaccacagtgcattctgtatcctagtcttggaagtgatataacaatacttctgtcatattctgccaatcacacaaaccaacccagaaacaatgtgggagggaattacaccagagtatgaataccaaggggttgggataattggggggattcatcttggaggctgactgctccaccttttcatctatctctcctttttttcttgtaattttcaggggttttttttccattttctttttctttcttttctttcgttctttttttttttttttctcaaaatcttgagctcaagcgattctctcaccttgacctcccaaagtgttaggattacagatgtgagccaccatgcccagcccagtttttattgttgaagcaaccaggtcatttgtctgattgagtttatattttgttcattgcatcccactgtgttatttacctgtttctttgcctgtccccctactccatatattttctgtaaatttatagttagataaaccaagccactctaaagcttgatcagattcaggttttgtctttttgtcaagatgtcctttttttgttggtgttgtgaggttttatattggagcacatgatggctagtttactctttttgttatattagcagccactgatgattctctagctccattagttcaaaagagtactattctattattcctcctttaattagtttgattacttcataaaaaaaatgccccctcatcaactatttgattacatgaaggtacatttcatataatgaagggatgagaagtacttctctctttttgtcagtaagttgttgtctctctagaatcctctaaaggtaacaagtgaggtctgggaaccaacatgggtatgctgaagcagagtctccagggataggtgctggtcatggggatcttgaaaacgcttcctatgtgattctaatttggtcctctattaacttctaccaatctccattcccagagtctgacttaggtatgggagggggccaaggattctgtttttgttttttcttttaatctctagatactcctcttcagctgacaagtttggggaacactacactagaaaacacctttttaaacttactgtggctatatgcatctatgctattctcacaggccatgggtgtctcaagtttactctcaagccagctgccatgttgtaaagatgcttgtcttagtccattgggttaaggagagttgagagtctcgcttagtgctatagttatagcaaacactatggagttagactgtgtgggtctaaatcttggctctgccacttactagctttgtgaccttggggcagtgaattacctttctgcctcagtattctcacatgtaaaatggaaatgatagtaggattttcctcgtgggtgttttgagaactatatgagttaacattgtgtttagaacagggttttgtaaggatttcttaaatacataatagagttatctccctctgggagcacttccttggaacgttttattgataaaagccaaatgtggtggttactaatctcatcatgataacattgtcatttattggatgtttatatatgccaggcatgatgggttatgtatattctgcagttcacataatcctcatatcaatcctacaaaattagcaatattattttaattttacgtatcaacaaactgagtctctgagaagtaacttgctcagtgtaatagagctcataagtgatggtgtagatatgacatatattaaagaggcagcatgatggttaagagcacagaatctgaagctaagctctctgggttcaaatcctggcactaccacttcctagttgtgtatcttgggcaagttatttaacctatgtatcagtttccttatctgtaaaatgaggataatagttatacctacctcatgggttattatgaggattaaatgagttaatactttctaagcacctaaaatggtccctagcacaaaatgttgcagaactcttccttagttcagctaaagacagagttctttgtcccacagccacaaaaattcaggcccgcagacaatttgaatggtgaacaagcagggttttatttggtgaaaaggaagaaaagggggaaacatcctgctagagcaggatgttagaatcccaacttccacacaggaaaaggaggggccaggctcctccccagtgtaaacttaacgaggctccaccttagtgggcaggctgtttggagtttctccagggaccccctcccacctgactgtctcaataataaatactttgtatgtactagctcgttattattactgctattattatttttattagttagagtttaaagaaaaagcagcagtaaaaaaggagagactgaagttgccaataaggaagggaatacatgtatttcaataaatgccttaataaataaataaatcttcaggaggagagaaaaggagagttgtctcgccacaaagatgagcagaatagaaaacagttgatttctaggcgaaggcagatgattaaactcctgggagatagattcatttttacaaggtagaaatcaagctaatcctttagaaatgaagaaaggaaggtagaattggaagcctgtggaggcaggggaggtctggggacacttggggagtcaaaccacagagcacgcactagacatagccaagttgtgttttgtcaatgcttgatcatggctgaattccttgtggctaaaaaaaattatgcctggtggaggggatagctcagcagcctagtgacagcaacaagttcagacatggttgaatgggatggttatgatggtaagtagaagtgaaggagcgtggaacaaggaatcaggagacttggattcattttttaactttagtatatcaactagcttgtatgacctcgaatagttcgcttgacctttggatctcagttaattcacttgtgaaataagagagctacatcagtttatctctaacattacttctaattccagaatgtatgaccctacagggccgattctagcatctagctgcaccagaaaggagtcaattgaaatggcaagagttaagaaagtaatgggaaggcccagggaggttgggatgcaggttcaataaaagtgaaggtagatgagggaactcgtgtcagtctctcagtctttctgcctttaagatttttcttttctgcactcaaaattctaagactagtttgtcttttttttttttttgtagcaaatatcattatggctattgtgaatttaataggctatgtttgacacacacaagagtaaatgttattttagttttacatatctaaaatgttcattaacacatcagaaataaacagttcacttgtagggagttattttttttcttttaaacagaacataacaaaagagtattttatgctttcccgtgcccataataacattacattttggagtagctaactaggttgcttgaacacgctgttacagaactggttaatccataattcagcaggttcttggcttccaagttgccttattgacaagcctgaagaaagtggatggaactaattagcactcagcattataaaataggaagaattagataaagcagcttcaatattaaactcagacccctatgaagatattccctttagttatggggattttgaaatgatggacaggctaaaccaaaactcataatcctattacagtctcctacacccacctaataagcttcaagagccgtttccttggagtctgggatattgccatcttcctctaggcttttctgtatatagcttataaattctttacttgtttccactaaatactttgttatttaaaatagcataaaagagagtatataagtatatatacatattgaggtattttgactgtaataatacccttggcctgtagggaacttcaaattattaataatttcagaggaaagctttttaagaaaaaagctccaggcttagctgtaatgaggcatttgaaaaggaggaggggttatgtttatgtgcgtaatgaaaatattgaaccctttgggatgttatgaaccatggtgcactaataaatgatcttcccatttcagtgttccagcagacatctttgtacccctgatgtactcttgcaaaatgcctatagctcacatatccttttaaatatttctatctcctaacattcgttactgtgggtgggggtgcaacaggataaatctgatggagaaaggaggacaatacaagaagcagacaaagttggtggtttagaataatgagcccattttcagctgagctgtgtagttcatatgaattaattaaccccttacaaacatttgtctgacaatccaaattctcattcagttcaatgggttttataattatcatttaactaaatagcactaagaactgtttatatcctgacattaaggaagctttgtcgaattctttttctgtaaatcatctgaagttgtttacaatttgcagtagtcttggtttgtgctcaggttgctgttttgctgctttaaaaaatattttcagggtgctaattatagaatatgctctagagtttggttagctttgtaagagtagaagacctttgtaaagaacgttttcacattttaattggaagaatgtaggcttaagctattatctgtcatgttaaacaaaaggaatccgatgatgctcaatggatatagaatgattaattactcattcttaagacctgtgccatttagttcctggtgataagatggtgataaagcactttttacccagaaagagagaaatgagagtattgtgatgaccatgctgcaacagagtgtgagaacacttaaaaaaaaaaaaagtttgaaatgagaagcatctgggacctcccttctatgctgttgtgtatgtaattgcttttaattttgtacaaaaagttaaggtactattaataagcattttacttcattgagtgtcttctgattacaaggaacaaaaagctatttaaactgggtgttcattgaacagatacagagaggctcaagggaattcagggcaggatgtattatacacctagacctagagccctggaaatgggatctttgctctcctttcaaggtggctctgtggtccttcacatcatgagttcatgggcctttaatctagtgcttgaaacgagacttcacttatcctcatctaactgctccttctacctcctgacaaagattcttgggtcccaattctatgttcctgtgacaggaatgttatctgaatccttttttttttttttttgcaccaggccccaagtctttgacaagcctaggatggttcccctgtaggtcggggtccttccctgattcaatcagctattaccattttatttatttgtttatttttattattatttttttgagactgagtctcactctgtcaccaagctggagtgcaatgaggtgatctcggctcactgcaacctctgcctcccgggttcaagcgattctcctgcctcagccccccaagtagctgggactataggcacacactaccacacctggctaatttttgtatttttagtagagacagggtttcaccatgttggccaggctgatcttgaactcctgacctcaggtgatctgcccacctcagcctcccaaatgctgggattatgctcccggcctctactatttgtattatataataacaaatttaatcctcacaaaaatcctattaggttaagtactattactatattcccttttatagtgggggaaactgaggcaaggagaggttaagtaacatttccaaggttatgtaactccagggtctgtgatgagttaggagatctggtttctaatgcttgacccatcactgtgcgaatgacttgaagtgaatcacttaatctccctgggcattcagccattccatgaacagtttaaaaattgtttttctaattttttttattgacaaactaaagggaggaatcaggtccactgccacattgtcataggcactgcttggttgtatggaacagaaatctacataaggtagcttgagtgaaggggtatttatttaaggatgtgataagcaaccttgtggacatccaaggataggaaacaacagtgagaccacagagtgtcttaggctggaaccaaaatggaaaagttagaaatataagttgctctcaggccgggggtggtggctcatgcctgtaatcccagcactttgggaggccgaggcgggcagatcacaaggtcagatcgagaccatcctggctaacacggtgaaaccccatctctactaaaaaaaaaaaaaaaaaaaaaaaaaaaaaattagccgggcatggtggcacacacctgtagtcccagctaatcaggaggctgaggcaggagaatggcatgaacccaggaggcggagcttgcagtgagcccagatcgcgccattggtttcctttgtttgaacatgactgccacaactatgatacagtatgttgcttacttcaagtgcctatctttatgtgacatgggtctctccaagttcagattcttgtgacagaatctgactgatccagctagcctgtgaatttgtttcccttaagtcaggtgttcattctgtggccaatcagccagagcagagataagatcacatggtgataggactgtcaccttttccaggcacttgatgaaagagcagattctctgagaagggtatgggaagggctggcaaatagactgatgtttgctacacccataatcctagcactctaacacaattttaaagcatattgtgtatttctccatagatcatcattttggctacataaatatatatatatgtatgtttttgttgttgttgttttgttttgtttttgagacggagttttgctgttgttgcccaggctggagtgcaatggcacaatcttggctcactgcaacatctgccttctgggttcaagcaattctcctgcctcagcctcccaagtgctggaattacaggcatgcaccaccacgcctggctaattttgtatttttagtagagacagggtttctccattttggtcaggctggtctcgaactcctgacctcaggtgatctaccctcctcggcctcccaaagtgctgggattacaggcatgagccaccgcgcccggccatggctacataaatattttttaagcacttcactgtataccagggactttactaggactacactagcttcaggccctccatttcctaatttgtaaaatgaactatcctgtcttgctttagaattcacccacacacacacacacacacacgtttatgcgtttatctatattatactgaatacaattgtcctttcatatccgtagattctacattcatggattcaatgaaaggcatatcgaaaatatttttaaaaatgacatctgtactaaacatgcacagacttttttcatgtcccctaaacaatacagtataacaacttttacatagcattaacattttattaggtattttaagttgtcaagagatgattttaagtatacgggaggatgtacataggtgatatgcaaatactatgccatcttatataaggaacttgagcatctgctaattttctggtttctgaaggaagttctgtaaccaattcctcatggatacctagggatgatggtatattgcctttgttaccaaaccaaccggaattttgtttgtttgtttgttttgaggtgaagttttgctcttgttgcccaggctggggtgcaatggtgcaatctcggctcactgcaacctccaactcctgggttcaaacgattttcctgcctcagcctcccaagtagctgggattacaggcattcaccatcacacctggctaattttgtatttttagtagatatggggtttcaccatgttggtcaggctggtctcgaactcctgacctcaggtgatccacccacctcagcctcccaaagtgctgggattacaagcatgagccaccacgcttggtcccagccagaatttatttatccaaatgaatgttgtgcagtaccctgaatttgagctagagaagaaattcagtataatttcttcagttacatctagtgtttaaccaaactttagtattacccaggttacttattgatttggctctgaaatatttgttttgtaaaacaaatctattaaaagtcaaagacttgctgtcatcaaaactatttaaaaggctgtgaggcctactgtaaagatatcccaaagaaggacttcacaaatgttttttgccaatgatagaatcattccttaattctgtagctcctaaagtaactaccttgaagagcacggatcttaccaacatatgtaggttgtttaaaaaatcattcatattatgtacagaatcaaagatttaaaaaagtatacaagatacaaatacccagttaaatctatagttaggcatttgagacttaaaaaacaatttggtgggactctttactgaagtattaaaaaacagaattctatctcacatctatttcacctactgtgacccagtatctaaatatgtcagtatacttctcttcttatgctcacataggaaaaaattggattgaaatgcttaggacacactggaaactagatgaatttagagcttttagaggaaaaacaccttgccacagatctcccctgaaccagccaagttaattaatcttggtttttgttgttgctcttgctgttgttttaccatagttatgcaaaagtaatgctgcaagtacagaccaaagccccagaggaggtagttgaagttcagcaaaatagatttaccaaatccatttgtgtttgcctggttttatgttggcatttagagtctatctttattttggtagctttgtagcctgagagtgagagagaatatatgtgtataggtatgtttatatgtattgctgacaaattcaaagacatttgattaaatatgctttatgtaagaagtgaaaagtattgtgtatattttttctttttctgtggattacaatatcttcatttctgtggttactttttgcaaaagattagtccagattcatcactctagtttctaagaggaatgaaagacaatttaaagctaaattcaaattctatgtaagtagtataatctgatgaacacacccttttatcccaaatttagagcaacaaatgttttatttaatttgagaatatgagataggaaaagtccatcataaaagtggtttcagaagctcaaaatgttaactatagcttccatgcgttacagtcccgtgatgctcatttaattctaaagtaagtcactgttgtttctagaaaactagtcatagttagactaattcctttttgttgttgttcaaagatttgaaataaatgcacaaagtcttccttctttgtagtagactagtatcctggtttctgcatttttcctgaggaattatactttaagacctaagataaacaatgtagaagaatcctctaaatgtgacttgtggattccctttgtacaggacatattctttggtgttaatcatgatcctgaatcattcctgccccagccttttgtctcatcttccctattgtacatttacaaattggccctaatgggtaagaaagaaacagacaactaaaatagctataagatgaacagcagttttttaaaaaactttaaaatatttttcacactctacaggggaataagcagataatttgcatatacacttgtggctctgtgatgttttcatataccagaatttaacacctttgcaaaatcctagcagagaccatggggatacacaattagatgcttaatctaaacctggaacaatgtgatttgggctgatttgcagagagactgtaaaagctgaaaaatcagtttgacaacgttcctgctgggattggcctgcaataaatgtttgcagtggtatttggaggccatgccagtttattcagatcactggggcttaggagatgatgcctacagtaaaacttgagttcactgcttatcagggaatgtgtgaaggctcccaggctgaaggttcattaggtcagtatgtaagagctgtcaatcagaccaagctgtcaggggaatacttttttaaaaaacaaacagaagtaaaatttttctacttaggatttttccacattgcatcccttctgccatcatatcgtccatacaagagacagcccttgtgagagagtagaatattagcccattgtaatgttccgaatgtcagcctttggccaccatcacctatgagcacggctgctgctcttagtaatcattgtggtcacttaggatgaatgggatagaatggttgtccaaagtacataagtctttaaggagttaaggacttgcatcatattcattagccccagtattttaccactgtgatggaaacatagaaggtgctcagatgtttattgatctcaacatcaagaacagaaactactatatgaatctagcatacatatggcctttaccgccccatttcccattcttggctttaacaaaatttgacaaaattatttcctgtatttcttccatattgtcaagcgtgtattgttttatagctagaaaacctattatttaggtttgattttggtgtatttactgattgagcatgactagaagaatattcgaaaggtctttgtgaaaaaaaaaaaaaaaaacatcgtattacttgtaaaggaagccaagaaggtttggaggtgcaccgtttattaggttttgtgtgaacatttaacactaaaacattagttaatatatattaaccatttagatgattgtaaaacattatatccatgtggcaagtcactaaatcaaaacacaggtaactggaacagactgacagaaaacacagttggcctcatcagatacatagaaaccatagtaggatgaccaagataaacagtatagctatgaaaacatcaagttgatgatagcatagactctaattattatcatcgatagaatgtgaatgtataataaagtgaattatatagtttttgtttaactcttgttttaattagcaccagattcagctacagttgtatttatgaatctatgttaatttctaataattagaatgaattacttcttcctaagataatactcttcctagaatggaaatttagaaaatatactctattaaatatcagttgattttctttccaggtggcatccattaggacaaacattatgaaaaggccactgaccaaaatgttgatttcctagctgacacctggaagaaaaataaacttatgtttaatggaatagactgtctaaatccctgttttgagaagagttcacattcatgaatatgtattcattgctgaattcaatagattcgagtagtgaaggacatccgtatcatagaaagtcgcatctattcattaacttacaactttccaaagaaacaagcaagaatgcagcttgagatggagtgctggcaatacgcagttcattcctttattatgtgacacgtttatcatgacctgcatgataactaatgaaataaatatgagatttgtgtattatctgtggcctaatttgttgaacttctcattttaagttacagtagcacaatcctaaatcagtattataaatgagctgtttatggttttgtcttattcagtgttctaggtgcattatgtttttttatttatacatttcaaataatttttctctttatttcttcttttctgcagtggtaaatcatccctgtgcaacaagggctaatccaagatcagctacataaacggcctgagtgctgttttaaacaggattgggtgatggtacaacatgactttttaagataatcaagtagtaaaagtttctagtggaaacatgata

SEQ ID NO: 2417 - DNA, 146586 bp, Homo sapiens
tccttcccctccccactcttctccttccctcccctcccctcccttcccctccggagcggctggggctgcggcgccgctgctgacacggatcggccgcggccgccaccgggcggaggctgcgcggcgcagacccagacgggcggccccggagggcgcgcggcgatggcggcggcgggcaggcggcgggcgcggcgggcgaggggtccgggctgagctgcgggccggcccggatggcgggcggcgcgggctggtcgggcgcccccgcggctctgctgcgctccgtgcgccgcctgcgcgaggtgttcgaggtgtgcggccgcgaccccgacggcttcctgcgcgtggagcgcgtcgcggcgctcggactgcgcttcggccagggcgaggaggtaagctggcccgaccccagtcccggcccggggaccccagcccagccccgccgcccctcccccagctcccccgccgggtcacccgcgtggcccgaggcggtggcctccctcccaatcccctccctccgccggagcccaggacctcggccccccccgggtatccctggcccagccgggccctcgctttccgccccccggcgcccgtgccccgagcgtcacgcgtcacgcctagggtggcttctgcgcccaccttccttcctcggccatgcaggtccttctgagcggtctgcacatccacccttgtctgggggagagagctgccagaatccggccctaggctccccaccccacccggcgctgcggagaccaagatgcaagggtctgtgtacgtcctgctgggccgggccagggggtgaaagggaccggtaggggtgctctgcagccttggctcctcggctgcacacaccctgcccagacacggaaggaggtgtctgctggggccaccgtgtactcccgggccagtgtcgggtgacctctcattcaggctctgctgggcagccaggctggcagctggctgtgttggttgcagcaggccaggcaaagccaggctcggggagtggtggctgagcagagggctttcatgtggcggggccgcatctatttggggaaagcaggacttacgtagattgttaacagggctggaagcggagggtcggtgccgccagtagggtggacggagtcatatcactaaacgcacactacaccagtgtcctctggtgccaccggcatggggactggggactgtgtctcaaggggaggacaagacacccacctggctgaaatggtcaggggtttcccctggagccaaaagccctgagaagtgggtttccaaggccatctaaggcctcaggccctgcatggggggcctggggccatgggcctcaaatgggcactggctggcattgtgttcccagaacaggtcggaccaggcatttcagaacatgggagaagctgggtgatggccaggttgggcccgtgcctctgcgtcaccagagagtgggaggcgattgagaatcatctctccacccgcacctgggcatgggccgggacttgtgagtcgctgagagctgtgggcagaagagagtgaggcagcttcagggcttgagaactcaggtacccaccacaggaaagaccactgcagtgcctgtgagagcccagactgccctctgcggggctttgctgagggacactgcctgctgccaccatgacccttcttccccaaaggccagccaagcccttccgtttttccagtggctcccatctggggcaggctgagcagactcctggcatggggatagtcgcgctccttcctctcagaacacagactgcaggtcgggtaaagaagctaccagctctggctgaaacctggagtccccgaactcagagcctcagtagtgggaagggcctcccaacaacctctggcaggggccaccggcctcagccacgtgcccagcaagcctcacccacttctcccccagctggacagttcctgccattagaaccttctccctcatacactctagagacagacctgcttgtcacttagtcatcaccgttctgcacggggactcacataggtctctcttctttgggggagcctttaaatatttgaaaatagcactcctgccccttctctccttcccagctccatactcccattttcccttctccaggccaaataccccagttcctgaagccctaggccatttccatgtgacccagtagccagacctctggcttctggccttggagctgccatcgactaattctgtgattcagttttcctagcaataacatgaaagggctggacaagcagaccgccccccgccgcccccaccaggactatattagccccaagacctcacacatatgcacacagcttagggtggggctgcctctgaatggggcactgcactctgcttatattaagtttctggccaccgaaacctccagggatctgttttagaaacctctgccaagccagggattctccacccttcggggagggtcagtgatttttttcttttaaaagcatactctgagattactacagaagcggtggatatgcattgcagaaaactggaaatagggacaagcaaaataaaaagtattgtgtcctatctctcaggcagcgcctcaatgacacttctgtcagacctttccagagctgtttccatgcttatatgtcaattttctccagaaaatgagatcatactgtgcatactgttttgtaacctgattttttttgccggtaaatgatcatgacttttctgcttcaataaattttcatctggtttaatatgcagacctttttcagatttccctatttgaccccaaaatgtccatttttgctgtttcctctccaggactgtgcagtgtatgtggttgttgtcaccttttagtctctcttactgtacacaattcctttttcttttcttttcttttcttttttcttttaacaatcctggcttgtggaagcattcgggcctgttgtctgtcagtaatttctggaatctaagcctgtttcttggcccttattcccatttaatttcgtcttgttcatttcatcacattgtatctgtcaagaaagagaatctagcatcctacctctatcactctcagctgtgctgctgcctgcgggctggagaagcagtgcttggtgtgtctgaatccacaaggctggttaaacattgcagggcaggaccatggacagggccccgaggcacttgtaggggtggttttcggcttatgctgtattgaccgagacccgtggaaatatattttgcatctctactcactacccatcttatcccctgatgcattaaaaaatcggagtgttgttttccagcggtggggtggcggggggcggggggggggggctcccttacgaaatgcagtgtactctgactgtttctattttatttgttttaaaatcaggcagtgacattgatttcccagccacttgtgctctgggatggataatgatcattcattagatatgtagttcagtgaacttagagctgattgtccacagtttaccacctacccccagaataccagggataccaggatcaaatgctttgcaaaaaccaaaatatactaggtcataaagtatgaaataaatatccatgaggccataatgaaatatatatatgtataaattattgaacagatgataataaataaataggaaaatctctcgtatagaagaaatctgaataacgtatgttgataattgccccattgaggaagtgaagcataacgtcccaccgtgtaagcatgagatgtgcgtagtggcttccttataaagggtagagtttggaaagtggggggaacagcaactgtatagtggagaaacccaacaaacactgtctcagaaggtgatcaaggacaacatcgatagtgacagattgtgatgatggcatacacccttggtgtgatgtggtgagaatagaacttttcctctgtggtcttcctcccaaaccagtaatcccagtctagtcctgagaaaaatgccagacaaatcccatccgagaggcattctacaaaatgcctgattaggacctctcaaaattgtcaaggtcatccaaaacaaggaaattttgagacactgtcagagccaagtggagactaaggaggcagctgactaaatgcagtgtggtgtcctggatgggaccctagaatcaagaagaggacattaggtaaaaactaaggaagtcaggatcaagtatgaatgttacttaataatgttatttatggattaggttagtccctgatagttccctactttgttgacctaggtatcacagcagaaaagaggagacaatgggccgggcgtggtggctcatgccggtaatcctaacactttgggaggctgaggtgggaggatcactggagctcaggagttccacaccagcctgggtaacatggtgagaccccccatctctacaaaaaatacaaaaattagcccggtgtagtggcgtgcacctgtaatcccagctagttgggagactgaggcaggagaatcgcttcaacctgggaggcggaggttgcagtgagctgagattacatcgctgcactctagcctgggtgacagagtgagaccctgccacaaaaaaaaaaaaaagaaaagaaaagaaaagaaaagaaagaaatgcagatttttgagggatgggggcacaccactgccctgatcctgaaagtctacaatgccagggagcaggactctgataagtatgtaacatgatggctcaacatcctgaccctgtgttgccttctgatatattgcattgtctccctaacctctttaggcctctatttactcatccatcaaatggggctgatcagagtccccattctatagggttattgtggggtttgagtgagttaatacatacaaagggcttagtccagtatctgcacagagtaggcataatatcagaattgctggtgctctccttgtcattattattattttctaaacacttgcaagcatttttgagaggctgttctaggctggagatttgctaggaattgaggtcaagatctggcaccggcctctgtgtgctcaactcaccctccttaaccagctgtggtgttcctgcccctcttacgtcccctcggcagtcagaatggtagacattgaaagcagccagagatgtcctggaccacacttccctgtgacatggtcctcttccctttccagtttgaagaccgtccttcttgctagaaaaatagaaataagaatcaccaagtaggcctctcccatgcattaacacagcaccatctcctctggacagtgggcctgtcctgcctgcttggaaatgaaatgatggtccccactgggctccctgagtcctcaggtcccctctgagctaatgcctgctatgggggaattgctagtgccacttgggttaagcctgggtctttgaaatggcaaaggggttggggtgctaggatgggctgagaccggccaggagccagccctggggctgggatcgatgtcttttgagatacgtggcttccaggaacaggagcacctggaactaaagctcctctgctcaggagtagcaattggataacagggaagaaacaactgtatccccacagctgtggctggaggaaggggtgaaggggaaggtagggccagatcagtggttccctgtaggcagtgagacctaggcagccaagagtggatgtgtatgagagaacaggggatggggagcaggattggaggcaggaggcctcctcgggactgtggcacatggtaagagaggaagagcatcctaacttgggcagtggcggggggtgcagaattgacaggggcctggaaggccggcaaagtcccaacgagctactcccaaaaggtgatagttaaaggtgctcttttgagaccaggcaacctctatgtgccccaccctaatgaggctaccatgcagagtgacaaggctggcacatcagaaggaaggcccaggtgccctgagcctggcagaaaaggtgggagtgcctgggacctgaggtggaagcaggacaagagtgagcccagagagatgttctctttcctatgcttctgggaaactgtgctcctgaggttggaggtcatcatggaagtggggccagggctggggatcccttggggcctggggatgggcatgtggcaccacactctgcattgaggcgggaggacgagtcctagctggggcaccctctggcctcttgtgcccaccagtttggctgtgctgggaggaggccagatgcagaaagtctgctgggactcatccatcttatcagacacgcccctgcctttttttttttttttaattgaaacaggctctcgctttgtagctcaggctggagttcaggggtgcatcatggctcactgcagcctcgagctcttgggctcaaaccgtcctcctgccccagcctcccaagtagctggcactgcaagtatatgccaccatgctcagctaattttttgtcagacactttttttttttgagacggagtctcactctgtcacccaggctggagtgcagtggctcgttgcaacctccaactccggggttcaagcgattctctcacctcagcctcccgagtagctgggattacagccatgtgccaccacgcccagctaattttttgtatttttagtagagacagggttttgccatgttggccaggctggtcttttaactcctgacctctggtgatccactgcctgagcctcccaaggtgctgggattacaggcgtgagccaccacagctggcctgtcagacactcttgacgaagcctgaatccatttggcaaaaccttgctgagttccagcgtcattcccaagacactggagttctagagaaggaggaaatgccagcgttgagagaccgtgccatggggggtggggggtgtgatccctgcctccattggtgagacctgaatgggggacatatagacctgagtagggggaagaatcagcccttcccatcagcaagacgtgccctccgagggatatcagtgggtagagaaccttgaaccatccacaagcttcccttatgggcgtccagcccatgaagtgtgacgttcccccttgtacaggtgggtcacgaggctggacaggcagcgtggctttcagacctggccctggctctgaggcttaggagccttccctagcaccgggaagaaaaccaaagaggaaaagaagaagaaaggaccggacagagggaggagaggctgggccaggagattcctgtgtgctgcctgggctggtgggcggggagtagggagcccaggaacctgggaacgggggcgatggctacaaagccacccctttttccttcagcagggcctccactgcctgagaagttcggcactgggcaacactgccttggagggcagtgcattgctagggtgggcagcaggctcctggacaatggtgccccggcctgggcaaccttcggccggcaggaataggggtgttcacaggtccacatggaggaggggttctgcctcagccctggagtgtagggcggagggctccttcccttcctgttgcagcacccctttggcccactgagcagtcatccccaccccagccctgagcagtgccaccaggaacagtgcagaaggggaacctgacagctggctgagatagactcttagagctgagtcacaccaacctgggcgggatggaggggaaatgcccgctggcctggaaatggcatatggcttgcccaagtcactgctgtcctcctagccccaagttattgggtaaatgcgctgaaatttttatagagttgattttatggaagtatcccttacatttacccttaacacgggtccagatttaaaaattttttattctaggccaggtgtggtggctcaaccctgtcatcccagcactttgggaggccgaggcgggcagattgcttgaggtcaggagttcgagaccagcctggccaacatggtgaaaccctgtctctactaaaaatacaaaaattagccgggcgtggtggcatgcgcctgtagtcccagctacttgggaggctgagataggagaattgcttaaacccgggaggcggaggttgcagtgagctgagattgcaccactgcactccagcctggatgacagagcgagactcagtctcaaaaaataaaaataaatacataaatacaaataaaaaatttttattcctaggcccagcgcagtggctcaagcctgtaatcctagcactttgggaggctgaggcaggcggatcacctgaggtcaggagttcaagaccaccctggccaacatggtgaaacttgtctctattaaaaatacaagaattagccgggcgtgatgatgcacgcctgttatctcagctactcgggaggctgaggcaggagaatcgcttaaacccaggaggaggaggttgcagtgagccgagattgcgccactgcactccagcctaggcgacagagtgagattccatctcaaaaaaaaaaaaaagccattttattccattaacatcttgggtacctactgtgtgccaaccctgccctgggcactgggaaataggaaacaacagggacctgggctcgcattctgataggggtcgcagaaaagaggcaaaggaatagaaacaactgtcaggtgcgggtaagtggcagaaagaaacattagtgccgaaacaaaagccagtgtacttagaacaatgtcatagatggctattgaggtggagcccagaatgaaatgggggctgcaccttgcatatgtcttggaaacgtggtccaggcagaggcaggagcctgcccaggggcttagaggcacagtgagcccgaagacaagggtggggccagttcctgtggccttccctgcaggggctttggctttcttggaatgagatggaagcccccaaagggttctgagcggaggagatacaggatcagacttaggtttaatggggaccaccctggctgctgtgtggctcctcggagaggcagaaggggccggggagaggcagggagaccagcaccaaggctagttcttcacccaggtgatgggcgctgggggccaggagcagaggagaagccgtggagcagtggctggatcttgaaaatggagccgattggcagtgggagtgagcaagaggagactttggagacaagctgccgttgctgggtggggaggcagagaggaagagggctgggtgaggactcgggagctccacgttggcctgtgagacctgagtgcagctgtggagccagtggcgatggacaggtctggggaccacgcttcagcccccaccgcctggcacatcctgggctctttctccctttccttctaccctggccctggggtctcatctcattgcccacaacaaaggagtttacagaagctgacctaggtgtggtctggccccctttaaaagtgaggcttggccgggagcggtggctcatgcctgtaatcccagcactctgggaggccaaggcaggcagatcacgaggtcaggagacccagcccatcctggctaacacggtgaaaccccgtctctactaaagatacaaaaacaaaattagctgggcatggtggtgggcgactgtagtcccagttactcgggaggctgaggtgggagaatggcatgaacccgggaggtggagcttgcagtgagccaagatcacgccactgcactccagcctgggcgacacagcgagactctgtctaattaaaaaaaaaaaaaaatgccaggcttgccccagcatcttcagattcttggagactcccccaggggccatagcttagggtcaccaattccctgcaacctgtcacccctgaggtcactgctgaggacccattgtccatagcttctgtgcccttgagggcaggatgagcagagcagcccagaatccttataggtttctataacaacccatgacccaagacggggagcaggctccatacagctgtagcccagattccagctgtaaggacctctggcttccctggagaccaaggccttgagtccaacacacactgcagttgctgtggctcagggcttacaggcgcaaaacccggagaagattgccagcttcctccaaagtgtttgctgatgacacatgggcctgcagtgggcactgtccccaggaagatcccagtctaaggctagcacctggacaggatagacagaggattgatttgaaccaaaacaaaaaccagaaggggagtagaggtcattcaatgagactcccattcagtgcctgcatcactcagtagccaagagacagggacgcgctgcctcccaaggcaagcccattctcacctggcagggctctggctgagttcttgttcatataacgagctgaaatctatctcctagagttccatctgctcacacttcctccacccattcatccaaccatctgcctgccggttcacctaagcatccacttacccatccatctacccatccatcatcccttccatccatatatacccaaccatgtacctcctgatccatccgtccagtgaaccgcccatccaacagtccatccacccatccattcattagccacgcaccccttagtccacccatctgtttatccacccttctgcccacttccgtagcctccccatctgtccatgcatccatccatccatccatccatccatccatccatccatccacccaccatctaccacttcctgagtatcagtcatgcaaaagtcctaagcacagacccagggatggggactggtattttcagggagtgacaagtgtctccatgtggtgaaaggacagggagggcagggagactgagaactcaggctggaacagggaccagatggtgactttcgggagggctcaggagctgggagggtctgagtagctcagatgagttttggatgagcagcaacacctcagtgcagtgattcctgccctctatggaatcaactcttttttatgatttctcacttcccacacaggccattgggtctggcaagagctgggaccttgctgaaaaatgtgaaggctcagattattttatttatttttatttatttatttatttatttatttatttatttatttttgagacagagtcttgctttgtcgcccaggctggcgtgcagtggcgcaatcttgactcactgcaagctctgcctcccaggttcacgccattctcctgcctcagcctcccaagtagctgggactacaggcgcccaccatcactcctggctaattttttttttgtatttttagtagagacggggtttcaccgtgttagccaggatggtctcgatctcctgaccttgtgatccacccgccttggcctcccaaagtgctgggattacaggcgtgagccaccgcgcctggccagattatttttaaaggtgcttattatgataggtggacctcagtttccttatctgtaaaatagaggtcatacccctatttgtggcactgttgtgatggttggagattgaatatatagagatatatgagtatgactgagcatggtggctattgcatcatttcttcaccgccccgcccccccgcccagccatgacccacatgggtactgcgctgccctcagtcctaggactgcacctctgacccctttctctgcccagtacaccccaggcatggggctcccttgtgcaatgaccaaagtcttctgcagccactggtgattttccatggacagagaggatatggagacccaaggactccaggacccaccaaaacttgctggctgcctttgtatttctttctttctttcttttttttttttgagatggagtctcgctctgtcacccaggctggagtgcagtggcgcaatctcggctcactgcaacctctgcctcccaggttccagcaattctcctgcctcagcctcccaagtagctgggactacaggagtgcaccaccacacccagctaattttttgtatttttagtagaaacggggtttcaccatgttggccaggatgatctcgatctcctgaccttgtgatccacccatcttggcctcccaaagtcctggggttacaggcatgagccaccgcgcccggccctgcctttgtatttcttaatccctttcgtcatcacggcaaccaggagcctccatgaggtgaagtgacttgtccagggtcttgagtaactggtggagctgggattagaacccaggtctgtcaggttctaaagctgcctttttagcttcctgctgtgggggtctcatgttcttagaaggtcagaggagggagagagtgacctgatctgagttccagaaatctaacattggagaaatctgaaatttgagacttcctctggctggggactttgagcctggtgtggtctcggttgggaaatgcgcagatcagaagtaggtctgggctctgcaggatgggcggccaggggccctctcatgggcactgcatcccagcactgggcagggagggaggctgccagcgaactgtgcccagaattatgcatctgcgccacttcctgttcaaatggtgattccatggccccaggaggtgcgcatttctctgactgctccgatttcctgccaggcactcataggtaatcctctgcaggcccaggctgtgtggggctgagtcttctttgtctccagttggccgccccgccagcccgtggaccacacactcctgttcctgcatcctcctcggcctgcactgcagatcctccccagtcagaggccctgcagccccagccggccttggccccatcctgctctccgccccgtccccacttccacttttctactgcacctcagatcaggccaggccatctctcaggttctctccctgccctggggaagtgactgggagctgggccctagtgtcagacacatctggtttgagacccagctctgcaacttacttgctgcgtgactctgagaagttacttaacctctttatgcctcagtctcctcatctgtatagtggggataatattagcaatgcatgttaaaccctcaaaacgacacgtgacatagtgtcacatatgtttgttaaaatgaccgttaccaccacctctaggttttctgagtcagctgtctgatccactcttttacagattttttgaggtcagattctgtgtcatgtttggggccagagggtatacagatgagtaagataggattccttccctgcggtgggggcgggggactgacatggaaaccagacctgcgggaagggtgcgggcttgtgcaggtgtggctgaggcatgaagataggagagtcactctgcctgggagatgagaaagcctttctggagtgggacttcagaaatggatggcggggctgagtttggaacagggtctgccagggtggagggaaggacaggtatgccaaaggtgagacctacctgtgcagaggcccacctgcaggggtggaggggctgaccaggcaggctggaggcaggaggtggcagggcttgattttatcccaaaggtttcgggataaaatgttgaagaggtttaagcagagggccacacagctctattgcctttagacaaacccacctagaagtagcgtgggttggggagaaggggctgaggtgggaggcttctgtcccagttcaggggcaaggagaggggaccctgaggatggagagaaggggagggtcagagggaggctcccaggcggtctggaggcgttcacatgggtcctccatgattcccacctccatgactgggtgctggagccctgagcccagcgcaggtggcactcataggcctgccaagctcacgcagcctcagggcctgcccttgctctcaggaatcatttgaagggcagctgatctttttttttttttgagacggagtctcgctctgtcgcccaggctggagtgcagtggcgtgatctcggctcactgcagcctccacctccctggttcaagcgattctcctgcctctgcctcccaagtagctgggactacaggcatttgcgctgccacacccagctaattttttgtatttttagtagagacggggtttcactgtgttggcaaggctggtctggaactcctgacctcaggcgatccgccctcctaggcctcccaaagtgctaccgcacccagcctgctctttattttaaaagcaaaaaaattatcaaatattgttcttgatatagaaatttaaattactttatacttagtttttcttagttttctttatacttagttttacttttatagtaggaaaaagaaagctaactagcactgaattgaatttctgtaccttaaaacccacatctggttatgattgcctggtgtgagctatcgtgaccctttttcacctcgaggtgtttactgtgcctgaatctgttctagagatggtggtgtctcctccctctcccacccctgcctcatcccaggcaccgactggccctcacaccagtcactattagtgtctgcactaatagtgcagacactctgctctgcccagcccagctcactgagcccagcccacctggcagggcacctgggccagctggtcaacccctgggctcagctcctgctctggtgcaagcagggtggggcccagggatactttgctccccagatgatgccctccagagggcggaaggggggttgtctggagccaggctcactgcagaaagcctggaggaggagtcctgggtaccctgagctgagctgcacctccctcagtaccactgactgtcccttgggctctgctcccagcgcaggcgctcagctgccagccagaggagtggcctctggtgtgggcatctcacaacccctgacccccaggaggcacgtcctagacactgtgtgggtggaatccagggcctgtctgctcatttgtctggccagaggcactggctttgggcttctggtcaccttttctaaaaatggtcgtgtctcctccttctgtctcccctgcctcaaagcaagccttgctccaggcacgagggtgctgtttctgcacgaccccatcagcactattattttaatgtatttgtttctgccagtttgataggtgtgtaatggtatttcacatcttgtttacacttgcatttttaattgctcatgagactttgcattttttccatgttgctatttactcttggtatttctttctgcataaactgtcctatcgatcttttttcagcatttatcaaggggaatttttgttttgccctttattttaaagtcagttctatatatttcagcactgtttgtcatgccattttttcttgctctgttgctttcctctttctctctgttaatcatatcttattgctcaaaagttttcctgtgtgtgaatatgttttctttcaattatatcacatctgctttgtttctgattatatctatcacttctttagtagttagacacttattttccatctctaacaagaataaataagccattttgtttataacccccagttaactcaccaactgtttagtgttttgacacatttgtttttttgtttcacttgatttttttttttttttttttttttttttttgagacaaggcttcgctcagtcacccagactggagtacagtggtgtgatcttggctcactgcagcctcaacttcctgggctcaagcgatcctcagcctcttgaatagctgggactaacaggtgtgtgccaccacgtcctgctaatttatttttattttttgtagaaatgggggtctcactatgttactcaagcttgtcttgaactcctgggatcaagcaatcctcctgcctcagcctcccaaagtgctgggattacaggcatgagccatcgtggctggctttcaccctacctcttatctgtctgtcttatctatccatctatcatctaactccatttctgttgttttgttttgcttgaaccattttcagtagatgaaagacatcttgacctttctcccataaatacttgacagtttcctgcccaaatgcagtgccatgatcacccagggatttcacattaattcagcgatgtcatctaagattcagctcataatcagatttccctagttgtcataacattgatgtttctgaggagtccaggccagttgtcctatagactgtcccatcacctggatgtgtctgtttcctcgaggttagatacacagtaagcgtttttggcagggacaggtggtggtgtgtcctcagagcatctcatgaggggccacatgatgttcatttgttctattttggggatgctgagttcaatcacttgattaaggtggtgtctacctcatctattcaacataatggtacttttccccttataattaataggtaatctgtgggaccataccttgggacagtgtaaacatttggtttacataatagttttagcatccactgatgccccttgcctgagtaaattacactggtggttgccaaatggtgatttttttctaattctctcattctttccacagatagagcattgttctgttaaaaaaaaaaattctttccttccaccccccttttctgagtatcactatgaacttgtggctccttacctccccagcctgtcataccttgttaccttcattctttttaatgctcaacagttttttgttttgtttttaatgcaacattataacattttgagcattatgacttggaataatgtatttttaattgaaacaagccaatcattattaccttttaaaaatccttctgatagtcttcattatttatggattttgaagaatgtaacacatttttcagggtctgtaacgggtattgcattcagtctattagattagagagtgctgccatctttacatactatatttagtcctcccaataggagcaaaatattaacattaaaaataggtgttttacaattggactaaataaatgtttaatatttaatgtgttttattactgctgagaattaagtactttttttccattgatttttttcctagctgcatgtcactagcatataggaatataattgattttttgtaaatgttttctctaatctcaccactggtatgaattcatttatcatttctagtagttttctggttgatgactttgcatttcctaggtaagccatgccatccagttcaaaagtcattgttttgtgtcttcttttgagttcaattactttttcttctgagatgggagccgccagcatttctagagctaagcggggtgggcacaggagacatcgccccaactgacatgtgctggaacattggccacaggcccagctgtgagtcaaggagaacagctggggcaggggcagtggtcttaacagacagggtcccaaaggaagtggtgaatcctgaagaggtcgaggctggtgttggcacaagaggtggcctaatagagagggaagggggccagcaagaggccatcaggcctcctgctatggttcaggggaggactccagcctcatggcagaaaaaccaagtcccaggcagcagagcagggatgatggaccagatgaaacatgcacacagacggccgcagagttgatccgggcagccagatgcagctagctgggctgaggctgttccctggcccgtgtgtggtcttggatggtggtggagccagtagggataagggttggtaagggatggtggaggcaggaccccatcatcctttccttataattttttacagtggagagacagtagcttcctaccattaagtaccttgtcagtacttaggtttaggtcaatattcttttgcatattaataaagaccaccccctctccgctccgttctccttttgttagagtcttattcaagaccagatggtaaattgtatcaaatgtcttcccagcatctattaaatgtttcaacgatgcttgctattttcccagttgatgtaaagaattatgcttggaatggatgagtctccacttggccaggcctggtcaggtgcccatcctcagcggcagtccacccaaatcacagagaatggggaggagcagctccccagaggaaaatcagggtgcacttaccaggtgaggggcattgcaacgttgggtagaaagaaactccagatgtgtaggaaaacttagccttttagcccaagctctcttggttcccaccctgcactcaaggagcagggaggagcatttatttctgtgattctcctggcatgaggacagatgctgggtttctgcagccctctgcctccaacacagggtgttgtactggtacacagtactgggtttatagtgtgtaacaggggcacagtgttacttaaccgactgggtgagtaaacaaatagagtgcaaggggaccagcccggaacccaggagccccagctcctcctgagccctgcccccaaaatcttgtgatttggaagcaagttcctctctgcttcttgaggctgctagatggtttgggaggcaggagggctttgtgatcaaggactcagtgtctgaacgggtcagaggtcaactcccagatttccagcttgccggctctatgacctgggatgggcctctgtacttcctggtgcctcacctgcgaaattgggatgcgatactgttcccctgagagggttctcatgatgctaatgaaagaaggagggtgaagcacttagcacagcccttgtgcatcctaagccctttaccgagaggagttattagggtgcactctgtgtctttggggatatttagaagaggaagttctgcgctggttatagattatttggggctcttgtggggatagggataagtatccaagtccataagtcactgggattgtgcgcttgctgctgccaccacgtggtcccaggatgatgaggatgatgatgatgatgaaggagaaacatacctgcacctgcggctgcagatacaggggtaaattgaaaaggtggtattgcatagtagaaaatagtgcaagttgggctgggtgtggtggctcacgtctgtaatcccagcactttgggaggctgaggtgggcggatcacttgaggctaggagttggagaccatcctggccaacatggtgaaaccctgtctctactaaaaatacagaaattggccaggcatggtggtgcgcacctgtagtcccagcactgcaccgagggggctgaagggggcgggggcatggtgtcacacccttggaggggctgggactgctgtgggctgagtctgcctgggaaggggtgatggcacagcccttctgtttccactgttgctgctgggaatattcccactgccaccacctaaccacctttctgccagcctcagagggcatgtgccagctccaagaccagggccctggttgaagaccagctcctgccactccctgctgggtgaggtccaccagccgcccaatctggattcccctctcagggtctcatcatcagaatctccaggggaggccctggaaaatgcagcttccagggtcccaccctggtgaacaggctctgcagatctgtgttgagatgacaggatgagaatccctcccatctttccaccctggatggcacacggtttaatggaggatgcgtaggccctggatcagaatgccaggctcaaacctcactttccaggccgggcgcggtggctcacgcctgtaatcccagcgctttgggaggccgaggcgggtggattccaaggtcaacagatcgagaccatcctggctaacatggtgaaaccccgtctctactaaaaatacaaaaaaattagccaggcgtgatggcgggcgcctgtagtcccagctactctggaggctgaggcaggagaatagcgtgaacctgggaggcagaggttgcagtgagccaagatcgcaccacttcactccagcctgggcgacagagtgcgattccatctcaaaaacaaacaaacaaacaaacaaacaaaacaacctcgctttcctctcttctagcccagagatcccagctaagtccctgactctctggagctttggttttctggtttattaagtgaggccagtaacttccctccaagggctcgcatgaggataaaccaggggaagggtgtgtaggtgccacacgcctgagtcctttctgatacccaggactctgttacactggtcctccaccccaggcctctgagctactttcttttgggaaagaggtttaaattataaataagggcctcaatcatggatgaggcctcttgcctcctgccgtgcttgctggaaaagaactttgcctctgcaaagagcgtctacaaaatgagtagactcaagacctcccctgtggcccttggccctgccatacgggccctgaggaatttgctgagctgcctgggggtgcctcccatgaggacagctactcagactgcagggcgtccttccgaggagaaggtgcagttgcagcagagaggaagcgagggctagaaagcctgagacatagacagcccctctggccatcgtccttgcctcagtcggggctctgggagggccgcagccaggctgggtaggaccgagcatctcatgaggggccgtgtgaggttcacttgttctgtttggggatgctgagttcaatcacctggggagcagcttggtcctgggaggacccaccagaatttctcctccccaagtgagtgcatcagtgctggcagctgaacccacgagctgcaggcaggggtgtggagcaagtgaacctagacagttcatcctctaggggtgactgcgcacaccaccaccctcctctcacacagatgccggttttgccatggaaatggcccatttaatgtcctgtgcaagggagaaaagctctagatccccagagcaggggtcccacccgtgtccagcaaacagagggaggaaagggtattctgatccagcagttggtcaagcaatgtggaaatggagcccgctcccccttcactttagtccaggaaagcctccgggtaaaaatgctgactccagcctaacctgtctcaaacttacggatttcagaaacctttctacatgtaacacattgacactctctaagaaatgccatcctggtgatcttgggtgaaggactcaacctctctgggtcccacttgcttcatcagtgaaactggaaccttaatccccatcctgccctgtcccatcacagggaccacggataggaaggggcggggccaccttaatctctgctgcccacagagcctgggagctcctcttgtccccagcccctggctagacctggcccaggaaatgtacgtgaacaccagtgagtcccagggagcaggcagacaccaggcgcagataggtttcaggtcctctgccagggctacaggctgcacctcccctgggatccaagtggggtttccgtggtggagagattgaccagtgggcagtgaggtgaggagcagtacctgccccatttcacaggcaaaaaaactgaggctcagagaggtcggggtctgccagggcctcatggtacgtttgaaattccattatgggattcccagaacaagtcgcccttctcacttgccatcttgtgttgtactgacagcaacagtggaatttctgcctggagccactgtattttgctttgtttctgtagctaaacctcaatttactgaaaggccatgaggtgtcctggttaactcattttctggggaatggagggaggactggcgggagcttttcagtttgagtctagttgaagtgtcagagctggggagctcggcatgtttcggatggggcgggatagatgggttagaggaggcagggtccagggaccacagctcagagtggcccaactcctgcaggccagcacccccctttgatgagcagacattcccatgtaaccttaaataatgggtctaaagccaaccaaagcccacagcgagcagcgcctttcaaactatgctgagagccagagatgtcaacagagggcctcacacggagggcacggagggagctgtccttccataggccccccgagaagagagtgtcttccctcttcccccgcccccatatttagcctccccctgccctccagccactgagaacagctggtggttcctcagacccttcgagcacctctacggcctggccttggctaccctctccctcctccctcccttttgctcacaccaacgccccgcttcttgaattcccattccccacacctgctgtgtcagttcttccacctgcagtccagcataaccccctcctcctccaaggcccttccacatctcccaagccctctgggctgtctgtctcctctgggccccaaaactgcaaggatttggggtaacaccttcgagggggttacattgtgatggattctgtcttatcttcccctacagtgctatcagcagtttttcaaaagagtcataagagtttcattgagtttttttccccgaagtttaaaaatgatccagttcatattttaaattcagccagttaaaaattgctggaagaagaggtgcaacgactggctgtcccagctcatgaggttcacgggtgtccgcagcttcctgaccagcgtccaggcatgctctgcctatgaaagcctcatttatcccgagcctgctctgtgtcagctgccaggctgtcttgatatgccatcccctctcagtcctaacacatgatgaggcaatgatgttgctcagggaggttgagtcatccaccactggtcacacagctgggaaatggaggaggtgggattccagctcagcaatgtctgcctccagaggctgggagccacgctaccctgcctctgggcgtgtggcagtattaacagtcacctacacacttttatgctattcccgaggctatttttatttcactcaaaaataactccaggacatctgttccttccctgggagcttcctgggagcctctctgtctccccacaggccagtcagtctggctgaagagctgtggaaacatttgcaaaaggaacggacagatgggcggatgcctgcagaggccagtccacttcagagaccacccaggcttctgtcactttcgctcctattcagaccccaaacaaagcccttgtgggtggccggagggattctgtcagcccagactcaggctgtgaatgaggggccacctgatgacactcagatggatggaggtgttggcggtcccataaaggaagatgtctccagctgtggcggctgggacagcgcttcccaggaggcggtggcctgggtaccatgtcactgggccatggtgctggccagccctctggatgtctagccaccctggccagaggcactccaaagccgcacaggccctctccacctcccctcccatcaccaccttttatcccagtgggtccctgaggcggggtccttcattgggcaggggccctccagctgtgagaaccaggaagcaatgcaaaataacttacatgctgaggcaagtgtattcttccttataacacaagggtccaaggtagggcagctccagggctggttcctcaggggctcagaggcaccagctaggacccaatccccttccattgagcttcccagcgttgacccaagagggcatcccttctccagcaggggaagcagggaggggacagcttcctgttcatgggccccaccctccagagacagcctctcccagagccccctgcagatgtcttctcatggcttattggccagagatgtagaacatgcctttgcctgaaccaatcactggcaagggggaagagccccccggaactggcttggtccagtcagaactcatgctccaggttgagtggccccaggcacctggtcagacaggaggtgggcacctcaggcccagggggcgctctacgtggacaaagaggaggggaggggcaggatagtggtgactgacgaatctgcctccgttcttgtcattatttcttgactttatagaagaggggaagtaaaaggctcggaagagaggttgagtaattccccagggccacacccactccaaggtccccaagccatttacttgttccgtggtgaagctccagtaaatggaggcatttttctcccagtcctctgaccccgtctgcttctccactctggttttcttctcttcctccccccaatccccatgcccaccccaaacatgcctgaaagcattacgatcatagagacttcagagctggaagagacattcaatattaatgttatccagtgctgtcattgtccagatggggaaactgaggccgagagaggggaaggagctcagcgagaccactcagtaaagcagtctgtggtggagctgggactggatggagggcccaggaagcacagcatccctgagattctcagagggtctcagggaccaccctactttctcacctcagcccccctgcggacggtctccgcagcctcccagctggctggtggcccctctgcctgtcccttcccgggggaaggctcaccctcaggccccctttatgcatctttgcacctggcacatccatggcactctgcagcctctgatgtccttgactcatagtctgatctgatcgtcacagcggtcctgtgagctggtcggaagtgcattatagatacagaaactgaggcccagagaggcaacagggcttgcccgaggtcacgcagtggtaccttatcgaagcccaggcagagcccgctctctcggcatgcgacctgtgcagtcactcagggattagtgctctggggttgccttcttgaaattcgtggtaatgttcccctttgccctgggcgccactaattgcggagctggtcctgggcccggggctcctgactcctccaggatgctttccacaaccacataccccctctaccagtggcctacccagggtaagtctgactgattccgtgggacagcccttcacatggaggggagcgggcttagggagtgggagcaagacagtgggatgttttggcctgggctcagggtgcaggaactggaaggacccactttggaaatgcctccctcatcccttgtctcaggccggtgttgctgaagttcttgcctggctcccttcccatcctggcctcagaattaatggagagggccagtggcggcctgtgccctttgtcccaccggccggcctgggggtggcggctccagaatacagggtcctattgtgtgccctgatgtcaggcagctggactgctgggagtgaggataaacaagcagctggagcatctcgcctgaagccccaggagagggccagagcccctgcagcagcaggagaaggggccagtctgaagagggacagagctaggggcagttggattccaaccctgcctgctgtgcggtgaggccagcacagcaacagggtccactgctgtaagaggggaatgactggcggtttggctacttcacagggctgctgggagtgatgcacttgagtgcttcgaaggctgcctgacaccagccagctctgccgctgtcagcacttgcccctgtgcttcctatcgcccatattcaggataaagcacatacaggccctttgcctggctcgtaagcccttctctttcaggcctgttccctctctctttggccccatctcttgatgacgccccctccccatattccttccatccaccccagaccccctgcgtttgccagcattgccccctctccctctcctgttccctcttgctgcccttcacgtccttccccactgtccccctcacctggccagctcctagcaggaaaccctgcaactggtcctgggatttacgatgcctccggtaccccagtgtcctcacaggtgtctcctgactgtaaggcctccagagtggccacccctgagcaaggatctggccccagcacctgcctcacctcctccagagggtcccttccccagaagcactgccagggaaatctaggctccacgtgggttcaaaaggcacttcccggcctgctgcagggagtctccaggtgcccagacctgccactgtctttgtaggcccctctcaccccacaggcactgtcctttcccctcttttcccatctgtcttctattgtggctgctaaaacagcataaaaatgctggggagtttcaacttcaccctactccaagccaagccctgaaaccccttttgtggatatagacgatgtcaggtgcccagccaagcccaggttagtgcctggggtagcaggaattgccactccgatgcccatgggggccaggaaggaatgcagcctaggtggggctgcggtggggaactacttgagatttgggggttcccatagacagctggggagcagaatacattccctttctaaagagtgtgcttgaattcagctgtcgctcattgttgctgtgggggaatatgggacctgtattgccagatctgatttttcaagaaaagccaggggctgggcatgggggctatgcctgtaatcccaacactttgggaagtcaaggcaggaggatcacttgaggccaggagttcaagaccaacctgggcaacataatgagaccccatctctacaaaaaattagccaggtgtagtggtgtatgcctgtactcccagctacttgggaggctgagttgggaggatcccttcaacctgggaggtcgaggctgctgtgagctatgatcatgccactgcactccagcctgggtgacagtgagaccctgtctataacaaaaataaaaataggctaggcgtagtggctcatgcctgtaatcccagcactttgggaggacaaggcgggcggatcacctgaggtcaggagttcgagaccagcctggccaacatggtgaaacctcgtctctactaaaaatacaaaaattagctgggtgtggtggcaggcacctgtaatcccagctactcaggaggctgaggcagcaaaatcgcttgaacccgggaggcggaggttgcagtgagccgagatcgcaccattgcattccagcctgggagacaagagtgagacttcgtctcaaaaaaataaaataaaataaataaaaataaaaatttaaagtcagatatccaactttgtatgtgcagttcccttgattttttttttttttttttgagacagggtctcactgtgtcactcaggctggagtgcagtggcacaatcacagttcactgcagccttgacttcccgggctcaggtgattctcccgcctcagcctccgaagtagctgggactacaggcgtgcaccaccacacctggctaattttgttcattttttgcagagacagggttttgccatgttgcccaggctggtctggaactcctgagctcaagcgatcctcctgccttgacccactcccaaagtgctggggttacagctgtgagctaccgtgcccagccagttcccttgatttttaaagaaaaattttaaaaaattgtttttactttacatacagtaaaattcgctttttgggggtgggggaagaagtgtcactatttacatagactcctgtgactcccactgccatcagggacagaacggctcatcccccaaattctctccggctgctcctttgtcttcagtccctcctcctcgctcttggcacccactgatctggctttgtcactatggttttgccttttgcacgtaaatggaatcatacagtttgtaacctttgggagtggtttctttcccgtagcataatcatttgttctttttggttagggaacacttgcttatccattcacttgttgagagacactggggatgtttctaggtttgggtgattatgtgtaatgctgctgtggacatttttgtgcagttttgtgtgggtgtgtgtgaatgtaagttttcatttctctaagataaggaaggataaggaagttcccttatatttctactttgttgagagtttttttgttttttttttttggtatcatgaatggatgttaaattttgccacttgatttctctgcatcttttgataggtttttcttctttggtcatgtttagattacatccattagttttcaaatgttgggccagctttgctgaataaaccccattcggctgcttgtcttgttatatttttcatatatatctcctggattcgatttgctaatattttgcagaggctcattgcatctgtgttcatgagggatattggtttgtagttttcttttttctttttttttttttttgagactgagtctcactctgtcgcccaggctagagtgcagtggggcgatctcggctcattgcaagctccgcctcccgggttcacgccattctcctgcctcagcctcccgagtagctgggactacaggcgcccaccaccatgcccggctaattttttgtatttttagtagagacggggtttcactgtgttagccaggatggtctcgatctcctgatctcatgatccgcccacctcagcctcccaaagtgctgggattacaggcatgagccactgcgcccagcaggtttgtagttttcttatattgcttttgtttggtttgggtaacagggtattattgctggccccataaaacgagttgggaagtggctcttctattctctggaagaggtagtgtagaatttatgtatattttccttaaatacttagtgaaattatctggtcctgaggttttcctttttggaaggatataaattgggaaattaatttctttaatcactcaaggactgttcagattatctatttcttcttgcatgagttttggtagtttgtgtttttcaaagaattggtccattagctcatctaagttgtagaaattatgtgtgtagaagtgtttctagtgttcccttattagccttttaaaggatgtaagactgtaatgatatctctgttttcttttttttcgagacaaggtcacactctgtcacccaggctagagtgcagtggtgtaatcaaggctcactgcagccttgacctccctggctcaagcgatcctcccacctcacccaaccccggtagctgggaccagaggcatgtgccaccatgcttggctaatttttttaatcttttgtagagatggggtcttgctatgttgcccaggctgatcttgaatgcctggtctcaagcgatcctcccaccttggcctcccaaagtgctgggatgacaggtgtgagccactgtgctcagcctcattttttatattggtgatttgtattctctctctctttctctctgtcattctggttagagatgcatcagttttgttaatcttttcaaaaaaaaaaccagatttgggttttgttgatttttctctaccagtctcatttttaattttattaatttctgctcttatctttattatttctttcctcccttttgctttgggcttgaattttatggtattgtattttcattttcatttagtttaaattatttttattttctcttgagactttggggctgggtgcggtggctcatgcctgtaatctcagcactttgggaggccgaagggggtggatcacctgaggtcgagagttcaagcccagcctgacccatatgaagaaaccccatctctactaaaaaatacaaaattagccaggcatggtggtgcatgcctgtaatcccagctactcgggaggttgaggcaggagaattgcttgaacccgggaggcagaggttgcagtgagccgagatcacgccattgcactccagcctaggcaacaagagcaaaactccatctcaaacaaacaaacaaacaaaaagatacttcatctttgactcatgaattatttagacacatactgcctaattcccaagtatttgaggatttttcagatgcctttctgtttttgatttttttgcttgttttaaaatttcttttcttttctttttttttgagacagtctcgctctgttgcccaggctgaagtgcagtgtgtgatctcagctcaccgaaatctccatctcccaggttcaagtaattctcgtgcttcagcctctcaagtagctgggattataggcacaggacaccatgcccagctaatttttgtattgttagtagagatggggtttcaccatgttgcccaggctggtcttgaactcctgacctcaagtgatccacctgcctcagcctccaaaagctctgggattacaaacgtgagccactgagccctgagactgatttttagtttaattatattatagtcacaggacttttttttttttttttttgagacagagttttgctcttgttgcccaggctggagtgcaatagcgcaatctcggctcactgcaaacttcgcctcctgggttcaagtgattctcttgcctcagcctccctagtaagctgggattacaggtgcccaccaccacgcccagctaattttttgtatttttagtagggatggggtttcactatgttggccgggctggtctcaaactcctgacctcaggtgatccacctgcctcagcccctcccaaagtgccaggattatagatgtgagccaccacgcccggcaagacatacatttataatttcagtttttaaaaatttgttgccagactctgtggctcatgcctgtaatcccagcactttgggaggctaaggcaggaggatctcttgaggccaggagttcgagaccagcctgggcaacatagtgagaccccccgtctctacaagaaaattagctgggcgtgttgacatatccctgtagtcccagctactcgggaggctgaggtgggagtattgcttgagtctgggaggtggaggctgcagtgagctatgatcacaccgctgcactccagccaaggtgacagagtaagatcctgcctccccaccacacacaaaaaaagtattatagtttgtttaatcgtccaagatatgatctacatgatctaccttggtgacagttccatgtttacatgaagagaacgtgtattctgctattcttgggtggtgtgttcgataaacatcaattaggttaagctggttagtggtggtattcagaccttttagatcccttgttgatttttcatctaactagctctactgttaaaaattagattttctatctaactggttatattctctagaggagtgttgaagtctccaactatgattgtcaatttgtctatttctcctttcaattttattagtttggcttcatgtattttgaagctctgtttttagggacatatgcatttaggattgttatgtatcttcttggtgagttgaccctttaatataatgtttgtctgaatccttggtaattttccttgtttggattaggcaatttctgttgttctatcactgtttgtactgtgatttccgttctgctattgatccaatccaatgaacttttatttcatatattgtattttttagttctaaaatttccatttggttccttttttctagcatctatttttctgcaagaatttcgaaatttccatttatttcggattgttcacctttactgaaccatggagcatggttataataacttttttaaagtctttgtctaataatggcaacatctgggtcatcttagcattggtatctatctattgattgccttttttttttttttttttttgagacggagtctcgctctgtcactcaggctggagtgcagtggcacgatctcggctcactgcaagctctgcttcctgggttcatgccattctcctgcctcagcctcctgagttgctgggactacaggtgtctgccaccacgaccagctaattttttgcatttttagtagagacggggtttcaccatgttagccaggatggtctctatctcctgacctcgtgatccgcccgcctctgcctcccaaagtgctgggattacaggcgtgagccaccgcgcccagcctttttgtcttttgtcttgtacattgttgtcagcttttcctgtttctttgtatgtcaagtaattttggactgtgtcttggacatttggaatactgtaagacactggggcctgttaaaatcctctgaagaatgtcagttttttctttgtttgtttattcgtttgtttttgagacagggtcttgctctgtcacctaggctggagtgcattggcatgatcatggctcactgcagcctcaaccccctggccttaagcaatcctcttaccttagcttcctaaagccttagggttacgagcatgagccactgtgcccagtctgtttgtttgctttttaaatcagttaggttgacgcctcagatcccaacctgccctctgtgaattatagtttcaatgtcagttcagttttcaaagcctttgcagtgctattcagatccaccccaagtatacatactccaggggccagtctgttcagtctacactgtagttcagttctcagagtctttggtaggttatttggggtcagttccatgtatgtgcagctcaggagtaggctaggacctcaaatacaacaactttatgggatcatattctcaagctcccttctttctgtgatgccgccctatccagcttccaggggcccctttttctcatttttttccaggtaaaagattttccctttctcggagttttaggtccccctgtgtgactgctacggctgctgccaccacctaacctttgggacaggttttaccttgtagggagggggctgggagagaaaaaagacccagggcacttctcccactcgatttttcccaggaggcccccctttcccggcttctcatcagaaagagagtttcttccgtagctttttctctgtgcacctgctgcacagttctgggatttgggctcctgagtctaggtcaggaaatatgcaagctcaccaccgtattcatcttacttaacgtttttgttttcctccccaattcaccttccactattcacttttcacagtccttgtgtagttgttttatgtcttctgtcagggtttttagttataatcaatgggaaagctagactgtagtgtgcttactccatcttaaccagaaccaggaggcttgcttggctttaaatattggcatctaattttaagtctgtcctcaagccacatctgagatgctagctggccacctctgctttagtggcacagtgtctcaaaattaatttttctttctttttttcttttgagatggagtcacaatcttggctcattgcaacctcccgcctcctgggttcaagcaattctcctgcctcagcctccccagtagctgggactacaggcgcgcaccaccacacccagctaatttttttttttttttttgaggcggagtctcgctctgttgtccagcctggagtagagtggcacgatctcggctcactgcaacctccgcctcccaggttcaagtgattctcccacctcagcctcccaagcagctgggattacaggtgtacaccaccacaccctgcctaatttttgtatttctagtagagatggggtttcaccatgttggccaggctggtctcgaactcctgacctcaggtgattcacccatctcggcctcccaaagtgctgggattacaggtatgagccactgtgcctggcctaatttttcttttaatactcaaattcttaagcaaaagttgtcagtaccaatgccagtttttctagattaaaagagagcagaatacagatttattctttctctggtcagagcaagcccctaaacctgtcagcataataatagtgattgcaattattttagcagaaataataattactggctaagggcatggagtctggaaccaggcctcttgtgttcagccgtcttctacgaactgtgtgaccttaattctgaatgactttgcctttctatgtctcagtttcctcccctgtaaaatgggaataataatggtatctgcttcccaggtggtggcgaggattaaacaaattcatatgcatagagcgctcagaacagtgcctggcacaaaggaaggctcgctaagcatttgctttgattcccgtgagtaatggctgacgtttattaggcaccttgccttgcagacagcttcacagcggcaagataagccggcttatctcacttgctcagatgaggcagctgagatttcagaaaggcaaatggcttgcttgagtccatctggccttcagaccttgaaattagggaggcgtgggtggctgggcatgggttcagggagtatctggctggtaatcaatcagacagcaacggcaacgaagctttttaacatcatctggtctgagctagaagagatgtgacccaggggactgagtggggggaaaaaatcagctcaaagagaaaggcaacagaaatagaaggggaagcctggtaattgagtggccccaaaaaggaaagatcaatattttacttccagtgaacaaccaatttccctggcagcaagctggggcccagctgtgtgtgcttcagtgacaacagctgcttctgcaatgcctgccaggcctggcgaacccgtctctcctggcctgggagccagagggggagccccagggctgcccagccacgcatggtgtgtgccccagggtgggggcggcccccagctcccctgcctggggcccaggctccccacgaagaccacatggggtggctatttgctatgctccctgcgtgaccttgagcaaacccctccccccgctgggacctcgcttcaccaactgtgaaatgacgggctgggtcagtggaatgtgtctggccgaggaccatctgtggcaaaaggttacctgatgtccaggaaggtcgagactctttgtgatccaaggcgaggggtccccacgtagtgagtaaagcttctttgatgctcagggcgccaggggatagaaagaacactttagtgcagacagccccgtgagagtctctggcccaggaaggcaacagggagcagtggctgactctctggggtcagtaagacctgggttcaagagttgccactacaggtgggcaaaaattttaaatttaaaaaaaggaaaataaaaggggagcgttaccactgcagtgactttgtctaaatgtcttaccctctctgagcctcagtctcctcaatttaaaatgggggactataataatagctactgttaagtttgctgtgaggattaaatgagactatgtgtgaaccctccgtggactccaagcatttgcaatacttctccacataaatgatgctgttatttattttaaaaatcactgagcctgtggttgatggtatgtattggtaataaccagcatgcattgttctaataatttcacacctgttttcttttttttctttttcttttccttttttttttttttttgagacggaattttgctcttgttgcccaggctggagtgcaatggcaccatcttggctcaccgcaacctctgcctcccgggttcaagcgattctcctgcctcggcctcccaagtagctgggactacaggtgcacaccaccatgcccagctactttttcttgtatttttagtagagacggggtttcaccatgttggccaggatggtctcaatctcttgacctagtgatctgcccaccttggcctcccaaagtgctgggattacgggcgccaggcaccacgcccagcccaatttcacacttgttttctaaagggcaggacatcagtgtgcctggccatttttgttttttgttttttgtttgctttgagacggaatcttgccctgtcacccaggctggagtgcagtggcacaatctcggctcactgcaacctccacctccctgtttcaaacgattctcctgccttagcctccctgagtagctgggactacaggtacacatgaccacgcctggctaatttttgtatttttagtagagacaggggtttctctatgttggccaggctggtctcgaactcctgacctcaggtgatccacctacctcagcctcccgaagtgctgggattataggcatgagccactgcgcccggctggcctggcacttttgtggccactactctggggctgccactctttgaagagccctgtgggagcagctgtagagaggtcacagcctggggtgtgcccccggttgcagcttgggccatggcgtgggtgcttcggggaccatgcagtggccctcagtaccccatctgtctgcctgtcatcaaacaaccccacccccacctctgtcccaggtaggcttttgctggcagaggaatggacagctcgccccaccagtgtctcccagcctcagggagctgtggacacagggattacagaatccaaatccctgcactcctgcctcctaggtggacttgaggtgagggtcctcatcagtcagtcagcactctgtggccgactccacccttgacttgcttcagaaataatgaaggcagagccctgaccttggagaggactgtaggcctgagcatgggaggctggagggtagagggtgccctggctcatccccacattcacaggccccctataatgccagcgatgcaaaggcaggaggagaggaggcggaatgccagccaggatggtgggtgggctcccctgcagccctgcaggtggcacctgggcattgctattctcagaagccacgtcattgcctggcagtgtcagaggctggcatggctggggggagggggcagctgcaatgttgaggaggctggcaaaaagccactttcctcctttactgaaattttgcaggtctttcctgagagcccactaggtaccaggttcagggaggttcacagaaagaatgtggcacggcccctctgcccttccctcaccccagactcaccccagagtggaaaagcagggtcagctggaatcaagatgcaagcacagagccgccaggttccaggcaaggagaagatggttagggtggggcctctttgtccactgctcaccttccaaagcccactgggcacagcccccatggtgccaggccaccggcagtgaccagggcttcagacccctgctgcagctgccacgctgtgggcatgcaagaaaaacgtggtccctataaatagatgaatccccaacgtggtttggcttcggtgcctgtgatgggtggtgtggtatgccggcgagtctgcctgtgatggcgtgaacactgacaacagtgactgtgagcagtttcctgcatgctgtgctctgcaggccccgggtgccctcagatccatcatctgcagcccagcctgagcagattctggaaagagctcatcctggcctggctgtgctatagatactgatggtgattattagggggagcggcaagatgcctgacaaggagtgtgagcgtgtacacatgtgtatgcactattgtgtatgtgtggctagccagcagaaccagcacctaccaccatcaacccctgaaagagtgcctggcatgtaagaggtgctcagtcatcacttgttgaataagtgagtgaatgaatgaatgaatgcttgtatgggtgctgtgggagggctgccactaagttttagaagcagttttagatttagaagcaggcttctgagccaggcgtggtggcgtgcctgtagtcccagctacttgggaggctaaggtgggaggatcccttgagcccaggcatttgaggctgcagtgatctatgatcatgccactgcactccagcttgggcaataatgtgaggacatggctcttaaaaaaaagttgttattattatgatgatgatgatgattattattattatttgagacggagtttcactcttgtcacccaggctggagtgcagtggcgcgatcttggatcactgcaacctccaccttgaaggtcagaggttctcctgaccttggagaggattgtaggtgtgagcaaaaacaaatattatgaagcctctactatgtaccagtcacggtgcaagcgaccaggtatacagtggtgatcagaatggacagggtccttgcccttagggagcttactttgtagagagaagatataaattaatcaaattatcccacacacatacaactacatgaaagagtatggagaaactaaggctaaggctttctgcagtgaggtcgggagatactcacacctgctaaagttcaaaccacacaatatcccaatagacttgggtgtgcaaccgaagtcatgatctgccagtctccagcatttctcagctgcgagtgccctgactagctcaccagtcagaaaggctttgcaatctaggatttctgcccagccaatgagctgcctctgaaaacaactttctgtggaaatcctccgtaaaaattggtctcctggctgggcgtggtggatcacgcctgtaatccaagcactttgggaggccaaggtgggcagatcacctgaggtcaggagttggagaccagcctggccaacatagtgaaacagcctctctactaaaaatacaaaaattacctgggcatgttggcgggcgcctgtaatcccagctactcaggagaggctgaggcaggagaatctcttgaacctgggaggcggagcttgcagtgagctgagattgcgccactgcgctccagcctgggcaacagagcgagattccatctcaaaaaaaaaaaaaaaaaaaaaagaatccttcctccacttgcctcctgggatgctcttcggggctgtcctgatcccgtgtacctgaattgcaattctttgtttcccaaataaacgctatttcctttgacctccatgtcaatctctttttagttaacaatagcaagttgcaacaaattgtttgaagggaaagtataggatgctacaagacaggatagcagcggggtgggccctgattggatgggggtggtcaggacagacctgtctcagggagggacgtttcatagaggtacaaagggagacctgaaggatgaactgacatggcgaatggggaggacagctgtccaagttgtagggaatagcatgtgcaaaggccctggggcagagaagagtgtggtggtttccgtgaggagctgaccaaaggccagtgcagctagagtacagtgagtgatgaagagcatgggaggagagggagtggaaggggtcagatcacatggggccttgtgggccgtgttgtggagtttggatttttttttttttttttttttttgagacagagtcttgctcagtcgcccaggctggagtgcagtggcgtgatctcagctcaatgcaacctctgcctcccaggttcatgccattctcctgcctcagcctcccgagtagctaggactacaggcgcccgccacgacgcccggctaattttttttgtatttttagtagagatggggtttcaccatgttagccaggatggtctcgatctcctgacctcgtgatctacccgcctcggcctcccaaagtgctgggattacaggtgtgagccaccgcgcccgccctggagtttggatttttatcctaagtgtggtggaatgatactggaaggttttaagcagaggagtgggtgacacgatccagttagacttgcatgatccaggagagacaggatgatggctatgaccaggtggggctcctgagaggtgtgggaaatgagggagctgtgggatacagtgggagcatggattgaatgtgagtgacagtgagcagacgcagtgatgctgaagaaccctgcagtggcaggaagggagggaggacggggtcagggagtgggacatttgatgggtggtattggagggggtgatcactgggttgaccaagggacttggtgcctgaggtggaatatgaggcaaaaagaaagtcaaggatctgagaggccgggggttgatgggtcatccacacagctgcaggaacccccaaagatgaattgtaaaagcaaaaagctggaaataaccaaaatgcccagctattaggggtggtgaagtaaattatgatgaacccaccgggcagaatgtgttacagccactaacaacgtgggttgtacacaccaagcagcatggaaactgtttctgtcctacctcctgttacacgggagagaaactctccaacctcagggatggctgactctgccaggtgaaaacttacttccttattcatctaacactcttcattgaagtgcaaggtacaaatagaacagaaaagttcatcagccaccagtgtccatctcagtgagtttccccatctagccagcacctggaacaagaaatagaacaagagaaatggtgggatttctgggtcatttacaatgagtttgtgtctgttttgtgtgaaagaaaccaattttaaaacatcggcagagcctcggctttcattgtgcagtccctgggggaaggaggctcggcccctgaagccgtgtgctcagggagggtgtgctcagggaggagccggtgttggctctgcttttctttgcccgagttgtctgtcaccatggggagaataaagtggccccatggctgatactgaccccagggtgagggtaagaggactgggcggggacactggtgtccctccctccctcccagcctccccacccagctccctgagtcttcgggagatccttgggtgtctcacacctgtccctgcttcattcccacaggtggaaaaacttgtgaaatatttggatcccaacgacctggggagaatcaacttcaaggacttttgccggggggtgttcgccatgaaaggtgaggtcttcccgggaggctttcccaggcgctctccggtcctgcccagctggggaagctggtgtgactgggggcccagcctggattcctccccacaggggtcccagagcccaggatgggccagaagtcggttctgcctctggcttccgggggggccagaggagaaggacactgttgccccagccgtggggggctgtggtctcacccatggaagtcacttctgcccttccccttgtctgcccgcctctggagaaagcctccttccctgcttttctgtcctcttcctctctctcccgctctggggtgaccaaacccagtgagtctcctgggatgtgggagggactccacttttaagaccagggcagtcctgggcaaacctggacaaagcgctggtcacatgactgcccgcctccctctgagctgctgcttttgtgtcctccctgctcccgcctcctctttttttttttttttttgagacagggtctggctttgtcgcccaggctactggagtgcagtgccactatcatggctccctgcagcttcaacctcctcggctcaagcaatcctcctgcctcagcctcctgagtagctgagactacaggaggtacaccaccatgcctggctaatttttgtattttaagtagagatggagttttgtcacgttgtccagcctggtcttgaactcctgagatcaagtgaccctcccatctcagtctcccaaagttctgggattacaggcatcagcctccatgccctgccctctcttcctcttaattcttcctaattcctgcctttcttccttgcccctgcttccagttttaaggggacaatataaatccctctgtcttgtcccaaaaattcaaaggccagttgtgagaaacttgcaggaatcagaatatggccactcacttactactaagctgtttatctgagacagtgagggccaggcacggtggctcacacctatagtctcagcactttttgggaggccgaggcaggcggattgcttgatctcaggtggatcacttgagtccaggagtttgagaccagcctggccaacatggcgaaacctcatctctacaaaaaatacaaaaaattagccgggcattctggtgtgtgcctgtggtcccagctacctgggaggctaaggtgggaggatcacctgagcccaggaagttgaggctgcagtgagctgaggtcacgccactgcactccagcctgggtaacagagtaagaacctgtctcaagaaagaaaaaaatctgagacagtggcataggtcaccagccaggtggacttgctaaggcctccccactagctgcagagagaatgcagtcacttctggagtcccagggtgtctgcttatctgtgaaggaagccatggtttcctgtctgcggctcagatcaagtttagcccttttctgtggggtgcctatgagtcctgggagggtggaacgatgcagggtgagggatgaagggaaccaaatacacggtgcagggggcacagaacacagaaggtgcccagggaaggttttctgcgtggatttgacaatgggccactgcaggctgcacctgccatgtgcctgtgccaggcattttgtcaggtccccctcccagttcagtacaaccttggggcgtttggttgggatctcaggagcgaggccagccgtgtacagagtcagcaggaactgcagctgtcctgcgggcagccctgtcctggacgtcccagggtctgcaggacacggggggcgcccagcctcggaggaatgggtgtgtttgctttctccagaggctggcacagtcgtttggagtccctgcaagccaggtgggcagcactgccttaggtcccctcccccaggaaggcctccttccttcctgttgccccagcctgccctctgtgtgtgggaattagtcccagaggacaagggcctcttgcagctccctccacagtgccttgagctgagttccccaccgcctgggctccatccctgccttccagtgctcagctggcctcctggagcctcgggcccccacctcagcccttcccaccctatgcccattagtcagaagcagagcagccgtcccaggctgaggctcaacccctcactgtcccgtgtgtctgcctgtctgcgcagggtgcgaggagctgctgaaggatgtgctgtcggtggagagcgcggggacgctgccgtgcgcgccagagatcccagactgcgtggagcaggtaaggcttggggggcctcaaggacctccatggctctgcctcctccttcttggtcttgcctttgctccattttcagtatctgggaggacccagaacctccctctgaggacccttcttgagcatcagagtcaagaaatagtttttggaacaggagccctgagtccccttgggaagccccagcagaatgtgtaacagctgggggtcctcacccagcaactttatttcccatctgtggcacggaggagagactgagttccagacagggaaagtggcaagtggaggggaggcaggactagaattgtttccttttcttctgcaccatcgctctctgagctgaacgcttcctgtttgtttgttttcaaacaacaacgaattctccaattctctgacactaactggtgtccagcaatcagttccacctgccactaactacccagcattagcacagactccatgagtcaaggtcaactccatgagactgccccacctcccacgccagctgcagttcttcctggataactgcaaacacagggttcccaggaccacctccctcgggctgggtaattcactggaaacactcaggaaatggttgtacttacgatgatcagtgtattacaaaggatacaactcaggattagccacacggaagagatgtacaagacagggtatggggagcagggatgcagagcttccgcaccttcgcttaggggcgctgcctcccagcacatcaccgtgctaccagcacccgggctctctgcatctcattgttcaagaatttgtaggcctggcgtgatggctgatgcttgtaatcccagcactttgggatgctgaggcaggaggacagcttgagcccaggagtttgagagcagcctgggcaagatgatgagaccccgtctctacataaaaacttaaaattagctggatgtggtggtgcacacctgtaatctcagctactggggagactgaggtgggaggagcacttgagcccagtagtttgagacttcagtgagctgtgattgtgctactgcactccagccagcctgggtgacagggccagactcatctccaaaaattaaacagtttttacaacccagtctccagcccctctcctctgcctggaggttgggggtaggtgggaaggtgagaaagttcccaccttattgtatgcttggtctttctggtgaccaaccccatcctgaagctctgtatcaggaagcgggacaaagaccacagtccccaaggctctgtttttctgttatcattgcctaatggtgtgtttcttatgaaactttgaactagttttccaagcagtgcagcttcatcctacagagaaacagttgaaggtgcacaagctgacaaccagcgaggtccctcctggtggcaacacccagaactagaagaggatgattttgatttcttacccagcccaacccccaaaccttttccccagttctgatgggtgcctcctctggaccccaaaacatgagtatgtttatagctgaaggagatccaggaccccagaggccactttggctgatggtaggcctcttggaatccagctgggtcgtggggtcagggttaggttccctgggcaggactggaggagggacagtccacagagagggacacagtgctgagggctgccaagtccatggtggcagagaccaaagccaggcaccaactgtgggccagggcccccaggctgggagtcaggtggctaggcctcaggctgctgtgctcaaagcaagagccctcagggatgcgtggagatagctgggccccaggcccatgcccatgccagcagtgatggctccaggcctgtcttgatgggtccagcaagcaggggttgaatatgtatttggggccagctaatggaaccaggattaggaaagaggacctccactgtgggacaaatactgagtgccccaggaactttgctgggggggcccttcctggattgctgagcaggaggcagcgtgcagaggtgtgcaggactgggtccatacccacgtgggccacccaggacaggccatggaacctgagcacgttcttctcaaccccgctgagcgtcagtgtcctcaactgtaaaacaaggcttgctgtgccaatctggagggtctgttgtgaaagttcagtgggaagacagacccctaatacgtgctaattcctcgccgcctgctgctgtaagaaaatggtgctgaagttaccatttgcatttttcagtttaccctcggatactggtgttgcaaaattatgttaaagtaaagccctgccccaggaactggagggcagagtggagccgaggcctggggagagggggtgggagttggggtaggggtgacgtgttccctgtagtctttggctgcttttgtggcccccacattctgccattcacacctctggaaaaggtggcacatggagaaaagatgagcagggggtgcagaagagtgggcctccaccaaggtactcttttttgtaaaccgatattgctttcctccaaagtctagaggttatgggaaagcagaaagaaagaccgcgtcagcctatctcagcaagcctggtgcttctccttgtttcttcatgggactttgcaatcctataggtttttgttgctttgggttttgttttttgttttttttttgtttttttttgttttttgttttttttgttttttttgttttttgagacggcatcttgctctatcgcccaggctggagtgcagtggtgcaatctcggttcactgcaagctccgcctcccgggttcatgccattctcctgcctcagcctcctgagtagctgggactacaggtgcccgccaccatgcccagctaatttttttttgtatttttagtagagatggggtttcaccatgttagccaggatggtctcgatctcctgacctcatgatccacccgcctcggcctcccaatgctttggattttaagcttctcgtgggtgaactcctttctgccctccatggaggtctggccccggcttggttggccagagcctagtgagatggcggtagctgtggacacagtggcagccttgttcattatgctcgctggggctgcttggttgacctggactccattccctaccatgggcttctgcgtgttggcagggagaggaagggggcacaatccgaagaccagcctgacggggcagacggcttctggattgtgaatgagtcctcttcctggcttaggctcctgtaatagcaaggtcaagaccacagctctgcagatgaggtgtcagagtgggctggactgggcaggtccgaatttctcaggcccggctctctgcgccctgctgtgtcttagctgtcccctaggggtcagtctgagactgagaagaagcgggtgcctggatcactacgtaggcttcccagatgcccccagggaacgcaaacctgaggcatgatttgaggaggtgtggggatgacacacagatgggatggcaggcgctccatccctgtgccatgcgtgtatgttgggaggtgaagcttgtttttcgggcacagccccctcccctcagggtgtggacggagacctctgacttaaccactggatgtggctcgtaattaaagcagtgaatgcttgagtgctggctggtgggccagcagctgccacctggcccctgagagcaccctgcccttcttgaccccctcccaggccccgagaagcctctagcgttgggcatcaagcaggggcccctggggttgctgtccagacctcaggccagtgcaagtctatcccgggcagttgatgcctggatgcaccagttcctgaccttactggatgtggctccacctgcgtccccagagccctgcgagaccctggcagagggaaactttgaggcttgggaaccccaactgttgagcaggctgttgagagagtttcctgacccagggaaatttgcttctggtcaaagggaatgttaggtgtgtcctgaaggactccccaggttccctgggtccatgcatggggtccctggaatcgccctgggagtccctctgagactgtcctgctcaggctgcccatcagcccccagtccatatgctataggggcccccgtggggagggggcatggagacacgtggagagcccgacactcgggtgctaaaggcaatgggatagttgctaggggcccgtggtcacccctcagcaggcagtaatgtgaaccctaatcctacaagtgctgtaaggccctgggccctgttcatccaccctatggtggatgaaatggagagggcatccagccacctgcccctcctgtgtagccaccacgccagcaaatggtgtcagtagcctccaacccagagagtcatcctcagcgcctcctcatgcagctgccttgagtcctctgttccccactcacccctgcctcccccttccatcacagccactgccacccactgaccgggcgtcctcctgtcctcagccttcctctctccacacccccatcccgctcctgggacccgtccttaccaagggatgaaaaccaacatcagctcctacccactactctagcctcatctctcaccatggtgcatctcacacctaaaactggcgataccaaaccgctccccgtttcctgagaaagccatgttctctcttgcctctgagtgttatctttctcctaggatgtcctccctcccgcttccttgtcaggagctaacgtctactcacctttttaagacttacttgccgggagtggtggctcatgcctgtaatcccagcactttgggaggctgaggtgggaggattacttgagcccaggagtttgagaccagcctggacaatatagtgagactgcttctcttaaaaaaaaaatttttacttaggtaccgcctcctccaggaagcctccctgactccttctgccccagcccaaaggagaaggacctgcactgagcttcctgggggcccttcaccctctaccactgcctgaacctcacccttcatgacagccagccccatgtccacccagtggcttcagggctcaggctgagctcctccttttcacccccaggacagcacccacagcaagcatcgttatccatgctccttgggtgtgtctctaagtatttctagaactaggtatctggaagcagaattgctgtgtcaaagggtatgtagattttgttttttaacagatacggatgaaattttcttccacaaagcctgtaccatttgtatcacccaagcactatatgagattgcccctttccccatggccttcgccaaccccggaagccatccatccacctgctggtctccggcctagcagcctgaggggaggaaagcccattgctgccgtcctctgtgctgcccagcttcctagggaggcggaccatctttttcttatcttcccataccctctggatttctgcttttacgaattagctattcatattctttgcccattttcgatatggttgtttgtcttttccttattgatttataagaaatctctgtatattctgttttttgcttgtttgttttttgaggcagtctcgctctactgcccaggctggagtgcagtggctcaatctcagctcactgcaacctctgcctcccgggctcaagcgatccacctgcctcggccccgcaattagctggtaccacaggcacacgccaccacatccagctaatttttgtttttttgtttgtttgtttgtttgttttgtttttggtagagacagggttttgcatgttgctcaggctggtcttgaactcctgtgctcaggtgatctgcccacctcggcctcccaaagtgctgagattacaggtgtgagccacagcaacaggttgaaatctctatatatcctgattatcaatctttatggattttgcttgtgttttaatcttgttttaggagtgttttattacacagaatgttaattctgatgtcatcatttatcaacctttttatgccatttgcattttgtgtatcattttgtgccttctgtacctccaggctataaacatattctcctatatatagttttcagatacttttgagaaaaagaagtatttatgcttagctcttttatccacctggagcttatttttgcttttggtgggagtagagatctggcactcttacttcctcaatatggccagtactttgagttcctaatgttgaatagtccctctttctcaattgatttgaaattttatctttattgtatgctaacttaccttatatacgtaggtctctttctggactctggtctgttatattgatctgtttgtctacctacttttaagccaaaaccatagtttcagttactcttgtttatagtttgatatctgatagggaaaggctctctcatccttctttgtttctttaacctttaaggccaggtgcggtggctcatgcctgtaatcccagcactttgggaggccaaggcaggtggatcacccgaggtcaggagttcaagaccagcctgaccaacatggtgaaaccccatctctactaaaaatacaaaaattaaccaggcatggtggcacatgtctgtaatcccagctacttgggaggctgaggcaggagaatcacttgaacccgggaggcggaggttgcagtgagctgagatcacgccattgcgcttaagccttggcgacaaagtgagactctgtcatacacacacacacaaaaacaaataaaaaaaactgtttttttgttattcttacatattttcttttctggaacagcctttttgtcaagctctattgcaaatcctgtaggagatcatatttgaaattaaatttgtgcattaattgaaggaaattggcttctttacaatattgcattctgtcatccaggaatgcatatatcttttcatttattctggccttttatgccctctaggaaagttttctgttgtttttcttttttggttttttgggttttttgagatggagttttgctgttattgcccaggctggagtgcagtggctggatctctgctcactgcaacctctgcctcccaggtccaagcgattcccctgcctcagcctccctagtaggtgggactacaggtgcccaccaccatgcccggctaattttttgtattttcagtagagatggggttctactacgttggccaggctggtctcaaactcctgacctcaggtgatcctcctgcttcggcctcccaaagtgctgggattacaggtgtgagccaccgcatctggccggaaagttttataattttcttaaataggttatgcacactttcttcttagggtgactatatttggagtttttgtgctgatatgtgtaggatctttttgctatgatattttataactggttacaactgatgtataggataggttttcatttttggtgttaatcttgtcatgataaccctattaaactctccttattttatttatttatttatttatttattgaaacagggtcttgctcttattgcccaggctggagtgcagcagtgtgatctcggctcactgcaatctctgcctcccgggttcaagcaattctcctgcctcagcctctcgagtagctgagattacaggcgcccacgaccatgcctggctaatttttgtatttttagtagagacggggtttcactatgttggccaggctggcctcgaactcctgacctcaggtgatctgcctgctttggcttcccaaggtgctaggattagaggtgtgagccaccatgcctggcccattaaactctctttatatttaatagtttatttatatgctattttctatcatgcttaattctatataacaaggtagccatgctgccattttaaattttaaatggcaacatgatatttcatcacatgaagacaaccaaatttatataccagtttcttattgttgggcgtatatacactttttttttttttgagacggagtctcactctgtcgcccaggctggagtgcagtggtgcaatctcggctcaccgcaagctccgcctcctgggttcacgccattctcctgcctcagcctcccaagtagctgggactacaggtgcccgccaccacgcctggctaatttttttgtatttttagtagagacagggtttcactctgttagccaggatggtctcgatctcctgacctcgtgatccacctgcctcggcctcccaaagtgctgggattacaggcgtgagccaccatgcccagccaggtgtatatatatatttttaacgtaatttggggaatgaacaaaagcagtgtaataatcattcttatagctaagtatttccccacagcagcaatcgttgctttaaagtaaatcagaggttggcaaattacagaccccacgagccaaatctaggagcttgttattgtaaataaagttttactggaacacagccacacccatttgttcacatcttatctgtggctgttttcacactacagtggcagagctgaaaagctgccacagaggccaaatggactgcaaagcttagaatatttactgtctgccctttacagaaaaaatttgccaacccagacggtaaattcaggcaagtggaaactgttttatgaaaaggatgcaaaggctgggcgcggtggctcatgcctgtaatcccagcactttgggaagtggaggcaggtggatcacctgaggtcaggagtttgagaccagcctgaccaacgtggtgaaaccccgtctctactaaaaatacaaaaattagccaggcgtgatagcgcatgcctgtaatcccagcctctcgggaggctgaggcaggagaatcccttgaacccaagaggcggaggttgcagtgagctgagatcgtgccattgcactccagcctgggcaacagagtgagactctgtctcaaaaaaaaaaaaaaagaaaaggatgcaaaatattaaaactgcctaatactaatctgccaaattcctctgcaggaatcccatcaggattgcgtcagattcctgctacccttttgatactggtgttgctgagttttcagatcctttaaatttgagaggctaaaattagaacccctcttttgaattataatacagtttaacttcttaaagtacattttttggtcactaagagggcgttcttcatgaattgcctgtcgacattctccaccctggctatgtttacttctattgagtattttttaagaaccagaaatataactttttgacatacattaaattttttccagcttgttatttatttttaactttgttcatgataccaaatttaaaaatttttatagccaattcatcattcttttcctttatggcttcagcctttggtgtaatgcttataaatgctttcccgcccaagattgtgaaactgttctgttttatttttgtgtatttgatttttaattcgtagaattgactgatgtctagagtgaggtagggatccagtttgcctttttcctgtcagttcctcttgccctccctcacctggctggaaccagcagcttcttgctaggctatgcttacgcacgcagtcccctgatggcaaaggaagtgaggtttgcccggtgcagtggctcaggcctggaatcccagcactttgagaggccgaggtgggcagatcacttgaggccaggagttcaagaccagcttggccaacatggcgaaaccccatctttactgaaaaaaaaagaaaaaaattagcctggcatgatggggcatgcctgtaatcccagctacttgggaggctgaggcacaagaatcacttgaacccagaaggcagaggttgcagccagcagagattgtgccactgcactccaggctgggcaacagagcaagaccctatctaaaaaagaaaagaagaaaagaaatggggtttgctgggaacccagacctgagcctgagcccaaattggctcttttgctcatattcagaaggggctttgccaaacccttgtcttcctggaagtttttaaaatgatgataacctgtgcctctctctagaacttgctggggaggaggcctacagcctgaacatctaagcccaccctcgcttcatttcatccatcctgaaacaagcatttctaaaaccactcatgacaatggcacttataagttctaaaaatacttttcctgacaaacagcactgtgattcactgtgctggtggaggtgtgggtggggtgccatgctcccactggtgtggtggcaggagggagtttcagagcccagggaagcagcctttctacttatatctggccccaatatatttttctatgtttcaacaccccccccacccttctaaagagaaaaaaaaatctacttatcccaagcctcagagcttctgtaagatcctcgatttgtgtctttgggaaataactcaactctgattaagccaaaggtggcggggatggaagcagtgcagatatggaagccccttttgttcgttgcctcagcctggtctgccctggaccgtgtgtcttctacctcctacccctgaccatccctaccctagagacgctaagctgagctggccagcaagtgctacttcccacgggccacctcctgcctaacccaaccctgacgcccaagtccacatgtatctttagaacctactcaccaagttagagcttgacaaaaccttggagaggctccttacatcccgtctttttaaagctgagcaggagggaaaaatttgggttttatgaacctgtaggacattaaccaccttcgtatatacctttccagtctcatttcagcatcctttctttccctgattacatagactttgatccctccccttctcctttggatgagttatccctacctgctgcttccctcattaatgagtctagtgcagtgcatttttgaaacagtaactgtgggaaacacacaaacacaatcacatgagggcagatgttctccgagaaagcacggtcgaaaccagtggggactctgggttagcagggcctatggtgcttcatgtgtcagaggctgaactgggatatcagtggagattctaaactcaccatccagtttataaacctctgagggcccaagctcctgctgcagatggtgcaagaataaagagtagatcacttttactaaacaaagacctagagagttgacttggtctccaactttttattttgaaaattttcaaccttcagaaaagagcagaacaatgaatccacatatatcctttgcttggatgacagctgttaacatgctgctaaactgagtttctctgcccctgtgtttgttggtggggtgcatgtgcatacatactactttttttctggaccatttgaaagttagttgcggacatgacacttcatccttaaatacttggccattcctaagaaggacactctcctatgtgaccacaatatagttatgacttgcaggaaacttaacattggcacaatttgttacctattgtaaaatctacattcaaattttcccaattttatatatatatatatatatatatatatatatatatatatatatatatttttttttttttttttttttttttgacacggagtcttgctctgtcacccaggctggagtgcaatggcgtgatctccgctcaccgcaacctccgcctcctgggttcaaacgattctcctgcctcagcctcccgagtagctgggattacaggtgcatgccaccactcccggctaattttttttttgtatttttagtagagactgggttttaccatgttggccaggctggtcttgaactcctgacctcgtgatccacccacctcggcctcccaaagtgctgggattacaggtgtgagccaccgcacccagccatcccaataatatttttatagcttttatttttatctcaaatctaatacaggatcacacagtagtttagttgccatgtttctttagtttcctttaatctagaagagttccttggctttttttttcttttctttctttctatttttttctttttttttactcctaatgacattgacctttttaaaaacttcaggccacttgcttcgaagaatgcccctcaatttagatttgcctttattgattttctggtcctttggggtactgcaacttaaatttaaattaaaaataaaatggtgtggcgaggagggggccaggaggggagttctactgtgtttatttttcaagtctaaaacacatttaaaatgcatattgttggcacccactcagtgggcctcagttttcccagctgaaacatgatctaaacaccccttgcagcttctgtcccttctggcatttggggaaaaataaatgcctaattgtgtgtgtgcggccgagcgtccacccttggcatctctcaaattgtggggaggcagccggccttggtactttctggctccaggaacacgccatgggccattgaacgtctgtgcgatgggtaacgtctgtgcgatgaacactgtacactgggtacagtgttaggaggtgtgggctcttatacatgaccaggccacatctccatcctctttgggctgagattaggacattggagtaggtgtatttgtctcctgagaggggcaatctcaagagaaaactagaaaagaccccccccacgtctttggggggattatctgagataatgtggggaagaaatccaagcccctaagatacactggacggtgcttctccgggtacctgtgcccgagggagataccagccacttgctgggacaccagggggcatcttcctggagcagcagattgcctggaagaattggagaaaacattgtccaacattaaaacaaacatggaacataataaacatattttgaagataagaaagaagcctgtaatcccagcactttgagaggcccaggctggaggatcccttgaggctaggagttcaagaccagcttggacagcaaagtgagacccccatatctattaatacaaaaaagacaggcgggtgccgtggctctcgcctgtaatcccagtactttgggaggccaaggcgggcggatcacgaggtcaggagatcgagaccatcctggctaacacggtgaaaccccgtctccactaaaaatacaaaaaattagccgggcgtggtggtgggcgcctgtagtcccagctactcgggaggctgaggcaggagaatggcgtgaacccgggaggtggagcttgcaatgagccgagattgtgccactgcactccaacctgggccacagagcgtgagactccgtctcaaacaaaacaaaacaaaacaagacaaaaattagctgggcttggtggcaagcacctgtgtgtcccagctacttgggaggctgaggcaggaggattgcttaagcccaggagattgaggctacagtgagccgtttgtgcgacagcactccagcctgggcaacagagcaagatctcatctcaaaaaataaagtaaaataaagataatgagaaagacttttatcaattttattttactttattttatttatttatttttttgagatggagtttcactcattgcccaggctggagtgcaatagtacgatcttggctcactgcaacctccgcctcccgggttcaagcgattctcctgtgtcagcctcccaagtagctgggattacacacgcgcacccccatgcccagcaaatttttgtatttttaatagagacggggtttcaccatgttggccaggctggtctcgaactcctgacctcaggtgatctgcccacctccacctcccaaattgctgggattacaggcacaagccaccgcgcccaactgctgtattttatttttgagacaggatctcactctagcacccgggttggagtgcagtggcgcgatctcagctcactgcaacctccacctcccaggctcaagcaatcctcctgcctcagcctcttgagtagctgggactacaggcatgcacccagctaatttttggatttttggagagacagggtctcactatgttaccctggttggtcttgagctcccgggctgaagcgatccacctgtctcggcctcccaaaatgctaggattacaggtgtaagccaccgcgccctgcgggaaagactttttaaattgttttgctttagaggctgctctttcgagtcccacttctactgtagacccatgtccatcttctgctgtggggccgctttatgtaaggtattactgttattgctattttgttttccttttcttttttttaagaaacaaagtcttgctctgttactcaggctggagtgcagtcactgcagcctcaacctcccaggctcaagcaatcctcccacctcagcctcctcagtagctgggaccacaggctcataccaccacatccagctaatttttttttttttttttttggcagagaccgggtctagctatgttgcccaggatggtctcaaactcctggcctcaagcaagtctcccagctgggcctcccaaggcactgggattacagtcatgagcaacctctcctagccctgttttcttgtaataaagtaaatgcagtgttcattttagtaacaaaacaggtcttcactgggagggagaaatgaggaaatttgaccccgcgtggctgaggcctggaatgagctccatgggcaggctccaggaatgatgtaattttgcctcctctcaaggctggcctcaaggaggcctgattccagccctctttgtctggggctgccctgaacctgtaagaatccttctgaccagatcctccagacactgcaaattctcacccaggttgctcagaatcctggaaagagctcaggtttgagtcaaacgggctgagtgtgggttctgcttgaccactttctgtgtgtcatttggcaagtcgcttcacctctctgagcctttttcatttctgcctatctaaaatcagagtcgtcagcctgattttcagtgttgtggtgagaatgcaatggattaatgtttctaaaggttcctgaggagacaggtcccccagtcagtagtacctatgcctgcattctctgtaccactcagaaccctcaggggaatcattcaggacacaggggacagaattccctccccttcccattcccaaagtcaccagcctgcctccacctgcacccacactttcagcttgctgctgggatggtgagtggcatgaccctgctctgacacaggccatgccctccaatcccagctcctcacccgcacaccgcctgaacactggatcccagcccctcctgccaactcaagcactcgccttcacaaacagcccctcacccacagcacccgcaccacgcccctgctgggtcctttccattcgcttctggagctgacataataatgcccttcccatgggcagggaagcacccgcttgaccacacatcctggctttctttcctttggtctatttcctccaaagactggtctcaactccctttcttgcctccctttctctctgttgccactcccaatgatgtcttggcccctctgttctgctgaaacacttctcacagtcaccagggacttctttttgagacaggggtctcactctgtcacccaggctggagtgcagtggtgcagtcctgactcactgcagcctccaacacctgggttcaagcaatcctcccacctcagtctcccaggtagctgggaccacaggcatctgccatcatccccagctatttttattttttgtagagatgggggtcttgttctgttccccaggctggagtgcagtagtgcagtcctagtttgctgcagcctcaaactcctggcctcaagcaatcctccaatctcagacccccaaagtgctggtatggcaggcatgagccaccttgcctggccaccaggaacttctcactggccaaatccaagcatcagttctctagtcacatttttacatagtgatggtgtgtggtgaatagatcagggtaattagcatatccaccatctccggcatttatcatttcttcattttgggaacactcgatagtctcctagctactgaaaactctgtattattgttaatgatagtcatcttacagtgatgtagaacaatggaacttatccctcctctagaactgtaactctgtacttttaacaaacgtctccctactctccttcccctgccattctcagcctctagtgtcctctgctccattcacattttactggaaccctgggcagggcctggcacagccaacctctcccttctcagatcgtccttttagctcaagccttcctcctacctctcaggctgcttttctccccgcacaccacccccccgccaccggctttattattattattattattattattattattattattattgagacagagtctccctctgtcacccaggttggagtgcagtggcgtgatctcagctcactgcaacctccgcctccggggttcaagcgattctcctgcctcagcctcccaagtagctgggattataggacggcgccatcacacccggctaatttgcatatttttggtagagatggggtttcaccatgttgcccaggctggtctcgatctcctggcctcaagtgatctgtccacctcagccttgcccgccctcctcctgggtccctttaaatggcgctgggtctcaggcctcgtcctcacccctatgcttcctgcctgcccactccccaggggagctggttggtcccagaactctaaaagcaccattaccctgagggctcccaagatagtattttcccctccgacattgccttcggctccagtctcttctgtcaaacctgtggcgcaccctctgcatttccaccatgttccaggctacaccctttgatctgatccagctccgtcccctcagccccaagaatgtttccccaggctccccatctcagtaaatggcaccacctcccctacctggtcactctgaccaaggatcaagtcatccttaatttctttcctccttccacatccaacccatcatcacagcctaatggttttacctccaaactatgtcccgagccatccacttccctccaccttggaggttacaccccagtcccagcagagccgcaccctgtacctgtgccccgatggcctgcattctctcttgttttttgtggtccatatgacaccggagtgttctttaaaacttgtaactcctagtggctgggcatggtggctcacacctataatcccagcacttttggaggctgaggcaggtggatcacctgaggtcaggagttcgagaccagcttggccaacatggtgaaaccccgtctctactaagaatacaaaaattagctggccatggtggcaggcgcctgtaatcccagctactcaggaggctgaggcagaagaatcacttaaacccgggaggcggaggttgcagtgagccgagatggcgccactacactccagcctgggcaacagagcgagactccatctcaaaaaaaaaaaaaaaaaaaaaaattgtaagtcccatcctcctctcccttgcataagagcctccagtgacaaaatccaaaaccctgacttcccactgtggcctcgaaggtttcacttttgcctgaatctttgaccttgcccctcccagattcccggtgactctcactgttcagccaccctgacctgttttctgttcctcaaactgcccaagcgagttctgcacagggcctttgcctggcttccccttcacctagaacccttgtcccccaaatctttgcacagctgcccttgtgcccttcaggtttcagcacaaatgtcacctcctcagagaagccttcccccaccaccctctcaagaaactccctccccaccctgcccccatcactgccagagcaccctgcttatttccttgagtatgcaccactgttagctgcatgtttttttaatggctgtgtaatagtgatacatgtttttgggatacatgtgatatttcgataactgcatatgttgtgtaatgatcaaatcagggtaactgggatatccattacctcaaacctttgtctttgtgttgggaacattacaattcttctagctttttgaaagatacaagaaattattaactataatttccctgctgtactagcaaatactagaacttatttcttctctccaactgtatcttgtttggcacagtcttgatcatctatgtgtgtcctgtcatcccccactggcctgtaagctccgtgggtccagggctttgccagtgtcattcactgctgcacagtgcctggcatagagaggctgttggtgcagatttgttgcacaagcagatggatgaatctcagatgtggaatgttgactctttgtcagggagggatgggctcccacctaggagtctccgaggaccagctcaaaggctgtaaaaatcatgccctgcctcagtgctctgggggattagaaagggggtgcctggattctctgagactctgcagctgggctctctcgctttcctgtgcgtgtcaatcactgatcttaagaaaatgcagattctggttcacaggcctgggtctgcgttcctagcctgctcatcagcaatggtggtgctgctgacctcagatctctctagcagcgcttttgtaacttgcaggtcctgtgccatctttccccctacatgccatgggaccacgcggaaagagccagaggggtcccttcattgcctcctctgcccctcctccctccatccagcagcaagtgttatttgtagcagtcactgtcacctccgcatgtggtgaggcctgctaggtttctgtctccacatttctgttactgtgacagacaagacggattctctgccaggaactgtgctcagccacttgcttctggcattgctgtttcctctctgtgcacctcttattcaggcagactcctgggggatgttgcccctgctggaagtcaggcccagttcattgccctagtgtgggatggggcagctgaccccgcggggaactgggaggcattaccgagaggtttccaagctttggtttcaggagtacaggtataggcctacctgactggccctgggggcaaaatgttcatttaaacttggggagaggctgggcacggtggctcacgcctgtaattccaacactttgggaggccaaggtggatggattgcttgagcccaggagttggagaccagcctaagcaacatagagagaccccatatctacaaaaaaattaaaaagtagccaggcatggtggcgtgtgcctgtagtcccagctactcaggaggctgaggtgggaggatcacttgagcctaggaggttgaggctgcagtgagctattatattatcacacgactgcactccagcctgtaccatagagagagaccctacctcaaaaaaaaaaaaaaaaaaaaaaaaacaaacctggggagagtttgggacctttggagtccaagagttctgagtttgaatcctgatgctgtcacatactacttgggccacgccgaacaaggaacttagcctccctgagcctcactttcttcacttgctagatggaggttgtaactcgtgtcttcctcccagggtcgttgtcaaaatgaaacatgaaagtgcatggaagtaggaggtcaaggcaggtgaattacatgaggtcaggagttcgagaccagcctggccaacatggtgaaatgctgtctctgctaaaaatacaaaaattagctgggcgtggtggtgcatgcctgtagtcccaactactagggaggctgaggcaggagaatcacttgagctgagatcgcaccactgcactccagcctgggcacaagactcgtctcaaaaaaaaaaaaaaaaaaaaagaaagaaaagaaaagaaagtgcatggaaggctctccgcactgtggaaaatactggcatttctcaactcacaatgcatagattgtgagacatatcatggtccattgaatatcttttgactcaggggtggtgaccaggtgctgatagcaaggcctggggcccagtcctcctcccacaaccgcatcccccccagccccacccacagccacctgctgctctagcactagctagaaaagtcagcccctgggcattctcaagaattgagcccacccctttgtcagaccattctcccagggcagagactggcctgatcacatgaaaaccacacctgccgagccagagggcaaatgctccaacattgtattagagagattaaacagctgttctcaaccagatcattgctacattccatttcctgaccaggaaaatgaaaatggctgtcatagaagacagagcataaagtctgattcttttctttttgagatggagtctcgttctgtcacccaggctggagtgcagtggtgcgatctcagctcactgcaacctccgcctcctgggttcaagcgattctcctgcctcagcctcccgagtagctgggactacaggtatgtgccaccacgcccaactaatttttgtatttttaatagagatggagtttcaccatgttggccaggttgttctcgaacccatgacctcaagcaatctgcccaccttagcctcccaaagcactgggattacaggcatgagccactgtgccttgcctaagtctgattcttaagatggaaactcagtcaggcggccatggctcatgcctgtaatcccagcactttgggaggccgaggcaggtggatcgcttgaggtcaggacttcaagaccatcctggccaacatggtgaaaccccgtctctactaaaaatacaaaaattaatcaggcccggtggttcctgcctgtagtcccagctactcgggtggctgaggcaggaaaatcgcttgaacccaggaggcagaggtttcagtgagccaagattgtaccactgcactccagcctgggcaacagaacaagactccttctcaaaaaaaaagatggaaactgtctgtgggctctagggaggcagtggaggtgccaggtgaactgacgattagcaccacagtgggaacaggcaggaagaggactggtctccagtctctggtctcctgtctgaacaagtctgtaggggaggaaaaacttctcctctacccttttatgttatgtctgcagtctgcaaataaaattgagcaaagacagattaatagaaaaaaggcatacgaattttattgttgtttttaattttacatgcatgaaaagccaaagagatggtcagacccagggtttatatacaattttgacaaaggaagataagttgtgggcaagtaactaaacaaggaagagggggatttgggctcctaagggcagtatattctgggaaggtagctaggaaatgtgtgttagattgggggtggtggtttagatgtgttatacagatacataacctccccattggatttattctccttttcatgggacgggagaggggggcacatttacaaatggaaatttatgccctactttcaggcacctaaggggagggcagagagctcatcctgtgtctgctgtttctcagttgccttcagctcaaaataatccttatgccaaagtggcgtattgcagggtggcatatttggatccccttcaagttcctgcctcagtcccttccccagtcctctgccttgtacacatgggtacctcactgtacctactcaaactaggtctcctttgaccacagggagtgggtctgctctgataatgtgttgataattggttgactttacaaccaatatttcaaaacaactgccttatcgagcccagcctggggtttctgtcttgtgctgtgacttgcaacattcttggtcagaccccttctcctcaagggaaactttaatctaggctgaaggggcctctgagatgggtaccaggcaggaggcatgtcaggacccttacctgctgcagtgaatgtcagctttgccaccttcagggctgacgctcccaaggcagctgcactcaccctccgctgagagtgccatcctgggcttacaggcagaggctcagctctgacatgtgatatcggagaaagtcagtcatcttcagcatcttcaggtcatgttaaccctattcctttagattttccattatctatcctaataccaagttccgtgtcagaaagcgctgtttgctcttacctccttgcaaatacgtctttactgttgtacattttgtttttattctcacggctcattgaatattgcttcaatttcattagaattgctacaggaaaccttacagctgatttgtcatcctgtgtactctttgatccaatatattctttttttgagacagggtctcactgtcacccaggctggagtgcagtggcacaatcttggcccagccttctaggctcaagcaatcctcccacctcagcctcccaggtagctgggactacacacatgcggcaccactctcagttaacgtttgtattttttgtagagacgggctttcaccatgttgcccaggcttgtctcgaactcctgagctcaagcgatccgcccccctcagcctcccaaagtgctggaattacaggcgtgggccaccctgctggcccctagtacattctttttaggattttgtaccagaaaagaagtccttcctgatgaaatgatacctttttacatcagataacaagagttacagcataactatccccttgctgtcctttttggttttggtaagtcagaaaacttagagctaatgagactggtgaatcaataaaatctgcctttccatttaatcatttacctcctttttctctatggtttatttttatttttactactctagctatgaatgtgtcttttattgtaaataatttcatagctgtcaggaagagataaaaaggaatcttgatttactaaggagagacttattaaaggattattattgcctgggggtggtggggaggggactattccaatggaagcgggagcattgcagtgggagagagcactgaccagaagatcctcctgcacctccaaagttaagccgaaagggttgttcttttctaggcaagagtaaacaaggcttgaaagaactggtgcggggaggtaggttgaaaaggtggcctggtcctgggggcctgtcttaatgcaggccaacctgtcctccggagggctgtaaggagggatagtgagttgctcaggtgagggtggccaaagttcacagaactgggggaaagagagaaactagagtttagttaacaagcatcgtgttttaggtagagaatgggaatttggagggccttcctcacaggttctcgactgtgttctcctgggggacgaggaccagcttcatggcttgctgtgccctgcgctgggcctgaccaagttacttggtccctgtttgttcactgacgttgactgagggcctttccagagtcaggagctgacctctcacagagattccaagaactagcaggtcacactctcacctctccccaggggtccccagttccggccatgccctgtgtcctctccttctcctcaaaggggtccccaggcctaacctggggaagcactatccattccctctctcaccccaccccagtcccccctggaactggcttcctgcctgcttcttcccctttctccggggtggggcgggacaaggtggagggagagtgggaaggagaggaggagtcacccagctgcctcctaggactgataagagacccagcgggagctttgaaggctgttacagcctgggggtgggagcaggcctgacccccaccaccctcacccccagccccgcaggtggccacacccctcctgctgccctaccctctgtctctcaacttggccctttctgtgcctctgtgctctctctctttgtgtgtgtctctgtctgcatgtgtgcctccctctccgtccctgactatcctcccttcctctctctccttttcccctccccgctctgtctcttctctctatctgcaccccatctctctctgtcctgaagtctgcattctcaacacagggaaccttccagtctgacccaggtctcagcaggagccagacaaaaggccttgagggaagggacagatggagtgtccccatgctaatctcctttaaccacccccagcagaccaaccctgccaagtaggtactgtggtacccatttcgctgatgaggaagttgaggctcagacagcagttaagacgtgtgtccaaggccttggggccacagtgtgcagggccaggatttttagctgcatctgatccagttgcctcagaatgcgggctgagtccacctttcctgaggctcctcaggtgtcccaggcctctcctcactccctccaccccatccctggaggcaggaccagaggactcctttgaggagctgcatagcttgggagctgcgcatcaggagcatctgcagtgctgcaggaccatcttctacccagaggcatgaagcaaagtatcatgggagccccgcagggcattgcggggaggcaagattctcccagccccttcctgctgcttttggaggcctgaagatggctctgacctggatatagggggtcctaaaatggaagccctttggttgaagaggcaggtggcactgagcctgccagctggggctgtgccaggggtgtttggaggtgcctctcagaatgggccttctctgcacgggagcctgggagatgcatcaaggaaagatgtaccagcttcctggctgtggggcttctgggggtcttcaaaatgctcatgtgcacctctgggcctcccagcacagaggtggaggcagtttgccaatgttctttcctcttggaacccttcatgcaccagcatctttgtcacattagtgaagaatggactggccttgtgggtcacccagggtgtgaaacacgtttggggcgaagctgccacttcctccccaggagaaaacagaatgtggcccttgatagcagtgtggggtttagctggcagctgttagcccaggagctgaagacctgtggctacatgcacagtcatgtgtgtgaatctggtccctctattagccagggtcactgctacctaactccaaggggcactattatcactgtagtctatggaaattgtgcagtacccaacctgtgcagctgaacatggtagtcctgatctcaactctcactcatcatgtctgacagttgcaatggcctctctgctgactttctgcctctagtctgttccctctagtattgcctacaccccctgccccgtgtcaattccccagtcctacccacctccaagtcccttctcccctcagccacctgtcagagagatctacgagtactctcagctgttcagggatcctgggagtagactccttcctctgagatggatgagccatgtggtcttgggcaaagcacttaacctctctgagtaaccccacactggtatcacttattctcatttataaaatgggggtaaaatgcccatcaggttgtagttttcttgatcactagattcttaactccaggaggccagatactctcattcctctctgtacccacatctgacacatcctcagttccggtgagcgttttattattattattattattatttaacatgaatggtaccataaagcatttgttgaataaatgagcgcatgtcactttgaccaaaacctttctgcagcttccactcccacgcctgatgggttaactcaggacttcccaggcactgctgccctttctactcctgggcttttgcccatgctgttccctctcctagaattccctgtttcttgcagcactgtcatctttgacacagctcggctgccacccagaagcttttccagcccctccccccacccaaagcagcctctttatcccccaccagtccctccccacggccccagatacctctgcctgacagtgggttgtgccccagaggggctcctctgttgttctggacacaggggtggctgggactttaccctcctggggtcccagggcttgtgtggagcctgggactggctcaggacagaagtacacagagtgctctggaaattggtggtggccacagtgctcctgcctgccttgcggtcactcccggccctctcaggtgcctcttgaggaaaaagccctgctgccttcccagacacaagcccaccatgggctgggacagaccagactgctaaaaagcctggctggaatgggatggggtgggcacttcatggtcaggctttggggtccattgaaaaatgtgtctttgggtctggtggaggagcaagcacgttggagactcatgcctgatgctttggcttactaggctgttgtttaaaaaataaagtgcttttcaaatgcttaactcagaacctgacccaaagtaagcagtggatcagtgtctgccgtccctgggagcaggtggtgtagactcaccttagagcatggacgtcaagagtcagaaggacctgggtccgaatcacagcttggcccttccccgtgagactttggacaggttgtgtcatctctgaacgttgttttctttgcctgttaaatgggcatgaccctaatgtactcctcagtcttgttgagaggatacaggagataaattagaagccgctggcatcagttaggatgtgtgttagagcctgacagcaagacagagtgctagaaatgttggtggctataaatattactacttgcttctattttctggcaaagaaccattaatttcttggacctcttcattttctctctccctccaagactagtggtagcaggtggctttctctctgggaccattttttcacagacacaaagttgagtgggtgtatatatagagacatatatatatttcttcaagacagggtctcactctgtcacccaggctggagtgcagtggtgtgatcctagctcattgcatcctccaaatcctaggctcaagtgatcctcccaccttggcttcctgagtagctaggactgcaggtgtgcaccaccacgcccggccatgtgtgtatttttaatcgcttcacaggagttaccacacacagctagtttacagcattgtgctgtaaatgctggctgggtcatgtgtcgagccccctaccacccacagcctcccctgtccaccaactctcaccatccacagacctccagagcccccacatacaccaccatgatgccccccaaatccacagacccctactcatagcccttgctgccaacaacccccctgactcccacccttagcttcctcaccacccttatagccccacctgtctgataaaataccttgaggccatttgcagcagaggtgcaggtgtgcagatgaggcagaaaagcccctccacacgcacaagcctgggcctggccttggactcagacatcatctacgtccacatctccatccaccctacaaagccctcaccagttcctgaggtgcacagctaagaaccatcaccacgataccaggcacttactgagcacttagcttggcactgagcactgatgtaagccctggatgctcaaataaaaatgcatgggttaccttgatgcaggacttctcagagctttaatatcccagcgcccctctggatgccaaagagggagatgagagtatgcagcatttgcagacttggccagggcaacctttcttcagctctggagcatacttaggaacattctgtgtccttgacattcctagtgtggtccatggactcatgcgtgtctcatctgcaaatcacctgggatctcaaactcccaatgtcaggggatccacctgcctcggcctcccaaagtgctgggatgacaagcatgatccactgcacccagccttttttttttttttgagacaaggtcttgctctgtcacccaggctggagtgcagtggcacgatctcgactcactagagatacagaatctcactacagatacagaatcgaaacccatttctactgaatgggaatctgcattttaacaccctcggagattcattcatgtgctcattaaagtttgagacacacttttgttggtcacagggctggaccttggccagatattggaatcacctggggagctttaaaaactaatgtggctgggtgcggtggctcatgcctgtaatcccaacactttgggaggccaagatgggtggatcacctgaggtcaggagttcgagaccagcctgaccaatatgatgaaacccccatctctactaaaaatacaaaaattagctggatgtggtggcaggtgcctgctgtagtcccagctactcaggaggctaaggcaggagaattgcttgaacctgggaggcagaggttgcagtgagccgagatcgtgccaccacactccagtgtgggcaacagagcaagactccatctcaaaaaaaacaaaaaacaaaaaaaaaaacagggcctaggttctacctccaaattctgatgtaattggtctgaagtttggcttggtcattgggagtttgaaaagctccccagctgattctgatgtgtggccagcagcatagatgagtgaacattagaaagggtctggagtatccgcttggaaatttgcagggaagcatttaaagtcttggaacagccccagcgaggcacagggagaacaagggactttcccgaggtctcatagctggctggttgcaaagcctccaccagcactcagtttcctagcaccagcctcggtccggactcttagcgtcattatctccacaccatcttctattttttcttctcttttattattttattttattttttgagatggagtctcactttgtcacccaggctggagtgcagtggtgtgattttggctcactgcaacctccgcctcctgggttcaagtgattctcctgcctcagcttccaaagtagctgggattatatgtgcgtgccaccacgtctggctaatttttgtattttagtggagacggagtttcgccatgttggtcagactggtctcgaactcctgacctcaaatgatccgcccgcctcggcctcccaaagtgctggcattacaggcgtgagccaccgcgcccagcctcataccatcttcttgaaaattctccctcctgatcctgagcctcagcttcagtcctcaaacaaaagccttgattgggttctgatcatgaggccgcctctgcacttactttgctggctgctggctcagggctccagcaaacagtcccaaagccagtaaagcttaagccatcaacatgaggaggcgttaacacattgtaaccaccagagcatagtcccattatgtaaggagtcctgctgcaaggccgctcagcttaatggagaacacgagactccaggcaggcctgggtttgagccccagccctggcacttggcagctgtgctgccatcatgacccctttagcctctctgagcctcatcttccctacctgtaaactgggcacaatggtaatcccctgctacaggtggtgtgcagatcatataagataaagaagacgatgagtcccgcagtgccctggcgtgtggtgggcactagatcagagttagttggggtcgttgagggctctcaattttggcaccaacacaggaggcctggggttctcagctggccccagcatctcaagtttccacacagcaagagcacccagaacctccctccaccaggccagaggcagccagcatgtgcctttctcttctcctcagctcactgcaacctccgtctcccaggctcaagcgaatctcctgcctcagcctcccgagtagctgggattacaggcacctgccaccacacctggctaattttttgtatttttagtagagacggggtttcaccatgttggccaggctggtctcgacctcctgacctcaggtgatcgctcgcctaggcctcccaaagtgttgggattacaggtgtgagccactgcgcctggacttttttttttttttttttttttttttttgagacagagtctttctctgttgtccaggctggagtgcagtgacccgatctcagctcattgcaacctcagcctcctggttcaagctattctcatgcctctgcctaatgagtagctgggactacaggtgcatgccaccacactcagctaattttttgtatttttagtagaggcagggttttgccatgttggccaggctggtcttgaactcccaacctcaggtcatccgcccaccccattctcccaaagtgctaggattataggcgtgagccgccgggcccagcctcttctccccatttgtttctcctgtgccagacccgcaggttcaaggatcatacttgcctgtgtttgaacatggctatgaggagacctgtgctgtcagtgtgggggacccccccagctttctcaggctgatcaagcagaagttggccatgccggccaacagttggtggcattcttcccatctcgtgggcccactcatgacagagcagctgttactgtcatggttattttatttttattcctccctctgggagcccagaatcaaagggaaacatcagcactgctgcctcattacagagagcagagaaaatggggatggggatgggacattatctctttttttcttttttctttctttgagacggaatttcgctcttgttgcccaggcgggactgcagtgtcatggtctctgctcactgcaacctccacctcccaggttcaagcgattctcctgcctcagcctcccaagtagctgggattacaggcgcccaccaccacacccagctaattttgtatttttagtagaaacgaggtttcaccatgttggtcaggctggtctcaaactcccgatgtcaggggatccacctgcctcggcctcccaaagtgctgggattacaggcatgagccactgtgcccggctttttttttttttttttttttttttttttgagacaaggtctttctctgtcacccaggctggagtgcagtggcacgatcttggcttactataacctccgcctcccaggctcaggcaatagtcccacctcagccttcctagtagcaggaactacaggcacgtaccatcatgcctggctgatttttgtatttttagtagagacagtttcgccatgttgcccaggctggtctcgaactcctgggctcaagtgatctgcctgccttggcctcccaaagtgctgggattacaggtgtgagctacagtgcctggcctggatattctcatccagggcctacgggcagtcagtggagactatctggggtgacatattcatcttacagatggggaaacaggttgcacagagcctggaacttcccaaggctatgttgaggccagactagaacctggttctccaggctccaggtctgaggtctttcccctgtagtcaggaaggaatctaggttaggactccaaagtcctcctcaaccagtgtgtccatgttaaatgcagattcctaggccccattgactagcccaggatgtgggtggacctgggaatctgcatccttagcacgctcccctaaccaaagttctagaatgactgctgtgacctctttccattggccccagagctccaggcctatgctccgggactctgtgcttcaatcccacattacaactcaccattcaagaactgcagcccctcaatacggatggcaccctgttaaaaaaaaaaaaaaaaagaaccccagcccctgctgggcgcagtggtgctcctgtagtcccagctaatggggaggcaggaggatcgctagagcccaggagctctgggctgtgatgctctatgttgatcgggtatctacactgagtttggcatcaatatggtgacctcctgggagcaggggaccacagtgttgcctgaggaggggtgaacaagcccaggtcaaaaacagagcaggtcaaaactcccgtgttgatcagtggtgggatcgcgcctaccagtggccactgcactctagcctgggtaacatcatagcaagaccctgtctttaaaaaataaaaaaaagagccaggtgcggtggctcatgcctgtaatcccagcactttgggaggccgaggcgggcggatcacaagatcaggagatcgagaccatcctggctaacatggtgaaaccccatctctgctaaaaattaaaaaaaaaaaaaaaatcagccgggtgtggtagcacgcgcctgtaagtcccagctactcgggagggcgagacaggagaatcgcttgaacccgggaggcggaggttgcagtgagccgagatcacgccactgcactccagcttgggtgacagagtgagactcggtctcagaaaataaaaaaagaatcccagcccctgactaatctacttcatttacagcattgcttatctggtgcacttgaggacagtgggtcccaggggaaggaggcagagacagtgtcatgttgtggttaaggacatacaccctggacccaggcagcccgggattgattcctgaatccgccacttctagtcctgtgaccttaatgtgtttcttcccctgtcggtgcctttgtttcctttcctgtaggtggtgatgccttcctcctaaggtgttatgaggattaaatgaattagtaaaaagtacttaggttagtgtctatcgcatagttatgtgctaagtgttagcagctgttacaccattttacaggctgagaatgttatgcagagagatgctgagactttgccgaggttatgcagactctgagtagcaaagttggttggggcttctacactcgtcccacatagttcctgcctgggcgtctaccgccttccagtgccaaccgtggctccgctggtagattatagcttggcagaaaaagaccctctgcactcccccattcactcatgtaccttcctacacactctggggttggggtaatttccccagtcccagtagccaggaaggcagagtctatggaaaccaggtggccatacagagcaaagttgagcttcccttagccctcagagtccctaatggggacccagggatgctaccaccttgagtctcaaaagctcaagctttattatgtcaattcttatttatactcaaagcttatttccatttttctggacaaatttacacttcaaatctctgcattttggtttaaaggaatgttctcaaacattggctctcctggctcttggtgtcaacaagaccacttccttccctgtctggagaagaaaatggagttaaggcccagtgtccttaaaccatacctcctgcatctagctcctgagtatttctttcttttcttttcttttcttttctttttttgagatggagtcttgctctgtcgcccaggctggagtgcagtggcatgatgtcggttcactgcaacctccacttcccaggttcaagcattctcctgcctcagcctcctgagtagctgggactacaggcgcatgccaccacacccagctaatttttgtatttttagtagagactaaaatgggggtttcaccaagttggccaggctggtctcgaatgcctgacctcaggtgatctgcccgcctctgcctcccaaagtgctgagaatacaggcgtgagccacggtgcctagccacttcctagtatttccagaaaaaaacagaaagcagtctcttcttggtactccccttcttcatcctgccctcagtctttctctctgacttaattctcttctctgagtggttctgatgctaagtttggcccagggacatgacagaagtctacatccccactgatctcagcctcagaatgggctttgtgagcacattctgaaactctccacctggggagagagtagtcccagctactctctctgctctgaggactgagggactgagtgaggccattcaagcctgtggagggcccaggcacacactgccccactcctgccacccaccgctctccatctcagtgcccaagggagggcagctccattaccgctcttttcctcttctcccatccctgctgtgatagaatctgccccgagcttggggcccattctaattaaggtaactgaatgcccaggcagctgaaaccggccttttgcaaaatagcaagtggaaggcctgcccttgaggcccagcctgccagctcctgtttgcccttgcctggtgttcgagatgactgggccctgcagccccagtgaaggaggggcctgggaaggggaaggggacagagagcaggtttattcggggtgagctgcgctggtccattgtagtttgcactcagtgcttccaggagctggaaaggcaaacaatagatttgggtcacgaggggttgggggaggagatggtcagatttagcaggattctgatgccaagtagctggtgcttagggctctgggctgtgaacttgggactcttctgatcagagcctctgtctcccttcctcgcttcgtctcccttcctcgcttcctctgctcagacccccacacacatgcaaagctggcctcaggcagacacatgccaccactgttctgggctcctttccttagatttgagaggcctggggcagagtggagagggctttggtcctgcatccaaatcctggctctgaatgtccttgcgcaggttatttaatctttctgtgcctcagccttctcatatgcgaaatgggaagagcaatgcattctctggtggatctgggttgtgtggggcctgaagctcttaccacatgtagagccctttttaaggtaaagaatttctggctgggcactgtgtctcatgcctgtaatcccagcactttgggaggccgaggcaggcggaccacaaggtcaagagattgagaccatcctggccaacatggtgaaaccccatctctactaaaagtacaaaaaattagctgggtgtggtggtgggcacctgtaatcccagctactcaggaggctgaggcaggagaatcgcttgaacccaggaggcggaggttgcagtgagccaagatcgcaccactgcactccagcctcgtgacagagcaagactctgtctcaaaaaaaaaaaggaatctcaacatcttgtgcaaagtttacaaacacttaaccatgtgaacacactggcagggcccctctggagcacgtgagggtcctagaagcttaagctctgttagcttcacagtaaatccagatgtatacatgcctacctgataggactgtgagggattaaatgagctcatatttgagctcctagaacagtgtctggcacagaataagcccctcgtaagtattggctttcattcttattgccctcagggttcctgtgagcattagacatttgcagattgcccaagtaacatcaaacgtggtgtgggcagatgctgtgcacctgacacatgcattcattagctcatctaatatgtagcgttcacgatgggccaggggctgttctgagcactggggaaccaatggcccctcttaaagctttcggtctgggaggggtaattgggcagttactcacacacataggcaggtccaaatggaatgaggacaggtgctatgagaaaacaaggcaaggccaggcacggtggcccatgcctacaatcccagcactttgggaggaggatcacttgagcccaggagtttgagactagcctgtgcaacataatgagatcttgtctccacaaaaataaattttaaaaaaaatgagctaggcatggtggtgtgtgcctgtagtcccagctactcaggaggctgaggcaggaggatcacttgagctgaggaggttgaagctgcagtgaaccatgatcatgccatgccattgtactccagcctgggtgacaaagtgagaccctctctcaaaaaaaaaaaaaaaaaaagcgagactatatctaggagaaagaaaagattttgatttggggcataaggaaaggcctctttgagacattacgaaagagtagggaagaattcttattctcatttctggtttgcttgcagtttctgcatgtctatccgtaaggcaatctggcatggtgacattaattaaagcaactaaaccgtttggcggtccaactaaaatctaagcaaatattgtctcctctgagcctctcaacaactctgagatgagtaagcggagacccaggcaagagtggctttacctgagctgacataaatactaaatgaaggagctggaattgaaatctccacctgactgcctcacaggtccttccttcacaccatgtgcctgacacagagcaggggtgcccctgcagactcatgtgacctcatgaccttctcagaggccacacagtctaatctcctcccctctcactgtgggaacagaggaagccgagggcctgagagtcgctgcttctgagacccatcccacatcctctgcctgccactatcaaagtggttgtgacctccctggggtagcagagtccaagaacagtcagtctcccagacacaggaagccctcctgtggtcctcaggcacctgcaccatgggtatgcagatctggccctcattgatgcaaacaccagccctctcctggctttctgctctaccccctggcacatttcttcctggaagggtgattgatgctctgctacttgtggccttggaggtgctcacagtgagagacatgagatgccttaaaaccatgaaggtcagagttcaaaaggcaagtaggcaagcagggagagcccaagtattgggcccacagaactacagtagggaagcaggcttatatctgagcatccccacaggcctggcagaagcaggaatggatgatacatggctctcatgatccaatggagggaagcaggtgcttaacacatgggctgggtgtggcaccatggggatgagtgctgcctaagcacctaccatgtgccacccactctgctaggtgcatgaagccagttactgagtgggcctcttaactgtcctgtgtggtaggtacgtttatccctatttcacagatgtgagcactgaggctcagagaggcaagtgaacattgtctcctctgtaatgaccgtcccctataaactcctggcaggagggccttgccagctgagtcatggcactcatcataaaggcttcaaggaggaggggagtcattatagaggagacaatgggccacatagtagatgcagttttctgtagaagttttattttaaaaatcaatgttattgtttttaaatacagaaacttttgatatttccattagccctggttaaaagctgaaggaaatgttttaaaatcatatgtcataaaagtatgtctgggaaatggaaggttttttttttttttgagatagggtttcactgccacccaggctggagtgcaggggtgcgatcatggctcactgcagccttggcctcctgacctcaaacgatccttccaccccaacctcctgtgtacctgggaccacaggcacacaccaccatgcccagctaattttttttttttttttgtagagataagatcttactgtgttgtcaaggctggtctcaaactcatggcctcaggtgatcctcctgcctcagccttctaaagtgctgggattacagacgtgagccactgcgcccagctggaaatgggagttttttaagtgtccaggattataatatttggtcacatatcagtgccggagcactcatagaaatgcacacatactgaggtcacaggaactaactgctttagacatgttaccccagccaagcccccaacaacctcgtgagagagatactattcctatccccatttcacagataacaggctcagctgtcaagcaggtcacccagctgggaagtggcggagcccagctgcaaagtcagggctgctgaaggggagagaggtggccgtgtgcccagctgtgagcaggctagaggtgctgggggacagtctgggtgtgcacagaagcagctcccgagctctcggtgctaatgtgaggatgaaaggcccccaccctgctgctgcccagtgggagagcctgacgctcaagttggcgatgagccttgcaggctgggcctggatgtgtgtctgaaacagggagccttttcaggtggggaggcgccctggctgaagccctcaaatgcagagtcacggggccgggcgcagtggctcacgcctgtaatcccagcactttgggaggcagaggtgggtggatcacaaggtcaagagattgagaccatcccggccaacatagtgaaaccccatctctactaaaaatacaaaaaattagccgggcgtggtggcgagtgcctgtaatcccagctactcggaaggctgaggcaggagaatagcttgaacccgggaggcggaggttgcagtgagctgagatcgtgccattgcactccagcctgggcaaaaagagcaaaagtctgtctcaaaaaaaaaaaaaaatgcagagtcacagaacaggaaaggggctgcccacctgaggtcaggtccccagaccttggctgagcaccgccctgggctcataaagaaccactgtgcagtgccgcgtgatgagtgctccccccatacccagcgcagggaacctggggagagagtggctggttctgccctgggggtcggggccagccgcagggagctggcagccaagctgggccttacgcgctgagtcatggctctcatcataaaggcttcattcagagacacggccacaggcggccccagcgctcaccatccctggtcctcacaaccggcccaggatgaatcccagccgcacaccagggatacacctgcgcacaggaagacatggtcccttctctcaaagaattgcggtctgaggggagaagcaagaccatgaacacggaaataagtcagtagcgcccatgctgatagagaaagtgcatcaagaaggcgaagcagaagggaagacagggatggccatggtgggggtttttctctaggaagagggcctcatgcaggaggtgacgtgagccgagccagacagaagtgagggatggaggccaggcatggtggttcatgcccgtaatcccagtactttgggaggctgaggagggtggatctcttgaggtcaggagttcgagaccagcctggccaacatggtgaaaccccatctctactaaaaatacgaaaattagctgggcgtggtggcaggcacctgtagacccagctactcaggaggctgaggcaggagaatcgcttgaacctgggaggtggaggttgcagtgagccgagattatgccactacactccagcctgagcaacagagcaagactcgtctcaaaaaaacaaaaaagaaaaaagaagtgagggatggaggcacgtgaggtgggggagtgggaaagagcttggctgtttggtggctgagtgatgggaaggtggaatggaatggaaggaggacccgggcagaggttctgagagcacaagcaaggagtctgcacaagaggccaggcaagggcttttagctgggaaatgacaagacctgcctgatgttttaaaaatatccctggccagtcacagtggctcacgcttataatcccagcactttgggaggctgaggcaggtggattgcttgaggccaggagttcaagaccagcctggacaacaaagcaagacccagtctctaccaaaaaaaaaaaaaaaattagctgggcatggtggcatgttcctgtagtcctagctactcggaggctgagatgggagcatcactgcagcccaggtgttagaggctgcatgagctgagatcacgccactgcgcttcagcctgggcgacagagtgagactctgtctcaaaaaagagcccctgcagcacctggaggaagacagcactggaatcgggaagagttaggtggttgcatttgtccagggaaaagaaggtgagaaggaggcggtcagctcggccaggctgccaggactgctgatgtaggtggaggaaagagccatccagggctattccatggtcctcacctgagctcctgcatggaggttggtgcgatttgctcagcgggcatggagggaaacttgacatttgggtggtaagcatgttaatttgagctgcccactggatagtcagttgaagtcgtctgcacactgtggtatgcatccacatccccttgaggtccaaggccacctgccagaagtgttggctgctgcagaccgtccccaggagccaaaggggctgccttgcccaagatgacagacccatcctggggcagccctcatctgaaggctggtccaggtggggacacaatgattttgcccccttgcctctttctgggcaactttgaaggactatcttggctccagatgccccggggatcagctgaggctcattgcagctgcaatgcaatccacttctccctctgcccatcctgcatcccttgtgccctcacaggccaagccctaagacattccccagtcaacttcctcacaggcaattggatgcatttagttcggagctccaggaagaggtctaggctgggtggcaacaatgtggggtggggacatcagcactggtggaatttaaagtctcaggctaggtgagaagggaagaggattgaagcacagagcatgccaaccttgagagctgaggaggttggaggggtggtgccctggaaccaagctaagaaaggtttaaagggaccaggtgcggtggctcacacctgtaatcccagcactttgggaggccgaggagggtggatcacttaaggtcaggagtttgagaccagcctggccaatatgatgaaacccatctctactgaaaatacacaagttagccaggtgtggtggtgcatgcctgtagttccagctactcggggctgaggcaggagattcacttgaacctgggagacagaggcttcagtaagctgagattgcgccactgcactccagcctgggggacagagctagactccatctcaaaaaaaaaaaaaaaagagagaaagtgtttaaaggagagatccggtgcctgtaatcccatctacttgggaggctaaggcaggagaatagcttgaacccgggaggtggaggttgcagtgagccaagattgcaccactgcactctagcctgggcacgacagagcgaaacactgtctcaaaaaacaaaacaaaacaaaacaaaacaaaacaaaaaacaaaaaaaaaacagagattcacctcaccaggtgctatgaggattgttaaggtaagatgaggacccgtgacactctagttagttcatttcaaccgctgtggtgttcagggaggaacttgaaggaacgtttaaagccaggggcataatgtggtgaggagaggaactcatagagaaggagaaatggatgattcagaaggggagggcaggagcaaaaccttgaaggggatggggtccagggcccacatggaagggtccatctgtgaataatgctttgtatcaagaagaaggcagagtagaggcacctgtgcaggttggtgtgtagagctggtggggaggtcactgggcatggtcactggctgtgagtgagtggtgggaagcagtgctggagatgagaagacaagaagagaggagagtcagcttaacctgcaagtctcccagctgcaaagggcactggtgcgcttcaaacctgactctgggcttcattcactggaaaaagcacaaagaaagacattctaagctgtcaagacgtggtaggttcagcaaataatactagttacagtaaaaagatgtgagctgttgctacgcttaagcattcgtcgtgcattctttcatttaacaagccatccctcaaaacccctgtgacacagatacagttggtccttattacttgcacattctgtatttgcaaatttgcctgcttgctgaaattcatttgtaacaccaaaatcaatactcgcagagcctttgtgatcatttgcaaacattctcacggtggtgaagatgtgagttgcccaacgtgcatgttcccagctgaggtcaaacaaggcgacaagcggccttcttgtttcagctctcatactgtaaacaagtgtcctcttcacggtctagttagtgccacgttttctgcatttttgtgtggttttttttttttttggcgattttgctatttgaaatggcccccaaaggctgtctagtgttcctaaatgcaagaaggctgggacgtgccttgtggagaaaataacgactgagtgttagataagctttgcccaggcatgagctacagtgagttcaatgttaatgaatcaacaatatgtattaaatatagtgtctttaaacagagacatgcttaaaacaaggttatgcattgatcgtttgatgaaaatgttgtgatcagaggctcacaggaattgaaccagtatttcccctaggggcaatggttcagtattcacgattctgtgtttgtagtgacttcatagagcataactactgcaaataatgagaatcgactgaacttttttttttttttttttttttttttttttgatacggtgtcctcctctgtcacccaggctggagtgcagtggtgcaatcttggctcactgcaatgtctgcctcctgggttcaagtgattctcctgcctcagcctcccaagtagctgggattacaggcacgtgccatcacgcccagctaatgtttgtatttttagtagagacgggatttcaccatgttggccaggctggtctcaaactcctaacctcaagggatccacccacctcgggctcccaaagtgctgggattataggtgtgagccaccgtgcctggcctcgtgtgtactattaactctgttggtcacataagaaaccaaggctaagagactagacgagctacaggtagtaatagcagagctggggctgaaacctgggctggtggggcactagggggcttcaccccatgaatgtggccttgtgatccagtggggaccacaggggacctggcctggaagaaaggtttcttttttagggcaccccatgagcagcctgcctccccactgcactggcctctccagtttctacgtgaacacagaagctccttcagccctcctgggctgcagccacagagctgttgctgggccgtggttttcccctaagtgggtggaacagtggctccgtgtccagaggccgggcacctttggttttcctttgcccagcccagccctggcaggggaggcacaaaggaggcatctgtgactgagcacggaggccagccagtctcccgacaccagcccatccggtctgctgtggcctcctgtttattcaggggataaacttgggcaggccccagggagccgccctctccccagccccaccaccttctccacagggcagagtctgcagcccttcttctgtcttttgtggggtagcttgcgtgttgtggtttgggatacttcttcatcccagcatcactgagataatttaggagacaattgcgggggactctgctttcagagtggagttacaagcccttcagtgtgtgtccttccaaccccagaacagactcagagtcgtcatcgtccactgtcatcccgcctctcaggaggccgctaaatctgagactaatggctgccacctggagtgttcctcaggcagggagcaaccacacgactgtgaggagggggcacttacctggtggggggctcagtgctcccctgtggggctgaggaaggagcctgggcttggggagaagctgggtgctccccgcccaccctccttgacccatcagatatagatgagaagccacggctgggagggtgcgaagctgacagcagagccccaggtccccagacaagctgtggggagaagagcagcgcgggcgtcagaggcgcctggacaggcagccggcaggtccacagcaaggctgcaccttgttcttccttggtctctgggtggccagcactaggtctggcctgcggtttctgctcagtgattcttgtttgagtaaatgaatgacggggtgaatgaatgaatggtcttggttctatgatggttactttggggaagttattttattatacaaaaccgagcctctcttttttacataggataacggctaggtgcacagtctctggagccaggctgcctgggtttgactcctggctctcaacttactagctgtatgtccttgagtaacctctctgagcctcagtttccccatctgtaaaatggggataatacctgcctcgtagggttgtcgggaggattaaatgagctcatatcatgtgaagcactagaacggagcttgtatatattaagtgctatgtggccatttgctgttaatacttttttttttttttttttgagacagagtctctgtcacccaggctggagtgcagtggctagatctcggctcactgcaacctccacctcctgggttcaagcgattcccctgcctcagcttcctgagtagctgggattataggcgaccaccaccacacctggctaatttttgtatttttagtagagacggggtttcactatgttggccaggctggtctcgaactcttgacctcaaatgattcacccgccttggtctcccaaagtgctgggattacaggcatgagccaccgtgcctggccagctgtaaatacctttaagatgaacataacgtctgccttccgcgcgtgttgggagcctggtgcattgtttgcccaggtgtgctcttctcagaacactgatcccttgtgttgttaaatgttaaataagaagggtcctgtccaagcccagttgccttaaggaagcctggggttaaaagctagggaggcttctctcctgcagaggtgcctgtgacatcttcaagagggagtgaagaatttcaccggctgatttgaccacagatcaatttcttgctatcagagtgggatggggtttccacaaaacacgtctttgaagacaacaaatactgcttccttccctccctccctggagccctggcctcatactgcttagcttatctggtagcagccagggaaatggcaggatgcatctccctgggcttagaactggggcaggaggcagcagccaagtcaacagcaggtagtggccagtcctcagctctaagccagcaggtaggactgcagaggtgcatgtggcaaatcatagacacctgatgtgggctgccactgactgagacactgctgagctggacagcagacacctgcaacccaaggatgatgaagaggaacttgaggcctttaattgctcatggtcttcaatcatccttaccaattagtttctgctgcttcccaggcaattccggttgctgtaagtaagccagtgatgcaacaagagaggcagaagggagtcctgaacgtgggccagatctgggtacaaatcttgtctctgccaccacttaatcctcttgagcctcagtttccttatttgtttcatgagtgcagtaacatctactctacaagattgttggattaaattaagaaatgaagtggctggcacatagtacatagctgttatcaacaataggctgcagggaaatgttctctccttggtttcagggcccttgtccaaggttcccattaggtagaggaattgtttcttcagagttgagatctgatgtgtctgggaagagggcagcctgacttgagaaggtctctcacctttcaaatgcccatctcaggaacttcagaaaaggcttccgctaattcaaaaatcaagtcctcagctttccattgtctgtgggtgagggattctcagtcccattcagggccctaaccattccccaggtgattactgtgtgccagacatgttaggagcttaagtccaaagacaccaggggcatggaccctgtcctcaggaattgcagaatggtaggggacctgacaggaggccaatcctgacaattcagtgtgttcctcttagtaacacagcttgtgattgaggcatagacatcatgaagccaaggaataatttattatcactggagaagacagggaaggcatcacctgggaaatcatacctgggtggagttttgaaggatgaataggagtttgcctggtggacagaggaggccaaaagtttggtactaaaaacagcatacctactctactcccaaccacctcccttttctaggattggtgtgggtccatctgccgttagcaagctttgtgactataggtaagtcatttcttctctctcggcctgtttcccattggtgaaatgggatcccttccagctttaatgcattgtgatttcatgtttatataggcctagataattgttttaaagtcctcatatttgcaaaacacggggcaaaagtctttgactttttctcttctaacgcatctcccagtcttacaaagttggttgtactctctccatttgactgaggaggaaactgaggctcggtgaagttacttgcctttagccaatatgtggcagatccaggcctcaaatccaggtcttctggccctgagttccactgtttctccactgctccacacggcctctcaccccacaagccctcggcggctgcacataaatgatccttgacagattactgcctcactcaggcccctgtcagatgttactgctgacagttggggaggaggaggagcgagaacattgtgtgccaggatgccaggcctcggccctgaaggaggagcttatgagaaagaggcaagcagggaggcagcaggtaggacattgagcatggtcaagaaaggctgttttggccagagagtggataaatgataaagtctggagtagcaggcaagtgcacagccaccctttcctgaagcaaaaattggtgcctaaatccatagtgaaaatagtccccctggccgggtgcggtggctcacgcctgtaatcccaccactttgaggccgaggtgggtggatcgctttaggtcaggagatcgagaccaccctggccaacatggtgaaaccctctctctactaaaaataaaaaaattagctgggtgtggtggcacgtgcctgtgatcccagctactcgggaggctgaggcacgagtatcgcttgaacccaggaggcagaggttgcagtgagccgagatcacgccactgcactccagcctggcgacagagccagactccagactccgtctcaaaaaaaaaaaaaaaaaaaaaaagaaagaaaatagtctccctgcctccagggtctctctatgcccataccctgctttgtttttcttcagagcacatattatatatgtcactcattaatttattgtttcatcatctgacttctcccactaaaatgtcagctccacaagaatcaaccaagacttggtactgatcaaggctgtgtctacaacacctagaacagagcctggcactaactgttttgaacaaatgaaggaattaatgaaggaatgactgaaagaatgaaggaatgaatgaaataatgaaggaatgaattaaagaatgaatgaaggaatcaaagaacaaacgatcccttcacctgtgatcatgtcagcacccactgttgtcagcaagcctttagcaaagcagttcccaaactgctgcatcagaatcactgggatctttaaaaactgccaacacctggcttccaccgtgacattcggattaggttgccatggggtatgttattgacatttttttaggttcaagtgattccaagcgttttttaagttcttcaagtgatcctgatgtgcggtgcagtttaggaaccactgctttaaagggttgtccactcctgaaaaagggcagtccactcctacaaagcttctagctgagttaatagccaatcagagacatgggtagtggcacgcagggtgggacctctgtgctgcccaagtctgggaggaggtggggagggtgaggtgtttggggaaaggagagttgtttttgctgcctgggttttgctgtctgggtaactctgatgttaccaagagtagaggaaaacgaagtttttctccttgctctcacccaattcaagtcaaaagaacaccttgctggacttcctcctcccctgccacctcctcttcttggatgactgaatgagtcagggggcttgtttgttagggaggaaacactggttttctcaccattttccccctttcgttgagcttgaatgagtaagaaaacccattgtttatacatgcacaggttgacacaaatagagcttggagcttctgaagactcaacctgggctccagagtcaataagaccaggtcccaccccgtctgcacagcatccagccagatgttacaagagaacccagccccgggggcaggctggtgaaatcatcccggccagtggacagtcaccaacaccggagtgtttgccaagggaaacaccttgtttccacagtccaagatcctctcctgggctggcacagagttgcagaattggaagagacctaaagatgtgctgtccagctaaaagctcttccaggggaggagtctgaggcccaaaaagttagggagagcccagaacccaggcctcctgcatcttcactgggtttggtgggaagaggcagaggaaggagtggtcagagaagatgccagcttagtgcagacccctagacacatccccactggcgagagagggcttttggatccaagagtcattcccattttttttctaaataaaaaattgggggccaggtgcggtggctcacgcctgtaatcccagcactttgggaggccgaggcaggcagatcacttgaggccagttcaagactagcctggccaacatagcaaaaccccatctctactaaaaatacaaaaagttagctaagtgtggtggcatatgcctgtaatctcagttactcaggaggcggaggcacaagaatcacctgaacccaggagacagaggttgcagtgagcaaagatcgcaccactgcactccagcttgggcgacagagggagactctaaaagaaaaaaaaagaaaaaaaaaagaaaagaaaaaaaattaggaatgactttcctttggggtcaagaggcctctgcagtctcagagtcctgcctatttgcttggtagtcccttccctaagccactgcttaagtcatcaaatactgaatttaccacctgggatgaaagctgagatttaagagttgtagctgaacttcctgagcgtggagtcaatggacctctgagagagaggtgagagaggacaagtacttgtggtaaagtcctagccagctgccaggggggcttttccacacatagagccccagctgggcagaaataatgtcctctggccgggggcagtggctcacacccataatcccagcactttgggaggccgaggcgggcggatcacgggatcaggagttcgaggctatcctgaccaacatggtgaaaccccgtctctactaaaaatacaaaaattagccaggcgtggtgtcatgcgcctatagtcccagctactcaggaggctgaggcaggagaatcgcttgaaccctggaggcggagtttgcagtgagccgagatcatgccattgcattccagcccgggtgacagagtgagactgcatctcaaaaaaaaaaaaaaaaaaaaaaaaaaaagtaaagaaagaatgtcctctgtgtgtgcgttgacagaatcaagccctgctaagatggaccaggtttgactgatgctcacagtcctgattaatgactggtgtccaccttggagagcactagactgagagtaatgcaacctggctctactcctggctccaccactaactgagtgtgctacttgtgaggggagatgccatttcccacctctggggctcattcccctgtctgggaaatggttatactataccagtgattttaaatatttttaaagccatagaaccctttattcacatgaagtttcatacagaagacagcatgtacagcagacagaagtggagctatttttgtggttcccctggagcacatcttcccttttgcgaagtctccacagaaccctgagggttccaacaaactcagtttgagaacaacttgccagactttttgttttagctccaatactatttatgtcagctgttgtttgttcacttggctaatattggttggcatcagttgcttggctaatgttaacattaggtaatgttcagaagggttcttttctcaaaataatgatcatgaaaccatatatatatatatttagccagtcgttccacatggccccaaacatgtgcagaatgttgcttctttacaccatccaatgttgagctaactcttgcatggtggcagcgaaagaaaatagacacagagaggccaggcatggtggctcatgcctgtaatcccagcattttgggaagctgaggtggggggattgcttgagcccaggagtttgaggctacagtgagctatgattgtgccacggcacttcagcctaggcaacagagcaagatcttatctttttttttttttttttttgagacagtcttcctctgtcacctaggctggagtgcagtggcacaatcttggctcactgcaacctccacctctcaggttcaagtgattctcctgcctcagcctccagagtgtctgggattacaagcgctcgccactacacccagctaatttttgtatttttagcagagacagggtttcgtcacgttggccaggctggtctcgaattcctgacctcaggtgatctgcccgcctcggcctcccaaagtgctgggattacaggagtgagccactgcgccgggcctgacattgtctctttaaaaaaaaaaaggaacctcacaggtaatgctaagagaccagggtacctaactcaagaccttccttccccacatcctcataggtggtgctatgctcagaaggcaggattatatttcctattaactcactcttagcccccgtttgaaccaaggacactgaatcctagcctgtgttagagccctcagatcccatattcatcctgtgtctaatctcacccatcagatacagtcaccatccccaccccaccccccactggactatcattgcttctctgaaccctgctggaaagtgttagcccttccctcaaaagtcagggtcctaaattttccctcaggctgcctctaatcctcacctctgttcccctcagcctcttgccataatgatcattagtaatagctactgtttattggttacctgctctgtgccaggctctgttctatgtattttactggtcctgattattttgatcctcacaatagttctaaaatacatactattattatctccaatttaaagatgaggaaattgagacactgggacttaaacttgcctacgttcatttagcaacaaggtggtaaagccaagatatggcccttggccccggcacccatgcacagaaccagtgcgtcagactgcagctcactcatgctgctggtagtgactaggaactgccatttattgagcacctgcagcatcttaggcattgcactagacactttatcatttcattgaaacttcacaactgcaagaggaaatgtcttatttccattttctagaggtagagactgaggctccaaaacattgacttcccttgataagtggaaccgggcaggcttcaaacccaggagtgttcaatgcatctgtggcctttctctgtcactctgcttttaaggacaagtacctgcagacattccccactccactacctttgagaaaaataaagaaggacctactgataccacccgttccatagagctcttgagaaatgtcgctcaggctgcccatggtggggacagggagggggcttgacaggcctgactttctccattgaccttctctgggagagagtcacgaccagagaagggatgatcacccttggtttctgcttttctttcttggttctggacgatcctgtcatgtgacctgctttgagcctaataatccttaggggcaacatcggacttggaagggaagaagggaaaccaagatagaacccctggactcagccacatcctaaaaccttttgggacactgctgagcttaaggtctcagggtggagatgggaaggcagatagagtgggcccagggtgcatgggctcaatcgcataccacacctttgaggagtgcctaaaattaagtgtagtcactgtgctagggtgtacaacatcctgtgaggtaccattcccatcttacagatgaagacattgagtcttagagaagtaacagaacttgtcccaagacatctgggaaataagactcaattcaaacccaagtctgtttgatttcaaagccagtggtatgatacaccacataggtactcttattttttttttaaatagagacagggtcagccaggcgcagtggctcacgcctgtaatcctagcactttgggaggccaaggcgggcagatcatgaggttaggagttcaagaccagcctggccaatatggtgaaaccccgtctctactaaaaatacaaaaattagctgggcgtggtggcacacaccagtagtctcagctacttgggaggctgaggcagaagaatcgcttgaacccaggaggcggaggttgcagtgagccaagctcacgccactgcactccagcctgggcaacagaatgaaatataaatctcaaaataaataaataaataaacaaatagagacagggtcttgctgtcaaccaggctggagtgcagtggtgccatcatggctcactgcagcctcaaactcctgggctcaagtgatcctcttcagcctcccaagtagctgggactacaggtacgtgccaccacacctgcctaatgtttttatttctaattttttggtagggatggggtcttgctgtgttgtccaatctggcctcaaataccttgctgtgttgtccaagctggcctcaaatacctagccacaagtaaccctcctgctttggcctctcataggcactgggattacaggcatgagccgccacatccaaccaacatgtgtgttctatatgatacaccacagtgctcctgtgtgttagagactgtgggagcggacccaaacaagagaaacagtctggcctctgcacatatatctctgaacagcaaggcatactttccgaggagagggctggggcagtggagtttctcttggggccacagctctagctcctctcttaggtggctctggccaggaggccctcctgtacctaatgctgtcccatttggaaagtccccagcagttctgggagctccagcggctgctttgcctcagagacaagccctggtaaacataggggccgctgcgaatttactggcaggagagactgagaaggaagttgacagccaagaggcagagaagtgggcaaagctggtgcgtgtgtgcatgtgtgtgtgtgcatgtgtgggtgtgggtgggtgtgtagggtggtgcaggaccaaagcacccagatgccccactggtcctgcccgtaccaaagtgccgttgccactttgttggccagtgaagactcagggaaggcaaaggtggctttgagccagacaggaagataaatctctcccctcactcaagttatatagtgcaacagcaggtcaaagggcaaccacatttgcaatatttgccgctttacattcatctcatttttgtctttttaaagtccagggcatggttaagagtgatggggggatggggagtacatttttaaacatttaattttttgtagagacgagatgtcgctatgttgcccaggctggtctcaaactcctggcctcaaagatcctccgcctcggccactttgtctgagccactgtgcccggcctgaggacacatgtttgacataaatagtatttactagcattcaacaggaagggtcctctcctttttttttttggttctttagttctcgttgccgcttggttctttgtgttcctgggctggttatggagatggttccgacttcacatgaaaaggctggaaaagttgtgggtaggactctggatgaaagtcagcctaggcgcccccggactcattagggggtggaggcggcggcggaccgtgtggggcggggtgcgcagtgtgagccggggagcgccggccggaatctcacagtgcggtgacaaaaaaccgtgagggtggcgcagaacgggcaagagactacagcgcctacctggcaggggcgcgagctcacacgccgactcctggagtcccagccagggctgccctgagctgggcgcgccaggcgagctccacctccggaggcggggccgccgcgcggccattggtcggcgccctggagccacctgcccctaccttgggggcggggttacctgggccccgccccgcggctcgggttccggggccgcgtccctgtcctccgcccccgcccccgccccgccccggcgcgaaggccccgcccccgagtcccggggcccaggcgcctcgtgatgtcaccgcagcttgatacaaagagcccttcggcccacgcgggtctcccggcaacgggcgggggcggggccgcgccttccactggtgcccagaagtgcgagcggacaggccggccgcgattgttcctgcgcttcggggctgcccgccgtccccgccgccgccgacccgcgccctctggcttccgcgcctctgccggggagcggcccgcggatgcgcaccccgccagctctcgggagccaggtaagcggcggccccggggctggcgctcgcagggctccggcggcgcgcacctggctcggcccggcccgcggccccgggaagttggcggagagcggacttggcctgggaggtcgtgttacctgagccatctcgttcggccgcgagtagaagccgctgccaggtgcgcgggtggcggctccttccccagcgcagttccaggaagtgcttttagtggactaggaagggggctcgtctgctggggcgcctccctggggacccgacggcgggccccacctccggccgcagcgcccctgccctcctgcccttgcgggatcggcgtggtacccagcgccgtacccttgggccgggtccccgagggggctgagcgccgcgaagtttttctgtagctcttggcggctgcacagagcctgtttcctggcttcccccgtccctctgggatggtggaggtggggagtcctcggggccagcccaggtcgtggtgtggggccggggccctgcctctccccagccgagaagctgcagtggtgggaggtgtgttgtggcccttgaggcggccggtctggcccggtggtgggagctgttggcacagccgcttctctgtgcgggcgacaagtgtctccaaggtcctggcggcgcagtctctggagagcgtgtctgtgctgtggggaactgggttccgacacagccccgcaccctactcctcgcccatgcaaactctccagtgccttctctttcccttttccctcaccctgctctcccacagagggctggaaatgacacctcactcgccccgagggccatgccagttttccttgactgaccgattttctcaaagcaatgtgagaggtctgggtcctgtctctgcacttagcctccaccaggtcttggagtggcagcaccctgggctggttcctggtgatccaccaaacttctgccctgccctgccagagcaggaggcaggtggcattggcttgggcttctgggacgctgaaaagcaatggggcaggcacattccttagaacatccccaggtcctggcccagctgaaaggtggttacagtggttgctgggatgggaaaaaggagactcaaaggggtcggaggcagtactaattgtgtgccactagacctctgcaatgggagcgctctcactcccccccatatcctccccccaccaactagccttgcgttggtggagtgcctgagtcgctgcctttgactggggtctcccccaggtgctggcaccctggcactggcccaaaccttaccctgctttctggctttcggggactgttgattatgttcccagggaacattacacacgggacacttccctgccttcaaggtgtttgcaagctcaggcagtctgaatactgggtctgctctgggcctgcccagctcttctaagttgattgcaagttgcctgcagttgtctttgaggtccctgtcacttcacaggggagagtgtcgcctggcggggtgagggaagccgctagggttcttcactgcagaaggcagcaccccttgggcaaatgcgtagtggagaacagcttcggaatttgaagggggggcctggacttaggcgaagggggtggagtaaatgactaaggccagtagaagagataagactgggccggaggcgaggggcgggactagccaggccaggtgagccagctggaaggcatgacctttgccctaagggaggtctgtaggagagactgcctggagcctgccctcggaagggacttttaggcaagtgggggaggaaaagcagaagaaattagagggcccattgggttctaagccacctcctttggggttccaggggcagcctgcactcggaaggctctgggctgcagcttgagatactccaccggccctcactctccctcccgaccatctgtgccacttctaaagcatgctagtgccttcctagccccttcccctcctggtaggcaggctgcttcagacccaaggttttctctttggccgttcacctggggcccttgcaactccctccttcatctgtacccgtaggtatctggcagtccccgatctgggcagcccgttatgctgaggtttttcacaactgattctgttctgaggagacttcgcaatttcactttatatgttttaggtatgggtaaggagggggtgaagggggtaggagaggctcccaatgaaatagcaggtgagcagttcccagaaggcaggcatctccgaatgagaaagggcatgctgtttcctggcacagggctcattgtgtttgaaaaggaagcatcttttttttttttaattgagttgagacagggtcttgctctatggcccaagctggagtcaagtggtgtgatcagggctcactgcagcctcccaccctcccaggctcaagcaatcttcccacctcagtctcagctgggactacaggtgtgtgccaccctgcatctggctaatttttgtttttgtttttgtagagatggggttttgccatgttgtccaggctggtcttaaactcctgggctcaagggttctgcctgcctcaccttcccaaagcgctgggactacaggcatgagccaccacacccagctgaagcatctttatctgttcgtgcctgctgtctggtgttagcagtggggcacagtgccctggccttgccaggcatacagaacccctggggctggactctgtcttcctctgggtcagctctgctggctcttgactcaggaactgggcacctatggcttcaaacactggcctcgaagatcaatgcccagttacttcatctcaggtctcatggctggattattgggtggtcccatccataccaattaggcaccacaagacaggcctgcctatttggcagtcccacctggtgccttactggatgtcgtacgatctttgcccctgaatggtaccacagtctccctcaccaggaggcgtttcaggacacggaggcttccccatttctgtttgctcagcccccagcacatttcccagtacagggcaagtggtactgaattcattcaccagattcttcgttgcctactttgtgccagattctgtgctgggcactggagatacagcagtgaacaaaacagacgagaacccctgccttcaaggagctcgcaggatggtagtgaggcaggtagagcagtaaaacacggagtatgggagttggcaggaggaagagcagggaaggggagggagtgctgggtttcagagtcagacagggaagtcctcactgagaaggtgacatccaaacgaaagaggttcaggcagagaaaagaggaactgcaagggccctgaggtgggacggtggctggcatgctatgtctgtccacagaactacaagacaggatgtgattggagagcaagccagggctggggggacaggggacaagctcagagagatgggggaccacccaatgctgtgacaacccagaatcccaggaggaggaggagaggggactgacagtacaagtgagactagaaatccacaggcacgagctgccttccattgctctgcccttctcagagcctccgcgtcgaggggatttgggcattgaggcatttctggaggacaggcttctgtggccactgctgccacagacttccctgccctcagcttgagttgggtcagacgagcctgtccatgtgaacgtggaaacatttcctgccagactatgctgttgccaccacacgaatcaaaccagcaaagggcacgccggcgatgtgcatacagctgtgtctctgacagctgcctgggcctgcctgctgttcccacgggtcagctcctgtcgggtagggacaggtcctgctctcaaggctcataaagcagccagcagcctgcccgtgttttccgtactctggcctgtgtcacccaggctgtctcctcatctcttgtctgatcctcaagggttccctggcctccctcttcactccctctgcctgtggcaggcagcagcacagttctatggggtcctaaggaccccagggagtcactcccacatttgagcagcaactttgggtttagtctgtccaggttagggccccagatcatatatatgtgtgtacacacacgtgtgtttgcgtgtcatgcggcattcggatggggcatcctgttcatccacccccctgctatggggtggctgaaggttggggtgccctctgagtttttggtgggtggggcttcagcagggtgtcttggctacctctcctggccagcacatgttatcctgggaggatttgtagctttgggcctgaccacggttccaagcaccatgatctggagcccacactgggtggcaggctgcagagaaggtgcccccagaagcctggactgcacccttatctgttttcatttggagctattttctcattatctcatgccaagtgtctgactacacatggcagtccttccccaagtgtttgcagcttcatcataatactgttaattgaatggaatttgtcattggccagcttctgtggaccccattcaaggctgagtggatgctgggggcgcccagctggccttgctcagaggggtcccgagcgtcttggtgcttcaggagctgagcccccctcaagagcattgatgacaagagctcagattctcagaacccccctgagcacccagacaaccttggtggttacttcttcactttttcgcatgacctggaaaggagatgagacggggaggagaacataggcaaccagaaggacgtgcagcctacaagggtcgtatgaaggtcagaggggtggctgtgatggcccagagctgtggggtctgagtgacctccagcccagaaccgcccagcaggccagtgctagtcatgccagcacttccaaacccacttcttgactgaccttaagaaatgggaagttttccaactgttggtcacatttttaattgatctaacctgcttcatcttcccagacaagtgggttctttcccaacaatgtaaacattaattcagatgaaaacaaagctctgtagaagttattaatatctgtggctctgctcatgggagcctttctcttttgaggtaccagaaagaggaaggcctaaacagaactggagtgtgggagagtgggcgggctctctctctttagtcatctgtggtcaccccccacccccctgcgctgtgcaagcctgataccatggaaagggaacccacatttcaaatagctgctgctgctccggtgaacttggggtaagggagctgaggggtgtctaccctctgcaccagactcaagtctccctcctagaataggagcgagaatagcagcaagtccctgccccctgctccctcgttttcctggaagaaatgcctacctaagacacagacacctgcatcccacgctttgtcacccaatgcctgtttccttaaggagaaaaaatgggcgccagaaaacttctaggtctagatcctggctctgttgctcgctagttgtggaactttggacaggcgacctcacccttctgatttcactttccctggcctcactcttcactccctctgcctgtgggcaggcagcagcatggttctgtggggtcctaaggaccccagggagtcactcccacatttgggcagcagctttgggtttagtctgtccagtttagggccccagatcgtatatgtgtgtgtgcacacacgtgtgtgtttgcgtgtcaggcagcattcagatggggcatcctgttcatccacccccctgctttggggtggctgagggttggggtgcccaacaggtagaatggggttgataatagcacctgcctcgcagggtgatggtgaaaataaaatgagccatggtgatttaagatgcccagtctaggttctggcctttacttagttgacactcgtggacggttagatggttagagaggcaggccagtttagtaccaaaatgccttcagagtcaggctgtctctgggttcagatcctggctctgccccttgctattggtggaatcttagacaagttatttaatttctctgtgcctcagcttccccacctgtaaaacgaggatgaggctagtacctccctcacagggttcgtggtaagaggatgaggctagtacctccctcacagggttcgtggtaaggctcaaatatgtaaatgtatgaaaagcacttaaaactgtgctttggggtgagctgttattcttagttcctgcaggcttcagctggtttgattgttgtgactaataaccttcgcacctaacagaatgtcttgccggggagtgtcatggcccaaacaggaaggtggcagcggaaaaactccattactcaagggcctttgcaagagaagcaaaactctacttcctcagcttctgtgggtttttaaatcttttttttcaattttaattttaatttttttaaaaaaaaagtagaaatgaggtgttactatgttacccaggctgatctcgaattcctgccctcaggtgatcctcccaccgcggccccccaaagtgctgggattacaggcatgagcctctgcacccagccagcttctgtgtttttaacaaaccttgctcgggctctgcagatacagattctgggtctggggtgaagtgactagcatttgtgtggcagtctgtgaatgagatgtcaagcagcttccgaggtaacagacttctccccaggttcagtgagggagactgtacctagcctgtccttccagaggctgctcacactgccaggctgtggctggcctgccaaggggaggatggccctccacacctcggcccacctgcccttcacctccagccagggcctgcctgtccatccacctgtgcctagctggaaaagctggcttggagcagtgctgcccatctgccactgccagcccccagcatctgccttattaaaatgctgaggctctggctggccacaagccccaggagatttggagaaaagccagacaaaaaggtgcaggctgtgccaccgcccagccacactgggtgactgcccttggtagttaaccacagagtcatccagcttggctgcccagaggtctatagctccactcaggcgaagctggctagcctggcctagcctggctggttaggtgggcaggacagcctccacttgactgattttttttttttttttttttttttttgagacagggtttcgcatttctgcccaggctagagtgcagcgatacaatcttggctcactgtagcctcgacctcctgggctcaagtgatcctcccacctcagctgcctgagtagctgggtgcaccaccactcccggctatttattcatttggtagagatgaggtctcactatgtcacccatgctggtctcaaacttctaggcgcaagcaatccttccaccttggcctcccaaagtgctggaattacaggcatgagccaccatgcttgactcgtctgactgatgttaggcaaccttgaattgatggtctcctggtgaaatgagggttcttgttgacaaggcaggtctggccaacacatttttgtatgattatctgcacgattgcatcagttattagcaaagaaggattttatagcagcaggtgtgtgctcatgtgcttgtgtggagttgttgactgcccttcactgcacacacacagtctgcggaactgtgactgaatccctgttccctactcacacttacatggtattttctgggattctaaggcacattctttttttcctttcctttttttccatttaacatcttaaattggaatgtgtcgcacatttgcggattattataatttgacagcgcctttttcttggcatacttgaaataacggtgcattgtaaaatcagaggtgtctcagatttaatgaaatagaaactaggtaacctctggggaacttatataatttgtccagttcctccaaggatgcaggtggagccaccttgtagtggtggcagattatatgaggggaccctgatgtggttcaaggggacaaccttggattgggcttagattccagctttatggctcgccagctgtgtggccttggcaaagtagagcgacctctctgagcctcgggattttcctcccaccacatatgaatcgtggctccacagttgtcatggctgtgtgcaaggcaacattccctgtttctcttgctgggtatcatctaaggtctgccccgttccatctgggttaagagggaaaatgagggctgggagtgggtcactggccttcccaagggagcagagggaaactggtgttccaagggcttcttgactcagtttataatccttggacattactcttcttccctcgtccttctccccctttgcctgagttttcattttcacatgtgtttccttttagcaattttctttcaaatctctcctctccctttctgtaaagtcttcccacatgtagcctctttgaagctccctggggtgggaaaggggaggagggctctgcctgatggcctggatggcacagacctcagaagcccagtgtgctgtggtccctgcaagcttcagctcaagtccaagttctggtaccatcagcgttgctaactgccattcctgtggctgcagggtcagcctgagtccactccagtgcacagtgttgtccatggggtgctggatgtcgcatcgctgagagcatttggtattctctgtaccctccttgctgcgttaaaatcagacctggttcaaatcccagccctgcgacctttcacgaattacttaacctccttgaacctgtgtattctcatctaaatagtggctgatgcacagaaatacctggcacacaataggtgcttagcagatgcgtgctttccttgttctcaaatgtttaagacccctttgtggacaggcacgatggttcatgcctgtaatcccagcactttgggaggccaacgcgggcggatcacctgaggtcaagagttcgagaccagcctgaccaacatggtgaaaccccatctctactgaaaatacaaaaatcagcccggcgtggtggcaggcgcctgtaatcccagctacctaggaggctgaggcaggagaatcgctggaacccggaaggcagagcctgcagtgagccgagatcatgccactgcactccagcctgggcgacagagcgatactccatctcaaaaacaaaacaaaaaaaaaactgctttgtgcttgtttaggtgttaaggatctcggggagtgccagccagtggcactgctcctgagacagacggaggagttctgggcagggggcagtggcaaaggcacaggggcctgtgtgagcaggatgtgtcaggggccccgtccttcaggatggctgggctgcagtggggtgaggcaggacggagagagaggaggaagagtggtggggtgggcacccagtcggcacctacaggggtgcacatgacaaggctgcacagggtctggctggagcagtacagagggttaggtgtgggctgttcatggaagtcggggctgagttggggaggcaccaggagacagccacatggggatgtctgggtgacagtggcccccaagcaggggctgagtgtgcgctgctggctagagggaggctttaagagcaggtgatggttttaaaccttgttttccttggagatcttctctctgccccctccctcttgagattccaatgaaagccagtagcccaacctcctcagttttgtgtgtagtgtcagagattcgaagccccctctttgatgaggtggtgcttatgccccctgtgcataagaagcagcatgtgctgaggcattggggtgggtaaaggtgcccaggagcctggggtactagggaaggggagaggcagagcatgtcctgaggctgagacctgctggaaggggctttgcgagctgctctcaggagctgggcctggttctgtgggcagtggggagctcacaagctcttagagggggttcccaatggactccctgggagggagagtctccaccccatgagcccctaatgccctctcacctgtccccactgcgagaaagcctgccctggccggaggccctaagctgagctctggccagctatgcttgagtgacaccccccaaccccccatgcaagacagcagcttctggaacacgaagcttgggtagctgggtctagcaaaggccacaggacaaagagagacacctgaactgagcttgctgggaagaccatgggggctatgtgctgatgggaggtaccagaagatggggcagggaggaggagagggttataaaaaccaagggctctggcaggaggccctgcagggttgggaggaggagagtcaccctgctgaccctgacctgcctgctccagaagggcgggtcacgtggagccttggccattggctgtgggtaaacatcggtgctctgctggctgttcaaggcctgagggttctgtggcagaggaggagctgggtgggaacccaccctggctttggaccgtgggtcagctccatccaggcatgctctccttgagttggatagtggcctctctctggaaagttccatgtcacctctttggagggtgctcccctgaaaatgtagcctgacctacccggtggactctacgagaagaaagagctggcctgagccactgttttccctcccaaaccttcactttgagtgaagtgtttttatcatcgctcctcttatcatgatggtaaagtatggagcccccaaagcaagccccacagactcttggttgtgtgagtaattaagccctctcttcaaaaagccacatcttgaaaagctataatttgtagcaaaaaatagctgcccgttccaagaaccaggagagccctttatacgcaccccattcaactgcagcacgttacttcgcttttgagttgagttgctgggacctctggtccatgcttttcttgggggaaccagagatgcagtggctgcatgggaactggagcttccggtaggcatttgggaaatcttttctgagaatttagatgggacgatttaaattagggaactcctgatttgggtttgcatggccccaactttttgtgtgactccaaaggggagtaaagagaaaaactgcaggatacttcaggggaaagtggatgagactctctggacaccattcccccactttttcttttccttcttcctttctttcttctttttttttagatagagtttcactctgtcgccaggctggagtacagtggcacagtctcagctcactgcaacctcctactccctggttcaagcgattctcctgcctccgcctcccgagtagctgggattacaggcacgtgccaccgtgtccagctaatttttgtattttttagtagagatggggtttcaccatgttgaccaggatggtctcaatctcctgacctcgtgatccgcccgtctcggcctcccaaagtgctgggattacaggcatgagccaccgcacctggccacatttccccatctataaggaggaaaatgataattacttgcagggagtttaccacctctgtaaagcacagagcagactggccacatggtaggcgccctagtatgtcaactttgttctctttctctgagttgtggctccactagctatttgtagacaggagatctttgtggcttcaggtaggtgatgggggactgaaagctaagaggaaaagcctcccctgacctgcagcttctctttgagctggcatgcctggaattcttggggctggctgctgggtttgttttccagatgtggaagcaatttaagttctgttttcttaatccccaacagtttgcctccgaagtccacattctcatttgaaaatcaaggccgttggctctgtttgcagggcagagggtaggctagatagcctcttcaaaccctttttgtttaggaaatgggcttactggggcactcagatctgggacccagggcattcttgggacagtcacaccccatccaggacttggttaaaaggtgagttcactttctctgtgggttttccttggagatgattcactgagctaaattcagctgcaccttggttacaaaccagctctagaccgctgtggagtggcgggggtggggctcgggtttgggccatgtcacaggccagctggcgtccctctgagcagggtgcccacgtgtcccgggggcagtagcggccctccttcccacactgaccacaacagagggaggaaaatgctccagatgtcaggtagccagaaatactgtctggcacggagaaactggtaatatcttgttcagttactgagcgctgctggtcacagaggcagcctgacccaggataaaaggctccttgtgtgagggcctgtggctccagggctaactgctgatttattctcttgtaaagcaatcgctgtgtaggtaaaataccttttacatttgtcttataactatactaaatacagttttgggcaaacaaaaattgcctttgcaattctaacgtctctgaactgtgcatatgcttctctgaaattgaaatagaatacttatactactgagagaatgcacaagaaaatggaagtggctgggcatggtggctcatgcctgtaatcccagcactttgggaggctgaggcgggcagatcacgaggtcaagagatcgagaccatcctggccaacatggtgaaaccccgtctctactaaaaatacaaaaattagctgggtgtgatggcacgcgcctgtagtcccagctactcaggaggctgaggcaggagagtcgcttgaactcgggaggcagaggttgcaatgagccgagatcgtgccactgcactccagcctggtgacagagtgagactccatctcaaaaaaaaaaaaaagaaaatggaaataacttacttagattggcatatagtgtttatagaatgccatcctgataatcatagattcaccaagctttgatttcaacaaaatatcatctcttaagaagtagcagtatttcaaactaatcgtgaaagagaataagagaatacaacttttttttttttttaggacagaccaaaaataaatccctgagtctcttgagtaggttctggaaatccagttacagatgctccttgatggggttacgtcctgataaacccattgtatattggaagtatcataagttaaaaaaaaaaaaagaaaaaaatgcgtttaatacatctcacctaccaaacaccatagcttagcctaggctaccttaaatgtgcccaaacacttactttagcctacagttgggcaaaatcatctaacacagagcttgttttacaataaagtgttttatgtcccacgcaatttattttttgttgttgttgttttgtttgatttggtttggtttggtttttctttgagatggagtctggctctgttgcccaggatggagtgcagtggcgcgatctcggctcactgcaagctccgccttccgggttcacgccattctcctgcctcagcctcccaagtagctgggactacaggcgcccgccaccacgcccagctaattttttgtatttttagtagagatggggtttcaccatggtctcaatctcctgacctcgtgatccgcccgcctcggcctcccaaagtgctgggtgtaatccaccgcacccagcccatcccacgcaatttattaagtactatgctgaaagtgaaagacaatgctcttatgggtacttgaagtatgacttctactgactgtggatcactttgcaccatcatacagttgaaaaatcaaagtgagcccgggcatagtggctcacggtggcctgtaatcccagcacgttgggaggccaaggtggctggctgcatcacttgaggccaggagtttgagactagcctggacaacatgccaaaaccccatctgtactgaaaatacaaaaattagccaggcgtggtggtgggcacctgtaatcccagctatttgggaggctgaggcaggagaatcacttgaacccaggaggggggtgttgcagtgagctgagatggtgccatcgcactctggcctggttgacagagcgataccttgtctcaaaaaaaaaaaaaattgtaagtcaaaccattgtaagttgaggaccatctgtagttctctttaaaggttgaattggctgggcgaggtggctcacacctgtaatcctagcactttgggaagctgaggtaggtagatcacttgaggtcaggagttcaagaccagcctggccaatatggtgaaaccccatctctactaaaaatacaaaaattagctgggcgtgctggtgggcacctgtaatcccagctacttgggaggctgaggcaggagaattgcttgaacccaagagacagaggttgcagtgagctgagattgtgccactgtactccagcctgggtgacagagcaagactgtatctcaaaaaataaaaaaataaaggttgaattgaattgacctttaaaaagttctcttttgttatcagggtgagaaggtgggcgaaaaatccagactgagcttgggttggggtttccatgaagccttcctaggggaggagaagggatattggtatattggtctattggtctgctacggctgtcatagcaaaggaccacagactgcgtggcgtaaacaaccaaagtgtgttttatcacaattctggaggctgaagtctagcatcaaggtgtcagcaggcttggtttcttctgagtcctctctccttggcttgcagacagccatcttctccctgtgtcgtcacatggtctttcctttgcgtgtgtcctaatctcctcttataaggacaccagtcacattgcgttagggcccacccattaggacttcaatttaaatgaattacctctttattattattattattattttgttgtttgttttaagacagagtcttgctctgttgcccaggctggagtgcagtggcactatctcggctcactgcaacctccacctcccaggttcaagtgattctcctgcctcagcctcccgagtagctgggactacaggcatgtgccaccacgcctggctaatttttgtatttttagtagagactggatttcaacatgttggccaggctagtctcgaactcctgacctcaagtgatccacccacctcgacctcccaaagtgctgggattgtaggtgtgagcctgcagttcagcccggcctgaattacctctttaaagactatctacaaatacagtcacattctgaagtactagggattaggacttcaatatatgaattttagagggaacaggattcagcccatagcagaaaagggtcttgggaacctccttcaagggaagggggaagaggaagaggagggtgggcaaagcctggcagagtagaggggaggcagttctgctttcaggcaaaggcccatgggtgagggaccccctggggatggctcttgaccacctgctctatttggaaacatttctaggactgttatgactgtgaatggtcttttagaggccggatcattcttatgacctcagccatccattgccgcttgatctgatcatttgaaaccaagactgctcgtcgttctgttctcatttcatccttgaagctcatgttggtctgttcgggctccagtttctgtggactctacccgctaggatagtattctttcaggatggcttcactttttcatattcttttaagtagagccagacctgtcaggaaaaagcgaataaaccgatcaaaaaatcagcaaaagatccgaatagacatttctgttatatgtaatttatataaatggaaaacaggcatatgaaaggtgctcaacatcattgatcatcagagaaatgcaaatgaaaactataatgagatatcatcccatcctagttaaaataccttttatccaaaagacaggcaataacacttttccttcactagttcagcaaatttggggcaggctattttttcatgtttccatataatgtttactactacttcttttttttttttttttgagacattgtctcgctctgtcacccaggctggagtgcagtggcgcgacctcggctcactgcaagctctgcctcctgggttcacgccattcccctgccacagcctcccgagtagctggaactacaggcacccaccaccacgcccggctaatttttttgtatttttagtagagatggggtttcactgtgttagccaggatggtcttgaactcctgacctcatgatccgcttgcctcggcctctcaaagtgctgggattacaggtgcccgccaccacgcccggctaatttttttgtatttttggtagagacagggtttcgccatgttggccaggatggtcttgaactcctgacctcatgataagcgctcgcctcggtctcccaaagtgctgggattacaggcgtgagccaccgtgcctgtcctgtaactttcaaatgaaccaagtttcttttcaaatgagccatttgaaaagaaattagactaaatattatcaaaactaaggacattttccttcacaactatatgccattaacacacctgacaaaattaagcataattccctaatatcacccaatatctactccagattccatcctccttgtttatcctcaaaaggtcttttacagctggtggtggtttgtttgtttgatctgggatctaatcaaggataatattcggtttctatgtctctcagttaatctagaacagtggtttgcaaagtgtggtcctgggacaagtggcatccgcatcacccgagaacttgttagaaatgcgttttcttccagcctgcctcaacctttagaaatgcatcttccctgtggtgatgtgtaacttctatcccatttttccgtttggtagaagttagatcctaaggcttgatttgaattgagttaaatacttagttaagcccacactataggtgatgctgtgtacctcttaggcatcgcgttgggaggccagcgcctggttctttccaattagtgatgctaaatttgatctctgcattaaagggacagtagtctgtgttctccctggtagaggtatgtggggtgctttggtgttttgcagcaatctgtagggtgattcttcggtattgtgcaagtatctagtttttcattagcctttaatctactggtgttattctgcagttgttgagtgtagtgttctgtatgtatcagtctggagtttgtgttgttctggtcttctgtgtcctctctaattctcttgtttgcttattccatcagtaataataataatatataataattattatatattaatatataattattatataatatataataattattataacatataataataattataatatataatatataattattatattatatataataattatatattatatataattattatatattatatataataataattataatatataataatatataataataattatatattatataataataattatatataatatataattatataataataattatatataatatataataattatataatacataattattataatatataataattatatataatatattaataatattattattactattattaaagacagaatcttgagctctgtcacccaggtgcaatcatagctcactgtatcctcgaactcgtggcctcaagcaatcctttggcctcagcctcccgagtagctgagattacaggcatgcaccacctggctattcttttttactttttttttttttttgtagagatggagtctcattatgtttcccaggctggcctggagctcctggccacctgccttggcctcccaaagtgctggcattacaggtgtgagccacgttcagcatgttccatcagtttctgagagaggtgaattaacagctcccacttcccattctgttaagttttgctttatgttttgagactgttagatgcatagatataaaagtgttacatcttgttaaatttcaattgtgtttcttgtaagtggtatgtagttgtttttaatttactctgacaatattgatcttttaataggattatttactcagttttctttaaaagtattactgatgtggtagagttttaatcctacataatctttaagtttttaattgacatacaattgtacatatttagagagtacagtctgatgttttgatacacatgtgtattgtggaatgatcaaatcagggtcattagcaaaaccatcacttcaaacacttgtcatttctttgtggtgagaacattcaaaatgctatcttctagctatttttaaatacacattgttgttaattgtagtaaccttactgtgcaatagaacaccaggacttagtcctcccatctgactatagcttcgtgcctgttgaccaacctttccccgtcctcccttctcctaccctctccagcctctggtaaccaccattctactttctacttctatgggataacttctttagattctacataggagtgagatcatgctgtttgtccttctctacttggcttatttcacttaacacaatgttctgtaggttcatccatgtcacaaatgacaggattttattcttttttatggctgaatactattccattgtgtatatatacaccccattttaaaaatgcattcatctgttaatggatacttagttgactccatattttggctattgtgaattgtgcttcaataaatgtgggaatgcagatctctctttgacatactgatttcttttcttttgtttgtatacctagtagatgaattgttggatcatatgatagttttaaattctttgaggaacctccataccgttgtccataatgattgttctattaatacttacagtcccaaccgggcacagtggctcacagctgtaatcccagcactgtgggaggccgaggtgggcggatcatgaggtcaggagtttgagaccagtctggccaatatggtgaaaccctttctctactaaagatacaaaaaattagccaggcgtggtggcatgtgcctgtaatcccagctactcgggaggctgaggcaggagaatcgcttgattccgggaggtggaggttgcagtgagccaagatcgtgctattgcactccagcctgggcgacagggtgagactccatctcaaaaaaagaaaaaaaaggttacagtcccattaacagtgtataagagttcccttttctccacatccttgccagcatttgttattttctgtctctttgatgatagccattcttattagggtgaggtggtatctcattgtggttttgatttgtgtttccctgatgattagtgatgttgaacattttttcatatacctcttggccatttgtgtgttgtctttggagaaacacctattcagatcttttgcccatttttaaattgaattatttgtttttttgctattgagttgtttgagttccttatgtattctggctatcagtcatctgtccttttggatgattcaagcatttttttattccttcatttctctcatctattattattattactattattttaagatatagggtctcaccatgttgcccaggtaggccttgaactcctaggttcaagcagtcctcctgcctcagcctcccaaatagttggggatacagccatgcactgccatgcctggcttagatttttagtaatatgttttgttttattttattttattttattttaactaatttatttttagacagggtctcactcccgttgcccaggctggagtgcagtggcaccatcacagcctcgacttcctgggctcaggtgattctctatcctcagcctctcaagtagttgggacaacaggcatgcgccaccacacctggctaactttttgtattttttgtagagatagggtttcaccatgtttcctatgctagtttcaaactcctgggctcaagtgatccagccacttcagcctcccaaagtgctgggattacaggtgtgagccactgtgcccggcccgtttttaactcccaacctttgacatgctcacttgttattggaacggaagtggcacagtggggagagaggagtgagagcgtctccccacagtggatggctcagctgttcgggatgtttccagtgggatcacaccatggtccagggtctggtctgcatcctaatgggcttgaaaaccagatcttactggcttttcccacaccccacaacttgagtccactcatgctcactgattgtccctaaatggacctgcagagccagtggatccccttgtggtgagaaatgcactcacatgagcttgggcagcccttctctcctgtctgtcagcaggcttctgggagtgggtgctacgtgaacttggacacaggggccaagggctggacaggtgtggaatgttgagccaggccccaccgcctttggggcaggctggatgtgctggccagccagacctgacacctctggccagtgcctgggtgcacgcggcccgggtcggcctcagaccctccctcttggtgcttcccaggagaccactcgcttagcccctccctgaggacaggctctgtctttagatcccttagtacttcagtccctctgtcagcctcaggaaatgtgtgcatctctcttagttgagctcccaggaggttatctgacatctctcatttctgagtctttctgggagcctcagcacacaccccgcttcctctctgtgggctcctctgacgctgccttatcagcagtgtgtgtgttggggtgaggttgtgagatcggagagagagacagctcaagagttgtgatgaaaacactgaaagaaaggcagtgtgggcttcagcagcccttcctcggtgatgtttgtgcagcagcagaacttgttgagtgaccgcctttgctttatgtaaatgtcatgagttctggagaaacacaagcatggctttcgctttcttttctgttcagcaccaacctgaggttccacagccagtgtgtgccagatccagaactgaaccaaatctgcccaagagcctcagtctccacatcttcaagcccaggagtttgaaaccagcacaggaaacgtggtgaaaccctgtctctacaaaaaatctgtaaaatagggtgatttattacctccctctgggggtgatgcaagaagcctgcttgcttctcatgtgaaatgaatgagcacctggggaaccccagttgtcccggttgcccccgctcctggggtctgcaggcccaccttaggatggaagtggagcgcagcaaccaggtgtctacacaagatccactcctagaagctgcagggcgggagcagtgggccctgctgaggggtggtcttgagctcctggccacaccctttctggggtgagtttcaggaggtggatccggggcccccggctgggagaagagagtctggaagctgccctgccttggctgccatcccctgggagggagtttagctggaggaatggggcactgggtccctccctgacaccccggggcctctgagccactctggggatggaacgtagcagtgcagcatttcttcctgatcagagcgggaagctctgggctgcagagctttgatctcacagtatgtggtcagtccccggggctggctgaggtgtgggatgatccctcgtgacctggcgacctggtgctcccatgcttacccctggctctgttggggtgagccgaggcctcatgtctgagctgaggttgcttgttgttcagaaggcaaggccgaggcactgcctctgggtggatgcttgaaccccctttatcccacccttgccttggctggtgcctgggcaactctctgttgaaccaaaacctcttatcagcaactgataagtacccagccttgcatctgcagagcaaggcctgacccagagccagggttggcagctgcagcaggagtccgttacagccaagattgcgtaccagtctctgcggccaccaccttttcatgatgagagcagccaagccacagtggggtgtggaagaccccagccctagcaatcacatcccttccctgtggacctggggacattggcacctatgagttagctcagtaagctgaatttcctgctgcccataggaaggaccccgtgagaccttgacctggcccatctcgttccagagctgttggttggctgggagtggggtgagagattcatcacaggcctagccctggcaaccgctggactcccctacactaggcttagtgtgtgtccacccccaccgcacacatgcacaccttcccagcggcagcgctgcacgtgtgcctgctggtgccttgctgcaagggaagtgggcatgtgcccgcccaagctatttttaccctgccttgtccccacagagctgttctttggctctgagttagtgcctggggaatgaggccgttgccagggctgggggtggatgagctggaacctcggagcttcttggactcccttccccaggcagcatctcatcttaatgcttactaaagggtgtgactcgtgtgcagggcgaccttccataagagtgggcaggagaggaccctggtggggagaaagaggcactgatgtttggagggcaggctctggaacctgcaggtctggcttcctgcagccaaaaaaacccagccgagctgcagcccagtgagccacggtgggtagagggagaggtcccaggggctggatgggagccaggaggccaggaggtaccctggattgttttccttcaacacaatgacgacaatagtagttcagttttggggtgtggtggtgtgtacctgtagtcctagctgcttgggaggctgagctgggaggatcacttgagtcctgggagtttgaagctgcagtgagctgtgattgcgccactgcattccaagggtttttttgtttttgttgttgtttttgtgtttttgttttgttttgttttgttttctgagcactttctgtgtgtgctaagaccataaagtgcttaggatgtgtagcagctcatttaatcctaatcacagttaactccattttatagatggggaaactaaggcactgagcagttcagtaaccctgaagctgcagagctcatgaatggtgaatggtggagcagggctctggcctggccgtctactccagagcttgtccttaacgccaccccgcgcctccttttgccgtgtgttccgcgccctcatgacacaaggcattgtcctagttccctgtggcagcctgccaggcaggtggttccctccccgtgtttacatcaggcccagaaattaaacagctgatccagcatcagacagtcaggcagtgaccacaccagagtcggcacccaggtctcagggtcctgtggctgtgctgttcccagctcatcatactgcagtacagtatggttccaccacctgccatgtgctctctacagtgctaaccactggggttctgacatgtaaatccccatagctacccacttagggtccttgctctcacagggaaggtggacatgtggtcacttggggtccatgtactctgtgtgtcagctcagggaaacgcagggtgctggcgtgtgcctgtgaggtggctccccatgggggaggtggggagggagaggaccagatgctgcatccgctctgagagtgtggacagtgtggcattgttggccactctgaggctgggacggcccccacgtgtattgatacttggccttttcagcagccctgaattcatcccttgccaacttcctacaaaagaaggggtgacttggggcctgctggcaggcgaacacggctctcaagactggagagggccccacggcaggctgtgtgcctctaggttcccactccctgctggggacagggtgggacagtgggacagcgaggtaggggtgcaggggatgcagacctgccctgccagagtggctggctggatcctgttctccagctctctccagaatgccctggcctcaggtaattcctcagcttggcttctctgaggagggtgggcgtccctcctggctgctcgtctgtccaggacattgctggctgaccagccggggacccatggctgtaggaatagctcaccctctgttgcctgtagcccctcgtgaggccaggtcagaatttacggctcctaccgtgaccgactctccggtgtaaattgtcacgtgtggccccctagagctgccactgaggtggagttgactggccccattctgtaggtgaggagccaggtgctcacaaaggtggtcacttgtccaaggtcacatggcttgtaagtggctgggccagcagggccggaaacccagactgctaggccccagagctgagccctcacccaagcccacccccaggggcctcctggggcttctggaggaacacgctgctgcatccgctctctcccttcaccccggggtccgctggcaggtggaagaaagcctggggtggtgtggccatgtaccagccaagcctgtgggcctatggtggctggccctgtgtcccagggtacagggagctgtgagctcagggctggctctgggtcttgagggacagagccctggcaagtcagactgtgccagagacgatgcccggtgctgcctcctgaggataccacactgtcccttccccaaaggcccccaaaagagcagacacagcctttctgtgcaaaccctgggaacaccaggccaagctccaggcctggacatgtgtagggtccctgggtggtgactggacggccgtgtgtggactcctttttcacacagcaggcgggaatgggcaggaaaccggggctctgagaggcagtcttggaagctgccctgggcacagaccttacttgctgaccccggccacctagaaacatgagctctggggaggccctgtccctgccccaccactcctgccagccctccagagccaggcttgggtgggcgcctctgtggtgaggatgtagaccgtgcagctggggtgagcgggcagctctctgggcatcctgacgagcatagtgcggtgaggtggggtgatggtatcctctcccatgacccccagtctacttggaagtatgctcaacagggggctccgcgtgattcttacctgcaggcagcctggccggagaggaacccaccgcctccagaagtctgtgacccccaggccatctggaaaccttatgagggcaatgtttttattatggccaagttcttccttttcctctgcaactttatctaaaaaacatacaaaagggaaattggccaagaagagtcctagtatgcttgactccgagttctcccagcccatgaatggtggctcaaggagagagaagaggctgcgttctggcaccttccagcatctcccctccaggccggcgggagaaggagcaagggcttccaccagacccttccccagagggccggggaaacaagagctggggctggggactttggccctcagggaggagcaagggtgaccatggcaaataccaaaccaaggggatcttgggacaggcataaaccagtactgtcctgggctaaccaaggcgtgcagtaaactgtctttattatatttgaatttagggggcaaactactagaaatggttttaaagttataattaaaatttccgattgccttggacaaacaactgtgggttgaatgaaaaagtattaatgttgggaatagccatttttaagagaaaaagctggagagagtgtgtgcgcatgtgtggccaggcaggtgaggacttggtgtgtcagccgggtgtcaggtccctgcaggccctctgtgaactgcaaggttccagggcagccactctcccactctgagcctcatcttccccaggtgtcagacggagctgatgaatcccagatctctgccctgtctaccccaggcagctcgcacggggctgttgtgagggatggggtgtgtgagacaggcgaggagcttgctgaagggctgggcagatgtggactctgcttagtccaaggctgaaagcctgcccgaggaggtggtggtcttctttggagggtgggaacctggtgcccctgcttctgccctgcctgtgcctgagccaagccatttgaggctgctctctccacccggtcaggggcttgggccagctgctgggagtatcaggacgctgctgtagatgttgggtgagagggcccggtggttccacctgcatgtcatgagccaggtgttagtggggcagtgcccggcacacactcggcctctgtgtcctcgtgtcagtggccagaggccacgtcagacacctgaggagcaaggacgctgatctgcactgggccctctgcctgcctctgggagctggtgggccatagcctccccaggatgtggctgtagggggaaggtgggtgttggggaaacagaatcatgtccggacccggctgtaaactcccacatggccccaggcaagacccttcacctacagaaaggggaaaagaggctcagctcatcgggctgcggtgaagtccagaagaaacaccattgccaagttgctgagctctcacatgagccacagggcgggcattcccagcaagggggaactctcgctacccgtgtggccaggaaggtgaaaagtttgcagttcttcctggccaggtgaaagaacagaccaggcgcattgtcctctgagagccccaggtctcttctggtctccctcctgccttgtttctcttaggtgtccccgcactaacctgcagtgtcctgtgagggcgttaagtggatggacgtggaagttgctgcgttaggcggcatgctaaggagtcataattagtcacatgtccctataaaatgtgctctccttgttgtcaccatgaggtttgaaaatccacaaagtgtgggaggtgtcaaggataaatggaatcaagtgtgtggatgcaaaggcaggcggggtggggggccctgccctgccctgccctgccctctggctggaggacttctgatgcgctactctttgagcctctgtttccccatcagtaaaatggggataatgatcactgccctgaagagctgtcatgaagcacaggtgggataatatgtgaatgcccagctcggtctctggaacctaatggctgctcagtgatgctggtttccttttgtttctactgggatgcagcttcaggcttggggatgaagagcttgcttagggcacaagatgtgataggttgggagccatgtgaccagattaatgacatgtgggtggaaggggccctgggaaccctggggggattctcattacacaacctcagtctccacagtctctgctgttggcgtgcccggctcgctggtgtacgtgttattggtccatctggtgctcagcctatcacagcacaggcaggaaccaggctcatgataatattgccatctatttttagcccaggggtctcctggtggggacggacccccaggagggctgccagctcactggtagcagcagacggctgcacatgtctgggcaggcacatccaggcctgtcgctgagcagcttcttcagctgtctgagactccaggaggcttttcacagcctgtttctgttgcccttcttgtagtctcgggactgcagggtcctttaatagggtgccctgccagccctggctgaggagcacaccaaagaaccttgggaacaggttgacatctccaatgggtcaggtagaagcggtgccacctgagaagtacctacttcctcagaggtgaagtggccccagtaagtgatttacagagagctgcccctcggtctagggccaactctgaaccaggccgaagctcttctatctgatgatttaacaaaaggtgccagcatgtctttatcacacactgtcattatgctgggccccagacccagcacaagcaacgctcagaagtgaggcctggcattcttgctcccagcaaggctgtggcagggcccagacaggcagttgcctcctgggctgggcatcacatcttctggccagggtttattcattgaggtcctactgtgtgtcagatgcgaacgtgaaatacctcatttaatcagcacagtgatcctgtaagattccattgccattcctgatttacagaagacaactgaggttcagaggtgttccatgatgtgcacagggtcatgtagggtggatcccaagttgtgcagctttcactgcaccatgtggcagcagactctactagatcagggttgttggtcctaaaagctgttcagtgtgactgtgcccttacaccgtgcaccaagaagccttctagaagccgtttggcttcctctgacagacttttgtggtggttttaccagtggagggtgtccaggttcttagcgtcttgaacaaaaattggacaaaatgcacaaacaaaacaaagaatgaagcaacaaaaacagagatttattttattttattttttgagactcagtcttgctctgtcacccaggccgaactgcagtggcgctatcttggctcaccgcaagctccgcctcctaggttcacgccattctcctgcctcagcctcccgagtagctgggactacaggcatgcgccacctcgcccagctaatttttgtatttttagtagagacggggtttcaccgtattagccagggtgatcttgatctcctgacctcgtgatctgcccgccttggcctcccaagtgctgggattacaggcgtgagccaccgtgcctagagatttattgaaaacgaaagtacactccacgggatgggagcaggcccaagcataggggatcaagaacctggttgcagaattttctggggtttaaataccatctagaggtttcccattggttacttggtgtacaccctatgtaaatgaagtagtggcccacagtcagtttgattggttgcaggaggggaccaatcagaggccaaagtgaagttacaaagttacaccctatgcaaacatctgattggttgcagaaagcaatcagaaagcaaccaatcagagactaaagtgaagttacaaagtgatattcctatgcaaattaaaacttagcctgtgaccagcctgattggttgcaggaggggaccaatcagagatactctcagtttttcatctgccaggcagaaaaggttggggggcgaggaggcggtgcgggggggggggcggtggggggggcgggggggaaggggatgcaaagggagtagctacttgggctcggaaaattggggttttccttttgatttagctctaggaagtcagtgtgaatcagccttatgttccctgcctccagaccctattctgcctcagtgggggctctgatgtgccaaccagggtgccctgaataaagtggctagcctgactgtggcccttcttcgtggatggctgttcctgggagttctagctcctcactagatgctcatgagtcagccagtatgagaggtccctgggactaatcacctgccaggtgttcccacgcttagggttcgggatctgggcctcctgtacccaatccctgctgttttggcctggctgatgcccttgtggtctgattggaacactgagccctgggaagctggcctcacttatcttgtctctgctctctctttcccagggcagcgaggtcacaggccccacctttgctgatggcgagctcatccccagggaacccggcttttttcccgaggacgaggaggaggctatgacgctggcgccacctgagggcccccaggagttgtacacagacagccccatggagagcactcagagcctggaggggtctgtcgggagtcctgccgagaaggacgggggacttgggggcctgtttctgccagaagacaagtgagttaaaaccacctgaagctccatatttgccctctcagcccagaaatgtggttcttggaaagtgtctccaggaagtaaatttgaaacatgctcaaaatttgtatcagaggcattagtgtcatgggtattctgaatagcacaagattctaagcagactaaatgcttaacagtaagggatagttttggaattttaggcagctgtgcaaagtcaagtttttaaatttaattttactttattttcagtcctagctgtgcaggcaaagggagttttaaatgactagttaataatatgagatatatgatctcaattagttttaaaaagcaggttgtggccaggcatggtggctcacacctataaccccaggactttgggaggctgaggcaggaggatcgcttgagcccaggagtttaaggttacagtgagctgtgatcacatcactgcactccagcctggcaacagatcaagaccctgtctcaaaaaaaaaaaaaaaaaaaaagggcaggttacaaagatgtccatgagatcagctttgttaaaaacacaaacatatgccaggcaagtggcatgtgcctgtagtcccagatacttgggaggctgaggcaggaggatcacttaagcccaggacttctgggctctagtgcactatgccgatcggatgtctgcactaagttcagcatcagtatggtgacctcccgggaatgggtcaccaccaggttgcctaaggagggatgaactggcccaggtcagaaacagagcaggtcaaaactcgagtgttgatcagtagtaggatcacacctgtgaatagccactgcactccagcctgggcaacatagcaagaccccatctctaaaaaaaccaaaaaacaacacacagacatatgtgttaggaaatgcctagaaaaaaattaatctggaaaattaagcagttatttctgtatggtgggatgattttttttgttgttgttgttgttgagacagactctcactctgtcaccaggctggagtgcagtggcatgatctcacctcactgcagcctccgcctcccgggttcaagcgattctcctgcctcagcctcccgagtagctgggactacaggcgcgtgccaccatgtccagctaagttttgtctttttttttttttttttttttttttgagacggagtctcgctctgtcgcccaggctggagtgcagtggtgcaatctcagctcactgcaacctccacctcccgggttcatgccattctcctgcctcagcctcccaagtagctgggactataggtgcccaccaccacgcctggctaattttttgtatttttagtagagatggggtttcaccatgttggccaggatggtcttgatctcctgacctcgtgatccacctgcctcggcctcccaaagtgctgggattacaggtgtgagccaccgcacctggccagttgatcattttaattacttcccatctactctgctatattttctatattgagcatgtactcccataatcagaaatgttatttaaaaacagtattaagacctaagtgacttcccagtgaagcagtttcacctttaactttggtgttggcagaaaggagtcccttccatctcagccctcaccaagtctctcgagggatacagtgctgtggggtggtgggaagctgccaccattgtggctgaggaagccgagggggttgcaagtggcagccccttaccagaaggtgatggttacgactgctgcagggatttggagagggaagagaggggttcccatgttggttgaaccacatgaaattgacaacttttaatcatttccatcttcaaaaaagtaatttcatgtggttcaacctagtatatctcaatgcagggtttctcaaactcaagtgattctcagagtcctgatgttcttggtggggccctttgggtctgtggatggagaagaggggccgtgctgctcgtgctgctctctgggagcagccttgtaatcccagcagtttgggaggctgaggcgggcagatcacctgaggccaggagtttgagaccagcctggccaacatggcaaaaaccccatctctactaaaaatacaaaattagctgtgcatggtggcaggaggctactcgcagctactcaggaggctgtggcaggtgaatcactagaacctggaaggcagaggttgcaccaatgcactccagccaggcgacaaagcaagactctgtctccaaaaaaaaaaaaaaaaaaaagacaaacttaaaaaataacacagtataacaactatttacatagcatttacattgcattaggtatgataagtaatctagagacgatcgagtatacaggaggatatgcataggttgtatgtgaatactatgccatttcatatctgggacttgagcatcctcagattttggtgtccacagggggtcctggaacaaatctctcttggatgccaagggatgaccatactcagtcttacagtatctaaaattttagatccatttatattcattttctgtattactccgaatgtttttttttcctctccttaaagtgaaagcaagtttattaaggaaataataaaacaatggctactacagaagcagagcagctactccgaatgtttttttgtttgtttttttgtttttgttttttttgagacggagtctccctctgtcgcccaggctggagtgcagtggcacaatctcggctcactgcaagctccacctcccgggttcacgccattctcctccctcagcctcctgagtagctgcgactacaggtgctcgccaccacgcccggctaattttttgtatttctagtagagttggggtttcaccatgttagccaggatggtctcgatctcctgacctctgatccgcccgcctcggcctcccaaagtgctggggttacaggcgtgagccaccgcgcctgccactactacaaatgttttaacaaacctttcaacaactatttgatattccacaatttaataatttactaacattataatttaataattataatttgatctagctgtagctagacaattaggttgtaagcagtgttttgctactgtggagtagcatgggtagaattggtttgaactgtagaaatggtttctgtggtgagatgtttccctttagatagggtccctgaaatgtacttaccaggtcaagagctacaaacttaatcggtagtgccaattaaagggaaatgcctgtcagtttccccaccacgggctgtggctggggacccatgagtcctcctctgacttgggtgctctcggaccctcaggtccctggtccacactccatccatgacgacctcagacctttctacacactccaccacctcgctcatcagcaatgaggagcagtttgaagactatggggagggtgacgatgtggactgtgcccccagcagcccttgccccgatgatgagaccaggaccaacgtctactcggacctggggtcttcggtgtcttccaggtggccccttggtctgggatgtcatttggggtcaaaagttgcagaagcaatttaagcacatcctagggggtgggggggtgcgagtcctgagctggcccttttcctttgtcctcagctacttgagttctgctcctggggcttggggttgctaccttcgcaccctgattaggggtcaggagttcctcctgaattaactgacctaggaggctgcacactgggggccacggggctctgtgtcatcttgtatcctagaacctcagtgttgaagcatccttccaagtgacccctgtgatcccttctcacccacctgagtcaccactttctctgaaatgagctcgcagtttgccttagctgttaaatgggtatgcctcactggcttctctttgagcgtgttggagaagggatgatctgttgctatatttccactccctgcccctcccccgtaacaaggttcaaaggtactggggactcaagtaaagtcagctcagcagggtggtgtagggcaccagactggacagcagttaaggtggtgattcctttccctcatgaatcagtgcggggcagacgcctaggaaaatgcggcacgtgtacaacagcgaattgctagatgtttactgctctcaatgctgcaagaaaatcaacctgctcaatgacttggaagcccgactgaaaaacctgaaggccaacaggtgaggcccaggcccagctggggggtgagaggccggggggccagggcagggcctggagggagaagctacgggcatggcgaggcgacccctgctgtctgggcaggtgagagctctcagaggagggttgatccaggggctttttctgccacaggaaatcaggctgtttcttctcaggaccaagctgactagtgaattcctttcagtgggagggaagagccttgtcctgcactgtggtgtcttacagctaggacagagtaagggagtggactagaacccctctgttcaatgactgtttcctttctctctctagccccaaccgaaagatctccagcacggcctttggacggtaaggcccgcctcgagggagggcaaattgagtgctgtccccatgctgcccactggccggggctccctgccagcagcccggactcagctggtgcccgcatgtggctgagtgagcagaggggaacgaggccatcccagggcagtgcagccagggcagcgtcacttctgaaaaagaggggccagctcctccctgctctctccccaccccttgtcccttcttcaaatcctaggtcaccttgacttcaggcaggcatgccagggatgccctgagagagacagagcaccccacagcgttcagtgcccttcctgcctcttggagctggcagccatactcaataaagagaccccgggtttcctgcaggcggggatctgggcatgagtgtgcgccattggggctggtcactttgctccgattaagtcctgcggcagttcagtgtggccccaggtccacactcagggctctgggagctggcagcaagggcccaggagctaggtgggttggcctcttggcagagaccctggctgctgcctatcagggagctggaaggggatgtcactgggggtggcagctggattttgcctcaggcacgggttagctcagcaggcccagtcccaccccagctcactgctctgcaaggcctggagaattctctgcctttgccatcccccagagttcccagagacgtagcaggagccagcttggtggagaggctcaagcctcaggaggcccagaccctcttccagggccatggagctgggctacctccttgggggcttccccactggaagaggagggggctcacgtgccagctgaggtcactgggtagctgcaggccagcatgctggcgtgaagagggttctgaggccgcaggagaagctgtgcgtcattggctgtgtctgccaggggaccccgggggtctgtacagcccatttgccatcctctgggcggggtgatccgctgagtttggcaacattcttcctctcaggctgagtgagggcagcctccttaaaggggcagaccccctggggtactggatgctcgcctagccagtagtgtgagtaggcccctgtctctggaaggcccctgcagccagacaccctcctcccacccctgcaggcagctcatgcacagcagcaacttcagcagcagcaatggcagcaccgaagacctgttccgggacagcattgactcttgcgacaatgacatcacagagaaggtgggccttgggtggctggagaagggactgaatgcatgcctgctcccaggggagatggggtgcactcaggctactgtctggggacttgggagaccctgtacctgcctaggaattgggggcaggtggccctggtcacgtgttccccactcccccaccccacacatgaccgttctcagatacacagtggtttggaggtcctgctcatgaacctcatggcgtcgaggttctcggttctgtggcctcagaggtcttctccaccccaccccggccccctgctgcaggtaagcttcctggaaaagaaggtgacagagctggagaatgacagcctgaccaatggggacctgaagagcaagctgaagcaagagaacacacagctggtgcacaggtcaagcaggcagcggcgctgggggctcggccgtgacgctggggaacaaaggggggtccatcttgctaagacctccaggaggaggcagcctcatgcctttgcagctctgagggtctgtgacgcatcagcctcttgtcacatggccctgcccacatgtggtgcccaggacaggaccttagggacagggagacaggttggagcttgaccttggctctaggcccaatggattctaccccctgaggtctgaagccacagggctggtccaagatgggagtggggatccactgtgtctcactcatacagtgacaggagcctgacgtcccttcctagggacaagctctgcaggggacaggccagtgtgagctgggcggtgggaagggtccagcactgctgctgatggaggtcccctgagcctgccgttcctgatgctgtctgcagtggtggattcagggtttagttgtcctcaccagatggcatgacccttgggggacataccctggccaggggtccggtcctccaacttgtcacagggcccaaagatgggcccttttgtacaccccagaaggtcagcctggtggaggggctgttgccagtgagacgtatcccagaccgaaataccaaccaggctgtcactggggtgctcacatctacgtgcccctggccctgtcccaggtctggggcagacttcaggccaccagccaggatgtgcctattttgggagtcaaggtgcccaataagctgaattattaatcagaggggtggccgggaaggaacagcacaaaaagaagaggtgaggcctgaggtggttccggccaggtgtggctgcagggactggtgggggcggtccctccctgtgctgccctgagcgccccaccttctgactgccaggcctgcccctccatggcatgtgtgaccgacaccccctctatatgtgcggtgtccccgttcatctctctgaaagctactggcccacacgccctcagtggacatgccagtgactcagggtctcggggcccagggtcccccgtgccacagcctgggttggggtgaaatggtgcaggccccaagagcttgcccattgcgctgtcctcagggtgcatgagctggaggagatggtgaaggatcaggagaccacggccgagcaggctctggaggaggaggcgcggcgccaccgcgaggcctacggcaagctggagagggagaaggctaccgaggtggagctgctcaatgccaggtgggcccctccaccgagccccctccctcagagggaccccctgtcctggggcagccctgtgggataggcgctatccccattttatagatgggaatgtgaggctgaggggcagcctcttgagactttccagtagtaacagttccactttaataccacgagaaacacagaggcatgctcttcaggaagttcgctaaggaatgttcccaggagcgtggctcacatttggtaatgcaaaccacacaaatgtctgtcagagaaaagggcctgggctgggtctcacatccaggcctggagcgccccctgctgtcaggttctcccctgacccctggtggactgagccagagccccagggccaaggtaaatggaaaacccggctcctgtgccttgcgtgtacctgtggcttcgtcattggaacgtgacgcaggcgggacaaggagcagccccgggccagggatctgagttggtctcccattagctccatggccttggacgtactgggtcacctccctgtgtgccccacagagcggctgtgtgggtgggtgagccgatgtaagtccagaccctgcccacgggtgagggctatgatgatgcctctgtgatgaagcccctttgcggcccttgaccgaggccgaggaggccgcctgggcttctggcagagaggacagctgccctggcactcctcaggccccctgaggccccagtctccatgctgaggcttcccagagttgccgagccccacctggcggctggtgggctgctgagcaaatgactgggagttgggctctcaggcaggtacctccctgcccccgtgtccctgcccctgtgcagtttggtgaggagacttcccaactccccggtgtctgagacctgctttgctaagttacccaccaggggttcattttacattttgactctattctagaagctgctgttttgcatctgtttctggaggctggtgcctagttaagggtgactgctctcgctcagcccgcctcggcagctggcccaagagaggtggctgggacacgggaggtggtaaaagacagtgtgaacctgggccacaggacaaagtgcagaaagccagccctcgggaactgtctcctaacgtgtgcccgtcacacagctccgggggcgccattcgtgtaaaatatccgagtggtgttcccagagtcctgccgtatgcttggttccctaccacttccacccgcttggggccacctgctggtggtggggctgaattcctctctggagcccagagggcagtggaggcccagaagccatccttccaggaaagaggacatgatggggaggtggtgggttgagaacgggatgctctgcaggagtcactgccagaagtgaccctgttcagttctgctgccaccgacggcccaactcacctgcacctattctcagaccatttaaaactgacctgaggccgggcacagtggctcacgcctataatcccagcactttcggaggccgaggcaggtggatcacgaggtcaggagatggagaccatcctggccaacatggtgaaaccccatctctactaaaaatacaaaaattagccaggcgtggtggtgcgcgcctgtagtcccagctgctcgggaggctgaggcaggagaatcgcttgaacccgggaggcagaggttgcagtgagctgaggtcacgccactgagactccgtctcaaaacagacaaacaaacaaaaaactgacctgaacacccaggctctgtcttcttgtggaatccctttaggattccctttgtggaattcctgtgtgaacgctaacacagaggattattactgtcagagcccatgcctgtggtcatcagagggaggtgcagtgagcgctcagagaagagccctggatgagatgctgttggcggagaatgaaaagccaatatgatcattgccttcaagttacagagtctaacaggagggcccagtcacagaagccacaagaagactgtttctccatctagcagaaagacatccccgtgttgtctgaggatctgaaggatgcatacaagaagaatctgcgttcctactctctaatgaatgtttccacttattggaaaaataaaggccacgtgtggtggctcactcttgtaatcccaacactttgggaggccaaggtgggcggatcacatgaggccaggagtttttgagaccagcctggccaacatggcaaaacccgtctctactaaaaatacacaaattagctaggcgtggtggtgcatgcctctaatcccagctattcaggaggctgaggcacgagaattgctgaaggagttagaggttgcagagctgagattgtgccacctcactccagcctgggcaacagagcaggactctgtctcaaaaaaaaaagaaagaaaataagaatgataatttactattttgcttacaaatagtccttactattttgctttggctgataggaagctcacggctaaattgtctttgacataataatcatattctttctctcagttggtttctggtatctttcctctgggaggaagcagagaatcactgcagactggcaggcgcttatcagatagtctacattccaggtttctgagatttgtctttctcctttcgccagggtgcagcagttggaggaagaaaatacagagcttagaacaacagtgactcggctcaagtctcaaacagagaaactggatgaggtgagcagcagatccaggcttggaggggcagggctggccatcgggagcctttagtttattgcttctgaaattctaaacaaatgccgcaccccctaagaaatgcaaaaaaagtgaataacaacttgtgtttctgtatttctgattttccaagttttctacagcgaatgtatttattactttatacaatggagaaaaattagttttagaaagaggttagcttctatttgggctaacaccttcaattcaggttgcatctagcatcgttgaaggacttcagaggcctgaggtttttagttgtatttctagaatcatcggggctctggccgtttctgtaagccaagactcagggctccgtctaagggagctggtttcactgtgcatctgcctcgtgaagatggctgaccagaccccagggacacccctggacatagtgagcccctctctgggaactctcctcccctgatcgggtctccctgctccaggagcggcagcgcatgtctgaccgtctggaggacaccagcctgcggctcaaagatgagatggacctgtacaagcgcatgatggacaagctgcgacagaaccgccttgagttccagaaggagcgggaggcgacgcaggaggtaggtcccaggccagcaggcaccagggctccttccagcatccctgctcctgccaacctgcttctctccctcgcagctcatcgaggacttgcggaaggagctggagcacctgcagatgtacaagctggactgcgagcggccaggcaggggccgcagtgcctcctctggcctaggcgagttcaatgccagggcccgcgaggtggagctcgagcacgaggtcaagcggctcaagcaggtgggtctagcagtctctgtgtccagtggggcagggtggccgggcccaccacgtgggtttcctgtgcaggatctgtggtaggggagcccagagctgtagcagcactgcctgtctgcttctcagcaacctgtttgccagggctgactgccccatttcacagctcaggaaaatcgatccaaagatctctcccttacgtctatgtaaggaaatagaccctgccttggtgctcagggtggaggatgagaccatacccagctgcagtatagtgcctggaggcattgggttctcccagaagtagaccctcacccaaggttcctttttttttttttttttcccaagagacagggtcttgctctgatacccaggctggagtgctttggcactccatagctcactgcagccttgaattcctgggctcaggtgatccttctgcctcagtctccctagtaactaggactacaggcacacaccaccatgcccagctaatgttgtttttgttttttgaggcagggtctcactgtgttgcccagggtggagggcagtggtgtgatcacagtcactatggcctcaaattcctgggctcaagcaattctcctacctcagcctctcgagcagttaggactacaggagagcaccaccacacctggctaatttacttatttatgtatttatttccagagatggggtctccctatattgcccaggcttgaactcctgggctcaagggatcctcccacccttagtctttgaaagtgttgggattacaggaatgagccactgtgcctagccagaagattacatttcaaggagcgctgccttagctagagacctttgggtgggggagtggatcaggaggaggcagtggccaggtggtgctgggtgaagtgtcagctctgcctgaccctgcaggtggaagagcctgcagcataaattatccttctgagtttgttccactggggacaaaggtgctggtggctgtgctctcacagaaatcctaaaaccccaacccttctcctagtctaggggtggggtgcccagggtcccaggtgtgagcattagggctctttaggcaaaagctggagtgtgagaccggtgcatgggatctgggcgggtccgcctgggtcaactccaaccaagcaggattcggaacgtggctgctgggggagccaaggaaatgagctggccagcctgcccagagagcccagagcatcacttccttcactgggctgctgggtgggtgatgtccctatgcagggcctagggaggaagggatggccaggagccttggctgcgctgagcagggctgtaactcctccacaaaccctgtgcactcccaggatgccagtcccctggaccaggacccagccctccttgcccccagcgcttggcaaaggctgcaacatctatggccccttgaaccagccgtgacacacacctgtgggaatggcgctggcggcaggtcggggacggtggatgtggagaagtgggttccagtgggctgtggatgcctcttggggttgatgtcgccttcgtccttctctctgtaggagaattataagctgcgggatcagaacgacgacttgaatgggcagattttgagcctcagcctctacgaagcaaaaaacctctttgctgcccagactaaagcccagtctctggctgcggagatagacaccgcctcgcgcgatgaggtaaccacaccaccggctcttgctttggggcctggccgccctctgtgattccttctcccggcccccacctgcccagagtgagaaaaccagaccagggcctggcagagagtcccatctacagctaccccacatgacagggcaaggctgtgagcaggggagggggctgctggagaagttaagtcagctctgagttccgcctgtgctggaaggagtgcgggtttggttcagagtggagtgtgagtcttaggtcggccagaaaaatgccaacatagccagctgagtggatcaagctgtgactctgggttaggctatcactcccgctcttcccagtccagagagggaggacattagcatttccccagcacctgcttctgcggtgtgttttcacttaatctcctgatgactctgaggctttaggaacagctccacattccaagctgggaaggtggaacccaggaccacccagctagggagggagagggacccagctctctccaaagccaaagcctacccttcctgccacaccagagtatgcttatgaaagatcaggcctccaaaatgccccggctgcattgtaacatgaattacaagacactctgtcactgagcctcaccctctgcctgggacacggggtgaagagctgacctctgtcctcaaggagctcccaggtgagctgggccccaacccctgggcagaggcagcatgtcagcaatgtccgaaagaacactgccctggagaagagcagtgtggggctgggggtggggagaggtgttccaggcaggagacagctcccctttggagtcttagcggccctgggactttgtcagtcttgattttaaatgactttggctagtgttttctacttttgcaaaaaattacccacacctgggccccctctacaaactgatcacattggaatctctgggggtggggcctgggcacctgcataggtaatactaggggctgagccacttcgactctggtcctggcatccaaatgctgaggctgtcctggggcccaccttgcccaggatctcctgatgccctctattgtcaggcactggcctgcgacaagcctgggagtctggactctgcctgcaccctatcccaggcccagccactgacccgtctttcccatttccttcagctaatggaagccctgaaggagcaggaggagatcaacttccggctgaggcagtacatggacaagattatcctcgccatcctggaccacaatccctccatcctcgagatcaaacactaaggcacggggctggctgcagagcagccttaggaccctgggaccaagggcagaccctgcccaaggatgcaggcctaagccgggcctcacactcacactgtaaatgtctctctggccaccatgcgttacgtgtacccgtgtatatgtggggaggctgtgcacacgagcgaggggtgagtggccgtggctgtgggcagcatccacacggttagccgtgcatgcactttgtggcccctttgcaaggggcagagggtactggaagtgggaggaggcaaggtctgctatcaggagttactgtaaaaacaagaactggaagctcgtgtttccggtactgggtaaaatgattctacctctggggataaggattcacattcgctctagtacgatgggctctttcaccccactcctagtccccttgggagtgggagcaaaattgtgatctttcctaggagtttgaatgccccatatttgtgtcctcgccagctctttggccacctttcaagccccagtgttcaagctcagagaggatgaaggggcatctggagggtccatgagatggggccctcaccaaatgccttggccaccggccagcagccctctgtgatgtgtgtgcagagtgaacagaggactcaggtttcatagcagctagtgcggggcatcctcatcctgtacctatagagttcgtgcactcccccatccatgctacctacctccccgtttctgtttcagttttaagacaatgaagcagcattcactgcgtcattgtaacatgaagggataaaaatgaaggagaaggagggtttgggatgggtgtctaaggcaggagttgacatcgggcaaccaaagaaatgagttttggggaggaacacaactcccatcccagtcagtttccttcccatggctgcatcttaagatggatgcacggagaaaccgtctgcctggctccctgtcttcattctccacgcagcctggtgatggcaggcctgggtttggatttcagaatcctagctccgggctccactcgtgtggcagcaagactgcttcgttccagcgtttagaaacacacctgtatttgattctcagccaggggagcactcgctgcactggtgggaggcggttgggaaagttgcaggaaaaccttagtcttccatccttctgacccatggtggaaattcacaccatggatttttaatggatctttgttctaggcagctgggaatagacatggtacttaccttagagttttccaatttatctcaattttatatggcttgtgattcattttcttaatccaaatatatataaacgtgtgtggtcttattcttccccctgcagtttcttgctttcttcagcacatcttatagtatgagaaggaaggtttgggcatgttgggaagggcggtggagggggagttgcagaaagagagggcagtgagggtgaggagaggggatctggggacttgggtgtgacacctgcttgacagaggcagggctgtggccaggaccaaccttcaattccattccaatcagcctttgcatttgttggatctcgtggcttctttttaatcttttgttggggattagtttcatgctgcacataatggggttgcactggtctgacccaggactttggagccacccacactgggaagactaggctaggcagtcggtcttctaggagtttctcagccccttaggacgcgggtctccttgggctcccccaagggttctgcgaagaggcagtggaagaaggcatgaggagagggtctcttgagaatttgccaataggaaggagtggccacggctgaaaggaacaagacagatcctgacatagctttggcctgggtgttaggtcagaaggagtactggtgcgtgggggccttaccccagggttgagtattttatctgtaaaatgttatctgccctttggctgcattggaatttcagagaaggctgcagaggcctgggttacacagcctgagtcacaacgtgggaaggaatctctgccacgggaaaggtgggcggaagcagctggcagcctggggcgtgcttcaggctcctccctctaaggggcgccatgggaacaggctccggagggagccggcgtctgaaaggcccccgggacctgctgcagtgccagaggggcctctggagcaggcctggcttttaaatggggggctgaattccagctcacacacacctcaagtccaaccttactttcttcagccagaatacatttcttgtaaaacctggcttgttgcttggcttttaaagatggtgtatgtttgtaaaaatattcttctgggctcaaaagctagcttgagggggcagatgccccaggtgtcccagctccacagcccctggcagatcccagaccccttggtggcaggtcccagagcctaggtggtaggagcttgatctttgtttctgcccttacccctcagtagtggggctgcgaggtagtagacaggatgcccagttaagtttgaatttcagatagaaaataattttagaataaatatgttctatctaatacatgggacagatgttatttttagagataggatcttgctctgttgcccaggctggagtgtagtggtatgatcatagctcaccacaaccttgaactcccaggctcaagcgatcctcccgccttaactgcctgagtagctgggactacaggcatgcaccaccacgcccagctaatttttcttattttttgtagagacagggtctcactgtgttgcctcactcgagctgctgacctcaagtgatcctcccacctcagcctgccaaagcactgggattacaggcatgagccaccatgcctggccaggacatatttgaaatggggagattttaaaaattctgatgattagactgaatcctcagacgttctggtttgattgttgtgggtgtagcccaggcatgggattttttaaagagctgctcaggtaattccaatttaattgcgtgtcctacttgggttttttgtttgtttttattgtttttgctaaacctggcaaccctaccgagtagggattagcagtaacttatctgaaatttagaggtgttttgggggtggggcgagggtttctgtagtagactcagattttacatggccctgagctgcccttgcgttcagttggaagccacgcaaaatgaactgaaccaggagtgagcttcgtgtacattatctattagaaaatgaagtaccttctggttcagctagtccctgtgcgttgagaggctttaagaaacttctagtaaaaatgtttttttcttttagctttgaattggccagagtttatcctagattattttattttaaattggtagaattctttgcgaactgtcacagagaaattccttttcatgactttatttctgacctattaaaacatgaacaggccaggcatggtggctcacgcctgtaatcctagcacttgggaggcagtggcaggcggatcacttgagctcaggagtcctaaaccagcctgggcaacatagtgataccttgtctctaccaaaagttaaaaaaaaaaaaaaaaaagctcaagaacctgcacgagggcctaaaacagtgggctcagctttggctgtgcattggaatcacctggggagatttgtaagcttctgctgtctgggctgaacccccagaggttcggattgaattggtgtggggtgtggtccaggcatcgagatgtgtaaagacctccccaggtgatgatatgcagtccgaggttgagactgccctgtcctgcaaggtcgttggccagaggtagaggaaactggtcaaagtggctgttgggcttgtcaagcccgtggctgaatgacagtgagctctcttgctgggagggttccttttcctgttgttgaatggtcctggcctgcaggatgggaggccagatgccttcaggagctggtggatccagctgttctcaccagcctggaggttagcagaccagagtgggtgggcaggaccttggcctggtgcccctggaatcagtgggtggcatgtgttgggatatactggctacaggctcatctcaaagagcaggtagaacagagtcagcagggaactgacaggtggggctgtccccctgaaagcagccgcagaaacagctgccacctatttgcatagctgagcaggaggacatactgtctttgtgggttttgcttctggtctgtttcctgactgggttgataaagggagtcccagctcgttccctgttagccaaaccagcatcctactcacacaccggacactccaggtgctagtccactggtgctggtgttcaggggagttggggggggggggcgcggggacagaagcgcgggttcttggttccaatgagggacttagcagaagcctccaggggccagcagggccaggtgaaactgggagaaatgaagccctctgtgtcctgtgtgtgtggtggggtttaatgcattagcaaatttaaacttaaaaactaactctaggccgggcacggtggctcacacctgtaatcccagcactttgggaggccaaggcaggtggattgcctgagctcaggagttcgagaccagcctggacaacatggtgaaactcttgtctttatttttttaaaaaaacaaaaagtaactttcgatgtgatcataccaggaaagttttgcgtggtcaccatgccaagaaaatgactttggttgcccagcagatccacagcgactctttctcaagggctactgtggattctagattgaggaaaggggccacttaggactcagtgctggtatcctccacagtcctttctcccagactctggccctccctttgggacccaggaaatcccctctagggtgacgctgctggctaggaagactgaggtctgctgcgccaaggggcctcaagttagaagggccatgccgttcagtggatgactttgagcgctgatcctagggacctgccaggtcctcacttcctgccctgggtgcacacatgaatggggcagccagcaggaagcgggagaggctggaaccaggagcctgccctacctgcatggcaggacaactctgaggcccttctgccatattctctgctacccaccagagaaaataggctgccttctagaaagatttgtttctaaaagcgtagaccctggggaagtataatgtcaccatgctcaccaggcgaggtttcccatatgacctccctgccccgacctcgtaggttgctcctttccccatctgtaaggtagagatgtctgccccggagctaccagctggggatggcatccaggccatgtctcctgcaggatccaagtgctgttgtccccagggtgaccctgcctcctgctggggcccatccgctttgctgtgctgcacaggctgttttcatctgcatggtttggggtctttgtccttgtgccttttcttccccatcgccactgtacaggattttccacattgcccactgcctccttttctacatcgtctcatctccctggcctttcccgagccctgtaaatgtgtactttttcaacgtgcctcccccaggtgaggccagctctcccgggcacattcgtccacaaggatcaggccccacttacccttggctcgctcagcctgtagacttggtaactttgtacagaatctttcattattgtcttaagcatggggggctaggacccacttagtccctcctccagcctgcagctaatttaggagccttgcattccagaaaagggcaactttgtgtaaagcagcttctcccacagagctttccctgcattgttagtgatgtcgggcaaagcatcactctttaacctggggcattggccccagcagggatatcatgggaccgcagccgctccgtgcactgtctctgcccccagaggaagccctgtccatggttcctggtgcacggccacaggcctgccttgaggccaccacatctggtgtctagaacagctgcgggccccacttgggcagaaggaagaggtgctagctgctgcccctgcctgctgtgaacacctgcccagcccttccttgtctgctgaggtgctcagaccagagtgccattaaataccaactgatgtcacggagcggacggtgcattgccaaggactcacagctgtgggctcccttccagctcctcccactttcttggctgggtcttctgaggcctacgtggaatgaactacacatgtggcctcatgcccaagggtttgttagatggcctctgactctgtgggattcaacttgacttttttgccccaggaggctctgtctggaaacaggcttagctttagtgctggggtgggacctgccctgtgggccccagggaggggacagtgggggtgaggccctgaggctgtccagggtctgagctctttgcctccaacctgcttctgccccaaaaggaacaggctgttggtggcaggctcctcccggggagctgtactgtacagaccaaggtgtaaataaacagtttgctcttctcgc

SEQ ID NO: 2418 - DNA, 8602 bp, Homo sapiens
tttttccaagaagaatggagaagtaaatcatattttaaaatgggattgattacttggactctcagtgcagaaaacactgttttatatctattcatctcagaggaataaagggtgtgatacttcttaaggtacttcttaagatactttaaaggaaagtttacatatatatacacatatacatatacatatacccaaacttaaactcttgaaataaaagcacatgtcggagattatatgctgtatgctggatatccatgaggaaaattttcccacaaacaacctggcatggttcagtaactaaataactacatcccccgtactggtaactagccctatctcaggactactgtgttcctgggtgcaagatgggtgtctaggcctccaccatcttcaaagcctcaatttctatgtccctggttctcttaacaatggaacagtcgtaaagcagggtagcctcttggtcctacaaagagacaagaggaggactcaactatttccaaaaagacatcttgtcttgcatgctatgttttgtcaactgtcttaaatacctttaatatctaataacaccacttccacttggttctccctctctggacatgtgtctttgaaataaatcctagtttcagcacacacaaaaaagacctgtttcccaggctagtcccagaagattctatggtaattacaacaggatcccaaatccaagccctctgagtaacagtccattcatttcttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccccattcatttctaaaagaagtcctctctagggtcaaatatggcagctgtttagctgacacagaggagtaataccaaagagttctcttttctgtttcctttcttttcctctttttcctaatcttccaaaggccaaagagaatgagaaggagcacttgggaaggtagatctaatataatcctgcctggctgttctaccctcctcagttcatgagtatcatgataatggacagctcctggtttaaatcattgttttattccatcaccccaccactagcaacccccagttaagattagctatagaaacataacacaaagggtgactgaagcgccaggtctttcagtgtgtgaggccagcaagagtccaacagcccctcaatgtcccagctgactcttctgatgatatgctcagaaatgtctacagaagctgagcagctgccagctcaacacaccctgccacacctgcgctatcggtggaatcagagaatgagaaagctagaaagaagctttagagaactacgctggttgaaaccctcatattactgatgaggaccataaatcatttaactgaaattaaaccaacaaatcaaaccacacatacccacaaaatctttacatttgtgacaaactatattttctagaggtggccactccaatacagattccatcccacatgctctaacaatgtgataatgacactccttcattgacaggtgggtctctctgttctctcctcctgagcctgggtagacctttgtaactgtcttgaccaacagaatgtgacagaatgataccaggtgacttctaagactacatcatacaaagcaacacagcttctgctgggctctccctctctggacacgtgtctttgaagccctgagctgccagattaaacagtccggcttgcctaaagtcaccacgctggagagaccatcagggatggagaggtgctacagaaaccctagctattctagtccccagccatttgagtcttcctagcccagactcataagtgaagaaaccttcaagatgattccaatacctcctatcacttgactgcaacctcgtgaaagcctaagccagacctgcacggtggagccattcctaaattctggtcccacagaaactgtgaaagataataaatgatcatcattgctttacattgggctaatttttattatcaggggtaacgtgttacatagcgataggcaactaatacaagattcattactaaaaccactaaaaactttaacctgttagtcactattaatttaagcaaacaaataagcaatcttccaatgatgcttccccaatttgcatgcctctctataaccttactctgccttcattttaaggcctagctcttatcaccatatgtgatatgattagataacacgatataggctacgttactgaatatatgaggaaagggcctttgttttgttcactattatatccccagcacctagaacagcacttgacaacatatagcaggtgcttgacaaccactggttcagtacaagaatgtatctggagatgattgggcttagtgttcctccaaggctatttgacctctcatcacctgttctccagtttgactcaacgtctcttaatatatattcactgcactgttaagtttctaactctctaactactactgacaaaaccattagatgttcttcgttcaaacccactagaggaactacaccatcccctccgtgatgccagctcagcatccagagtagagccagtgatttcctttgtcaacacacctgcatgccaaaaacccttcccaggaggtctcaaatatcaaataaaagttactccatttttcattcaaagaccatgtgcccaatgggaaaatgacctcatgttgtggtttaaacagcaactgcacccactagcacagcccattgagctatcctatatatacatctctgtcagtgcccctctgggtctagataattacactgagtacactgaagtcctttcattattgcaggcccaacaaaaagtactgccactgggtgaatatcagaaagcatgcatcaatgcactttcaagtcaaatgagaactggctagttaagcagcagcattaacagatgtagagattgtgccagccaaatgcctcttgccaattatggccacacagctacgcccaaattaaaaataacccaacacggccaggtgcactggctcatgcctgtaatcccagcactttgggaggctgaggcaggcagatcacgaggtcaggagtttgagaccagcctggtcaacatggtgaaaccccaactctactaaaaatacaaaaattagccaggcgtggtggcgtgtgcctgtgatctcagctccttgggaggctgaggcaggagaattgcttgaacccgggagacagaggttgcaatgagctgagattgtgccactgcactccaacctgggcgacagagcgagactcaatctcaaataaataaataaaaaataaataaaataacccaacactcataacagaatccaaatgggcatgggaggctccttctctccctacaatatcaccctacagtcgctacataaatgcccctgtaaagtggctcctaagttatgtcattaaaatgttcacctttccttggcaaagtagatctcaacacaggaggaaagagaaataagctaaaaaaagaaatgtggattgtctagaagttacaagggaacaaaaaagtagaaatcctccgtgagaggattttgcaaaaactgtaattaaaggaatctagaccagtggttgcccgatagaaatataagccaaaaatgtaagttttactcttctagtaaccatactttaaaaagaaacaggtaaaattaatttaaatgttttatttaactaaaaagatcaaaaatattatcatttcaacatgtaatcaatataaaagttagtaatgaaatattttacattctttttcttcctgctcagtctttgaaatcagtgtgtattttacactgaccgtgcatctacacttgggccagcacattgcagatgctcaacagccacaagagaccagtggttaccacattggaaagcacaggtctagaataatcctaacttctttttttgtaaaatactgaaacatccaaagcactccaagttttctattagggaggcaaaataactatactgttagaatcatgggcaacgatatcataaattcctaaaataaaaccacatagggccgttatttcaaattacataaaacttgtcttctagaagaattcgaccaaatgccaaagttcttaagatctgccccacttcccaaacaagggaaactgaagacctcgaccagcaccagggccttccgtcagctcctgatacaggaggggctcctggattttgtttccccttcttgacaatacaacatgggactgggttcctcatttgactcggttcatttaaagaatgatctcaaagaagaaaggaaaatcaatgacccctttaggaaatgtagtccagggtgggggtggaggaagcatttcaatgacaaaagccaaacctcagtcataatgcagatccctgtctaacaggtgatcattgttttttttttctattacaggcactctggtctcccgcctaccccatgcaggatggctatccccatgcagaatggctgtgactttcaagagagtcccccaagggagggtcccaagatcaggggctggtaatgggccccaccacaaggctacgctgctggcttttgtttggaacaatagcgctcccatgatacctcactcttgctgacaatattggtaatacgggagcatgaacacagctgtgtgtaaattacacacacaaacagattagatctgtatatttataaggaatacaaacatactaatagctcatttacatacacagctggatacaatgggctgcatgcagaggggagtttgagttccaaagtatttctctaaaattttacaaaaagaaatgctcagattactgctaacccaggctgagacttctgctccccccacccccatgcagtatgtcccccgaaatagagtccttttcatcctcgtttgtgatatttgagatgctatgaaggagaaacctcaacaagtgctgttagatttcacttttattattatttattattatttttagagacagggtcttgctctgccacctaggctacagtggtatgatcacagttcactgtaacgtggagcttccgggctcaaatgatcctcctggctcggcctcccaagtaggtcagactacaggtatgtgtcagttaccatgcccagctaattttaaaaatatttttttgtagagacggggttctcactatgttgcccaggcttggtcttgaactcttgatttcaagcaatcctgctgcctcagcctcccaaagagttgggattatggcatgagccactgtgcccagccagatctcactcctgtaggaaaaaaatcaatataggataattttcagttaaaaagatgtatatacatacgaagagggagacctactaaaacatctgttacaacagcatatagtaaggcagaatctttgcattttcaaaatgttttcataaactttatttgttagagcaatttcaggttcacagcaaaacggaacagaaggtatagggatttcccatatagatgggtctctggatttttcagctaattttgaaaaatagggaaaagagcaatcagcattttgtgctcactacagtaaaccaggaacacaggcatcaggagagctgggctctgattcaaaggcctgattctagcaaggcctcacagtttacttccggctagccatgaacactctctgcgcctgaggttttcgtggaaagacagcatcacaagtactcaaatgtagcgtttaaaagtactaacttttaaaatgttgaatgttccagtaaaacagttaaagaaaaaaaaaggtaataatccaactaagtaaaaatattaacttatacatatctggatagatgataagctcattacaggccctaattttattatttaaaatgtttacaacaaaactctctaattgatattctccctctctctctctttttgccttgatatggtttctataaactcttggtttaaaaaagaaaaaaggtccatttctgaggcttgggtttactgtacttacagttccaccagtaaatcgtctcccagtctgggctggagaagcgctggccacggtttgattgctccagccccaggttgccaggcaacccacacaagggggaagtctgagaaccgctgacagatagccaagtggctgaaacaacagacttctctctgtcaaaaatgtgtttgagagagccacttgcccacctctgctctctgctaaacactacatgattgtaaaatcaaaatcaaaaggccactgtaataaaaacacacttcctgctcaattactaattgttctaaagctgtggggaggcccagatcctacagtgtatggcaacagaaatgcgatactgtaaatgagataaagccagcagcatgcaagaaacctgatctaaatgcatctccgtagcttcaagtcaggagagctggtgtgtggaggaatcaactgcctaagaaaacaccaggaagaaaataatgaatgtcaagatgttaaagaaacaaaccaatcaataactacgaagctagaggtcaagactacttagtaataaaaccaagaacattctccattgttttgaaacacaatctggaggcaatgaaagttttctccctcagatggaaaggaggagcaagaaaggtcaatgacccttgggaaccacaccccctggcggttccaggtggattccctgatacttgactgtaaatgggattacaggaaatagtagcatccttaggataatgcaggacaataacaggtctgagagtctaatgcaacatttaaaatacctatggtgtgagctgggcacagtggctcacgcctgtaatcccagcactttgggaggccgaggtgggtggatcacctgaggtcaaaagtttgagaccagcctggccaacacagtgaaaccccgtctacactaaaaatacaaaaaattagctgggcatggtggcaaacgcctgtaatcccagctactggggaggctgaggcaggagaattgcttcaacccgggaggcagaggttgcagtgagctgagatcgcgccattacactccagcctgggcaacaagagtgaaactccctctcaaacaaacaaaaacaaaatatctatggtgcatgtaccaagccagtaacattgtgcccaacaccaactctatgcagcatccttccatgaaaccactgtattgaaactgtcatcttggactctggaaactatttgtagtatgtggaaggggccagcactgagtgcacagttctttatctcttctgtgccatggaccctttggcagtctggtaaagcctgactccttctaaaaatggtttatggccaggcacggctcatgcctgtaatcctagcactttgggaggccgaggcaggcggacatgaggttaggagatcgagaccatcctggccaatatggtgaaaccctgtctctactaaaaatacaaacaattagctgggcgtggtggcgcatgcctgtaatcccagctactcaggaggctgaggcaggagaatcacttgaaccagggagtcagaggtcgcagtaagccgagatcatgccactgaactccagcctggcgacagagcgagactccacctaaaaaaaaaaaaaaaaaggctgggcacggtggctcctgtctgtaatcccagcactttgggaggccgaggctggcggatcacctaacgtcgagtttgagactagcctggccaacatggtgaaacctcgtctctactaaaaatacaaaaaaaaaaaaaaattagctgggcatggtggtacatgcctgtagtcccacctacttggggaggctgaggcaggagaatcgcttgaacccaggaggcggaagttgcagtgaaccaagaccatgccactgcactccagcctcggtgacagagggagactccatctcaaaaaaaaaaaatagaaagtatgccagagtaatataactgctctatgaacacactaaataacaagagctagcagagggttttctttagctcatgcaggttttttgtttttcgggggggtgggggggctgttttgctttattatgtgacctcagatgataaacccttggagggcaaggacagcaagtttttcatcattcaatttccagtgcaatatgcagcccggtttcctgccccaagctcctaagctagccctcgtcacaccactagcccagctcctatgggggcgtgggtttccttgactctcccagtgcccagaagtgggcctggcatataagatgtgtaagaccatagtccgcaaaatgggatgtatggacacaaaagacatttttttcctatgttctctttccaacaatccatcagcctgagaaggcacacgctcctgtgaggggatgcagcctctcttcttctatccccaccactgcccccctctcacttcacaaaggcagcctcctctcccccgctcccatc

SEQ ID NO: 2419 - DNA, 12682 bp, Homo sapiens
ccctgagtacaaaaataaccaatagtaagaatgttcagaatcagctggctgagcagcagcaaaaaacaggatagctctcctctagaaactggtaggagcaagctttctgcctcataaacactttgctgtgtatacacatgtagtcttaattcatgagacataagatttgtcttttaaaaagctgacccaaatacaaaccatctccaatcagtttctcagacacaagtcagaatatgacattaaaatccagtgaattgcactgatattttctcttacagacaaacctagtctgtaggaaaataaattactctttctctctctcttttaatttaactaagggtcttgctctgttacccaggctggggtatagtagtacaatcataagctcactataacctggacctcctatgctcaagcaattctcttgtctgtggcctcccaagtagttgggactatagccacaagctaccatgtctggcttttttttttttttttctggtagagacaaggtcttgctaagttgccagggctggtctcaaactcctggcctcaagtgatcctcccatctccaactccccaaagtgctgggattataggtgtgagctaacacacctggccagaaaacaattttctctaatgaattaactgaaaagatttaccacacagcgtgtctatctttggaaacagcgctgccacaaggtacctggtggtgttcaagtacaaatccccctgacctgcaagaaatttcacctttaataatctttaagaaaggtcaaaagcattaacatgacagatgcccagggcacgagccaataaaaggaaaagttaactgggttatctctctcatatgtagttaaaacagcaaatgcttaatcatttaatttgtactgatgctgatttttttttttttttgagacagggacttcctttgtcacccaggccagagcgcagtggcgtgatcgtggctcactgcagcctcagcatcccaggttcaactgatccctctggcctcagcctcctaagcagctgggactagaggtgtgtgccaccatgcccagctaatttttatattatttatagtgacggggttttgccatgttgcccaggctggtctcgaactcctgaactcaagcaatccacccgctgcctcagcctcccaaagtgccaggattacaggtgtgagccactgtgcccagcccctgatgctaatttttaaatggacatttgaattctcaaagaaatttgtgttgcctcttgtcaaaccaggtcactgaaatgataacccacacaataagccaatgagaaggaaaaaatatatgggattggaaaacagaatgaaaatcaacattaaaattccataattaaaacacgcagatagaaaagaatttatctgacaacgtgctaagaaccccctgtcctgtgtttgctgtcatggggagggaagaatgtctgcagcacaggctttcccagtctgattcacagccctgttatatatgaatgtgcacactcgaaacaagatctgatctggacaatagtcaagtctctaaaagcaagggagttcaattaattttttaaataaacatttcactggattttttttttttaatgatcaatcctgttgacagttttcccgtccatcttccagaagaactcactactcaaccaactgcctggtattcagctgtgactgtgaggatggataactatatttccttaagaaatagcaggaaggtatctcatccaagcagaaaataagaccaacagttgtccaggtctcagtggttctgcatttcttcctaaaagagaaatatgtctctaaacatctctttcccgcctcatggggttgggggaagcaatatgctcagaaaaattttaactactccaggcagctgaataaaacaagctgaaaaccctagatgtgttctccacattactgtgacagaatgcaagtgtgtattcgaaagatttcctcgctggaattataaagcgtacagcaagccagcctgctgtactgccacctcgctcttgctcccagactccctcccatggactaagcaggaacgaacatacgagctgtgaatctggtaggggaaacaggaaacatccaaccaggaacacactggagagaagagaaaacagttaaccacctatgagaagatggcgctgattccagcaggtgacaggtgggacgtgaagggcattcccggccctccagcagaagcaacgtcacggagctgggtgctgggtgggttgcaccgttctgaggcagcacggttctctccaatgactctcacacaggaaccagacctgactctgtttcttccaggacggtcctccctcactccacagcctctcatggcagctggacacccaccagggctggattccacacacagaaaccacatccaatgctctgttactagaagtcgaccatctggatttcaaagacctctgtctctttctgtcctttgttaatcagtctcccttcccactcaaccctctcccctccatgccagagaaaaggatttttaaatctgatgagtttttcagggaagcagaaatgtgagattacactgttctttagcctcacctcatggttttgctacagagatcaacgtcttctaacacagctttgcccatactcttcctgaggctgaaccaaaaaatctttcatgaacagtactgtctccaccagcagaatgtaaatataccacagcactgacttcaaaacactgaagtagagagtcttaactctccttagacagaaggcagaaggctgcaaacatcccccagcagactgcaattgtgctgttccaactgacaagcccagtaagcactgcccatgacaggacctcctgcagaacttctcccagcctggcggacagcggggcaggggtcaccctcagaggctcgccttctctttgctccctagccatcacactacactgggatgagacacaacaagcacccaaatgacacagtgaccatttcttttggtcactgaggttcacgagatgggctgtttttctttttcaatcgaggagctgaaatcctaccagccacctaacaattaacaaccccaaccctgtccacggttaaaatcaacgaaaaaagcaaggccaacttcttgtataacttccttcatacgggaaaaacatcaagttcaacgtgtgttaatcaagtgtcaggtcaatgtaccacgcaaatatatttgatgttttttgctaaggccaatactaaactgttaaacacagagaatatgaggaaaaacaaggttaaaaaaagtgtatagatgtccaaccctcttttaataattccaaaaaaacacaaagctacttaggcaaaaataaatcacaaatctattcaggagcactgtaaaacggaagagaattatctaaagggattcaccggctactgactaattttaatatgaaatgcctcacaaatctccctgtgccaccaacaaatcaccagctgaggcaaatcccagataatgaaacattgtaagaagggctctttttaatagtttagcccatcaaggagtgagtattgattcttattttcagcagaaggagacagtcttatctccagccttacagctcagtgacaacatcagagaatttaatcacagagccttttctgccatgcaatccttaaactgtcacctaggattctgtgccattcctcatccatttgtagagaaactcctggtctcacagatgtgtctgcctacttaaaccacagtaaccatattatatggttggctgtgtcccacccaaatctgactttgaactgtaataatgcccacgtgccaaggacgggggctgggtggagataaatggatcacggcggcggtttccctcacactgttctcatggtagagaatacgtctcacaacatctgatggtttcataaatgggagtttccctgcacaaactctcttgtctgccaccatttaagatgtgcctttgcttctcctttgccttccaccatgattgtgaggcctacccagccacatggaactgtgagagtccattaaacctctttcctttataaaaatcacccagtctccgtatgtcttaattagtggcctgagaacagactaatacaccatagcagcacttcaagtcctacagattaaacacatctatctatcaattaccatttgccagctgtttttctttaagaattttttaacaattcatcagatatctttgtgcatttccaacttgtttgttaagaaatctgctcagtatcttaagagcagattgaaaatcataataatagctgtgccaattctctggacatctgtggatatttgtaatatatccaagacaatgccagtaacaaaagaaaaagccagggggaagtgatagcgaaatcagtcattatttccttatcctgacataggaagatcagaaagtcccccaccttccagagaaaattaaccaaatactaaagttagcagtaatattaattcaaaagtgtccctgcatctttaaatactaaaaaagtactcaaaacacagaaaaaattacactgaaaacaagccaatacttttttttttttttttttttttgagacagaatcttgctgtgtcacccaggctggagtgcagtggtgcaatctcggctcactgcaagctccgcctccagggttcacaccattctcctgcctcagcctcccgagtagctgggactacaggtgcccgccaccatgcccggctaattttttgtatttttagtagagacggggtttcaccgtgttagccaagatggtctctatctcctgaccttgtgatccgcctgcctcggtctcccaaacttttttttttttttttttttgagacagagtcttgctatgtcagccaggttggagtgcagtggtgtgatcttggcttgctgcaacctccaccttctgggttcaagcagttctcctgcctcagcctcccaagttgctgggattactagcgtgcgccaccatgcccggctgttttgtatttttagtagagatggggtttcaccatgtgggccaggctggtttccaactcctgacctccagtgacccaccctcctcagcctcccaaagtgctgggattacagggatgagccaccatgcctggccaagccaatactttttaattcaagtacaaatcaaactacatcactgagaggaatgttccccaatccagttacactaccctactatccattatcactgttgctgtgaataattagtacccccttccagggagtggggggtacagaccacgtgacagtgggtgtcactgtggtgacaagactgtttgagagtgggaggtgggagcaatcatttatgctggtaatttgccttaagatgttattcccaaacatccttccatgatcctttggattgagataccttaatcccaactgccttcatgtccaaggtcaccacacacacacacacacacacacacacacacacacacacacacacatcttccttccatgatcctttggattgagataccttaatcccaactgccatcatgtccaaggtcaacacacacacacacacacacacacacacacacacacacacaaacacacacacagacacacatcttctattagagagaaccgaaggcatttgacagctgcctttttaggtccttctgcctttccatccaaactatccatcgttaacaaggccctatggcagtgcagcagcgctctccattctaatcaggcatcgaagagaaacttcactgtctgtaggctgcaaccaagggcagcagcctcacaacaaaagtgcaccctttgtgtggcaatcatttacctgttgtaaaagcacagtacccttctctctaataaaaattcgaaaggccaaaaatcagcattacataatggccaaacataaagaaatgaaaagcagtctgggtgcggtggctcatgcctgtaatcccaacactttgggaggccgaagtgggtggattacaaggtcaagcgatcgagaccatcctggccaacatggtgaaaccccgtctctactaaaaatacaaaaaaatcagccaggcgtggtggcgggcgcctgtagtcccagctactcgggaggctgaggcaggagaatcacttgaacctgggaggtgaacgctgcagtgagctgagactgcgccactgcactccagcctggtgacaagagttagactccatctcaaaaaaaaaaaaaggaaaagaaaacataataaaacagcctcacgctatgttcactggaaaatttatatgcatgtatatgttttataagttatagaagcccataagaattccaatagttcaggggaaaaaaaaagaaaaaaaaaaaactaaacttgagctatataccgatgtctacccactaaaattactaaaactatagccaggaatacttgtttggtttcgtgcccctctcctttacaagggaggtagaaagcaaggtggagagacacccaacagtcacttccgttttaaaaaacaaaaacaaaaccaaaaaacttacacacagcagatttttctggctagtattggccaatctttctcttgacagtattaagtgctatcctttgtgttaacagtcccatgcatttaatttattggtttaaaagaaatatttcttcatctgattaaaaaaaaaatcaatctgacttttctgtcttgtaattaaaacaaactatcaatacaatggatagggggcaatttctctgaaccaggagctgttccagacactggggacaaaaaggtgaatgaaacacagccccttctcttaatctagctaagaggacagacacgtacagaggcatgatgtgagaatgatgctggctgacagtgcctctcaggcagaagcgagagatgactggaagtgggaggtggagaggagaggctcacttttatttttcatttcaatgtataccttaatatttttaacatccatttttggaattacatgttttacaacttcattaatagagttcagaggcacaagattttggctctaagtttacatataactaagtagtactaccataattatcacaagctggtaaataaacaagatggcctcaatgtgccaagggcacatttatgccaaacaaaggcaaagtcacttcatggcaagctgtatttacactgatggtttctgagtggcaataactgaaagaaaagcaacaggaaaaccgagtcattacaaggaatccagccgtctacacaaaccaggcaccatcccagcatccaagaacatgggccataaggaagcagtaacagttacatcacaagcggctacttatttcacaacatcatcgcccagtctattaaattaatgttggtagtcagaactttattggttttgtagtttggtttgaaattaatttataaactgccttttatagctgcattagggatataagcacacaaattatacctaatttgtgtattggggaagggaggaaattaagtaatatagaagaacacaaaaactatttttgaagtaaacatactcaagtttcaaaaacatgaaagaccctggaactgcatcagaagttccacatcctcaacgtaagcaacataaggaggagaccctgtctttacaaaaaattttaaaattagcagggcatggtggcccgtgcctgtagtcccagctactcaggaggttgagacagagaggccgaggctgtagtgagccctgaacatgccactgtactctaggtgggtgacaaagcgagaccctgtctcaaaaaaaaaaaaagaaaagaaaaaagaagaagttccacatgctgcaaaggacaagatcagatctacttttacactagttactggagttggggacaagccttcatttgctaatgctggccatccatcagaatctcctgagaagtgcttcaaaggagtatggattcctgggtttgactctggaacaaatgaatcagtattctcatcttacatgtgaagacagtgggactctgaaagattaagtcacctgatcgtacaactagtcaatgggtaaccaacatgattcaaaccgatactatgattttaacagtaaaaacgtgaggttttttaactacctccatgatctgggggaagggtatactgcagttccctgaactactctttcaacttctctgtaagtctgaaattattttcaaatagaaagttaaaaacaaaaactaaaaagaatagacagcaggctgagacgtgttaagaggtagaggtgggataggaaatggaaaaggatgaggcagaggcctctgaaaggagggcagaggcagagctccatctccacacagaggaggtcggctggttttcagttttgttttgttgtgggggaagaggaggtaccagtcaatagcaagctgaggagtttaaaaaaagaaggaaggaaggaaggaaggaagggagggagggagggagggagggaggaaggaaggaaggaaggaaggaaggaaggaaggaaggaaggaaggaaggaagtccacatatctgtaaggtgggcaataaaggaacgatctttctgtatttctctacattacaaattcaaactagcatttacgaacttgccaaaaaaaaacctgtttatgtttatagagaaatgcattctgaagtccaaacaactgaccacacaacaatttctaaacccttccactactacataaaacatctgcttctgtgctaaacttttgtaaggcacagtttctgcttcaagaaaatctgtgatgcttggaattgaggtttatcttactgaagaaaaatctgaagaaaagtgtttgccacccatacagctgataattttttgtaatcctaatggatcagtgggaaattgtaccacgaaatctcttgtcagtcaatataacaatgtctctaactaatttcagtaaagtgaaatctacagttattcccttgaaaaacaggacaaatcaactctttcccaacttttttcttttttttcccgcaagacggagtctcgctctgtcgcccaggttggggtgcgatggcatgatctcactgcaacctccacctccctgattcaagcaattctcctgcttcagcctcccaagtagctgggactacaggcacatgccaccatgccctgctaattttttgtatttttagtagagatgaggtttcatcgtgttatccagtatggtctcaatctcctgaccttgtgatccacctgcctcagcctcccaaagtgctgggattacagatgtgagccactgagcctggccttcccaacttactttaagaggtaactaaaggacgggtgcggtggctcacccctgtaatcccagggtgattggattgggaggctgaggcgggtggatcacctgaggtcaggacttcgagaccaccctggccaatgtggtaaaaccccatctctacaaaaaatacaaaaattagccaggtgtggtggcacgtgactgtaatctcagctacttgggaagctgaggcaggagaatcacctgaatccgggaggcaggtgatcatgccaaaatcatgccattgcactccatcctgggcaacagagcaagaccccatctccaaaaaaaaaaaaaaaaaaaaaaaaaacccctaaaaaaagtgataatagattatctccattactggcagcagaaaacaaatttaagtgttaaataccaaactttttttttttttttttgagacagcgtctcactctgtcacccaggctggaatacagtggcatgattatagcacactgcagcctcagcctcctgggctcaaacaatcctcccacctcagccctaaaagtagcagataacttttgaattttttgtagaaacaaggtctttctttgttgcccaggctggtctcaaacccctaggttcaagcaatcctccagtcttggccgcccaaagtgttgagattacaggcatgggttaccacacccagccaataccaaagttttacattacataggtgaagctagtatccaactattttccaccaattaccatgtaatatggttgaaattacacgacctttcaaacttccagatacaggtgacaaagaacatttttaatataatttctattttcaagatttaaaaattctatctacttttaatgtctacctagctgtcacctcaaaaaattcaagacagattctaaattttaaaaattttccaatttatgttccaggaaatttaagtgaaagggaggaaagctataactaaaatttactaatggctagtagtactaatatacatactttaaaaaaaaattaccaaggaataaatatttaggatgctccagagaaaaattatatctgtaagcagtttcaatctcctcattttatgaatgttttggttacttcagctattaagttttaatcaagctaaaaaataggcctttttccttccatcttaagaatgtcaatgggatgaggagggaaaagccaaaaggtgggaggaatagagtaacaaacttttaatcagctagcatgatttaaaggacacacacttctgtcctttaacacagcatgtttcttgaaaataggttactagttcctaaaaaagaacacaaaagctatttacaggctgaaaatctaagattttctattctcaaattttcatttagagaatacattttgggacaagagggaaaaactacattcattttaaggggataggaaaagtacctgatacgatctaatcgtaaaacatgagatcaaagataagaactgaaaatgcaacttccaggcaccaggcataataatttatatagactctaaaaaaggattaactttaagtgtattacttcaacttcactccagtccttagaaacatttaatatccttgggaaagagtaccatctcttcttccattgaaggccttgatatttatagaagatattgccggccagacgcagtggctcacaattgtaaccctaaccctttcagagactgaggcaggtgaattctttgagcccaagagttcgagaccagcctgggcaatgtggcaaagccccgtctctaaaaaaatttaaaaattagctgggtatggtggcaggcgcctgtattcccggctactcaggaggctgaggtaggaggatcatctgcgactgggaggttgaggctgcagtgagccattatcaggccactgcactccagcctgggtgacacagggagataccctgtctccaaaaaaaaaaaaaaaagatattcccatcaaaaaatactacgatatcctaaaaacaaagttagaataagtaaaaccacaagcttacttccatggcctgaaatgtctttggcaattctattgctaaaaataaagcctaggagaagccccgcatatttgtttttatatatatttctttttttttttttttttttttttttttttgagacggagtctcgctctgtcgtcgaggctgcagtgcagtggtgtgatcttggctcactgtaaccttgaacttctgagttcaagtaatcctcctgcctcagcctcccaagtagctggtactagagcctggtactatcacagccacacaacaccatatctggcttttttttttttttttttgagatggagtctggctctgttgcccaggcttgagtgcagtggtgtgatctcggctcactggaacctcttcctcctgagttcaagcgattctcctgcctcaacttcctaagtagctgagattacaggcgcccgccaccacgcctggctaatttttgtatttttagtagagacaaggttttgccatgttggccaggttggcctcgaactcctgacttcaagtgatccacccacctcggcctcccaaagcgctgggattataggtgtgagccaccacacccagcctaacgtttttgtttttgttttttttactttctgtagagacagggtctggtcagagactggtctgaccagttcaacctggtcttgaactcctggcctcaagcactcctctctcctcagcctcccaaggtgctgggattataggcatgagccaccacacccagctgttcagatattttttcaatcaactagtacggaacaagggctgtgccaagtggctttgtaatcttagcactttggggtactgacacaggaggatcccttgagtccaggagttcaagaccagcctgggcaacatagggagaccctgtctctacaaaaatttaaaaaatttttaaattttaggtagcatacacctatagtcctagctacatgagaagctgagaaaggagaatcacctgagcccaggaggttggggctgcagtgagccagaatggtgccactacacccctgcctgggtgacagagtgagaccctgtctgtaaaatcaacaaaaaaaccccaaaacatgaaacaccccaagaaaggcagggctgaaagtcctaacagtgcctgtaagtaataaagagcaatgcactatccctgaaagaacaagaagctcaataaaacttgcaaaggatcattaaatctaatatatgcctatggaaacaaaaaggcatttaaatcgtaggcagttataaaagcataggtttattgatatttgtgatctaaaaatgcggcttgatgccccttttggaaaaaagatgatgaatatgatgaaaagacagtcttaagaataaattgactgggcacagtggctcacgcctgtaatcccaacactttgggaacccaaggcgggaagatcacttgaggtc

SEQ ID NO: 2420 - DNA, 6362 bp, Homo sapiens
gtagttttttagtagtcctttactcctataaattactttttttttttttttttgatgatctgttaatagtccttggtttagaggcttttgcatacttgagttttcaccaaaaaattcttttcaaaccagtgaggcattacagaccagtgaagatattgtataatctaaaatgtgtctcttcactttcatcagtccttgaggaaggtgtaacttttttttgtgaccatatgaggaacacatgtaacctttgtggaagaaatagaataaacttttttcaaggtcaacagaatattaaaataaatgaaaaaaattaaattcactaatacaggatcaatgtaaaattatcttcaacaaattagttgtccagaacacaaagggctggttcaataactgttaattttactctcagcagaacctagaacaaataatattcgtttgtttttaatttaaaaaatcttttttttttttgtagagacgggggtcttgccatgtttcccaggatggtctcaaactcctgacctcaagcgatcctcccacttcagcctcccaaagtgggagccagacaaatagttattttgggaaaaatatctttgaagtttttctttttaattcaattaaaaatttttgaggttaggtaagcagttctcatgagacatttccaaagcttttgcctttgtattgttactctgtagttgaaaacttgtgtcagatatggtaggtgacattgatttgattacaaaataatacacttatattattgaaacttcaagcttatatttcagggttaaaacaggcaaggcggtgatcttttaatctaatttaggaaattaggtaaggcagagtttcatattttaacaaaatgaaaatgtatgattatacagtccgtgaaaaaggctggtataaccagactggtagctttaggaacttttaaattatgtgcactttttggtccctgtcatagatcacctagaattcttgtgctttttaaatttttttgtgagacagagtttcgctcttgttgcccaggctggagtgcaatggcgcgatcttggctcattgcaacctctgcctcccgggttcaagcgattttcctgcgtcagcctcccaagtagctggaattacaggcatgcgccaccatacccggctaattttgtatttttagtagcgacggggtttctccatgttggtcaggctggtcttgaactcctgacctcaggtgatctgcctgcctcggcctcccaaagtgctgggattacaggcatgagccactgtgcccggtagtcttgtgcttttaagtagagtactttaacttcactgttgtttgttatttatatagtgtattacagtgagttcattgccctatagttcactgcctataggttcattgcagaaccatgactaagttcattctcttcaggaacctacattccaaggcatcattatttacattatattaattctataatctactcatgtgttgtttttcgtatctcaaggtggtgctgtgagtaggtggtgtgtttatttttgagatagggtctggctctatcgcccagtctggaatgcaatggcatgatcttggctcactgcaacctctgcctcctgggctcaagtgatcctcccacctcagcctcccaagctgagactacaggctcatgccaccacacctggccaatttttgtatttttttctagagacagggtttcaccatgttgcccaggctggtctcaaactcctgggctcaagtgatccacccgccttggcctcccaaagtgctgagattacaggcatgagccaccatgcccagccaagtaggtgttttaaactgtttttcgacaatggtaatgagattgcataagtgatttttctctcctaactcttctttatgacctagttcatctgcaagatggttggctgggattccgggtgtggtcaagattttagaaagtgttggccgggcgcagtggcccacgcctgtaatcccagcgctttgggaggccgaggtgggtggatcacctgagttcgggagttcaagaccagcctgtccaacatggagaaaccccatctctactaaaaatacaaaattagctgggcgtggtggcacatgcctgtgatccgaggtactcaggaggctgaggcaggagaattgcttgaacccgggaggcggaggttgcagtgggccgagatcacaccactacactccagcctgggcaacaagagtgaaactccatctcaaaaaaaaaaaaaaaagatttagaaagtgttttaagtattcctttccaaatgcagaatatgtgaccttggactttttagcaaggttctgtaagtggaagaaaattgacattaaacaacagccttaggagcctcttctgtgccaggcacttgatagctgtttctcattagagaaaacattataatcaagcaggtactgttttcctaattttacaagtcaggaaactgggattcaggttaagtaacttgtccatagcgacctggcttagaagtgatggggttggaattcaaacccagtgctctggactcgaaagtcctctttattctactgctcaacaactgacataaattcaccacagcttttgtatcaacatcctacgtaacactgacccactctgttttgatatacatagtttttctgtagaagtgctgttttgcatgaatgcattcatgatgtgatcagggcttttggtactggtcctcccactcccaattttttttttaaatgcctgtcgcgttaaaaatttgggagttggggccgggcgcggtggctcacgcctgtaatcccagcacttcgggaggtcgaggcaggcggatcacgtgaaaccccgtctctactaaaaatacaaaaatttgctgggtgtgatggtacgcacctgtaatcccagctactcaggaggctgaagtaggagaattgcttaaactcaggagacagaggttgcagtgagccgagattgcgccactgtactctagcctgggaggcagagcaagactccatcaaaaaaacaaacaaacaaaaaaacacacacacagaaaaacaaacaaaaaagcaattataattaaatttgagtagaggagatagataggaatccaacagttatagaatagtgccaggtgctatggtggaggtatgcacaactcacttaagaaacatgagaagggaccccgggagaggcagggtcttagtgaagactttcaagaaaaagtgatacttaacgctgagtagcagttgccctgggaactggctcgaaattggggagctcaagaaacagcagcaagtagtgtgactggagaggtgggttttacctcgggtgtgtggcaggtacctgatcttggagggctgtcagaaacgtttaggagtttgaactttctttttgttgttgttttttgggacagaatctctctctgttgcccaggctggagtgaagtggcatgatctcggctcactgcagcctctggttcccgggttcaagtgattctcctgcctcagcctcccaagtagctgggattacaggtgcatgccaccatgccctgctgatttttttttttttttgtatttttagtaaagatggggttttaccatgttgactaggctggtttcaaactcctgacctcaagtggcccacctgcctctgcctgccaaagtgctgggattacaggcgtgagccactgcacgtggctgagtttgaactttctctgtaaaatgccttttagggattttaagagattagaaagatgggtggcaagggagtaaagggtagtttgggagaaggtggctgcagactgcaagacatattaggaggctgttgttgctgtataggagcgaggcagtggagtccaagggaactaaggcattgcctgtgggaatggaggggagcagacagacaccaaaaataccaaggactgtgattaacccagttttgatgatcagttagctgtgaaggaggggaggggaggagagatggagaaatgacaccttggtttctagctatggagaaggatagataagggttgaataaggaattccagagaagcagcagattttggagaaagcacatgtttctttttttttttttcgtcttttgagacagggtctccctctgtcgcccaggctggagtgcagtggcgcaacctcagctcactgcaacctctgccccctgggttcaagtgattctcctgcctcagccttccaagtagctgccagccatgcccagctaattttttaatttttagtagagacggtgtttcaccatattggccaggctggtcttgaactccagaccttggtgatccgcctgccatggcctcccaaagtgctgggattacaggtgtcagctaccacgccaggcctccggctaatttttgtatattttgtagagacagggtcttgccatgttgcccaggctggtctcaaactcctgggctcaagtgatctgcccacctcagcctcccagagtgctgagattgcaagtttaattttggaccaccaaaaagatgagtccacatgtagacccccactctggccttggtgctctaacatctccatttctttcttcttttttctttttttttttttgagatggagtttcgctcttgttgcccaggctggagtgcaatggcgcgatctcagctcgctgcaacctctgcctcccaggttcaagcgattctcctgcctcagcctcccgagtagctgggattacaagcatgtaccaccatgcctggctaatttttttgtatttttattagagacgggatttctccatgttggcttggcgggtctcaaactcttgaccttaggtgatctgcctgcctcagcctcccaaagtgctgggattaccggcgtgagccaccgcacccagcctaacatccccacctctttgaccatttcttcccttgtaacaggcctgaggacctgaggtcccttttttcctcagaagatagttgctaccattcactttataaccaggactctttcttaagcctgggaggacagtgggatgtatcctgccaggccctttcctctccttttgttcattgtagacaagagacagagaatgataataaggatataaacttgcttcacaaggttggcatccttatcccctgttttacagataagaaaatggaggctaatagaaattaatttattgaaaggcacacaactagtaagtggtagaacctggactctaatccaggttctgactccagagttttctatcgctttactacctctaaaacaagacttaacctcagccaactgtaacctttttggcattcttttttttttttttttttgatggagtttcgctctcgtcactcaggcttgagtgcaatggcctgatctcggctcactgcaacctctgcctcctgggttcaagcaattctcctgcctaagcctcccaagtagctttgattacaggctcccgccagcatgcccagctaatttttgtatttttagtagagatggggtttctccaagttggccaggctggtctcgaacttctgacctcaggcgatccccccgcctcggccttccaaagtgctgggattacaagcgtgaacgactgtgcccggccacatttatagcattcttacggtcccttctgagataggaagtggaagccccagtggactttttgtttgtttgtttgttttttaagacagagcctcgctgtgtccccatgctggagtgcagtggcacgatctctgctcactgcaacctccgcctcccgagttcaagtgattctcctgcctcagcctcccgagtagctggggttacaggcacatgccactactgcccggctaatttttgtatttttagtagaggggtttcaccatgttggccaggctggtctcaaactcctgacctcaaatgatccacccacctcagcctcccaaagttgtgggattacaggcatgatgctggagtgcagtggtgctatcttggctcactacaacctctgactcctgaattcaagcgattctcctgggtcagcccctcgagtatctgggattacaggcgcccgccgccaggcccagccctccagtggactttcattcccgtttgttattgctgagagtggagctcatcaagtagccccaagctcttgtagggaaagaaggcagaaagacttctctgtgcaaagtgcattttctcacacggcacttgtagtatctagtggaaatgtcttcctgtaaacggttcattcaacagcgcttacagttgactagctgcatccctgataacagacaaacgttgctgtatggagcttcgtcctagtgggaggagagggataaaaaacaagcatggccgggcgtggtggctcacgcctgtaatcccagcactttgg

SEQ ID NO: 2421 - DNA, 11699 bp, Homo sapiens
ctggaactgtacacttaaagatgtctaagatggtaaattttatattatgtatgttttatcacaatttaaccatgaataattattttaaactaaaaaaaaaaagtctagtaagcctcttgacagaagataccgcaaaggtgtcatgaaggccaagggttgaagttttaaaacctaaactgtgtaacaggctctgtaacggggagaaacccaagaaacttatggtcaagttgaaactcacaaactgcaggaatatagtcattggggtcccttagatgcagaaaagaaaattaactacagcgagttatgtttgtatttcacataagaaagaattttgaaatagagttgtccattaggggtagggtctgtcctgggagatgtgagctcatttccattggatatgactcagattatctattagtcatgccatgggtgtgaagttggagctagataaactttaggatattttccaagccctaattccatgactttgtgattattatcgccataaactctgaagtcttggctgggcacattttccacaaggggcttgtggtaaagtgtagaacaacgaactcagaaaaggcctattcaaaaatcagaactagtcatggtctaagatatattcccacaaagttctgaggccaagataacttaccgatatataacccaagaatatttctggatgtttcagttactgagcatccaggaagcctcacctctggacattgtgtgctaatcatctcttctttctttctttttttgaaaacagtctgtatccatcatcaaacacccctaggatgttatccttcttgatggacacattacagtttattcaggatataatttacacccccaaatttctatccctaactcagacctctcctctgattagattgttgcaatcagttggatatttctgatttgtattttaaacttattacacttgaatatttattaggcattttaaactgaaaacccctgacgcaaattttctgccatcaaacctgcttcttctacagccttgcccatttcaatgaatggcaactgtatccttccaatacctttggccaaaaaccttacaatcatttgtgccttttcttttacaccttacagccagtctgtcagaaaaatctattgtccctttttccaaatatattacgtttctcatctccactactacctcctggtctaagcatggttatctctcactgaatttaccacaataacctcttaactcatccctttgcttcatgtctcagtctttcgcagcacaggaatcacagtaggctgatgattcctactcaacatttatggtgagtgattgtggtgatggttgcatgactccatacatcagtcaaaactcatcaaatggtataatggaaattggcaaatgttattatatacaaattatattgcagtatagctgatgaaaacagaaaagaaagaaagaaaaaaaaacctcctcagcttcccacaagcaaagctgcttcctaatcgtactctgtacttatttgcttacatatatgctatctcccgcttgatttaatttcagcacctagcataagacttggcagagagatactcaacatatttactgaatgtattagactagtgaccttgggtacttagtgtctttttcaaattagtttccagtaaggtgataatcagtttagatgaaataatcattagctttattccaaatctataaaagcccattattctatgattctaacatagagtggcattgaagctctggaagattgctgattttaggccagtctctccaagagccatctagtgggaagagtaagtaattgccctgggtaattagagagagagagagagagagagagagagagagtgtgtgtgtgttttaggccagtctctccaagagcatctagtgggaagagtaagtaattgccctgggtaattaagagtgtgcgtgtgtgtgtgtgtgcgcgcgcgcgtgtgtgtgtgtgtgtgttttaggccagtctctccaagagctatctagtgggaagagtaagtaattgccctgggtaattaagagtgtgtgtgtgtgtgtgtgtgtgtgtgtgtgtgtgtgtttctataattcagtcacattaaatgacacaaagattcaccaacatcacacttttgccaaggtcttgcctaaaatagagcatttttctccctactggaattctgacttccaatttagaatgaactcctttggtgggaagtaatgaattggcctcagatacttatcatgagttacaggaagatctcatgaaactcatgcagaaatgcagccaggcctccaggaagagctgggaattctcgaggaaagtaagaagatttttcgtgctttgtcctctttctttctatgtacagctactttattcttctccctcttccaattggctttctctacttctttatccagaatgattaatattgtgtaggtctagaccagtaattttttactctacttaccagaaacacgtagagagttttaaaaattatgatgtccaggccaggtaccttcctactaattatatcagaatcccttggagggggactcaaataatagtatttttaaaaatattttaaaaatccctccaagaaattacacagagcattcaaggatgaggtcacttctccagtaacatgagttcttttcctagttcctaattatcaagtaagagattcaggcttggccaatattgtgttaggtgtctattttattcaactacgtggctactgggggtctgttcaagagaacagaccgtttaagttcggaagatagtctaaaaggtgctcatgtggacctctcatctgctaataaagtgtcagctctgacaagcatcaacacattgtccaaatgttaaggtctactgtaaaaataggacagttaaaatgtttttctattttattcttaaaatcaacaagacagttgtccatttgcaagtaatatttataccagatccagtgataagtattttttaatcacgatttttaaggtatgcattattctcctattgaagatgaggaaagtgaggcccaaagaaagtaaactgcttgtccaaagattaataagtggtagagcaagacctgaattgaaagtttacacaaactacattatatcaaactgcccccaaccttttttttttttctttttttttgagacggtgtgttgctctgtcgcccaggctggagtgcagtggcgtgatctcggctcactgcaagatctacctcccgggttcacgccattttcctgtctcagcctctcgagtagctgggaccacaggcgcctgccaccacgcccagctaatttttgtattttttgtagagacagggtttcaccatgttggccaggatggtcttgatttcctgacctcgtgatctgcctgccttggcctcccaaagtgctgggattacaggcgtgagccaccatgcccagctgctgcccccatcttacataaacatgaattttctaaattattaatgtcctcaaaacaagaaactaacctaaaaagttattcatgatggtttgattgaacacacagagtacatatacacacacattgaaaaatcttatcaaaaataaaaaccataccctattcaaatatcattaagacaatcataatgccattaaagaatagaaataaaaatacagtcaaactataataacccattattttattattaaattattactctttaccactggtttcctctgttatacctcgtggggtcatggaattatagcagagacatttggatgtgtaatgattatgttgttgggaaaaagtaactcacatggtaagtatacatcccagtggcattttctcctgatttgctttgctagaatgaaatttggaaaaaaaaaaaaaaaaaaaggaagagaaaagcactactaaaagcaatactagtggtagtgtttgttatatttgattgaagaagaaatcaccatcactatgttccatgcaattcaaaataatcaaacagctttcacttagtcattttgtttatatttcattgtgatatgctacaacgggccctatcttggagtacagctgctatagaaacatccattctgaaattattttaaggaaaagaataaataacattgcatagctgcttgtggctagattaattcacagactggattaatgcattaataattaactcaagatcagttccttcgctctttgaagaaatatctattgagggaaaaatcttacagggtaaaaattaatttggattagctgtttccatgatggaaaggcctagctccagtgattacaattataatataaaaacagatttcattctccattttgagaaattattattcataataaaatttccttctgatataaaatcttttctgatttgaggcttcagaagtttctacaaaataatgattccattttacgcatttctttaaaagactgtgttcacattcttctatacttgtaatctgagcataaaataagactagaaaattaaataatattaattggctccatggcataatggtcagcatatctggactctgaaaattaaatgatattaattcaaatccatgtcccatctttctccatctaaactctacctctacccccaattatcagctctttagcaacttaatgtagtaacatgcaaaaactcctcctccttcaacaaaaaataactattcctccccagttttcccccatttactttatgacactaccatccatcaagcttgttaaaacctgttaattgtattatttttgatatttcttctctctcaaatcccatttctattctacagcaaatctaattatttttgactccattctctttgccactattatctcttactgagactttttcttactgacttctgcattctccttgcctcctactcaaatctgttctttactctgtaccagagtagggtttttaaaacagaaatttgattgtgttatgcacctgcttaaacttttcattagtttttcattggattttgttaatattcaacttttcatgatagcctacaagctctttcatgatatggtcctgtctgcctatccaaacttaccttatgccaatctctataaatatacacatcatagtcacatgtgccttctaccaaactctgcctttaactggacatttacacttgctattttctctttctgatgtattctttttccatacttctatttccttgtaaactcttctcccactgccacgtaccagctctttagcaacctgaggtagtatcaccaatgagccaagtgaacttgtaaaatatgcttcctaaaccccatttgtcccatgatctaaaatatttccttagcatataaaatttatctatatctatcaagtgcattctatacggcaggcattctgtccaggtgctaggaacacaacagttaacagagtatcttttctttcttttttaaaaaaagtagtctattttatttattaatggttaaaaaacggcttcactaaacattgttttgttatttaaatattaatatgctgagagcagtattattacacacctttttttccacagccttattgaggtacaatcagtctacaataaacataattaatgtataaaagtcagtgctttggatatatgcatacactcatgttactatcactacaatccacgtcacaaacatatccatcacgttcaaaagtttacttgtgtccctttattgttgcttactttatcccttcctttttttcttttctctttctcttttcttttctttctttcctttcttttttctttcttcctttcttttctttcctttctttccttctttcccttcctttctttctttctctttcttctttctttctctttttcttttttccctttttctttctttcctttccttttctttttctctctcttctctctcccttccctcctgtcttccctttccttctttcctctttccttctttctccttcctcccttccttcttttcttttctttctctttctttccttctttacttttcttttctttccttctttctttccaatatacccagcatccctctcacccatctcctggaaaccatcattctattgtctatttctatacatttgactaccttagatgcctcatatagagggaatcatgcagtatgtgtccttctgtgatggccacttcatttggcatgtcttcccggtctatccattctttcacaaacagtacaatttctttcttttttaagtctgactaatattctcttggatgtatacatcagaatttctttttttttctttttttttttttttttttttgagacggagtctcgctctgtcacccaggctggagtgcagcggcacaatctcagctcactgcaaactctgcctcccaggttcacgccattctcctgcctcaacctcccgagcagctgggactacaggcgcccaccaccacgccaggctaattttttgtatttttagtagagacgggttttcaccatgttagccaggatggtctcgatctcctgacctcgtgatccgcccgcctcggcctcccaaagggctgggattacaggcgtgagccaccgcgcctggccattatccatttatctatcagtagacatttaggttatatcttggctattgtgaataatgttgcagtgaacatgtgggtgcagatatctctttgagataatgatttcagttattttagatatatacccagaagtgggactgttggatcatatgatagttctattttaaattttttgagaaacatctatactgttttctatagcagtttcaccattttacattgcaccaacagttgtataagggtttcaatttctccacaaacttgtcaaacttttgtttttctgataatagtcattgtatcaagtgtgaggtaatatctcaatgtggttttgattttcattttcctgatgatcagtgataagcattttttcatgtacctgttggccatttgtatggcttgtttgaaaaaatatctattcaagtcccttgctaatttttaaaattggactatttaaatattttgctattgaattttaaaagtttcttatattttttggaaattaactgctggttaattaatggtaaatatttcttcccattctaaaggctgctttattactctgttgattgtttccttagctatgcagaagttcttttagtttgttgtaatctcacttaatctccttttgcttttgttgactgcacttttggtgtcatatccatgaaattattgccaaaaccaatgtcatgaagcttttcccatatgcttccttctaaggagttttagagttgcaggtcttacattttagtctttaattaattgtgagttaatttttgtctgtggtgaaagaaaacattccaatttaattattttgcatgtacatagccacttttcccaatgtaacatttattgaagagacaatcctttccccgctatgcattcttgactttcgtattgaaagtcattgtatatgttgtatagttgactgtacatgacatggctgtaggatataagctctctattgttccaatgctctacatgtttgtttttatgccagtagcatactactctgattattgctttgtaattattttgaaatcaggaagtataatgtttctagctttattcttatttaaaattgtttttgttatttgggtattttgtggattcatacatattttaggattacattttctatttctgtaaaaatgtatttggaattttgataaggatttcattgaatctgtacattgctttaggtgaaatggatattttaacattagtttttccaatccaagaatataagatgtctttccatttagttttgtctgctttactttctggcagtattttagagtttttattttaaaagtatttcatgtccttgattcagtgtattcctaagtactttattctttctggtcttattgtaaatggatttttttcttaattttttggatagtttattgttggcatacagaaacacaactgctttttgtatgttgatttgaatcctgcaactttactgaatttgtttattagatctccagtttttgtgtgtgtgtgtgcagttttcagggttttgtatgtataagatcatgtcctctgcaaatagttaatttttcttcttgttatctgatatggatgccttttatttctttggtttggcatatggtttttgcccatcattctgttaatgcggtgttatcacatttattgatttgtgtatgttgaaccatctttgcatcctaggaataagtcttgctttatagagatttataggtcatagaatatgatctttttaatgtactgttgaatttggtttgctaatatttcattgaaagtttttgcatccatattcatcagggatattggcctgtcattttctttgtttgtggtgtctttgtctggatttggtaacagtgtgatgctggcctcataaaatgagtatggaagtatttactcttctactttttacaagcctttaggaagaaaggatattaattcttctttaaatgtacagtaaaattaacctgtgaagccacctggtcgtaggctttcctgtttgggttggttttttattactgactcaatctccttatttgttattggtcttttcaggttttctatttcttcttaattctgtctttataggttgtatgtttttaggaatttatccacttcttctaggttgtcaaatttgttcataatagtcccttatggtcttgctttttatttctctggcattagttgtaatgtctcctgtttcatttccgattttatttttgaatactctttttttttcttggttcagataacaaattgtcaattttatcttttgaaaaacaattcttaattttgttgattttgttctattgtatttttattcattttatcatttattcctgctctaatctttattatttccatccttctgctaactttgggcttagttgttttttttttttgttgttgttgttgttttgttgttattgttcatcgatgtttaaagttaggttatttatttcagatcttctttcttttgtaatgcagacatttactgctataaaacatctcttagtactgttcttgcattaagtttttttttattagtcttttggtattttgtgtttttgttttagtttgtcctgagagatactctaatcctgcccccatgattcaatcaccccccaccatgccgcacctccagcactggggattacaattcaacatgagatttggtggagacacagatctaaaccatatcactgaactacagtaatatgttggtttctttcacattctactagttataatattatctgttaatataatagcatgtagactattatagcctctactgcatacaaaccaaagagtctgttcaaagaataaaacagtaaattaacttcaagaaatgactttaagttagacagagatccccctaaaataataaataacatgttgacaaattttcaaaagtgtcaatcaaaaaggtaacaattgccatactgacaggccccggggcaaaggtggtgatactgctgacaagatgtcaatgactaaagtaataaaaacatggtgaccagctcagggtggtgcctgacagcaaatccatgtaacataaaggagtcagtatgatcaaggtgagagtgacgaaggtaaatcaaataagctgacatttaagacaggtgacagcagtgatgttaaatattaagccttggaataagaagttcaaaattgtaagtcaacaacatatcagccaatacttgctcttgtgttaacctattaacccttatatttctagaaggagaattctctgaaatagactaaggtgaggatagagtgtgaagagaaaaccagcgtagttgcccagaggtcacttcaaaatagaaataacaatatctatagggaaggatggttgtgaagatcaaatgagaaaaactacaaaccccaagcatgctcatttgtatccttctgttcccatggtaactctaccccaccatcaaacaccagatcttttagtagtctaaggtagtatctatcaccactgagccatgtgaacttataaaatccatttcctaaactcggtgtcctcataatctaaaacatttccaaaacctacccattgtttcaattgtatttattaagtgcctacatatggcaggcatttcattggccaaccaccaacaataaggtaaccactgttctagggatacaacagagaacaaaactgattaaaaatgtatttgaaggctacattctcacaggatgttgtctggtatacagtgactgttcaatatatgggaagtgatctaaaatgaaataaggtaaaattttgagtattggttataagaatcacaaaaagtccaatacttgtccccaccctggagcagagttctctgataactggtaggaacttacttatgtgttctgacttccacatgctcagctggaactcaaaaaaagagaaaagaacatcatgaggaaaaagtaagctggttattgaaaagaacagtagaaccgagaacagaaaaacttgggttctacccccagcattgccattaactagttttaacaccttaagaaaggcattacatttttttcttttattttttatggatgttattcttttctttatctctttgaggatatttaacaatttttacaacattttcagataattctattattgttgtattcttctgagtaaattatcttactatgtgaatttactcttttaaatccagttcctcagcttcctaactcatggccaactacatcttaaccaaatccagtatagttctccatttttttaaatgggaaaatggttaatccataggtaattttgcacacaatgtgaatgctaagcctctaaaaacaatcaaccataatgggtattcaataaattagatttttaattttttatatatattatttgagttttagaaccatataaaattataattctgccccttccatgaatgaaaatgatgaggttcaagataacgtattggagattttaaaagttgttaagtccttgagctgggaattctacctctatgatgacaaagttctgtctcagagacataagtgagaaaaccaaaaaggcaacatgatattcccaaaagtctgaaggcagaattactgagcaattagttcacaacttgaacccagactgcttgactttcaggatgccattataccatcctggatattttttgatctgatcctttacagcttgtttgagattcaactttactaaatcactgaattcagaagaacacaattctggtcaaaatttctaactaggttattttgtatttaaattctccacagcaaactaaagattttgggtgttttgttttattgtgctacattgccattagacccagcagaccccatgcattagagcgctgaaaatttggcatgggatgcataacacttctactctatttggaccaattgatactgcagtggttaatttccttaatactccatcaacatgaactaaggttagattccctacgtattggatcagatttttcagttagtttttatttctgccattctaatcttcaattatctctgcctgaagtagcaatctattgctatatgggtaaggaaatattctgtctttatggagacaatttcattttaaattacttttcag

SEQ ID NO: 2422 - DNA, 10405 bp, Homo sapiens
ataaacatgaaataaatgtaggcattaccttaaaccaccaacatattcttgtttttcaaatatagtgatgtcagagtaccccaatcgagccaaaaaggaagcacaacttatacttgcaggcccagcaccaaaaagagcaatctttgcagaataggcttcagacattttttctgggggaggcagcgaaggatttctgatctgtgggatactcattgctttgaatacctacggggaaatcaattgtcatggttaaaattttgaaactagcttacatcctcaaacatatttttaatgtttcaaacgaattcttgttttaaatagcaatgagcagtacattttcagtattaatatggtatacttacaacttttattgtgtcaagtagatgaggagttatggctaactttcagtctttcctttctagagtcatgcctcctctaggaaacactcatggggcacattccctactcccacctagagggtacattaagtgcctctcctctaagctcctacagcataatctgtatgtctctaacataaccatctgtggtatgtgttatgatgtcagtcagtagaatgaatgttagttccctgaatcagaaaacatgtcacatgtaaacacattacccttgcattataggagttagcattgcgatggcacacggtagacatttaataaataatttcttgaattctgcttttgattatgacagattaactttgggagaataatgatttaaaaaaatagttgaaacattcaagaactactgacgcaggcatcttggaagggctaacatctcagaggaaagtaagaacaaagttaagtgaccagaagtcacttttcccctgagggatttgcgacttcttaccaaagggaggaaggctaagcatcttgaagagaaccacagctcagaaaagagatgttggcagtcttttgaaaccagagagacacagagttttggaaatgtaggaggccattaacctagagcaaaataaagtacagaagagtgagattaattcttaaagtgcatatgacaaaaacctaaagatctaaacagaaaaccctatggtccaggaaaaacaaaaactggagtgactaaataagaaagagccctagtacacacctcagtgtacggctgaagcttctggagggctacactctacaagtagggcaaatgaggggtaaatagccaacctagccttgagtcaactcagccctggatttaaatgacagtgatcagtcctcactgttatctatgtaccaaacgatagaatgcactttctgtgaataataagtcaaccacagtttctacaaattttttataaaatgcctgggtttttatttttaaaagtccaagcctgcaagaaaaataaacctaaaaaaattgaaagagatacatacataatctcgtaagtgtggttatcaaaaataaattttagaataactatgattgatatgttcaaaaatatgtaagaagaatgtaaacttcattaaaagctggaatttgttaaaaataaaaaattaaatttactaagtacatttagtaaaacatatttagcaaaaaaaataactagctaatgtggaaggagggagtgggattttaaaaacacattattaaaatgtattaattaaaattattataaataggtggtagagggtaggaaacaaagaaacaaatggtaagatggtaaatataaatgtcaacatgagaaattatattaaatgtaaatggactaaaattccaattaaaagacaaaagttatggaagataaatgccttaaatataagagcacagatagataagtgtaaagttaaagactagaaaaagttatacaaagcaaacactaaccaaaagaaagctggtacatatatatattatatatatatatgaaatatatatataccaatattagaaatattacactttaaggcaagatgcattactaaacttaaagaacatttcatagcaaggaaatggtcaatctttcaacaagattttaaaatacaattttaaatatataaagcaaaattgatagaactaaaagtaaaataaataaatcactataatctcattattctactctcatgaaaacttgactaccaatagaagtggccaatgaataaatccatattataggtaagttatttatgctatccaatggattggctcacacagttgcttgcatttaataggtcaaagcagtaactttctctcctggaaacccagacagagatcaatagatataaatgtaagttttcttaagaatgaggaataaaggtgacaggactttacattttcttaacctcatcccacatataccacaaactattgtaaataaagtcaaaacacataaggaacatccaaacaatcttattttaaaaaattgaagagggtattatcaacaagtattatagggtcaatttctaagcatgagatgaaaggtcctcataaatggtctcataatattttgtcattttcattctaatactttgtcacttttactggtttacttatctgtttcctctcttagaccataaaatatttaagggaagacaacatctttgaattcaccttttaatattcagtgtttttatacataagggggaatatatgttaactaatgagtttaaattggtaataaaataatttcttattcccagctacaatttgtataatttacaaattattaatatgtgttcctgctcttccctgtgctatccaaacagtacagattttcttaaatattgtttttgaatcaacatatactgttatcttttattcctttctaagcaatgtgaacaaggaactaaattctggtagttttatatgatcattaattaaaatgtagttaaaatatattttatatttccccaaagaaaggtttcacatacttttcataaatatatattttattagatcattaattaaaatatagttaaaatatattttttatatttccccaaagaaagatttcacatacttttcataaagagatacttaaaacatatgtttaacgtgatcaaggatctctgatcagggaacagagatatagctaattttatttagggattaaataaatgctaatttctttcatatttagttgaataattttagctttgtgaactaataattaaatatttaactttcccatgttaaaatctgctaacatttacaaataacattgtgttttaacaaatcttaaatgaagacatttatgatgtatttaaaagtatcatttattgctgacatcttttacaatggaagcagatttaaatgtactaaggctacagcattcattataatatgaagttacagtgtcataaccaaatggaatataatttgtgctcagcattcactcataagcaagaaataggttagttctgaaacgcctagcatatctgaacaaattctagctaatggcatgcaaataataaagtagcaattaccaaataatacacaatatgtatgtattttcacctaaaatattttaatatttttgaataaaaatttaagccttcttttaaaaaaattatgagatgcaaacattgaattattttaaaaaatgtttacagaatccctattaagtacccaacacagagttaaagactcttaaaaagtgtttgaagaaatgaaagcaagcacactcctcagtacacatagcatatgtgcacatactagaatgtaaattgttagcccgatttgctcaaccccgtgcactgcagcttaagagttgttcaatacatactcattacattgcttggctcaatacactaatctatcaattggtatccctttgcctgctctgttctggaattttttctttacaactttttattgcactaggttttccccgagtttaacaggagtttggattaaccttgatgcaatttttaaggaagtaaataattgaaccacatttttgtgaatttcagcacaacagatggtatatttttagaagtatggcattgaaacgagactcttggggttgagtcttgacttccatcattctcatgatgtatagaattgaacaagtcctttaacatttctatgcctcagtctccttaataaggtgggattaataaaatatatttcatagagatgctttgaggatttaatgagctaattatatgtggaaagtgctttaggaaactgcctgcccatatagcaaatgttatctacttctcatttcacctagtgttcaaattccatgagacagaatgtatctaaactcatagtgtccaagacggaatccactagccacatttgattaagttcaaattaaaattaaaattaaataaaattaaaaatgcaaagacctcagtagcactaattatatttcaagtgctcaataactacatgtggctagtggataatacatcgaacacatccatcactgcaaaaattaaaatttcaaacatataatgcaatagatataaataatctcatgagcatagttaatgggaaataaataatttagaggcagtgagtttgtagtatttgttatagttatttttaatatgatttttatgactacatgttcatatactttaatttttcaaaattactgtgtttcacaacctgtttacaaaattcctaaaaatttaatcagcactagagctggtcctggctggcttcagcacactattgcacctcggcaatacatgagggctcattcaatgtttttttagccactaatattcttctaccatcaaccctaaattctgaaatacataagttacactttccaacttaatagagatctgaaggcataagtggccctctatccctttaaaacatcagcaactaactcttttttaactgaaatacaagtaatggattatttcatatatacacaatatacttccatgaatgtagcctgattatgacaaaatgagggcaaatggataaaaagccaaataaatagctccaaaaatattttgtgggtgaatggggggtagtgatttgtatttaagtatattatgaaactatgaaaattgaaatcaattataaatctagagttggcattatatgaaaaatgtaaattaaaataactaatattgtaacactttaaactgccaatgaatagattgtgtaagttaaaaaaaagagggttaacttaattttgttaaatttaaaaataaaagtttacaaaagttagttaaaacaaattacaaaatttaaaatgtccataaatacgaagaatatttttcaaaaataatatttttcattccttttattaaactacatcagtcttcagagaagtgcaacataaaattacaaacaaattatacataaaagatattattaggtccagttacttacagtatcaaattcctaagagattttttcttagaatatagttccctattgtttcataatgtaacaaaaatattataaaataatttggctctttcggtgagaaagacccctctttttttcgttaaagcaaatgtcagttgtccatcaactgactaatattctatgatttaatttttaagttgaagggtcaactgccgaaacaatgtaataaatgaaataaacttgttaatatcagaagagagtgactgaagtatttaaagatgaatgaaaagtatacttaatatgtatttccccacaataataaggtggccaatatttattgaaatatatcctatgtgccaggctttatgttaaatctctatcatttagtcttcaaccctcctttatggaggtacaattatcagatccatttcctaggtaagaaacctgtggtcaggttcacatacaaaagattttatcttaaggctacttgactccaaagcctgaactctttttttttttaaattatactttaagttttaaggtacatgtgcacaacgtgcaggtttgttacatatgtatacatgtgccatgttggtgtgctgcacccattaactcgtcatctagcattaggtatatctcctaatgctatccctccccgctccccccaaccaacaacagtccccggtgtgtggtgttccccttcctgtgtccatgtgttctcattgttcaattcccacctatgagtgagaacatgcagtgtttggtttttttgtccttgcgatagtttgctgaaaatgatggttttcagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttccagttctagatccctgaggaatcgccacaccgacttccacaatggttgaactagtttacagtcccaccaacagtgtaaaagtgttcctatttgtccacatcttctccagcacctgttgtttcctgactttttaatgatcgccattctaactggtgtgagatggtatctcattgtggttttgatttgcatttctctgatggccagtgatgatgagcattttttcatgtgttttttggccgcataaatgtcttcttttgagaagtgtctgttcatatccttcgcccactttttgatgggttttttttcttgtaaatttgttttttaacgattacattttcacagtaatcgctaaaaaattcactatatttctctaatttttcaataagaaatgtataactgaaaaaattatatgaatttgtcattcctaacccacttagaatatgttatattttaatatattaaattcatacattctgataaaatagattttgatatattctagccactctactaacaaaaatagctggttattataattaataaattaactttacaaaccaagaattgttcatgaagcatttaaaaaacactgaactacatcatctggtttcccaccatgctatcctgccacccgagaactaaggtagttggtgcattaagagaactgcctccctattatcaacatcctctccatagtggtacatttgagtacatttattacaactggtgcaccttcaatgggtttgcacaaatttattatgaaaatagcatcataggactacagcatcatacacaatagtttctttcactgtcctaaaaatcttcttaatctccatatgcatccctctctcaccttctccccagcaatcactggtctttttagtgcctccatagttttgccttttctagaatgccatacagttgaaatcatacaatatacagccttttcagattggcttctttcatttagtaacatatatttaagttttctctgtgtctctccatggcttgatagctcctctctttttaatcctgaataatattgcaatatctgtatgtaccatagtttatttatgcatccacttactgaaggatatctcaaaaattttggtgattatgaataaagctgctataaatatccatgtgcaggtttgcatgttaacgtaagttttcaactctttggggtaaattgccagatcatatgataagagtatgtttaattttgcaagatactgtcaaactgtcttccaaattggctgtaccattttgcatttccaccagggaagaataaagttcctatttctcctaatcctgtcagcatttggtgatatcagtgttctgcattttggctgtttggtctcctctgaatgtttgtgtctacgcccccatttcattcaattcgtatgttgaaaactaaccacaaatgttagaaaggtggggtttttaaaaagtcattaggtcatgacttaggaggtgattaggtcatgaggagccctcctcaattagattagttcccttaaaaacaaccccaggagaaataccttgcccctgtcacatgtaagacaggcacagtaaaaagcctttacctatgaccagaaagcagcttatgagcatatattttttttattatactttaagttttagggtacatgtgcacattgtgcaggtcagttacatacgtatacatgtgccgtgctggtgcgctgcacccactaactcgtcatctagcattaggtatatctcccagtgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgggaattcccagcatccagaaccaagagaaataatttttgttgtttataagccatccagtttatggtattttgttgtagcaaactgagcagactaagcattctaatagtatagtggtatcccgttgttgtttcatgttgcatttccctgatgatacatatgaggcatctattcagatgcttattttccatctgtatatctttcttggtgagatatctgctaaggtctttgtatcattttttaaatgggttgttttcatattgttgggttgtaagagacttttggacattttgcataacagttctttatgaagtatgtcttttgcaaatattttctcccagcctgtggcttgtcttttcattttctttcaagacagtttcctgcagagtagaagttttaattttgtttctgtgtttgttttgagatgagagtctcactatgctccccaggctggtctcaaactcctgcattcaagcaaacctccctcagccttctgagtagccaggactacaggtacatgccaccacacccagctcagaattttttatatttgatgaagtctatcttatcaataatttattttataaatcttgcctttgattttgtacctaaaaagtcattgtctaaccgaaggtcatctacatggtctcccatgttatcttcaaagagttctgtagttttgtattttacattgaggtttatgatccatctttaattaatttttaatgggtgtaaggtttgtttctagattcacttttttacatatggaagtagggtggtataaatatcattcgttgaaaggactatcccttctccattatattgcctttgctcttttgtcaaagataagttggctatatttacgtgtgtctatttctgggctctctattctgttccagtgatctattgtctattattttaacaatatcacactgtcttgattactgcagctttacagtaagtcttaaaatcaggtagtccgagtcctccaactttgttgttctatattatgttggttaatcttttgcctctctatataaactttagaatcagtttgtcaatatctataaaatagtttcctgagattttgatttgggattgtactgaatctatagatctaattgggaagacctgacatcttgaaaatactaagtcttctatttggaaacccggaatatgtctctatttatttagctttttttatttatttcatcacagtttcatagtttttctcatatacatattatacctatttcattagatttatatctaagtatttcgtttttaaggatgcaaatgtaaatggtatacttttaatttcaaattctaatcatttattgctattgtaaaggaaagtggctgacttttgtttattaatcttatatccttttttgccaaaattgtgtattagttccaggagtttttctgttgattctttggaattttctacatagacaattctgccacctgctaacaaagacagttttatttcttccttctctgtatacatttcctttccttttcttgtcttataaattgcatttgtattctttttaaggtgttcccttccctacaaatattgtatcacttggactattttaagattattttaataggcactcaacaagattttgatgaatttcaaaattcctggccttcagtgatatgcttaaacaaagtagtaaaagtcaccaaggaaaacagttctaccttagtgataatgaagaattatctgcaagtgaatatccttttttaaattttactttttaatatttttactttgtaagtacatggtatatatttttttaattttactttttaaattttttaatattgtgggtacatagtacattcttgaggaacatttttaatattaattttcttgtgtattcatcctgtgatttctcatctttcattcatctagaaagtgcatgtatttcaccactccaaattgactttaccagcattttctccataattttcacattactttgaagaaagggagagattatattgatatttaaaatggaaagattgcaatgcagagaggagccacaggattttcccccaagtctcctcaccttctggagacagaaatagtataattttctaatcattatatagtgt

SEQ ID NO: 2423 - DNA, 182649 bp, Homo sapiens
ggcagagcgagactccgtctcaaaaaaaaagaaaaaaaaaaaccaaaaacaaaaaaaaaagaatatacatctaataatgggaagatgtttgctttctgattccaaggatttgcggttttaaattgactctcgtttagccagcctcaaagtatttaggctagatttttaaaaaagtttgcatggtacagagattctgctttaaactattgtcagtgctattactttacagacaactttgtcttgctttttatgtctcaccagctacattattgagcagggggtgtgtgatttggttttatgtgaagctgccttccctaagacgttggcttttgcctacctagaagatttgcactcagaatttgatgaacagcatggaaagaaggtgcccactgtgtcccgaccctattcctttattgaatttggtaagtttttgcccctcacttctctctatcaagggagcaaacaatatggagaagctatttgttacactgatataatatttatacattttttctgatgtttacttgctgaagttttagcttctgcttccttttccattccacttctttttgtctttttgagtgactaaggctttgttctgaaaagtaattttctctagtcttttgatctttcccccatagaaattgttgccttttgccctttctgttatttggtttgattcttctttagagtcacatgtgacaggaactttgctaaagatctacttgattggcatataatggctgagttcttctttaccccagtccacagactcacactcacaataaggctcattttatggagatcagaattgggaaatcagaaagaatgatgttttgtttcttttagtagaataagatcctctaattaaaaaaacaaaacagaacaaagaaatagaagatacctggtactcatggtattggggtataatatttactacattcaggaatggtgagcataggtgtctgtatttgtacaagaattatagaaagactaattactaatcagacctggtaaagtatctgatggtaagggatcaaaggaaatgtcctaagtacagtaagtacagggagtgagaacaagtaggatcaggctatatcgctgcaatttttagttaaaagagaaattggttttactggcttagaatttttgaagtgtttcaagtttgctagataaatgggtcatcttgctttggaaaaacactctagtgtttcataactatatactctccaagtgctgctttatataatgtccagtttttcaaattttatttttatagacagtaatactcccataaacctccctcaaaaagaagacaaatgtatcagggtcatacaggaaacagatggcacacccaaattagcttaagggattatatacaaagatatgactaggctgtaggagaattacaaggtacagtaacctctgaccagtagcatactggttgttaccatccctaggcctgaatgtataagggggaggagcagtttctgaaactgaaaaggagaaaatttctagagaaggccaacttgagaggagcgtaacttttggtagagggatacttccagaagaaggttatttccttctctgaaagaagccaggggaataaatacccggacatcactcactgtctgttctccttcttccctactgttggggcttcttcattgcctgaacctaactggcacagagcaaggagtctattgaggcgcttcatccaagtcagcttcccagtgcagaaagcaaggtgcaggagggcagagaggagatctaaagaggcaaatgaaaggggtacagcacacttaaattaagatttttgccaaaagttgaaaatatctttaataataagtcgttcttcctatagttttgagaaatactgatatgagcaaaagatggatgagacttcagtttttatttatttatttatttatttatttacttagagacagagtctcgctctattgcccaggctggggtgcagtggcatgattttggctaactgcaacctctgcctcctaggttcaagtgattcttgtgcctcagcctcctgaatagctgggactagaggtgcacgctgccatgaccagctagctaatttcggtatttttggtagagatgggagttttgccttgttggccaggctggtctcgaattcctggcctcaagtgatccacccatcttggcctcccaaaatgctgggatttatacgtgtgagacacagtacctggccgagacttcagttcagttttatattggtattttggaaaactccctattacatacttgctttacctgaggtttaagaatggaatgaaactgggaatgtatattagagaaaataaggtaaagtttctcagctttttaatgatcatgagcccttttgccatgttaggctgtaataatgctagagtgttaccagcatccttttaaggaatgtgtagaggtaagtaacacttagcctaagggtcctcagaatactgtttgaaaatttctgttttcaggaaaggcttactatagtgggtcttaattcctctaaggattctgatagcagccttagatagcaaatacttctaatttaaaggtattcaaaggacatttctcctgaatggtcgtctaattatacctttacatcttacaaatgaaataatcaaagcctagattttgatattcaaccaagagtttggttaaccatggacagtggcaaatccaggaataaagtcagaactgttttggtttttttgtttttgtttttgagacagagtcttgctctgtcacccaggctaaagtgtggtggtgtgatctcagctcagtgcaacctctgcctcccaagttcaagtgattctcctggctcagcctcctgagtagctgggattataggcgtgtgccgccacgcctggctaactttttatatttttagtagagacggggtttcactgtgttagccaggatggtctcgatttcctgacctcatgattcacctgccttggcctcccaaagtgctgggattacaggtgtgagccaccgtgcctggccaactcagaacttttaatttcctacctcagtactttgatggccatgaaagaaatggtcagttttcttcatcattctagatactttcattcagaaaaccaagaagctctacattgacagttgtgctcgaagaaacctaggctccatcaacactgaattgcaagatgtgcagaggatcatggtggccaatatcgaagaagtgttacaacgaggagaagcactctcaggtatctaaaagcaatgagtcttatgaagaaatggttctcattccatagacaaggatagcttattttgcagtgccttttatgctattagattctacctagaactgttaagaatttatctcccagaagtacattacattacaatgcttccaatatattttttttcctagcatgattagtttttgttgagttggaacagtgtaaaggactcatccatattagaagcaatgattatttctaacatattcacaaaattaattaaattatataacttgtataaattaagggaaatgaatgagagaaaactcaacaatgtattgcagtggttttttgagtagcctctttgggagactttactgctgccagatcaatctttataaaatgccattttcatcaaagcattcctctctgaaaaacttttaaatctgggactacaagataagatccagtctgacttatttttccgtcagtcagccattgttattgagagcttgttatttgtaaggcgttgtgctctacatatggaaaataaggaagatgcaaatgtctgtcattctctagttcacaaacattcttctgtagccacaccagcttctttactatccttagtggtccttagaacagaatactgccttatgctggacctgttctgtatgtaagacctccataagaactgtctctttaaagaacctttctctgatccttatagcctgtatcacattaatctcttctgtcctttaaactcctaaagcacttagtaacataatggttttagcacatattacatgtatgtgtgtttacctaatttaccttaaatatatttattaaatacctcttaccatattaaatatatatttaatatatattaaatatatttccatataacataagtatatgtttcatatatttatattaaagtaggcaaacatatttggataattaaatatttttatataatttcatatatttttttgagacagagtcttgttctgttgcccaggctggagtgcaatggcacgatcttggctcactgcaacctccatctcctgggttcaagcgatcttcccaccttatcctcctgagtagctggggctacaggcatgtgccaccacgcctggctaatttttgtattttcttagtagagatggggttttgccatgttgttccggctggtcacaaactccagggctcaagcaatccactcacttcagcttcccaaagtgctgggattacaggcatgagccacaacacccagccctttatataattttaaaagtgtaggtaattaggtaaaattaggttaaaagtatatgtatatttacctgatatttaaatattacctaagtgtttaatgtggacatgtaagctctttaaagatagtgcttatgtattttatatctgtttcacatactccttatatatcccccacagaaatggtcacaaataggttccttaataagtatttttgaattcagccatgctatatattcattagtaagtgagttttcttttattatgaactacaaactttaacctttttttgagtagtgagcagttattcatttaccttcacactctttaaataccaaattttgagtgagtgagtgtgtaaggttttgtcatacagacttgcaattcctatatgggataaagtagactagcacaggaatttttcttgtatcactcatgcaagactctaaattccttaaaggcagggatcatgtatattttgatcactgttgtatcctcagcacttcacatggtgcctgtcacataaatatttgttaaatgacttctccaagcaatagctttgtctttatgttatcctgtatttcaaaacgttcatatataaattctctcaactatgacttgtttcatagggtctaataattgttcctctgctgagttattctcagcagatttagattcatttagcaaatgtttattgagcactaactatataccaggccctgttctgggcattcaggatatagcagcaaacacaataatttaaaatccctgtccagtgaagtgtatattcttgtaggctctgtaaaaagatgccctgtgcattgtcatggttatttctcagtccctgactcttcttccgtcactagatgtttttcttactcatgtgatcagttgctaattcagacgtggctgtcatgcctgtgttattaagtaacgccatgtttcccaatcaaaaccagtctctattaagcaactccaaatattccaaaagcattctttaaggaagaaacagccggattgcaaaatagttttttctgaaatttcaagaagtgaaaagtttgatcagaatttattatgtcaaatggagagtttgtgtttattattaaaatatgccctatattttaatatggtctagcttgtgtctatctggctatttctctaagtgtttagttaactgttataagaagataacaacattacaaatgtccttgggggtgaaaaaacttgccagaaaatactaaaaagcttaatttacttgcgtttttttttgtagtacttattgtattttagttacaactttcctatgtctattgaaatataaatcctgatagctttaacttcatagtagtctctactatgtggagaatcttagaaatgttagcagtcatcattgaagtatagcttaagactgtgtttggttaattgaattttctggttatctgagtttgttttacatggattatcattatcgtttttcaaaatataagagaatatgattcagaccattagaagattatgaagataataattattaacatgtaataattattataatttatcatgtgcaggcattgttgctcactttacaggcaatctcatgtacatacaactttatgacatagttactgttattatccccaattatagatgaagaaactaggttttaaataggttacatgacttgaccaatgtcacataacttgtacaggtgatatctgaaccaaagagtctgaggccagaacctgcacttctaaccaccttactatatagcctcaaaaattcagacataatctgatcagcatcatcagttaattagtatatgcaatgttagcctcaaaataaaaatgatgatttaagattcatggttgttgcagtgctgctcattttggttatttttaatgccttaatactttcggtaaaatacttccagggactaattaatgttttccttttttcctctttgacagcattggattcaaaggctaacaatttgtccagtctgtccaagaaataccgccaggatgcgaagtacttgaacatgcattccacttatgccaaacttgcagcagtagctgtatttttcatcatgttaatagtgtatgtccgattctggtggctgtgaaataatgaatacagtcactggtaagggagaacctagaacccagtaggtgtatattttcaggaaactgagctcacagagatgtgtattagaatccaagtggaacttctgcctctaaagaccttgcaagaaaagagatgtcctgaaaatgaaaggttgcacctcatttaatgaagcttaaccctatgtagaaagtctctttcgggggcagaggctttctctgggtgccaagccatatatattagggaatagtagattgttatttcgttttttccctcccagtgcattttaaaaacagcactggctggggcattctcattctctgatggagccatcaatgagatttaacttagtcaacctgtgctagcaacattctgaaattccttcaaagaaggcagtcctttgggaaggtgtttttttttttgtttttttgtttttttgttttttttgactctaatcaacattccttttgttggtgacatttgtgattttcagtaatctgagtttttgatggccttttaaacaagactccagtatgtgaaagttaattgctgtgctccacagatcttgtctattggcccctgtagaaagttaacctttgttgttttccttttataatttgcttattgcacaattgctttagggtaagtgaattatattaagatgccttgaaattatagcactccttgattaagaagctaaaatgtttctctcatttactccttaaacaaaagacttaaattagtttgggtcattattacttttattttgcagcatttggtttgttattagtgtaagagcaagtataggatatggagaggcccctggcttcatgagaacaaaggcaggcccaggttataattacagctttctcctgccccttctttactttctctaccacagttttctccgctgtttgttttcctcttgccacaatttgctaacacttaaaaaattttcctgcacccagtagtttcatatcctgtagacatcctcttaggacattctcaaatttcaaaataaaaaatattcatctatgtagttaattaaagttaaagtttctgcagatcaactactcaaactactaaatacatttacctgagaaaaagtctctgagagcacttcattcctgttttagttcgtgtaaattctctgagaatgttctggagatagataactcatttacagtggtttctattaactaattaaagtacccatgattttttccttttctgctcagggatgatggagatttccttttaccttttttaatggggtaaattttttaatggggaaaataggccttttaaatattattgccagggtctgcaatataacttaaaattcctgtacatactgcaaatatttctttaaattgcacaggaaaatgagcgaactttttatttcttaatatctttggcaaaaaactttaaccagtaagcaattttataaccctgagggatcatcaaagatactatcctgattcctggtaaggaaaaatatattatttccttataacaaggcaaggagaaatgctattttattcctgataatttatatagctagaataatttttttcctttcttttatggacctaaatctgccaattgggaattttgtgcatgaaatatgaagttactttttatagataatcagtgcttttaagtccctaaaaggctcctgctgaagtaatgatgatgttcataataaaagcctttgaaaggctgaaaacctacatagtggtaccatagtatttggagcttctataggagtggagaggggcagctcattgttgagagttgcatgctgcaacctaatggtcagcaatgaaagaaatacttgtagaatgttcacttcagtgtgaagttttgttatctagttaatttatatacatatatcctttgtagatacatttctatctaatcttgttgagctaattaagaaataaggggtggggtaattgtcaacaaagggagaagaaagtggtttaagatcagggcagcagaaaaattagagaacaagaatatcataatatggctcctggttttctttataagaggcagtgggaagatctgactagatgaaatgtatcatcaaccaaactggcatctaaaatagaatgggataaatactgtatggggttattggaggcatattaagaaaggacacctaatttattttgggaagaagtatgttaagagaagactttctagagaaggagaatggggcattctaggaagagtcaatggcatgtgcaaaggcatgaataaagacagtgaggcatgttttggaaatgtaacagcttgattcagcttagcccatagggtaagcatagacaacagaggagacttgaggaatgagaactagatgggtacactatcataaagggacttgtctatcatgctgaggagtttagaccatcttaatggtagtggccaaggatggcatcagatttatagtttcaagtgatcataatattggcataaaagatatattagggaggaagcctgaagtagggagatgaaaataaggagccatcaaaggcagaatgaaacttaggcagatttcaagtgattttcaaaaatgatgtgatcagaggtaccagataataactattacataacactttctttgttaggagcttatttctcacactgaccaaagcttttgaagtaagtactctttacaccactatataaataaaccttacaaaggattctgctttgaggcatgagagagttaagtcatttgcccaaagtcacagagttagaaagtaatagagctaagatttgaacctaggcagtttggctccagagtctgtgctcttacactatattaccaccaagaggtcaaataaataccaaagaatgtattttcgaatttaacaatgaggaacttaatcatacaggcagaagtaattccagagcaccggagacagaagccagattgccatatgggttaaagagtgtgtaaaccactaggaagtaaagacatagaactactctcacaagtgcttttctggttattgtgacgctgaacttcatggcttgttttaattaagacatcttacaagtgtcaaaatttggaaatatttggacactgtacactctggttatttaaatatctaacagtggttcttgagcattttgagaaacctttgaaaatctgatgaaaggtatgtgccattactctagaaaaatgttcctgtgtacatgcacatcaagtatcacatactgtttcaggctgttcaaagactacaaagtctgttcatgacctaatggtccatgttccctcagttaagagctccagagataaaggatgtggaactcaaaggtaagtacccagagccttgaaaactccatttgtgacttggaagaattctacaatttgaattaactttgtggagagagatatatttttgaaaaattgtgtgtaccaaaaaaatttcatatcaaataatattttcctgtagtgcattcaaggatctggttccacagcaaaaaattgttttggtctcagttcctcaaaatcacatttaaggagcttgagatttatattttctacttaataagtcttacaaaagcaagttaagaaggaaaatggacaatcatttctgcacatgtagggtttaataaaacatgtataatgaaatatttcatattttaaatttccaccttattggtagctttcatgacaaagggctagggtgctggtggccatacaattaaggtttttggttagttagttagcagaactaaatgactcctacctggtggctttttcttttgtttgtttgtttggttggttggttttttcccagatggctcaggaggaaggtaaatagcagtcattgtatgtgtgacagagtttgagatagaatgagcatattgaatcccacatcctgttcttattactgtcaggcagcgttgacctagcagtataaaactatctgaagcaatgtagtcactcagttctcataaagtttatttcaagtactgtaacaattcatgtttggattagaaaagtcactagaaatttgacttccatatagtaatctatacttttttctctcatttccttcactttttgagccgtaagtgtaaggcattttggtggtattattacaatggttatgaggagtttctttgcttgcccaaggtcacatagctagcaagttaaagtagattcaaatccaggcctgctagataccaaattattatttaagagtacttttcactactcctaaataatgacacagatatgtttgtcttacacatttcactttattgtcaagttattagtatgtttattttcaaaaggtattttttgcaatttctttttattattccgtactttttaaatttacttcattatcacgtcttcctttattctttttaaatagtttttgcttttgttattttgttttcccttttttactcttggtttgtaatacatctttccttatttgctcctttctcatttgatctcaatgttaatccaactgttttccacatctgattcactaaaattttagccctttaaaaaaaaattcctgtttttcctatctccttttgcccattctcttctccttgcctcacttcttttatctttttccattttactttcattttttgtttctctagatgttgttttgacatatgagttaatgtactggtacaattttgcatctgtaaattagagcttcagaatcaactgagtgtatttattctttatttttaggcctcaatttatcttaccttttattgattttataatatactatactctttcattttagtctgcatatgttagccaaagaagatatgcccctgttttaagaaatctctgtaaaaaatgtcaagtgtgacaagaattcttcaagaaacaagctcctctagtttgtcttctatatttagagcttcaacagttacctatattactggtaactcccaaatataccttcaaacttgttttttgggcccaagttttttgcttcatatatatctgttttgaatatcccataaataattgcatctaaagcatacctccactccattgttctcaaagataaaaccaaacctgtgctgcttcttatatttctagtatttaagcgtcacctgccacccctttacctgagctacaagtcacgcattgcattagactcctctgctttcttctttcacctctaactagactattcaccaaaaatttttaaatatataactttcaaaaggtattttattacatcatttccatcctttatgtttgggttcaagccctcattaactttaacatggattcttggagtaccctccttactgattttgttacacgtgtccctcttttagtcagtactaccatgataataccatggataataattttttcatttttatttttagtcttgctctgtcgcccaggctagagtgcagtggcgcgatctcagctcactgcaacctccacctcccgggttcaagtgattctcctgcctcagcctactgagtagctgggattacaggcacctgccacagctcctggctaatttttgtatttttagtagagatggagtttcaccgtcttgaactcctgacctcatgatccaccctcctcggcctcccaaagtgctgggattacaggcatgggccactgcgcccggccaataatttttcttttttttgtgctaatcatactacattttctttagaataaaagatcacatacttcagtttgccattcgcagtctggccccattgtgccattctagacttacctcctgccactccccaccagctttgttttgtcttagtcacacaaaataatctagcgtctctaaccagtcaaacattttaccttgtgccttggctcactctgtgccttttctccagaatatctttctgtgtacttttctcccatccttttacctttaaacctgctgctatggtttggatgttgtttggcccctccaaaactcacgttgtagttcaattgccaatgtaatagtgttgggagatgctacttttaagaggtaattaggttgctaagatggattaacatctttctcttgacactgagactgggttttcctgggaatggttagttcccaagagagtgagttgttataaaacagtgctgcctcttctattttgcgctttttgtttgcacaaactcggtccccttctgtttctctacgatgttttgatgcagcatgaggcagtcatgagaacccaccagatacagctgcctgatcctgaatttcccagccaacagaaccaagtgctaaataaaactctttttaataagttacccactctcaggtattctattatcgcaacagaaaacagtttaagacacctgctaggctcctaaccttgaggggctagaaaacaaagccagaggtccagtaccagcctcctcagagttagaatacacagctcatgagtgctgagctcagccttggcccctacaatcttccagaaatgaggccacttggctgagcccattatatgcaacattcagacccccaagggcatcaaagaagacaaaagcagaaaaacctatccaagaaacagcaacttcaaaggttgaagcaacatcagaccacacaggtgagaaccagcacaagaactccggcaactcagaaagccagagtgccttcttaccttcaagcaactgcgctatttccccaacagtggttcttaaccaggctgacatgacaaaaatagagttctgaatatggataaccttgaggaacatagatgcaaaaatcctcaacgactcaatttgctggactagcaaaccaagcccagcagcatgtcaaaaacgaatccaccacaatcaagcaagctttatccctgggatgcaagtttggttcaacatatgcaaatcaataaatgtgattcatcacataaacaactaaaaacaaaaaccacatggtcatctcaatagatgcagaaagggctttcaataaaattcaacatcccttcatgttaaaaaccctcagcaaactaggcattagaggaacatacttcaaaataagagccatctatgataagcccacagccaacatcataccgaatgggccaaatgctagaaatactccctgtgagaaccagaataagacaaagatgcccactctcaccaatcctattcaacatagtactgagagtcctagtcagagataacaggttagagaaagaaatataagacatccaaggaaaagaggaagtcaaactatctctgcagacaatatgattctgtagaaaaccccatagtctttgcctaaaagctctttgatctgataaacaattagcaaagtttcaggatacaaaattaatgtacaaaaattagtggcatttctatacaccaatagcattcaatctgagggtcaaaatcaagaatgcaatctcattcacaatagccacacacacacaaaaatacctagaaatatagataacgaggtgaaagatctctacaaaaagaattacaaaacactactcaaatcagagatgacacaaacaaatggaaaaagattccatgctcatggataggaagaattagtgttgttaaaatggctgtacttcgcaatgcagtttatggattcaatgctattgctatgaaactaccagtgacatacttcacagcattagaaaaaaaaacttttaaaattcatatggaactttaaaaagagcctgaatagccataacaatcttaagcaaaatgaacaaagctgaaggcattacactacccaatttcaactatactacaaggcttcggtaaccaaaacagcagggtactggtacaaaaacagacacatagaccaatggaacggaaaagagcccagaaataatgctgcacacctatgatctgatatttgaaaaaagttgacaaaaacaagcaatgagaaaaggactccctattcaataaatggtgctgaaataagtggctagccatatgcataagattgaaactggaccccttccttatgccatatacaaaaatcaactcatatgaagtaaagacttagatataaaacctaaaactataaaagccgtggaagatagcctgggaaatactattctggaataggacctggcaaagatttcataacaaagatgccaaaaacaattgcaactaaaacaaaaattgacaaatggaatctaattaaagagctttagcatagccaaaaacaaacaaacaaaacagtgaacacggtaaacagataacctacagaatgagagaaaatatttgcaaactatgcatcctagagaagtctaatatccagaatttataaggaactttataagcaaaaaacaacctcattaaaaagtgggcaaatgacacgaacagacatttttcaaaaagacatacatgtggccaagaagcatatgaaaaaatgttccacatcactaataattagagaaatgcaaatctaaaccacaatgagataccatctcataccaatcagaacggctattaaaaagtcaaaaagcaatagatgccggcgtggttgcagagaaaatggaacacttatatagtgctaatgggaatgtaaattcgttcagccgttgtgcaaagcactttggtgatttctcaaagaaccggcaacaattaccactcgacccagcgatcccattattggatatatacctaaaggaatacagattgttctgccataaagacacatgcacgcatatgttcatcgcagcactattcacgatagcaaagacatggaatcaacctaaatgcccatcagtggtagtctggataaagaaaatgtggtacacgtacaccgtggaatatacacagccataaaaaaataagattatgttctttgcagcaacatggatggagctggaggcaattatcccaagctaaattatgtaggaacagaaaaccaaataccgcatattctcacttacaagcgggagctaaacattgagtacacatgtacacaagggaacaacagacaccaagacctacttaacggtagagggtgggaggagggagaggacagaaaaactacctattgggtactgtgcttattaccaggtaacaaaataatctgtacaccaaaaccttaaagaaaagtgttttaaaaatgtaaaataaagcatatagcaaaacaaacaagacacctggtaaagttctgctcttccttcaaagacccagctcaaatgtctctttcataaagcctctctgacattctcataccccccttctctctgacctgggagaagctgtgttttcattctcccacaataacttgttcatatttctattataaaacctacaaatttaaactagctgtcagtgcatacttgtttgtctccttggctatgtgccttatgagatgcctgggatagagatcaattattattcaatttgaatccttggcattgggtgcggtggctgacacattggaggtgggcaacaaatattcgtggtataagttcactgaattacagagatgtatgcataagttttttggaactgggtttcatgaatcataggtacacacaatttgaataaaagaagaaaacaaagtggggcaaaagggtgtaggtctagtaatgaaatgggaaaagaaaggcacattgaaaagtcgcaacaaaagagagaaccagtacaattatatcaacatatagtaaacacattggagaagggaaaacaatacagcaagtgaaattgattctttggtggcagaaacaattgaaaggtatggaggcaaagaaggaggagaaattaaggcatagagataaattagacttggggagaaagcacagaagtcaaatatagcaacagatcttggactgggaatgtttccaattgaccattatgcttacgattacttttatgttgtggagacaatatttaatgagcatttcagatctgttaactaattttttgaaaaagtgactccagttcagtgataaataccttgaccaatatgccatataaagtaagaaatattttaccatacccaagaaactggttttaccggcttagttttgaccaactgatggcaatttgtacctgctaaactcccaattttttacttgctggttgtgtaggtaggcagtgaggtttgttggactgggcatgcagggacaagcagttaggccaatacatggactgaagattatatctatttatctgccttttgtttagctatttgcataaatatacagagtgggtttatttgcacacttagagctttagaataaaagaactttgactttcaaattggtttttcttgattttttaaaatttttatactccactttttcttccgtctttctcaaactcatttttccctagtagcagagttgagacttaatattacaaaactctgcttgctttaaagaatctaagaagaagaagaagaagaagaaaagacactaaagaacttccaagcagaagtttaagaagttctgctatagcccatccactcgtttgtggaatttaaatatatccgtttttgccacaataacagcgtagccttgctagaatcatatacaaagcagcagatttctttctataaattactggacactgtggtgtaatgtagacattgctgaggagggatgtaactgcaacagaaacaagttacttacattgcatgcagtagggaagtgggtgaaaagagcattgaactctgagtcgggagacgacttcaaggcccagctcagcactctagcagaactttaggtaagttttttagacactatgtacttcagtttccccatgtgaaaatgagaataacgtctgttctgcctacttcacttgaactatttgaggataaaagaaggtaaaatgcaataatggtcatgaagattttataaaccttgaagtgatgtacaagtataccatactgtttcacttttattactattataactgtttaaaaaagcatttgtgaccagtacaatcctggcttttctctggagactaacatccagtttcatagttattttacttttgatagggaaaagggaattattcctgttatatattgcaatatttaggatcctctagcaatttctcaggctaagacttcatgttcccagaagagggcagcaaaactccaaaggctctgccttttcctcaattaaaatgtctaaagcagtttttccttgagaggaaaagaactatactgtaaagaatagccctttaaaaatgatggtatttaggtgacaaagctaatcctattacaataaatataacattcattccaaataagatttttccttttctctgtcctgtgaagaaaataattgactgtttcttcaatctcatgttaattatttgacttatatttccagaaactcctacccatgtttttccatttaactctagatttgtagatcctacttagcaccagtttttaaataaattgtttcgtatgtgtaagagaaaaggtgttcaggcctgtttatagcttaggatgcctacctaagtccaaagagtgatcctcagcagtgtctaaatgtgttcctatcatagagtatatgtttgtcattcagataaaatgttgtctacatctaatctttctcattctttcattattcaaatatccccgtgcctttctatctttagtcagtgaattatcttgtaatgacaagagcaactaacatttgaactgttcttaactcacttaggccggaggttgcaatttttttttgtcaaaaaatcagaccttggtgataacttgagcagtaggctataagtaactagtaggctagcttactataagtaggctaggcatattaatagcgtataaggtgctctcacagacatgttttccctttgatactcaccatagccctgtgaagttgatagctactatcccccattttacagataaattttctaatctgtaatcaaaatagctgctctttgcttgaagaaaaagtccagagggacaccctatatgtcaagagagctccagggggtgggtaatttctttcataattgctagaagagccaattctgaatgtgaggctttttctatctgctttattacaaccagagatggaataggaaggctttcagttacagtttatcaattccttctgcttttgccagttaatctctagctttactcttttgaaaaaactacctgtttcccactccacttctgctaccaccactaccaagtcagagtcctctttctattccagccaaacctcttcctgttcttgagaattgcatcacattcttggcttaacgtaaccaacacccccacattggcaccagggagtgtgtagcccttctttattggctgaaagttcttgtctggtgagcatggaataagtcactcacttcctgaatttcagccctggctaaatttgcttctggaaaaacatatatatattcctcagatttttgtctgttggtttgcaaatctccttcactccagccctgtcctggaatgagcaagatttaccaaatagggacagcatgaaagggaatttagagggtagaggtagagggaaaaggaatagtatgtgtagcttgctgaatgagatgtctgctcttgctgtttccatttcttcacttctcaaacaatttttaacccaatctaaactggcatcagctcccattgtattgaaagggctttcactcaggacactaacgcccccccgccacctcccatattactaaatccagtggatacatcagccttgatcttacttggcatcagggtagcatgtgatgcttttggtcacatcctctttgatagattcactcttcctttgcactattattttttctctatcttagtcatgggtcttcagcatcctttgcaagctcctctttactcctaaagtactggtgttcctcagaaccctgttctatatcagcctcttttctctctaaacattttctgtgagaaatatcatccctttccatggcattattgagatccatctgccaattatttccaaatctctatcttccctgacctcttttgactgctttctagaacttcttcaattagaaattcctgaaagcctgttaaccaactccctccctcaaacctattcctccaataatgctcctcatccaaacatatgccacaccatctacccagtttttctaggcagaaatgtaggattcatccttaatgcctcttttgctcaccttccacattcagtcaataaccaaattcagtataatctacatatttgaatccatcagtttctccctgtccccactggcctaagtgatcaccatctatgtggcgttttgcacatccctttgctagtttcctgcccccaggttttctccccttggatcattttccactaaccactagatggttctttatgtaaatgcagttctgtaaattcaccacttgtgtttaaaatcctttagttgcttctcaccgtccttaggatggagtccgaacttcttatcacggttcataagcctctcatgatcagtaacttgccatcagtctgaactccactcacactgacctctagtgtttcaaacataccctgcttccttttgcctctaggccttcacagatgctgtttcctctgctcggagtgttctactgtagggcctctaacatctgtagactaaattctagcctcaaattatcagttatcttattcctgaatcagaactgaactgggattcttaatattttttttattaattcttgaattaaagccaggatttatattatcctatatatttctttgaaaaatgcaaagatattttctaatgaaactgtatttgaactaattaacttagggttcagtttttaaaaatcatagctgaatgtaaactggaacgtattttttttcatggtactggaatgttttcttggttgttattcatcatgacattctagctttggaatttttcatttccagctgacttctagcagtctcctttcttacctctcaaccccttacactctggttgccctatacttgcccctagatggatccagtttgcatgcagtggtagttgctgtgaggctgcggttaaatagagctgctcagactgcaacaggaaagcattgaatcgaaagcaaaggggaggaagcacaaaccgatacccaccacaaagctgctgagtgcccagcatgacccaagccgcaccctctgatgaggagtcttgtggaggagtaagaagccacagactttaataaaccatcagcacagcctgtcctccacttccctggtccagccttcccggatcaccatgagtatcaccgggtactgacctaagaagctgggtgatgacagaaaagtgaccagaaatgtagagtccagaggaaggtacccgaaatgaatgactgtagaccattttatctcaaactccctacacagtcaagcgtggtgagcacgaaggtccggggcatgagaatgtttctgaggagctccctgcttggggtgattcccagatgaagactcctaaaaatgttccctaaaaatgcctttgctacctccctgaaaggctgcttctagtagtggccaaaacaacttataaaaattttgtaactaaaaataaagcccttgcgagatacagttaagagaactttaaacatacactaaggtatgatgactatttttagattcctgacttcaatggagggaggagaaaggaaggagatggagcagcaaagacatatgttacctacttgattttgctcatggcctaccctgtttacatctgtcccttttgctatcaaaggagatattaaggaattataggaaagggaatgaaaagtgtggaaaaatatataggaactaagtacagattttaaacaccggtaaggtggagaactccttggaaatctagagcttcacagtggctctataattcacctgttcaggttcactacctcagaatctaagaaggtgagatctgggccctacttttgcagctggaaggtcagaacacaaagaatggaggtgactgactcagtctggaggaaaggttgcttggcttggctggaagtgggcacttgtgtcatcatagagtgccaacctcacacttcagataacagaacaggaaatattgttagttcagatgggagagcagaggactgactgtgtatccaagaccattaagttattcagtcacctctttgtgttgtactttctatcctacaagggaccagagctggctgtggggagcttgggcaatagatgaagcaggccatcaggccagtccctgttccttgcagctttcttctcccttctatcacgttcagcttctttaatctgctcaacccagaaagtcttccaagattgacatcattaccaaagtttaaatggaagaatctgaggcattttgataggagacaggggtgacaattctggagtagaggaactgtctctcacaaggcctctctactacaagtggtaaaaatttgtgctttattttaacaaccacaacaacagtgaattggaagggatctaataacagaacagaatttgtagtcagacaactttgttttgaaactattcttcctttcttcccttcctccctccctcccttccttctttccttccttcctttccttcggaaaggaaaggacagggaggatagccatagaatgggaagctccttagacctcagaggaatgccgcaagcttcccaagtctgagtgcctgcccagagtttgcctactttcttcagtagtcaaggatattcctcaagttgtgtttaatatctatgcatgagccaaactgtggtaggtgggtgactgcattccccaggtgcaatctttcagcatgtgacctgatgtagtacattacattccttagacaaggaaaaaatagcgatatgaatgcaaagagggggaggcagagagtgtaagctactctaaaacacttagttatgaaagaagaaagattggctagaaagcatgtgtaataaggaatgaattccatttttttaattgagagaggttcaggaatgtttatatacttgaggaaaaagcatagtgagagatcttaacaagtcacttcattcctaagctttgatacccccatccgaggtgaggaggagaggagaggagtttctataaagattaaaattgaattaaaatcatatgcacagtagtggcttatatgccacaaagccctttacacatgttaatttttataactattatcatctagtgactgtacagatgagtaagccctggtcacagctgttctatattttctaccctatatgacagagctgtcaagaggagacaggctcttgagtaggcagggctaagacacataaataagaggctaacattggtgtgatttgtatcttgacatgctttgagcttttggaggatggtgtgtgtatgtgtctgacttactagacacaatgagttaccatttatttcaacttgccctgtattcttattttaaaaatcttacttaaaacatggacacatgtcaaatccaacatgtctctaaaaagagctaatgtttggagaaaattttagaaatattcacaaactatgcatctgataaaggtctattcagaatctataaggaacttaaacaattcaacaagcaaaaaataaccccattaacaagcgggcaggccaggtgcagtggctcacacctgtaatcccagcactgtggaaggctaaggcaggcagactacttgaggtccggagttcaagaccagcctggccaagatggtgaaacctcccctactaaaaatacaaaaattagccaggtgtggtggtgcacacttgtaatcccagatactcgggaggttgaggcaggagaatcgcttgaactcggaaggtggagactacagtgagccgagatggtgccactgcgttccagcctgggcgacaaagtaagactccgtctcaaaaataaataaataaataaatagaatacatttaaaaagttggaaaaggacatgaacagatacttttcaaaagaagtcatacaaacagacaacaaacgtggaaaaatactcaacatcactaatcattagagaaatgcaaatcaaaaccacggtgagataccatctcacaccaatcagaatggctattattaaaaagtcaggccgggctcagtgcctcacacctgtaatcccagcactttgggaggccgaggaggatggatcacctaaggtcaggagtctgagaccaacttggccaacatggtggaaccctgtttctgctaaaaatacaaaaattagccgggtatggtggcacatgcctgtaatcccagctactcaggaggctgaggcaggagaatttcttgaacccgggtggcagaggttacattgagccaagatcgcaccattgcactcgagtctgggtgatagagcaagactctgtctcaaaaaaaaaaaaaaaaaaaaaaaatagtcaaaagccacagttgctggcgaggctaccaagaaaagggaatgcttatctattgtcggtgtgaatgtaaattagttcagctactgtggaaaagtagtttggtgatttctcaaagaacttaaaacaaaattaccgttcaacccagcaatcttcattactgagtatatatctaaaggaaaataaaccattctaccaaaaagacacatgcactcacatgttcatcacagcactattcacaatagcaaagacatggaatcaatctaggtgttcatcaacagtggattggattttttaaaatagggtatatacatagcatggtataatacacagtcaaaaaaatgagtgaaatcatatcctttgtagcaacatggatggagctagaggtcattatcctgagtgaattaaggcagaaacagaaaaccaaatgtgttagtaagatctcacaagtgggagttaagcattgggtactcatggacataaagatgacaacaataggtactggggactactagaggcaggaaggaggaagggggacaaagcttgaaatacttacctattggtcactatgctcattatctaggtgaggggatcattcacaccccaaacctcagtgttatgccatatacccatgtaacaaacctgcacatgtactcctgagtctaaaataaaagttaaaattattttttaaaataaataaataggtcgggcgtggtggctcacacctataatcccagcactttgggaggctgaggcgggtggatcacttgaggttaggagttcaagaccagcctgaccaacatggtgaaaccccatctctgaaaaatacaaaattaactgggcgtggtggcatgctcctgtaatcccagctacttgggaagctgaggcaggagaattgcttgaacccaggaggcagaggttgcagtgagctgagatcgagccattacactccagcctgggcaacgagagtgaaactccatctcaaaaaaaaaaaaaattaaaattaaaaaataaataaataaacaaaattaaaagttgccatgttgaaaaacactaatccatcttgagatgcaaggatctgtacaaataagactatatacatgaacttcaggttacataaaggagcagtttctgtttgtaggtggggggagtaaactttttgtgtttctttctggctcattgcaggatcacattataattttgctttgatacaaatttggcaacaggaatcataattctttttccaactgactacagtgcttgtatacttttaacgaataatcgctgtgagttgtacaaagccttatatattcaacaaatcagtgaagtttttatcctcttaatatttactttgtagctttgctttgaaccacctcagccccagttctacacagttggcagtaaagatatctgcaaattccactcccccatttcctttctgttttgcccttggtttttcaacagtgagatgattgtgccttcatttctgggtgcatcccttcacttattccttatttcccttctccatcccttactccttccttctcttccccaggccttcacaacctctagattttattactagcaacttcttaggccaatcccatagcatgctccttcatgcattacatgaacaaattttttgagggtgctgaaccaaacaatcaggtgtcttttttcaagagtgaacaagaagccactttttaaaaacagttttactgagatataatttgtattctataaaattcgcatttaaagtgtacaattcaatggttttcagtatatctatttagcagggcacccgtcaccataattaattttagaatattttcatcatctccaaaagaaaccttatattcattagcagtcactcatcaattctattctcccataccccacccctttattccctctagtcctagacaaacactaatctgctttctgtttctatggatttgcctattctggacattttatataaatgagatcatataatatgtggtcttttgtgactggcttccttcacttagcagaatgtttttgaggttcatctatattgtggcatctatctgtacctcattcctttttattgccaaataatatttcattgtatggatatttcacattttgtttatctgttcatcagttgatgacaaatgggttgtttctactttttggttattgtgaataaagtttctgtgaatatttgtgcacaagtttttgtatggaaatatgttttcattgcttttgggtagattcccaagataaaagaattgctgggtcatatggtaactctatttttagcatttagagggactgtcaaacttttccaatgtggctacaccattttactttcccactagcagtgtatgagctttccaatttctccacatccttaccaacaattattattttctgcctatattattatagccattccagtgggtgaaaattgatatctcattgtgcttttgatttatattttcctagtgacttttcatgtgcttatttgcatatttttctcttgaaaaatatcttgtaatcctttgcccattcccaacttagatcatttgtcatttcttattgatttgtgttttttatattctagtcccttaacagatagtataatttgcaaatatgctctctgattctgtggggctgttctttcacttgttggtgtcctttgaagcacagaagtttttcattttgattaagttcaacttatcaactttttttctcttttattatttgtgctcttgatgttgcatcaaagaaattactgcctaactcaaagtcacaaagatttactgcttaactcaggtcaaaagagttagttttcttctaaaagttttatatctcagcttcttttttttttttttttcattttttccatttttatttgatgtttccaaatataaaaaagtcaggattcttacatcaattatctcaaatgagaccatgcaaagcaattcagtgtatacaacaatcatttttccccttcagttctgctgctttatacaacagtgtgattgacagaaaattggatggcatgtgcctggtcagaaaatgtcatctgtttacaaaataacatcatgcagcacagtttctactttgtctgcaagtcaattcacaaaaactacttattttctgttttttatttgggaggcacatggaactgaaaaatttagctgcccaattttattcaactaccccaccaaaaaaaaaaaaaaaaaaaaatcacaaatgacagtcccaacactctgcaaattttggagggttgagatagtagacactatttgtcatactcagcagagttaactatttaacagaaataaatctccctagggcctttcctctcattttgctagactgggttccaggagaatcgtgaagaacccctcatgtaaaatttgaagtgtgaaaactgtgttgttgcattatgcagatttttgctagttgcatagactaaagacgttttgctaaatggcactgaaaatccttaccgagtgtcactattcagtccaagtgtttctgaccaaagaaaattatacaacaatatttataggctaactttaaagagatggttgacgttaatactgtacatattttacatgtcaaatacatagtccaagagtttataaaataaattcatgcatcattaccttattacctctaagaatatcatgtacaagatgggcactcccccacccccccagtacttatgacagcatttcaggtggaagcagtcttatatacaaaaacaatccagtttctctgctatgttaagtatataatttaaggaaatttcagagattactgaccaaaaaaatcttagtccattgaagatagaaagtgtcaatttgtgggatttaaaatgtttcctttataaaagaacacccagaatatgtaacctctgtacaaagaaaaaaatatacaaattctggatgatcatgtttgatcacactacgtacttgaaatgttgctggttaaaagttcttctgctttactcattcctttgacagcattaatttgtgaacatttatattcagttcagctgtatttatggcacaagatctcatttccaaaatggcactaattttccttaagtgtaacagcactctatttttagcagtaattatatttttaaaggttaatttgtagaacaaatgttttaactatactttttttctactctatactccccagttacaatatttacaaagggctgaagtctatataaaaaaatgatctttggctgggcatggtggctcatgcctgtaatcccagcactttgggaggtcgaggcaggaggatcacgaggttaggagtttgagaccagcctgaccaacatgaagaaaccctgcctctactaaaaatacaaaattagccaggcatggaggcaggctcctgtaatcccaactactcgggaggctgaggcaggagaatcgcttgaacccgggaggcggaggttgcggtgagttgagattgtgccattgcactccagcctgggtgacaaagcgagtctcaaaaaaaaaaaaagacatcttttactttcccccatccctcattttagtcaaacttctcccacctcatttctgccctggttggggaagtgcaagagtttcagataaggtacctatgtgttttagatgggattcttgattttaagtgagtataaagtaaaagatttaattcttagttcaggtatgttccagtgcctcgaaagttagttatgtgacaaatagtacctgttgacaacctagaaaagatgagacattctaaggtgccctaacaatcttcagtctctaacagctgaacaggaaggccatttcactcaactgtgatgcgatcatcactgactggcatttagaattagatttcaagactccactcctgtgggggccactaaataactgaatacattttaagagcaatctacactgagggaaataacggttctaaggtattctgcatagaaagagtatcgataatgggaactggcaactgagcatgctaaatcaaattccatgaatagagttttcataagatgtctttactacatgcattttgctaatatttccctaaaatattcaccaactctacagagttatactttgtgttaaggtactattgagttataagggaaatagccatatcaggtagctagtgacataataccagttgtgaaaattcagacaaaatgagtcgacaaatccccaaaaatggcaaattaagccctgtgacaaaataagttattggatcatacagaaatagcccaaatctggaaattttgaattaaaattgtaatcctgtaaaacaagttttggggtgaatggatttctttaataccaataatatttttaattcccaccacagatggatttgctgaatatgctaatgctgtgaatgagaaaacaattttggggtaggtatacccacaagtaatctgatgacaaaataaaccacagactgatgtcaaatggacaaaaaactgaaaatatgctgtgagaaatagacaaccaaaataatatagggggttgtggggtgtggcacagttaaggcatctaaacaaaaattccacatggctttggcttattaaaatattttacactatttttttaaaaaaagatttgaaagcatctgaaaaacatgcaaattgtttgaaaaccttgcatggcaaattcagacagtttgcaagcgtcaatcagatgtttgacgaggaaacgaaagaagcctctccccatgagactgcacatggtgggagaggcctacccagttctctctatcttacactagatggcaacccagaggtctgtgcagcggttacaaacaaggcattattatccgaagggaagggactgtagaatttccattggctggggaacaacccagctttagcttttccagatactctgcatgtacaggtttatgacactggagaactttgatagcatcttctactttgaaccactctctcttccttccaatattaacagaatcttcccaatcttctaatatttcagtgactgttagaacataaacatatgttctgtgctttcggtcttggttctgctcaaatatgcccagaagtctgcctagttttcctttgactccagcctcctcataaacttccctcacggcagcaccgccaggttcctcctcgggttccattcctcctcctgggacaatccactggtctgggtaccggctgctactcaccagcagcacctcgtcctcctgctcgctccggaagcacaggcacgccgcccgcttcttgaagccctcgcggtcgtaggtccgcgtctggttgggcttgaacttcatcatagaggcgggctcctgctgctgctgctgctgctccggccgccgccaccccgccggggagtgggggcgagggcgagtcgggcgcaggagcgcctgggagcgctagtcggtgcgggaggtgcggcgaggccggtcagtcccggggccggcggccgctccgacgcgggcgggacgggacgctagcgcgggtcactggaaccagggtgccgagatgaaagctccgcctctgcccagttgtccgccgctctccatggagcccgactcccgctcgcctccgctccctccggccgtagccgccaggggaagggcggctagaggcgcgcgccacgcggagacagttgcgaagacccgctcccactgagcagcagcaccacggcgactgtattttagcttctacatttaggcctatgattcactttgagttaattattgtgtacaatcttaggggtccaaattaattcttttgcgtgtggatatccagttgcccagcaccacttgttgaaaagaccattttttttttcccccattgaattgtcttggctctttcgttgaaaatcaattgattgtaactgttagggtttatttgtgattctcaattctgttccattgatctgtatgtttatccttctgtcagtaacacactgtctttgttactgtagttttgttgtaagttttgaaattgggaagtgtgaatccaccaactttgttcttcattgttttggcttttatgagtcccatgcatttccatatacattttaagagcagcagaaattgacaagttgattctaaaattcattaaaaaccctcacttctaagaaacaattaaaatattttctttccaacctaggatgaaattggataaggaggactgagcaggtacatttttgagttgtggtgatgggggatgggtcatttgaaagggggaccaacctgatggaggaggggaataaaggagccacaaagtttggtaaacttcccaccctggtgagaggaatgtttgttcagaggaggcagtttgttctaacaccagggaatattatgaaagataattgaaattgtaaagtccattgatatctccccagaagacaaaaaggtctctaagtaagcagtattgttagcttgttgattcttacagaagaagattttcatccaactaagggaagcagctgggactttctcagggctgtaagacagaaaaaaaatgaagaaatccctctgtatcttttcttacctctccctgtggccagccctaacttttgtccatttttgttacccttcccttttataagctccccaaaaagagagagaggagaaagagaaaaagaagaaaaccacagtgggagagagggttagagatcctggggatgggggaggaattctggagcatttcaaattaaagatccctaaggtactatgggtggaacctactaagtaatatgacaacttgtagcaagagtcataaggatgatcacatcttcaactcagtgatccaattcctgggaatttatgtaaggaaataagacaggcaaaaagtgtgagtgggaatgttaatgaaaatattacctataatagtgcaaacaggaacaacctaaatcaccaaaatagaagcatgttttatgacgtcatggcatgtaaagatggcagattataatactagcttcactgtcaaaatatactctgaattgcatcacttttcactgcattctgtatcactctggatcaagtcactattattcctcatctgaattattgcaatggcctcccaactggcatttctgctttcacccttgttccccacccccagtctactctcaacacagcacccttagcagtcctttaaaaacttaaatgtaaaattcatatggaatcataaaagggcctaaatagccaaagcaatcctaagcaaaaagaacaaatctggaggcatcacattacccaacttcaaattatactacaaggttatagtaatcgaaacagcatggtactgatataaaagtagatgcatagaccagtggaacagactagagaacctggaagtaaagccagatacttagaaccaactgatcttcaacaaagcatacaaaaacataaattgggaaaaggacaccctatttagtaaatggttctgtgaaaactggagagccactggatagaagaatgaaactggatccatctctctcaccacatacaaaaatcaccctaagatggaataaagacttaaatataagacctgaaaccataacaattctagaagaaaacataggaaaaattcttctggactttggcctaggcacaaaattatgactaagaccccaaaagcaaatgcaacaaaaatttaaacaaataaacggaacccgattaaactaaaaggcttttgtgcagcaaaatatataatcatcagagtaaagagaaaacccacagaatgggagaagatatttgcaagtatccatctaagaaaggactaatatccaggatctacaaggagctcaaacaaatcagcaggaaaaaaaaaaaacaaataattccattaaaaagtgggcaatttacatgaatagatgcttctcaaaagaaggtacacaaatggccaataaacatggaaaaaatttcaacatcactgaacatcagggaaatgcaaatcaaagccacagtgagataccactttaccccaaccagaatggccattgttaaaaatccaaaaagcgatagatgttgtcacagatggggtgaaaagggaacacttatacactgctagtgggaatgtaagttaatataacatctatggaaaacagtatgacgatttctcaaagaactaaaagtagcaatcccactgttgggtatctacccaaaggaaaataagtcattatatcagaaaggaaaataaatcattatatctgcacatgtatgtttatcgcagcacaattgacaatggcaaaggtatagaactaacctaagagctcatcaaccaattagtggataaagaaaatgtggtatatacatgccatggaatactactcagccacaaaaaagaatgaaataatgtcttgcactacttggatggagctggaggccattattttaagtgaaataactcaggaatggaaaaccaaatgccatatgttctcacttataagtgggagttaagttatgggtacacaaaggcttacaaagtggtataatggacatttgagattcagacaggggaaggttgggaggaaggtgagggataaaaaactgcatattgggtacaatgtatactacttgggtgacaggggtactaaaatatcagacttcaccactatacagttcatccatgtaaccaaacaccacttatacccttaaagttattgaaataaaaatgtatttaaaatttaaaaaagaaaacctaaatgtgtcatccactactcaaaagtttccatggctccttctcatttagtataaaagccaatgtctttgattagtcctgggccctacctcatctggcctccatctgtgacttcatctgatatttttcttcctgtaactccattctgaacatataggcctcctaactgtttcttgaatataacaggcctcctcctgccccagtgacttttgactcttccctctgcctcagagtctcttctcccagatatccattagtttgttccttcactgccttcagatctttgttcaaatgtaaccaatgatactttcttttcctgacaatcgtatttaaacttgctatcttcctcccatccctcagcctctagcatatcctgttcttccttgctttattcttccaacgcttatcattttacctgacttatttttctgggctgttgtctattcctccccctgtaacccatgctctatgagagcaaggatttatgtattttgctcactactatatcctcagtgtcttgactattcctggcacagagtagctgcttaataaataatttactgaatgagtgaatacatccacaaaaggagtgattatgaaaattgggtcataatttgaaaagtggaaagtacgttactgtaagctgtgatgtgcacagtggctgtggcaatgtggtgtagcatagtctgggagctgcagatgagagagatctggatttgaatcctgagtccactacttcctagttatgtgaacttcggcaagtgtacctaacctctcagttttatcatctgtggaacaggtagaataatacctccttcatagcatggtgaaaattaaatgagaagatgtaggaagaacctggcacataataggtgttctatgaacattaactctctctcttctcctaaagaatatatacacagtgggtaagaattgcaaaataattgggtgtttcaaagacagggatgatgcacttttataaaaaaattttaatacacaagtcctctctaagcatggatatatatataaaaacagtgccagactaggagtatggagacctgggttctgggttcacctctgatgcaggctgtgtgacattaagcaaatcctaacctcttgggactgtcttttcatctgcaaaatgaagaggtagaatttagtaagtttgagtcccatcaatgcttaaaattctataattcagaaaggcaggccattctacctagtttcatcccgctttagctcagccttactcagatatgctggccagatgtttctaatcttacacataaaagactctggtattcagaggccaaaagaaactggacaatttaagaaaagtactaagcagatgagttttccttctgtctgattcttaaacagctacatgacaattattcaaacttaagaaaacaggaaaagaaaagcaagtatgcacatttaggtttgaatcaactatgtgaatatttagccatgaagaaaaatgtgtttttttgtgtgtgttttattaattattatttgtacaacaaccaaaaagtagacgtcagcagttttcaactgtaactataaccttgtaccatgtggctgtgggccgaagtgcaggagggagtagctggaagggaatctggctagagccttcccctgctctggaaagctcgtggctttgtttttttcacattgctacaccgagacggaggaggggaggatgtttgggtttacaggccaccagccactgtcagcaagtttgtagccccagcttcacttccctgaaagggcgggggagtttcagctgccctggcctccctccagcaactgagccacagaggattcaaataccccatcagttgcaaggccctgactttacccagctgaaaactgactatctcatctgggaagggtcagttaaaaaatgacagaactgcctaaagtaaacaaagggaacaaccacaacagaaactttctctgcagtgtttccttataattaccggcccatcccaccagggctctggcttgagtccccatccactctccctgttgcccccacaggaccttgtttgagtaagccctagctgacctgaggatcgcctccctgtctacatgcctctgtcccaccctctccatggaggggagggagactcccgattgcaggaagttttgagaatggagtttgaggattgtcaggcaaaaagaccctctagagctcattcattaggacccctaatagatgagtaaacagcttaaatgaagtgcctaaagttgagagcaagtatgggacagaactggttttcttcttgctaaccgagtgctctttccagtaatcatatactgttgtaaggcactaaagataaggaaactaacattgaagttctttctccaccttttcattctaaccaaatcctactttgttggacttttacactttatagataggctgggcatggtagctcacacctgtaatcccagcactttgggaggtcgaggtaggtggatcataatgtcaggagttcaagaacagccttgccaatatggtgaaaccccatctctactaaaaataaaaacaaaaaaaaaattagctgggtgtggtggcgggcgcctgtaatcccagctactcaggaggctgaggcagagaattgcttgaacccggcaggcggatgttgcagtgagctgagatcatgccactgcactccagcctggctgacacagcgagactcaatctcaaaaaaaacaaaaacaaaaacagaaaaacacgctttatagataaacatattttgaatttagacttaaggacaaggactaaatcttacactctgtgtaccttgttcgtacttcagagttcatgaagtgtgttcatggtcagcagccaagtagagcgggtaggacatttgcttcagagttgagcaagcctcagaatcccatctctgcacattctagctgtgtaaacttgtaggcagattacctactctaaaacttagtttccacatttgcaaaaggggaacaataatagctccacctcattattttgtcatgaggatttcatggatgatacatgtaatgcacattgaaaaactcaacaaatgttagaaatggtaaatagttctggaaggcatttatcattcccattttacagatgagaaaattaaagctcagagagtttaagggctagagtcatacaattggttagtaagatagctaggatttagctcagcctcccagctccatatccacagtacttgctgccccaccattgagtgtagacaattgggggtggctctaagccatgggccaaatatgtctgtccctatcatcatggaatgacatgttatttattaagcccatatatgcttgaggtgccaggaaatggatgcttctggggtgaggtaggctcttcatgtgcagccttcatgtacagattccagccaaggaaaccaagcctggcactaatcccttgtccaagcccagagacgctgtgcccacggagtaggtcagaagtccttgaatatcctcagctttcctttcctctggcaatgcttccttgatgccctaagaatattttgcttaccctgacattagagccctcttcacactcccaagctttctagtattttgggtgtgcatctgattctcctgttgaaactggactccaaagtgaagtgctcaaaatggtacatagaggtatgagaaaaacatatgtgaatacttgcttctatttattttttaatctaaaatattaagaaaattaggctttactaatattaaaatgtcacagtagagtgtatggaatttatagcaaacatgcaattattaggcatgtatgctggttttcttttctttctttctttctttctttctttttttttttgatggagtggtatgaagaaaagagactagaggtaactgttctagaaagtaaggtcctacaggcagaagatgtgtctttttctaatgtgtattccacccctccctcattagcactaaatgactcctccctgattaaataaatttggcatctatgtaaacttggtggtctttcttgtttttcccctccttttgtcatccatctgatataatgtcttattcaatattctcccaagacctgaacaaataataaagctgtgttagtaaagagtgcaaattgccataaaaagactgaaaagtaagattcatagtccccaaggagatggttaatggtagtcaataaggcatatagcgggcaaaagaaaagctaaatgtaaaacttcatggaagaactcatggacacagtcaggcagggagccccagcactacagcctgagaaatcaaatgtaatctgagcatatgtgtgttttcaaactaaccactgccctctctctcctctgaaacttgcagaaagcaatgcaacacaatgcaatgagccagggtcttggagaaagaaagaaatcccaactctgtcactgtcctggttgggtgatcttgggcaaggtccataatcacccccactcccaggaaaaatagttcttcacctacaaatgaggttgagctaggtgattttggaggttactttcatgctttgaagcagcccatgttttcttcctgaggcaatttatacttcaagtgacaccatgaagctcactggaccaaaaatatcaccttaccaccaagcctttcatggtttgtgacatcctctcctcaggcaccgtgtctccatgcggtgcttcccaacctagcaataacttactggcatgaatccacttcaagtatcagttatgtccatgatgcatgtagagtgggaaagcaagatatgaaaggttatatatgtggtatgcgtatgtctataaatacctacaaatatatgtgcatacacatagaaaaagaactgaaagatactcagcatactttcaacactgattattcctagggagtaggaaagcaagatgaaggtatgaattttaccatttactttaaatcctcctatatttttgttgttttttaaaaataaatgattttactatttacaaataaaaattttaaaaaataaacattaaagtcctatacaaatgtttaataatatttgtaataagtagcaccagtttcttcaagaagccctaccagaagcaaatctgcatcttgatactgcattagagccttggctgaagtactaataatacccgaacattctatggaggattgggccctggactgggagaacctaatcacataatcagaaactcttattgagtaattttgggcaacttgagttttcccaaactttacttgagtttgtttttctcgactagaaaacaatgcttttgaactaaatcctctatcgggaactttctactctgaagtcctgtgattcttaacaacagtacatgcaaaagacacaggaaagtgagtatgtcatatggcatccaggatactttcccccaaagcaaagtgaaaactgatgtgaaactccttcttccttccttattttcctctctctctctctctccacctctgttatctaaatgctctatatttgaagcattcatcactttataggccttgatgggatacagaggacaaccttttactttagaagctgaaaatgtcagatacttgttttccagcttcccttacaggtatgcataggcataaggatctgcattgctttttgactcaggagctagtgacctcaaatagcaaagactgttgaatctgttctgcagcagggagtggcattagttgtaataacaacattcattttttagatgctacagtggtggtggttctggtggttctagcagcagggaccagcatccaggcttggggcattcactgagcagtggtttccatgcagtgggggcattgatgacttcatgatattgttctgcagtacaattttaggtgttgcttctggctatgtagcctctaaacctgggtttctagtcctcctggagagcttgtgaactacctaatattttttaataaattcatttaccgcttagattaactacaaattgtttctgttgcttgcgaccgaaaacatttactaatgtacctattatttttttaaaaaatcatgcacttggagattatatatatatacacacacatatgtttttaagggaaaaaaactccccttccctttgttgatcccttattttcccagtttcttctctggaggtagtaataatgatttgtttcttatgtattcctccagagatatcttgtgtgtacacaagcacatctatgtatttaagaaaagttacttaaaaatcactcaaataggatcactccatatacactgttccataatttgcttgtaaccttaagactacatgttagagataattccataaatataaagctgcctcattctttttcttatttttatttttagagacaggtcttgctctgtctcccacgctagagtgctgtggtgtgattatagctcactgcaacctctaactcctgagctcaggggatcctcctgcttcagcctcccaagtagttgggacaacaggtacgtgccaccactcctcgctaattttttattttttgtagagtcaggccttgccatgttgcccgggctggtctcgaactcctggcctcaactgatcttcccatcttggtctctcaaagtgctgggattacaagtgtgagtgactgtgcctggcctgcctcattctttttattggctgcttaatatccctctgaatgaatatactgtaatttatgtagccaatttcctcctgtaagcagttgggttgcttacagtttttgtgactacaaataatgctgcagtgaatatcgttgtaaatatgtatttttaaaaaaatatggaatgcttcatgcatgtcatccttgtgcaggggccatgacaatcttctctgtatccttccaattttagcatatgtgcagctgaagtgagcaagtaaatatgtcttaatgcccagtgcaagcagatacatgtctgatagggaagttgcagcgtcaaaaggtaaatgtaactttaacattttgatagatagcaccaaaatgcactgcaaatttagtaacaatttttaatcctactaaaaatattttagactcccccccaccaaatctttacgtcaccagtgtatattatcagattttataattttgctgttctaataggtgaaaactgattttctcattgttctgattttcattctttaatttatgagtgaggttgaacatttttcatgtatttaaaagccatttgtaagtattcacctgtgtagtatattcatgtcctttgcctgttgttttctattggatttttatctgtgtttaattgctttgtaaaaacttcatctttttttttttttttttttgaaataggttcttgctttgtcacccagactggagttgcagtctggcaccctcctgacttggcctttttttttttttttttttgagacaaagtctcactctgttgcctgggctggagtgcagtggcgcaatctcagctcacttcaaccttcgcctcccaggttcgagtgattctcctgcctcggtctcccaagtagctgggattacaggcatgtgctaccactcccggctaattgttttgtatttttcgtagagatggggtttcaccatgttggccagactggtcttgaactcctgacctcaagtgatctgcctgcctcggccccccacagcacccagccctgcctcagccttttaaagtgctaggatgacaagtgtgagccactacacctggtcaaaattccatattttaaagtaaatttgccttttgtcatacttgttgcaaaattttttcccaatttgtttttggttttctgatctttttaaatttgatctgatttttggtttttgctttgcataaatctttaattttcacaaagccaaatttgtctatatttttgcttatggctctggatttgtttggaatggcttttggctgggtagcttctcatggtttcaacattgaagctgctaatttagaaaaacaatacttgagacttctggttaaagacagcagattaaacacatgctccactccctcctagaactcaaccaaaatttaatgttttgattaagtgatacattcacatggttttaaaaccagaaaaatacaaagatgcacagcctgaaacgtttccctcatctatgtctcccatcagctcagtttccactttctccctgtccagaaataaggactgttatgctttcttatgcgtgtttccagagtttctttatgcatatgtaagcaagtaagaattttggtgagttttttttaaggagaaacctacaaggacaaaagaatataaaaaggacaagagtaagaaagataattttaaaagctggaacataaggccgggcacaatggctcacgcctataatcccagcactttgggaggctgaggcaggtggatcacttgaggtcaggagttcaagaccagcctggccaacatggtaaaaacccatctcaactaaaaaaacaaaaattagccgggcatggtggcgggtgcctgtagtctcagctacttgggaggctgaggcaggagaatcacttgaaccgggaaggtcgggggtgggggttgcagttagccgagattgcaccactgtactccagcctgggtgacagagtgagactgcgtctcaaaaaataaataaataaacaaataaaagctagaacatagatgaatgagtggtaactgaatcaagagacctgagaaagctgaatcctaagcctgcagatgagaaaggtaaagcaactcactttacatttcagaatcccccaaatgctcagcaattggtggcaccaggtacttttggaaataagggtgaagttgtggctaaaaacagtaagttgcattgaaaatcagttcaggaaacaatgaaagctccaggccccctcttcctcttgctgttagatggattgccccttccccacgatgtccaagaatggaggtttttctggtgggagagtaagacagagaagggacaaggcactattgtgtgaaaggacaacatgctgggaaaaaacaggagattataagcccattgccttctgccatcttctcttacttaggaaaccctgacagccagcctgaatattaggaaagccttctctgaaaccctgacacactggagagaaatgctccaaagataactcagaaatgacagcatctctgaaagaaaaagaaaacaagaagtattaataatatctccagagaaataagagaactagtgcatatatgaaataagaacagaatgctatgttttaaaaggaacattcagagaacaaaaaaaacttagaaatttaaatatgatagcaaaaatataaaaaagcttagtagatttggaaagtagaaaggaaagcagaaagataacagatagaaaataaaaaatatggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaagaaaataaaaaatataagagcaaaattagtttatttgggagatgaccccagtaaacatctgtacgggagtaaagtaacgagaaaaggatcctacggaagttaatatatcttgcaagttactgtgaaccagtggaacttgactccatcggggaactctgggagacctgtgtagaaagcatgcttcagggttaaaccgcctcatggttgagcaagctgggatatttatctactaactctcatcagtcattggttaagggtctctcccagggaaaagggggttaattccccagcacttcctgagcaaactttcagtagctagaaaaagccctcaggcaaacagacatatgtgctggcagttttgaaggcctggatgttaagtgccaagagaatttgggcagggcactgatggcaaatgttatatcttccctgcactctctcttaggaaactactgaagaatgtgctccaccaaaacagtgttgtgagtcaagaaagaggaagaggcggaattcaggaaccagagcactcaacacagaggtgaagagagtccccaggatgtgggtaaagggaagtcccaagatgacagatgcacagcaggcctagaggtcagttagcccagagaggagcagatcagtaggctctggaagagctctcttccagatgaaactgatggaataccaagtttgtttggacatattgagaggagacttaaacaactacagaggagtatggattaaattagtggcatatgcatagaaaaactaggcaaatgaaaaatgagacaattattaactccagagaaagcaaaatagttttgaagaaagtgatcataatttattatgcaacacaggtgtgaatagtatttatttgatcatagtaatataaacactgagtgtcagtttaatagtgacgtagaaatataggcccatgtggtataggaagaggcgaaaactgaatccccatcttccacagtggaaagtcaatagagaaaactaagaggtagctatttagagatacaatgatttccctcctccccctaaaaaaagatttagtgaaagcattgaaagtgatttcctctgaggagtgggaaatgaaggggtggagtaggggaatgctgtttcttgtaattagtaatttagaaatatttgattctttaaactatgtgcatatttaactttgatgtttaaaaaaactaaataaaactcagtaatttttttcctttgctgtatgaaaaagggaggaggtgagatggaaaatgtacctcattcctagctgataagaaaactgggcaggcaaaatgaaacttgcttgttccatgagtccatcaacccagcagggtcaatgtcttttccatcttcttcagtcagaagaaaagctatgagcaactgggaaatcaaaactgaaattcctttgaaagagccattgatgccaaactgacctgaaatctggggctaccctaagagggctttggcctaaataaatggtccagggtaagtacaaagaaaggattctatcaaatgcaaaaatgagaccaggattatattaagggagctagtaacagcacttgagtgcaagtagaatacattcttaattatgtctaatatgaatttctttaaattctttaaaagccagttgttttaaaatacagaaattaaaaatattactatattgatttatagttttaattttaaaaaccatgggagtactttgtacagtcttttaattaaccgtatctatgactgaaattgcacatcgtttaggtctctggcccgatcatgataccagagtctgttactttctgattgcaggcaaaataactacaggaatgaggcctcctgaaggcagaatcagttctcctttctcttcctgccttcaatctttacctactagatccttctcctcagcctagaaaaatgcccaaaaagttccaatctaaaataaaaataaagaaggaattctcacttaagctatcacccaaactttctcttttccttcatcataatacttctaaaaaaatatgctaacttccttttcttcctttacttcctcaccacatactacttcttaactccttgtaatctagctttcactttgaccgttgcactgaacctgctgtctcagaggtctcaaaggacttcttacttgctaaatttcggtcctgcttagccctcatcctcctcaacctctctgtttttgactttcaaaatgtctcactgtgtctctctctgttgctctgtctctctctcttctctctgtctctctcacccacccaccctctagcccccttattctgtgttattcctctcttttggttttctctcctcccttattattcttcctttgagtcttctgtcccgctcattctcttaagaataggcatccaatgagatcccatgactccctgcaatatctgggatctgcctatgtctccaaactcatatgcaccctgttcccccttgttcatttcactccagtcacactgatgtttcagttcctctaatgggccaatgagctctttattaccttaggacctgctctctctacctgggacactcttccccatgttcccccacacccaaagcgcttcatctggctatttccaaatcaactttcaggtctcagcttcatattacttcctcagagtggctctccctaagtgcatcccctccccacccctccaaattaaatctgtttccccattttttctattttagaaatagtttttttatcaaattattatatggtttaaaatgaaagactacttgtgtgtttatttgcttaaatctctacctttctctccagagtgtaatttccatgaggacaggaaccatgtcagttttgtttaacactgtatccttagcattcaacacagaccttgaagcagcagacaacaaatattggttgaataaatgagtgaacaaagtgccaggcactacagtaagtacttcttcctgccaggcgctatggcaagtactttacatatatcacctcgtttttattcttaccacaaccctatgcataggtactactatcagatgaggaaatggaagcttacagagacagaccaatatgcccaaaatctcacagaaaaatgaatgtagctatcacgacgtgaaaagatgtagaggaaccttaactgcagattattaagttaaagaagctaatctaaaaagccttcatactgtatgattccaactatgtgacattctggaaacagcagaactatagagacagtagaaaggtcaatagttgctgggggttgtcctcgggagggatgaagaggcagagcacagaggattttaaggaacgaaaatactctgtatgatatataatagtggatacgtgtcatacatttgtccaaacccatagaatgcacgatgccaagagtgaatcctaattgacactacggacttggatggtgatgatgggttgatgtaggttcatcagctgtaaaaaatgtaccactctgtgtggggatgttgataatggagagggcctttgcatgtgtggggacagggagtatatgagaaatttctattctttctgctcaattttgctgtgaatctaaaactgctccaaaaaataaaatattttaaaaatgagtgtcagaggtaggatatgaaaacatttgtttgactctatgtagggcttaattataatattatactgcttcccagttgacaaatctaatactttcaccgtccaaaacttccctcacacttacttcctgttgtctgtttctatggtttctcttgagtcctccttccaggatccattccaagccagacaatggtatgtgggtgagaaactgtggtcatggaggagactggacagaccggaaagcttttcttttctaacacatgtttctgaggagccctcaggaagcctgtgaaccaggaaaaccacggtgatggtcaatgctctgacagctcccctgcccctttctccatgctcttctcctgccgtgccttccccaaggctgtgggttgctccccactgtgctgctccccttgggccttctctccctgcccacatatgcatgtgccagccctttcccctcacaaaaatgtcaacatagaatggtaagtagaaaaaaaataagatgcaatatcgtacaaatagttgttatgggttgaattgtgtcctcccaaaattgatatgttggagtcctaacccccgttacctcggaaggtgaccttatttggaaataaggttgttgtaggtataatcaatcaagttaagatgaggtcataatgaagtaggagggaacttaattcaaaatgactattatccttattaaaagaatgccatgtggagagacagacatgcaccaaggatactgccatgtggagaggaaggcagagattggggtgatgcagcagaagctgagaaacaccaaagacttccagaaaaacagcagaagacaggagagaggcctgggacatattctttctcacagtcctcactaagaaccaatttgccaacaccttgatctcagacttctaacctccagaaccgtgagacggcaaattgctgttacttaagccactcagttgtggtaccttgttatggaagtgctagcaagctcatagaaataacagaatcctgatcttgtaaagcaaaataaactcatgtattacgggttatcatcttgcatacgcacatacacatatacatagatgaacacatagaaacaatgaaaggcaatatattttaaaagttatcaatacttctttggggataatggatgctgagtaattttgctttgtacttttctctgcacctttgggtattttctcagttatcttacctctctacaatattatgcattattacctagaccagcggtccccaacctttttggtaccagggacctgttttgtggaagactattttttccacaggtggggcagcagtggggatggtttcaggatgaaactgttccactgcagatcatcaggcattagattctcataaggagcatgcatcctagatcccttccatgcacacttcacaatagggtttgtgctcctatgagaatctaatgcttccacagatctgaccaggaggtggagttcagggggtatatggcctggttcttaacaggccatggactagtacctgtccatgccccgggggttggggatctctgacacagacagatccccagacctcagtttcctcatctgtaatttgagaatagttataccaatcttccagcattgttgtgaggaataaagtgcctgacacaaataataggtcagtgggtcttcctagaatagggagagcagctccaaagaagtaaacctggacagacctctgtacctctattcatcatcaggcttcagtgttgctgctaagcaggcatgcggatgctgctcagcactggcctccctgtgtggtaagggtgggtgtgcagagatgagatggcacaggggagctagctggatgtcttgggtttgggaaggtcagcaaagaaaggtaagagagggtgaaagtttgattgaagaatgttggctatgtaaggacaacttaacccattggggtaacatttcttagtttgggttggggtccaatggggcaactgaaaaggaaaaaggaaccaagagaatagaaagcatagccaagaagcccaacaatcccctcctacaggaagaatgccttgcctcctcatttcttctctgaaacccctctggaaatgggagtggacaatgtaacttacttatcattttccacagcccatgggaaggtgttctttccccaggaggaatgtttcccaaacagccctccttctggccttatctgtgataagttgttcttttctggggactgtttgggtatccttgactctgacatactcagtagggcaggttaattctcttgaatcttaaatttagccatctgtgacttcatattaatctttggtctccaaaaacattgggctgttttgcctctttctactcacttatgtcttctttatcttaattccaaatcccagcaactcagagaagaattgggtcctgcaaatgatattcacaatctattgctttatgggaggtcagtgaaggcctttcccatttactttgttaaaatctatatctattttcattcctaattttttatctgcaagattatgtagcaacatgggaaacatttataatattaaatagtgaaagaaggggacacaaaaattgcatgtaaattatgattctatttgaaaaaaagactgagcaaatagacaatcaaaaagacatacacacatacgagaaaaataaaactggaagaaaacaaagcaaaaaatgaataatgactatggtaaagtgctggaattgtggattttttaaattcttctctatttacctaaaaattttaaggtaataagaaaatacttttataattaagaaacagacttactaaaataaagtaggggcagaaatgaggaacaaagtttgctaaaataaataaaacaggaaagcttgtagataaggttttatggaagtaaatatacgtagctcccagcttagtgtgtgtgagctgatggagaaacacgactacagagctcttatggaaagcatttaaccatttgtcacccttgcagtctacttcaagagtgactaaaaggaagaacaacatgaggaagacttcaaatgtgttgaggatttgagaagaggggctagaagtccaggcatgttagaggttttggggctgtagagagatactgtagaagttactaaattgggggttttatgggaagtgcttcaagcatgacattgtgaggctatgatactgtttatttttagaagtcctgttgagaggagtatctttcacctctcactaaattagctatgctccttggaaccatggacatctttctgctgtagcagcaataggatcaaagcacgtgtttagaaagagaagtgaaaaacaccagatgtgagcaaaaccacaaggggaatttcagacaggcagcatgcaccagatgacccaatttggaacgtggcccaggccccaggacaggcagaccctgtaaggatcaggctggacagtcagaggttattgatcccgatttaagccaaatgttgctaaaacttgatctgtgaccttgcttaagccattgacctcctctaaaccactttcaccatctgtaaaatgcaaggactgtgaatttcctctcaggaatagctaatggaaaccatgctaaaaagtagagataagaatgaagcacgatcttgcgatcttgaacaatggtggtaaattgtatttgattatataaataccacaacatacacacacttacagtgtatagatgcgcacactttatgagaagaatgtgtataaaaaacatagaattggccgggcgcgatggctcatgcctgtaatcccagcactttgggaggccgaggcaggtggatatcttgaggttaggagttccagatgagcctggccaacatggtgaaaccccgtctctcctgaaaacacaaaaattactggggcatccacctgtaattccagctacttgggaaactgaggcacaagaatcacttgaacccaggaggcggaggttgcagtgagctgagattgcaccactgcactccagcctgggcaacagagcaaaactccatctcgaaaaaacaaaacaaaaaaaccccatggattaaagattgtgttccatcaattcacagagtaaataatctatgtgttgacaattgaaggggtagaaaaaatattttttctcttacacatagctctttaagattcctagggccagattcagcatactgtctagcacagttagtgacaaatgaatgttagtatagaatagagattatgcttcaaatttcaactgtcttcaccacttagttgctatgtggctttgggtaaggcactctatcattttgtgccttggtttcctaatctgttaaatgggaaaaatactagtatctacctcatagacttgtgaagattacataaagtgatatatctaaagagcttagatgagtgctgggtggataatgttagttattactatcttctaaagtcttctatgtggacttcaaagctctctgcatttctttatttcatctctgttttctcatttaaatgtttcccacattcttgctccattcaagaatatttcttgtttgtcttattcatctatgtaggatattgctccctgtagactttaaaccagcttactcattccccctcaaagccattactgttttcctatttacgtcaattttgagtcagtctctaagttgaccctacaaccagaaatctatgaagcgtcactcaatcctctgttctcccactcctgggcttcttatataacaggatgtcctcttaaccacaggggatgtttcactaaaattaaaatgtatatctttattttctttaatagaagaagtaatcagttatggcatcacagtatataacagaaaatcagcttgggatcactgagcatggctgtctttaagaggatggggcagtgaaaggagtcctgggtgcagtgaaaatgccttctaccctttggagagatgttgacattggagagaaagagggatgcagtactgggtccaggaagggaagatgttggaattcatcctaggtctcatgtaccaaggaagtgactctgtatgagaacagaggggaaaatcaacaactgatcagtgataactatggtattttggccttagggctattaggggatgatgagggcaaaactgagaggaatgttagggaatcactttctctaaagtatcaatataaattgactctacttttggcactcacggaaacagcagaaagaggacatcacaacccctacctggacaacttctgatccagtttcaccaacaacagcgtcactcctttcgaagagcactcttgtcttccactgttaccttgtatgattatgtgattgttatcgtccttatcattatcactctcaaatcacttgaatttcttgcatccctccactatgttatcttctaaaataattttactacaagatgatttaatcccatggaaatttttgagcccctattatgaaggctaaatcctagggaatacaaagatgagtaaaagagtcattgctcttaaggagctcatatcacaagatttaggcagattgaaattgctaaccaacatttaacccaggtccaggtgctcctaattatcttccctattggtttgtcttgtcctgttcatttatttaacacatatttatttatttctttatttgagacggagtctcgctctgtcgcccaggctggagtgcagtggcgcgatctcggctcactgcaagcttcgcctcccctgggttcacgccattctcctgcctcagcctccccagtagctgggactacaggcacccgccaccatgcccagctaattttttgtatttttagtagagatggggtttcaccgcgttagccaagatggtctcaatctcctgacctcgtgtgaaagtgctgggactataggcgtgagccactgcgcccggccttaacacatatttattgagcacctactatgtgctaggcactgggctagcctaaggatgcaatagcaactaaaataagcatcatatttacttttagagaatataactgcaatgtgaagaattaggctcaatgatatacctggttgactacagaagaaatattaagtattcctgtctctcctccacagagtgggatgcactccagtgcactcctcttccaaccattacgtagtgaagttttagctgagacatatttagttcttatgtgagtccaacttgagaggcacctgacaataagaggacaaatctccactgtaatgctgaatagctggtagtctcatgtccagtattcctgtgcaaacacccttgcaggaaccaagtacccttcatattatgccctgattctatatgggttagacatacacatcaaataattttggtttgtcaataaacaatctaaataatagaaggtacagtcaattatataaagtttccaaagaaggataggggaagagtttccaagaaaagttttttcttattggaagaagcatatcagatgaaggcaagcattactttatgtatatatgtatgtatgtatgtattttaaggcagggtctggcactgtcactcaggccagagtgcagtggcatggatcttggctcactgcaacctcagtctgctgggctcaagtgatgctcccacctcagcctcccaagtagctgggactacaagcatgcaccaccacatccagctaatttctgtatttttttgtagagatgggggtcttaccatgttgcccaggatggtctcgaactcttggctcaactgatcctcctgcctcggcctcacatagttctgggattacagatgtgagccaccacacctggtggctcactaattttcactaatggcaataaaaccactacttacaatatcagagtgtacaactaatgtattagctgactaaataagggatgtagtaaatttagtcagggcttctgcctatatagagtaagaccccaaggcatggaagaatgactcactgtaataaactaagccaactaaatattgatgaatagtgctcacataacagcataatattagaacagaaaagaaaattatagattgtactggataactcattcaagcataaaatttggaatctgatggtcctaggttcaaattccaactcagcttcctctttgccacctctgtggccttgggcaacttgagtatttttaaatttgaatactacagatctatattcctagctagtagagttctttctcttatggattaaataaagtaatacaattgaagtcacatggtgcacagtgggcacttcataaatactctagtcttcttttcattgtacagaaaaggaacaaaagcctggaggactgatctaactttcctgaaggcccacagttaaccaatgtcagatccagatgaaagcccctggcttcctgactcctggtccagctggctgtctatgatttccaaaacagggctgtgccaaagacaactgaaaatacatttacctctgtttttttaaagctgaagagaatgaagtaaaaagagaggaggaggctgatgtggggtgagaggtataagaagcagatttactttcctggttttgcattaccttcctgagtttacactgcctgagcacacacccactaacggtggggggaagtggcagagcgtagccaacatgggattaaaaattgtgttacatcaacccacaaagtaaataatctacctgcccacagttgaagagggtgtaacagggtattgtgttttttctcacacatagttctttgggtctgctagggtcattccagatctaattttccagaagatcctatatacgcctttccattggagttttgagcttgctaatgtgtggatttggcagacaaatgcaaattaaagaagatatatatgaaaaatcacttgtagcctaaacatgatttctgtgtgggactggtgctccacatggataaaaaagccatgggccagagacaggatgcttgactgcttccctgcactgctgttaacactcggggggacccaagaaaggagattaacttctctgggcatctattttgtcacctataaaataccatcaagtagtcatttgctatacattgaatgcaagacgtttgtcacattttatttttctgtatccttttaagagcttcatggggcagattgtactcccacattacaagtaaagaaataagggcttagagatattgtgacttgtccaacgtcatttagctggtaagtggtagaatctgacagaacctggatttgaacccagaatctgctttcaacctccaagctacactacttaatattgtgagggagggaaaggatgttaaccttcaaagtactttacatcagtttaaacaaatgttcaatacaatcatttattaggggtataattcctaggaggtgcctgtacttaagtcattttcagctcattgactttctcattcattgcctctcatctgacctgtgagcctcaaaccacagttatcctatttcatttcctttgtttttggtgtcagtactcctcccacattggctgatttcagggggagccggcaccacttctcttcaagtaggggagtgtaagtgtaggaagccactcatacacacacacataaatatgcgcgtgcacgcacacacacacacacacattcatattagtttgtgatacacatacgtggtttcagaaattgacaatttaagaatatgtcattattatgacagtgcatatatcatgtataaataattccccagaattggggttgggtgaaaaaaacgctgtgataaggtgatagaaagtgaagagacatgtactaaggagaatactaagagacttagaaccttctggcttcagcccccaccttgaattttaaaagaagttcatgaattttttcctgctcattcggtctcctgaaagatccttacccttggtaggaaatgagcttgatacaacccagtgttgtatcaactgatactgagctttcactctgttatctgtatctgcattccaggtagtggtggtcatcagactgtaaactttggaggctcagggtcacatctgtggaattctctcttctgtggtccggcatggcatacaattagcaaattggtgatgacaacgtttttcattccttctattgctttttatttggtttgttcaggagacagacacaaaatattttgagactcatttaattatagcccacaactgtcatggcattcaacaagtgcagttattcgttaaatatgtacttgttgaacatcatggtactattattgaacatcacaataatatttcattttttgcattaacccttaatggttacaaagtgcatctataattagtgtcacacctaggcttcctaagaatcctttgagaagggagaaaggaataaaagcattacctaccttatgaggatttgtgagaatcatacaataaaagacaaaagtgcttagcactggaagctgatgcagcgtaaacaatcatgaaatgttactactagcacagttattagcccatattactgatgatatacctcacttcctcaagtttgcacagtgaagtagtagaattcagctaagaatctgtttccagaccccaaatctgtcttaggaaactatcagttgagatcgcaattatggaaggcaaaaaaacagagccttaaagggagagcaaacatgacaggttttatggtgggtgagtaggcagaagtgtttagggaccttatgtgcattgtcaagtgctcaggggagagggtgaggcccaggctatgtaccacaggcagctgtacaattcatttttggttcctcaaatgttctatcttccctcagcaccttcacatagaatgtgttccttctcccctgtcttattctctgtcttcacctctcttcccaacacttcacccaacattcacgcttccaggctcaacccaaacatctcttcttccaggatgctctccctgagcccctgtctgcacctactgacaggcactcacagtactctgcatgcctcctttagagaacagttgtccaatatttgtcttcccagctaggaggtaagcactgagaagtctgcaactttcccttgcttgccggctgatgtctccccagcagcagtgtccagcacgtttgtcaagtgcggagcagctgctggccaccttaaagatggaaaggaacgagactgaaaaaagggtgggaagtcatgaaaacaaatttaaaatgctttactattttgccctagaaccactcggggtggtgctattgggaagagctaggcagtgagaaaacataaaggaggcaacggaaaggagcgagaaaaaagacacaagaaaggcatggagaagtcacttgatgcaaagagtagcagacataggtgctcatcctgaagaaggctgggccatggatgccaagccttccgcagacatatgaaaggttgctgagaattagccgtttctctttctttcaaacttccccttgtttatgtctgccgtcttttgtcagaaagagatgcaggggccctgctctctccagaagactaacccctgcagcagtccatggaatccagggctaagtctgctgaggggagagggagggagggaagagtttccaccaggatgacatatttctgactctgccctctgacaacaaagggtgccggtggtgggacttttggcaggaagcacccacctttgggggagtcagaatcatgttgcggggtgacagtgactgaggcggaccctggagccctggccgtcttccctgcgcggccctaggcagcggtgcctggatgatctcctgggcgcctcctccgaggttcaggcagggctgagggaggatgcgatgcccgagctccggcagggcccattttgtttatgttcccactccttcgccctgggaagccccgagttcccacactcactgaggcaggaaggtcaccacggacacctcatctgtctgggccgttgactaactacagataagcagcagctgccacatccatgttggggtcacctcccagtctgcccaccctggaaccaggggagaagcccccatccccgcccacttgcacatgatgcctccccagcaaggtcagctgctcctgaggccaggatggcgacatggggccacagaaaaacttgcttttgcgggagaagcaagacatgactaagggattgaaaggtcttagacatgactacccgagagcccaggcttatatttccaccttacctttttttttttttagatggagtttctctctgtcgcccaggctggagtgcagtggtgcgaactctgctcactgcaacctccgcctcccgggttcaagcaattctcctgactcagcctcccgagtagggattacaggcacgcacccccacgcccggctaatttttgtatttttagtggaaattgggttttaccatgttggcctggctgatctggaactcctgacctcaagtgattcgcccgcctcggcttcccaaagtgctgggattaaaggtgtgaaccagggcacccagcctaccttacatttgctgagcactttagagtttcacagcgctctactgcctgcatcttttcacatgactctgaccaccacccgtgaagatcgcagagcaggtgtttttgtgtccattttgcagatgagtaaacagccccaggatgttcgagacgcttgccaaattcacacagatagttagtggtaaaagtcatgttcacgggggctttgtgctaccccatgcaaacacaccacaccagctgaacaatcccaatttttatccctaaaagaggactctttctcccaggtttaacctgttttccacccaagcctgccgtgtagtgagaaacatagcagttttggagtttgaatctgattcctcttcttgttaaccaaatgatttagcagttgtgtatttgggacttgatttccctgaatatttgcttccacatgtataaaatgcagataatgctgcctaacttgaacggttgttgtaaggtttaagaataacaagaaacatctattctctgttttccataccctaagcttggttctaagcaccttatgttcattgacttattaaattctcacaacatgcctgtgtgatttcatgcatgctatcattatttcattgtacagttgaggaacaatggcagagaggtaaagaaacataccccaggttacacagagagcagatggcagagccaggattgcaacccagactacagagccgagtgcttaatctccaagctatattgactatgcaaattatgtttactgtccacaatcggcactcaatcaacagctattactaagaattggggaagggtttgtttgaattacaagaaaaatgatcagctaactacctgaactaattagatgaatcaatagtcctgtctactcaaaaatattttctatgtagtattctggtttctaatttcttcccactagattcatagctttagagcacgaagtcacccaagggacttttggcaatgtctagagacatttttggttgtcacaaatgtggggtgctactggcatctaatgggttaggccagggatactgctaaacatcctacacagaagagttcctcaaaaaagaattatctggcccgaaatgtcaatatgctgaagtttagaaactactttaaaattgagtatttagagttgagtcatgattacttaagttttgaagtgccctgctggatccaaatttgacacatatactaatttgtttattcaaattggacacatataccagtaaagtaatgccctgtttaatatctagtgatacattaacatggttccttatatgtgatcatttgtcattacttattgttgctgctgctattgttaccaagcaaagcagatgtgtgccctagaaatggtcaggctgatttggggtttgtggtagagttagaaaattgaagctgtttttctgttaaattacgttaccaacctccaaattgctgacatttcttccaatatattgaagtaggtcataaataaactcacagcaatgccatttcctttcagcatacaactctatgaatccctggtatctttcagtgcagtcagctcttgttttgtgtgttatgtacacaccaaacagatttttaaagtttaattttgttggccccttttgaaaactcctgtagctaatgacattttcaaaatgataaaagttttattttgtcaaacagaactttgaccaacagaacacccttggtacccgatgcacgtgtggcgcatctgtgatgcctggcagcatactgaactttcttactttgttggaaaacactgcgtgtcacatcatcaacactgattttcatatcatcatgcattagcttcaaagactgtgtttataatcctcaaaggagttgtatcagtcagttttagccaggttgtgatacagtaatggataatccccatatcctaataacaaaatagatttgtatttgttcatgttacatgtacaccgtaaattggccactgattacttcatgtcttttgcattcttaatctagactgaaggagctggccctatttgggatatggtagcatcatagcaagggaaatgagaaagatgaaaccacatgatgggtcttaatagtttctgctcagcatatatgacatatgtttgccttctattggtcaatgcaagtccatggccaaattccttccataggccccataggcaggggcagcaaatattttaaacaataagataatctgctataagagtctgtttttgccaccaaagtcacaaacttctaaagagccagggactcagccttgaatcattgctttctaaagatgtttttatcaagaaatggggagagaatgtaaaatgaaaaagttgaagaagtaaaattatcagattctaatggttaatttgataaggagcagagttgggtggcaatgccaaggaaaagacagaaatgaaaaataatttctaagattccagcttgggtgactgataaatgatagtgtcaacaagtgaggtagagaagagagaagaaaaagaggtttagaaggagacaaaacaagtttcatttttgatgcaatgaatataaggtgtctttggaacatccgtgtagaaatatgcagtggacagctggatatacgagtgtggctcctgagagagtactaagctggaaacaaagctctgagatgcaagaccatgtaaataataataatcactattagggttgcatttattgactatttgctatgtgtcaggcactatgctaagaattttcatacaatttgcgtatgttgtattatttaattttcatgtaaccatctaagctgggtatatatatatatagtcgatgttatttatactcatttagctgatgagtttaaaagagggaagcttagggccgggcgcggtggcccacatctgtaatcccagcactctgggaggccgagtccggcggatcatgaggtcaggagattgagaccaacctggctaacacggtgaaaccctgtctctactaaaaatacaaaaagtagccgggcgtggtggcgggcacctgtagtcccagctactcgggaggctgagtcaggagaatggcatgaacttgggaggcggatgttgcagtgagccaagattgcgccactgcactccagcctgggtgacagagcgagactccatctcgaaaaaaaaaaaaaaaaaagagggaagcctaaaagttgatataatttagcctaggtctcacagctaggaagttgcaaaaaagatgcaagtgtttaatctgtgtaactgacattttagccaggtacagtctcagttggaaccatgacggcaaatgagaacatccagaaaccaaagatagaaagaaaagagaagagcagtgggccaagggcaggaccctaaggaatatgaacacttaaggagcaggaagaaaaagagcccttggagaagacagagaaggaacagctagagggagacttgaagagcacagtctcagaagccaagtgtgcagagagtgacaacgaaagggagggtctaacaaagtcagggataacagagtagctgaagagcagaccttggaaatgttccttggtgttgagagttaggtctgctccctgacagcatctctaatctcagggaagcatctgtaaccagcctattccccacccacaactcaggaataataataataaaaaaacacaggtggctagtcacacactgactttggaaacatcaacctgttgctggttcactctctgaactttgtttctcaagactgccttgaattttttacctgtctggatagatctttgtttctgggtcttagtgacctggctttcagtctctacctatgtacacttctctgaggttctggactgttctctcagcttaggaaacccagccttacaccacatccttatttttggttactacccactcccacctacagtcagtgaggttgggcactgaccctcaatccacagggctgtatctccagctgattctctgaaactcagcctccatacgggaaatgagttgtggtctcagctggtggttgctgtatctgttctgtagatgtagcaaatgtctgacaacagggctgctgccttcgagatcacaggttgctggtcagatttgccaagtcttgcactgcctgttgccagagcaagctgtctgtcttcaggtgggccttcccagttgccatgttattttttgtcacagctccagtagcttatggagatagaaggcttatatttggggaagaggatacttatgtaaatgggacttctcatgtcttctggatagtggcctggctatagtctggaagcccacactgtgtggacaccactgggactttctcatagccctgattgattggcaagagtccttgaaatctgtagagtaggcaactacagcatcagagtgggtaagtatccagacctgcctcactctcagagatttgaaccgaatgagccagtattatgaagaaaagcaaaaagcatctcctcgaaagtcctgcaagaagagtcccctctgatgtgagggcaccagaaacctgtagcatctctattatttttgtttagttggaggctgcacccacccatcagccttccctgaccatatccctcagtgagggttaccagacttagaagatgaaaatacaggatgcccagttaaatttgaacttcagataacaaatacatatttggtataagtatatgccacacaatatttgggatagatttatattaagacattattcaacatttatttgaaattcaaatttaattggtgttctgaattttatctggcctccctgtggccaccacaacacccataacttgagacttggtaggaattcataggccttgaaatccactggggccctatctctcccaagaaggcagtggagaactttgtgaggaagaaaagcagatgactgggcctctgctaggattactgggatcctaatactgtctggttccctctcctgggccagctcagaaggaccataaaattagatcttctgagtgcctagcaccttgtctgccttccatcgttgcatttggatgacagagagtttgcagagaacacaatgcctcttgacctatggcagcagcatgatcagtatcctgcaggactttcaaggggatgctttttgctcttcttggaaaatgtcctaatatatcctgaaacatccacatgcaacctgactagctatgcttcatacaatactctagccccaacagttctgagttacctgaaacatcagcaccttcaaaacagcacagaaatgtgtgacatttctgaaccaagttcagtgtagccagttatctgtgattctggagtgagagacaccctggtcactgaggttacctagacattttcaagagatgtctaacaccattttgtctttttctgtgcaactgccctagtaatgacctcctaaaatagagaaggaagtttcctgatgtgctgaggttgacactatgtttggcaagtcaagactcgctgcacctctgctccagtacagcacaagcaagcactgacgatgtgccaggcactgctgaaagggcttgcctatattaactaatttaatactcatgataaccctatgagctatatgctattattattgctgttttgcggatgaggaaactgaaacatggagtgataaagtaactcctataaagccatacaggtaaaaaatttactaagaatagaaatgaatgcaagcaactcagctccacagtgtgtcctctgcacctgcatgccagctctacacagctggaacctagcttcattcagcatcacactgttgagactggtgctgccaacactgtggagtgggccaccctgacccaggagaagctttatgccacacttcattatccctgcgtggaaaggggaagggcctgtggtcaagcatgttttcaagccctagagggtccaatgtgtgatagggacttcagtctgccatagcctgaaagctcagctcatgctatgcaaggcagctcaccttatctgtgcttgggtgctccatcagctgtgtgcccagcactcagaatcacagaccagattctctatcctgaaagcctgagtacaagaggtaacagagagactcgctctggaagactatggcttgagtatttcacaatcattctgctcaaatgatgtattttagacattgatgcatggtcttaatcctgatacagggcctcttggggcaatttggattgatgttaaatgccacgaagctcttcataggagcaaggcagtgctcatccctgctaggaaggccagaatgcagcctcagcacagccactggccctccctgaggtgatatggtctggtacactaccacaaaagcacctggacccaaagcaaagatacctcagggttcctctagagccgcggtgactccttctgatccacactcgcatctgaaactccagttttgggacttctatttgttgtctgcccacttcctggattgattgattgattgattgttatagagacagggtcttgctatgttgcccaggctgaactcaaactcatgggctcaggttatcctcccacctcagcctcccaagtcattgggaggtctgcccctcttgacctcttccctgactctgccctcttccctccctgcattgctcctccacccattccagtcatttataccctgataggtaaaagagggcttctactttcatggtctctcaaagcactgctttccaaccacagccctcagctgtgcctcagtttgggcctatcaggtctacatccacatacccaccacccctagacaggtgacaaaagtagtgcttaagaaacaaatgtgcttttttgcctcccccacacaactgactgctctggctaatatcactgctacacactttgctttcactaattattattgcctgccctccagaactgcttttttgcatacaaaggtttttgtccttagtgttttttttacacctcttcttggtattattattattgttttttatttttttatttttcgagacggagtctcgcactttggcccaggctggagtgcagtggcgcgatctcttgactcactgcaagctccgcctcccgggttcacgccattctcctgcctcagcctcccgagtagctgggactacaggcgcccgccaccatggctggctaattttttgtatttttagtagagacggggtttcactgtgttcgccaggatggtctcgatctcctgacctcatgatccgcccgcctcggcctcccaaagtgctgggattacaggcgtgagccaccgtgcctggccctcttcttggtattattgatattcctgcagctagacagtacccgggaaggaatgcaccaactagaaggagctttaatgagcctactgtgttatggctggcatcagccttcagagaggtttgagcataggatgccatctaattccccgccagcccattcattctatccaactaatgggaaaactagaggattgctgataataatagcatcagcaaaaatagttaccatttatcaagcatttactatgggccaagtactacgctaaatgctctgcatatattttctcacttaattctcaaaaaatgcaatgaggagaatgctattttatctctagctcacagctgagaaaactgacctgccaaaaaagccgcataatgaataagtgatagagcaaaattttgaacgcaagttaatttaaagcctgggcattcagccactctgctgccattatcatacatcatctgacttccttcatgtcccatctcccaacttctgttttttattttctcttttcctgattctccagttacccaccctagcagtggaggtgatatatatgaactgcatgccaaagtgggtgtagactcataatgacaacataatgacaccaactggaccatgggaaatggtgaaggcaagagtagttatttcaacttggccctttgaaacagagaccctgccgcaagttatgaggggtttaagtattttcctgtttcatttgcccttagatcccaaacacctagaactgtgcctagctcatagtaggagcccaagaaataccagcatggaaacctggaaagctggggtaaatctgatgaagagcacaggagccttagtaaatccgggtgatctgaaactggctcttagttgagccagatgataggatcttaatgacaattgtgcaccacttctcatttcttgcgactctttgcaggtttgcttcttgctgtcttattccaactaaaaaattctgtttacttttcatgtattttctctacctcagaattgttgcttattcataaattctgccttcttatcacatggttctgcttcctcatagttttggtttgctataatcctccatggctccactccattgtatgccatcctttcagcttcagctcccatggctaactgcttctttctatccatgtttcccaattcaaatcccagaaggagagaatctgattgatcaaacttaccttttccactcaagccctggtttttgggaaggcagcccctaatgtcaagggccaatcactggtccaatcaggagccatccctgggcaaagaacaacctacctctgcttctcaaagcagggggctctgggtggggcactttcatctcaaagaggaagttgggtgtggcaggcactgtgttgacatatccagtataggagtgccctgggagcccatctctcatttctgaaagagatagcattgtagatctggacgtttcatcacatattcccaggaaagcccagccaaatgcagctggtaagttgctgaatgtggaattcctcttggccttccaactccttgcactcttccttctgggactactttggtttttcagtttattacctgtttggagttggcttgtttctggactctctcttctgctcaggtgagcagacttctaactggaacgcctggctcttggacaaggtgagtgtttggatccaactttggttctgcaccattctttcaacttggatgacattgcctcacctcttgtatccttgtcctctcccttctactcaatccactctgctctgggttattatttacctgagggtgccttcccttcccagacccaccaacatactcctgagggaagaacattcaaaagcagctggtggcttcagtgagatcaatttttagaggaatgatcggggcagaagctagatagaagcaagttgaggaagtggaaatagtgagtgcaagacacttttctgagaagtttagatgaaaaggaggggaagaaaacagctatgtgtcaagagtttggtgtgtgtgtgtgtgttttattttttttgaaagaatttgcttcttattatataacacatgattttgtaaaacattttgaaaaaaacaaaaattataaacaatatgtttacaattgcccattaaactactacctaagtaattacaatagttaccaatttttgaatacctactaaacagaagaattatgctaggaacttcatgaattatttttctatttcttgtgcaatacaatgtcccagatgggtcagaattcagacagatatggctgtgatgcagaattagacaatgtctcttccctttaagcaatgattggcatccattgatttataagggggctgagaagtttgctgggggcaaaatggaaatatttgcctcagtagggtcttcagcattcatgggcatgtctggagacagttccagaggtaggcagagtgctggcaggaatggtggggcccctggagagagcaccgttggttgaggaaggagtttgtaacggtaagactgggctttagacctggaaggtcgtggtaagtctgactgtcacagggaagggcctaacccagcttccttgcatgtgtcttcccagaagaaaacaaagaagggcctctgagtcatggaaagagccatgaaactctttaatgctctagggcctatcgcccagtaactggtaactcagtgttatattaaggaagagagcttttcttttcccactttgaaagaggatgctgacagacatcacaggggctatcatagccctcaatttcccataaaaccggcaccacagtgccagctgtgattgcagaaaaaggtttttatccaagttgtgttaaggaaatagtagttgatttcagttaattcagtcataacactttaccttgagcattaatgctgaaaaagtcaactctcttacttcctgtttttcaaaagcattattggctagggtaactgtgcagggctccacgctgacaccgtttgtggacttttagctcacagtggtgctgtcagtgccagcatcttggtgtctggctaactataacaatacacatgatgacaacactggcttaagaacacaggtaagatctgtccaccaatgacacccaaatgtctttgtacaaaaacacctactcgatgaggccctccctgaccaccttatgtaaaaccgagcaacccctctgccttcctaccctctgcctaccccgactttctttccatagcacttatcatcatctcatgttttgtcatttttgtttctttttcttcttttttaatcatcgtttttcctgtcccaaaaagcaaatgccaagaaagcagtgtccaggtctgtctgtttattgttgtgtccccagagcccacatcagtgactcacacagagtgctcaatatttattgagttaatccatttcatgaatttctcataaatatttggggaaggataagaactatgaagatttttaattaacatgatcacatttggatttatggctcaggagaaccaaggatatttgcttacatttataccacccttacaaggtccatactctaatatggccactttgcaggtgaggaaactgaggatcagagtgaaagcaacctgcctcagcccccatagataataacgatcagagccaatataaactggtgtagtaagtaagaagacaaagtaggtagtattgctataggtaaagcaagagctaaggaaagccttagttgatatggcagaaataggaacagagagaaagggacagaaaaggaagaaactgtgaagcctgattagaaatatggaaggcagaattcaatatactcctagaagcagcccatgaaaataaaatgaagaaagaaggattgtttttctaagaggagggtggcttcaatttctttcagaaaagattggctaactgaaaactaagaaagaaacagaccaaatccttgtagcttctagcacatctatgataaaattctgttaattggatttcatacttggattataactgcacaacacatgagagtaaaatgccttaagacaaaaagagtaaaaattgagtcataatatggagacgatactattctggcaatagtattcaaagaatggaccagggagcagtgcacagctttgggaagcaggggttgtcaacattaggactcagagttgttagtgatgaggttcccaggcaacataagagacccttgaaaaaggctttggcttagggaaaaagaattataggggccagacgcggaggctcacacctgtaatcccagcactttaggaggccgaggtgggtggatcacctaaggtcaggagtccaggaccagcctgaccaatatggtgaaaccccgtctctactaaaaaatacaaaaattagctaggcatggtggtgtgtgcctgtagtcccagctactccggaggctgaatgacttgaacccgggaggcagaggttgcagtgagctgagattgggcgccactgcactgcagcctggggcaacagagtgagacttcgtctcaaaaaaaaaaaagaattataggacccaagtaagaaggtctggctcccttggcatttctcaccccctggcccattagctggtgttgcagactccactgtggtactccaaggggttttagagaaagaaccagggcagatgaccatccaaatcagaagggccaggtaggatggtcagccacacatgtgaggggcagatagggaaacagaagattaatgcatatgggaagccccaggaagctaaatccatcccagatcacactggatactggctctgttgaggcaggtggtggggggtcagcctggtgacagcatatttgttcattcaatcaatatttactgaatgctctttatattctaggcactgtgccagacattgggctaggtgctgggaattgaaataataaactatttcctgatttctcttctctcttctggagaaagaattggattagaacaaggtatggttctcactggcacagggattgggcaaggccgtctgcaagaggcagacatcagcttgggcaatggggtcaagttggggatggcaggccctggctgatacaatacttatattttacctgaaatctgtgtttattttctatcttgaacctggtattgtttatatttgataagcaaattttatgttttaagtaattcctagacatacagttaggacattttgcaggggagggcttttgatttttaatcctaaaagcattagtttgtctgtattgccgggcttgacaatcacataaaataagtgtatttcaaatcactcaataggagtggctgcaaataggggaaagaacatgatctattactactttggattactactttttactggcaaaccataaatcacagtggggaagccacagtggagtataaggaacttaaatcatggcaagagtgatttaaggtcagtcagtgcagcagataatctggagagatgatcccactcataaccctttaagacatgacacttggtaaactacctaactcataagggtgtcctggcagtgaacctccacacctcctggttggggtgtgtgctccatctcacccagcttaagtaggcctgaaagaccaccctgttctctcaggcaagagtattcctcttcattactggaagggaattaaagacaaagctggtctaatcaataaccgcaggcccttgtctcactgagaagaataaaaatgaatacgcaattatttgccattgtggaatgtgttttccctagtatcaatgctgtatgtaatactaagatttctacagcctatttaatatagaatatatacatacacgcacatgcaaacacatacacacagatatatatatatatatagttgcctcttgtatggtatccagtcaagtgtctttactgtaactggaaatcaaaattacatcaatagaaaaaaatgctacaccagtagaaaaggtgggggggggaataggagaatgaaaaaggggaggagcaaaaatgaaaattcacttttaaacaaatgtaactttggctatatggttacaggtataggttctggctgaaaagatttcaatgtctgctttaatgtaaattataagtattccagaagacagataattttattttactttttttttttttgagagggggtcttgctctggcccccaggttggagtgcaatggtgcgatctcggctcactgcaatctctgcctcccaggttcaagcaattctcctgtctcagcctcccgggtagctgggactacaggcacccgccaccacgcccgcctaacttttgtatttttactagagatgggatttcatcatactggtcaggctggtctcaaactcctgacctaaggtgattcacctgcctcagcctcccaaagtgctgggattataggtgtgacccactgcacctgggtgacaagataattttaggagccactttaaaaagtttccggaactgtagtctattatttcagtctcagtcccatacaccatgaaaaatttagggcatttcattgctacaaagaattttaaagcagaatcaatccatgtaattaaatcttaacatttattaagtgcttattgtatatcaggtacttttacttttctaatcattgtacagttattaattcattcaaatcttacaaaagtctatgagttattgtttccattttacagatgaggaaattgaggcacaaatattgcccaagatctcacagttagtgattgacagtaagattcacactcagaccatctgactctggaggccacacttgtcattcatgttaatcttacttaacatgcttcatgctaactacagacttagttatctccatatgcatctttcaagtagatggcttatcacaacagcaattagacctgtttacatgtttggcgcttatttattgaatgattacctactacacactgaaattggttaagtttgtttctaaaactgacaagctttgttttaaaaacaattcatcttcttccgctctttttttcacaagaggtagttgtttggatagtaaccttttgagaaccaaaagaagtgaaggagagctacttttgtgagaatgaaaggtggagggtcattcattcaagaacttgtttttaccaggtaccagttgtcagtatgcaaaagcagcgaggtatgccaatgtaattcatgttcaataaacatcataaaatttatttctatacattaaaatcttcctgtgtaacaaaatgcatgttttatttttatctgccacttttcttaagtcagtagacaattccctcttctttctcccaggcttgatatgaggttagcttttcacaattggtacttctgggggggcaaaaaacaggcaaaataagtgaatgggaaagcactcagacttattatttattaatttgtgatattctagcctttcagtgactcttttcatgctattttttccaacttctgtgggatggggaaaaaacttatccggagtgacaacatttctattttccattattatttcttgcataaaatattcaaaaacaattgttttggcatcatctcacttcgaagataaagaaagcaatagtaaatatcagcctgcatattgggaattcttctagagaatattatttagacttcatgaaacaaaagaggagctaaaattatgctttgtgtaaatctcagatagtggttttggcttaaaatttgctatcccagcactttgggaggctgaggtgggcagatcacgaggtcaggagatcgagcccatcctggctaacacggtgaaatcccgtctctactaaaagtacaaaaaaatgagctgggcgtggtggcgggcgccggtagtcccagctacttgggaggctgaggcaggagaatcgcttgaacccaggaggcggaggttgcagtgagccgagatcgggccattgcactccagcctggtgacagagtgagactccgtctcaaaaaaaaaaaaaaaaaaaaagaactttctgttgtgttaaagttaactagcgaggagactcttgattcctaagaaatattaaccttatatccccaaatatatttcatgtgcagttcaacaaatgaaagttaggtgctctgaataggttttggggttaatgagtctattagaatacaggctttttgtatagcagcctcggagagctagcccagccaggcccagtttctgctgtttctcaagcacaggaggctgagagtagagaaaagtgctctgtaagaaggctgagcccctcactggaggtggaactactaccctacatgttttgtttgtttagatgatacgctgagaaccaaatctaccctgtcagcttactcttcaagaacaagccaagcaactgaaactgagtccacgctcagctaagtcaaagcccaggggattactggcatcaccacccaccccacctggagcatgacaatgtctgtgagagaataagagatgggtggtgtcaccactatctttctctttctgttctccaaattataataataacagtctcttttcctcctctaaacattttttataaaggaggttgaactcagttgaaatatcttgaaattactgtggctggtttacaagccactctggaaagttatgctctggcataaatttagcagctatgttttactgtaaaaagaaacccagggacatagcttattaagaaaatgtggtcaaagtgagaattttctttggttttatgaataaatatagatattatattacaaaattagatttatatcgttgagcttgatactagacagtaaatattatttcttaggaaaaggttaatacatcattaaattttaaaagttgaacacaaaatctctaacaaattaaatttaaatatttccatttcaatatcattgcagacagttcatggtagtgaagtacattgagaaaacttgttctttaagaaaacaaacttctgggtaaaagatagtaatatatcagcaaaaaaagatttttatcaagagggttgaaggctatagcatcatcaaggtaaagatcaaatagcatggaggctaaaataaacctgtgcttttttgagcgggtggtcaatagaaattggctctgttgctggagatcctgaattttaaattctggtgatcaggccagtaatatgctgatgaagcagaaatgtcacagcatattttaccaagtcaaagacaggcaacagttatgagagggacatggagaacctggtagagctctgtgtactatgctgaattaataaatagagaactaacttaaggtggacaaaactgctgggtgtctctcaggcttctaatgttttcaaaatgtatttgaagacttaaagccttataataataagaagaagagtagtccaagttctgtttatttccttttaaaaggagtcaacacttgaggagacaattctgtactcccacaacaggaaaaatgcatccttttaccgtgtgaataattgaaccagagtcattgcccactcttcaggaaatagctcatgtaaacttttggccgacctgtgcttcacagtgcacttacctcttgacatccacctctgtaaacttttatttgtattaccaaatattgactgcaaacaaaaaaaaaaaaaaggaagaaaaaggaacctcccttatacaattacagaacgttagagcaaaagagaactgaaagatgatcttgtgcaggccaccattttatagatgaagaaacaaaagcacagagtgacttgctaatgcttcaccaagctggcacagcctggcctagagctacattcccctgtgtcccagacccacatgccagcaccaacatcatggatcctctctctctctctctcttgtgagacagagtctcactctgttgcccaggctggagtgtagtggtgcaatcttggcttactgcagtctctgcctcccgggttcaagagattctcccgcctcagcttcttcagtagctgggactacaggcatactgccaccatagccggctaatttttttgtatttttagtagagacgggatttcaccatgttggccaggctgaagatcctctctcttattgcttgatgaaaaaatgtattaggcactgggaggatagaaattaaagagccccaatacttgacatctaggagctcacaacccaataagaaaagtacacatgtagaccaccctccaatattttactgtactctgtacactgttgctagaatgatctttctgaaaatacaaattgtaatgtatctaaccctgtgtaaaaccgtgcagtggctccttgttgcctgtaaggtaaagctttccccttgttctccagccttctgtctaactgggtctatgctgatgctcaggatccagccatagagaaccaattgcttttccctaaatatagcaggcttttccctaaatatagcaggccctttcatcctgccaggcctttgttatgctgttctctgcctggaatgacctcctctcattaccctccaggagggttatctctcttgtaatagatttccttaggtttctctccttccacctccaaccccacagacagaattaaccattccttcctttgtttatttgtcctgcccatatttctcctacagcacctatagtgctttgtaacattgatttttttttttttttgagacagagtcttgctctgttgcccaggctggagtgcagtggcgtgatcttggctcactgcaagctccgcctcctgggttcacgccattctcctgcctcagcctcccgagtagctgggactacaggcgcccgccaccatgcccggctaattttttgtatttttttttttttttttttttgagacggagtctcgctgtcgcccaggctggagtgcagtggcgcaatctcggctcactgcaggctccaccccctggggttcacgccattctcctgcctcagcctccggagtagctgggactacaggcgcccgccacctcgcccggctaattttttgtatttttagtagagacagggtttcaccgtgttagccaggatggtctcgatctcctgacctcgtgatccgcccgcctcggcctcccaaagtgctgggattacaggcgtgagccaccgcgcccggccaattttttgtaattttagtggagacggggtttcaccgtgttagccaggatggtctcgatctcctgacctcgtgatccgcctgcctcagcctcccaaagtgctgggattacaggcatgagccaccgcgcccggccgattgttttaaaatacataaatgtacttgccatttacacttatgtctttctctactaattgaagataagctccttaagagccatctttgtaagggccatctttatctttgtacccctagaatctagctcagtgcctggctcagaacaactccattgaatgaaccatccatacaggcccttacatcatgctatgggaatgcaacagaaggagcagtgaactgtgcttagaggagttgccttggaagctgaagcatgtataccaaatagaggaacatcagggcagggcaagggttggttcatagctggtcgccagaatagaatgctcaaaggtacaggggcctgagaagtggtggaaaggttggcaggtttgggaaatttgaggatacctgagaggatggactgtgggatgtggtggtttgctgttattattcttattgttaaaccagaagaagaggctatgagttagtcaggggctgtgtgttaaaaggcctggcaattcatgctgagaaaggagttttgattatattacaaagagctaaagaaagaagagttttgaaggtcagtattcaagagtagggatgattggatatgcctgtcagagacaaaggacaatgcagtgaccaggagaggttgctccagggaggagtgggactgcatcttagagtctgggtggggcattggtgatctgagggttcagagaactgagaatggtccaggtgaaaactgatgagggcctgaggcaaggcagtggagatggagaaaatgagaatgattggagaaataaacacagcagtggtggaatggtgactggcaatcagctgaagatggggaataaagggaaatgaggagtcaaaaatgatcccaagtgtttatcttgaatgtttaagcagatggcgttgtcctgatatggaatgcagaaaaataacatcgagttgagtttgtgatgctttcgagatacttaaatgaaaatgttgagaaagcagttgaaattacatgtctcatattcaggaaagagttgagggcatgagtctctctaggtaataactgattccataggacaggatgagagcatctgagagcatgtgagggcgagagaaggtctagaatgaggccctcggttaaggaggagagagaggagaatgagacaacaaagaaatccaatgtggagtcatgagagccatagaaaaagagtttattcacagggaagaaagagtttgtagtgttaaaaatcaaagaaaggatatagattgaaaaaaaggtcctgaaagaactgtaatataaggctacaaacatactcattgggggctggaggaagtccaacataagccagccccagcgttgagccagtgaatcggagacaaaaggctccctctcttttttagtcccagccagttcataagcctgaggttgaattgcaactatgatttatgctaaatagctttatctaattagggctggtaaaattgaagtggttggaatacctctggcaagaacttgataaaaatttgagagtctttcacgttaattttaatcttcgtttgcatgaaatgggatggttaaggagaagtaaaagaaaaacatgaaaaggaaggcacaataagaagcattcattctttaaaggaaaatggtgtaccaaagagtcgtcccagagctcttccttctcctgcctccacatagtctaaggtctgtttacaggaaaaacctaagctagcgtggccaatataggttttaatgggtgagccaaaaaaaaaaaaaaatgctttcatggcaaaaataccaaaagcaatttcaataaaagcaaaaattgacaaatgggatctaattaaactaatgagcttctgcacagcaaatgaaactatcatcagagtgaacagacaatttacagaatggaagaatatttttgcaatctattcatctgacaaaggtctaatatccagagtttacaaggaacttaaacaaatttacaagaaaaaaaaaaccccattaaaagatgggcaaaggacatgaacagacacttctcaaaagaagtcatacatgtggccaaaaacatatgataaaaagctcaaaatcactgatcattagagaaatgcaaatcaaaaccacaatgagataccatctcatgccagtcagaatggctattactaaaaagtcaaaaaacaacagatgctggcgaggttgtggagaaaaaggaatgcttttatgctgttggttggagtgtaaattagttcaaccattgtggaagacagtgtggcaattcctcaaagagctagaggctgaaataacatttgacctagtaatccaactattgagtatatacccaaaggaatataaatcattatattataaagatacatgcatgtttatgttcattgcagcacattcacgatagcaaagacatggaatcaacctaaatttccatcaatgacagactggataaagaaaatgtacatacataccatggaatactacgcagccgtaaaaaggaataagatcatatcttttgcagggacatggatggagctggaggccattatcctcagcaaactaacgcagggacagagaaccaaacactgcatgttctcacttataagtgggagatgaatgatgagaacacatggacacatagggggaacaacacatgatggggtcagtcagagcggggtgtgaggggagggagagtgtcgggaagaatagctaatggatactgggcttaataagcaggtgatgggatgaattgtacagcaaatcaccatggcacacatttacctatgtaagaaacccccacatcctgcacatatacccctgaacttaaaagttgaaggaaaaaaaaaaagtaaaaaaatgccatcatgatacaattaggcacttataaaaaatgtgttccaaatccctcaaaagtgttttagtaaggggcttactaagtatggagatttcaaatgtggtatgtggatggtgctaaaattgagagtaagcatttagaaatttttagagcaaatcgagaatgctgtaacatacaagcacattgtcagtggactcatgtcaatgagcagggtatggactggtctgggtgttgtggaattctcatagtgagtcacaggtggcatgacctgtgccctagtcatacgcaggaagacacttagaccacaagcttggaaattaaaaaaaaattaaccacacagatagtttgaaaatcactgctttagatcacaacctatttgtaagttaagaggccctacagctcgtttggtgcaaggaagttgacagagagcttgagcatacaccaaaaaatttagatataaagtgacgggaaatttgaagccattgtagaagatacgaattggagatggaactacccaaaattaccttctataaggatcttctagattaaatgcaagctaacttattcttaaaattgttttgttcattatgatatgaacagagtctatatcagaacctggaacatggcaggcactaaataaatattttatgaatattgaattagttgttctaacaacatcgtggagaatagcttgagaagggtaaaggctagaatcagaaaaagtggctaggaagactttaaagactgtctagacataggttgatgggtggattagcctagtggatacagagattcagaaaatatgaatctaagaaatattgggaggaacttccagtttttcccatgtcagtaagcacatggacattcatcaaagtccaaatcagaaatgtggggtcatccttgactcttctctttctccttgctcctcatatttggtcactctctgaatcctaaatatcgctaccctgccttctcctgctattcacactgctttagttcaagccccaccacgtccctccaggactttgttatagcttccttaaatggtctccctgccctgggttcttccccattaagcttttcttccaaaattgaaaattcagtgtttttccttttttgtgtgaaaccatgaaatggctcctgatttaccttctaagcttcagcatacctaagctccatggtagggctgctccttaccaggccttgtgtcatctggcacttgctttgcatgccagtgcattcttctgctccttacttggtggttcttaaaccagaccaacactaaacaactggtaacccctgccccaagggtttgccatgttatttcatgcctctgtgcctttgcttatgctattccttctgcctgaaatgctctcactcccagcaccctggctgcttttccatctgtattcatttcctgttgctgctgtaacaaattatcacaaacttactctttttgaggtcagaagtctgaaatgaggctatttcatgaggctaaaattaaagcattggcagaccttcatacctcctggagctggaggagagacactgttctttgcctcttccagcttctaaccacagtttttgtttttgtttgtttgtttttggttttggctgatggtccctcattgtcacatctctttctctgacactcctgcctcctttttctataaggacccctgtgattacatcaggttcgtctgaataatctaatcttcccatcttccttaaacgtagtcatatctgcaaagtcctcattgacatgtacggtaacatttacaagtttgggatgtggatatctctgagaagccattattctgcttactgcaccacccaaccccaattagtctcttaaagctctgctatcactttttctctgaaacatgttctgctcagagctaatcactctctattttgtgtcatatacatactaccttcactgcatgggttggcttgtattgcacataataacttttaaaacacatctacctctctattatattttgatttcttgaggggacagcttatttatctttgtattaccagcggtaagcatgttacatggtatatagcaagtagtaggagctaaattatactatttaaaaatgaatgtcccaggcagtgcaatgatccatttgaatgttaactagacatgtaggtttaaatggtgactacagttgtggtgcattcctaactttgcagggtcgttgcctaccactctccctgcccacgcttgtctgcttcccctccagtcacatggcctttctaaccttccttggtcatgctgttcctatcccatcctcatctctctgtctgtaatgcccttcctccaacttttcttttcataaatccctaattcattctcaaagcacaaatcaaaactttttccttctgcaatgccttttatttgtctcaagacagaattcatcacttcctcttttgagttgctaagacattttgtacagatctgtattacatatttcacattgtgttttgcttggttttatatatgtatctgttccatcacaagaatgcacaaaagccatatcttgtttatatcagtactaggcatatagcaagcactcaataatgtttatgaccttaaagcgaacatataaacagatgagaatggaggggcaacagaaaggaaccaaaagattaaaagagtgcctttgataaaagataaagaggaaggaagagactgagaagaccctcaaagacagcattcagaagaccctagaggcagagtgtgatgaaggctggagttagagtggctgacctctaattaaagaggagaatgtgagaggcagcaccacatgcagtgagctgcaggcctgagaaagagaaaggctgttggatgtgaccacgaagagatcctaatggttttaggaagcataatgagaatgcccagtcaggaccctgggtctgctcctgtttttaggttaggagagattaggttaggttaggatctccagaggataaatgacttgaggaaaaggaatatcacacttcatatccaatcaacttgcttgaatgcttgaggccatgaacacctcagcacagctccaagtcagtttggaaggcttggttctttcatctgataccacgacttcaaagtactaggagatgtagatggttctcagggaatacagaggccaacataatgtattcccctataataatcagagattttcatcaatagggcacagttggctgggtggtccaggctcctgaggaacaaaggcaaaatgtctaaatctggcttcagaactgagaataatttctctttcacggaacttttctggatgatgatatttctctatataaagcattctctgacccagtggacaaatatttctcacatctctgcctgccttgaaccttgccctcctatcttccatcaacactgctgtcagctgtattctccaacctgtgtcttgtttggctaacctgtatggccaactgtctgtctttacctttacaaagcctgatctagacaaacttctatgctggacatctgcactgattttcgcccaaatcaattgtctagcatctatttctgtgatctgcttctgctgtgtcctgaatcagtctgctgtggtctgataggttgcacattctcaatgggagtgagaattgatcttgggggataaaaaacaacttaattttttaaatgtacaaagtgcagatatacatacaatgcataaaccgatatcacaatatatctgcgtgtattagggctctccagagaaacagaactgatagcatatattatatatagatacacagaaatagatttattacgagagattggctcatgcaattatggaacctgtgaagtcccatgatcagctgtctgcaaattggaagcccaggaaagttactggtgtattataactccagtccaagccagaaggcctgagaaccaggagagccaatcctgtaagtcccagtccaagtccaaaggccccaaaaccagaaacactactgatatccaagggcaggaggagatggatgtcccagctccagaagagagagtgaacttgtgcttcctccacctctctgttttattcaggccttcaagggattgcttgatgcccactcacactgccaagggtgatcttttattcactctaccaattcaaatgctaaccttttccaagaacaccctcccagacacacccacaaataatgttttaccagtgatctcagcaatccgtagcccactaaagttgacacacaaaattaaccatcacactatggtaccaaaatttgatagaggagagcaatttttaaaaacatcggaaaagcctccttaggaaggcaataatgaaaagaaaagggttgagaaatattgtgataggtgatgaggctgcaattcctgtaacagaaggaacataaggagactggattgtgaggaaatggaggtagtcacagttatttgactgagaagtagactacagagagaattccgatgaagcaaacaaattatgagcacttattatgtgccatgaactgtgtgaaaccctttcacatttgttagcaaagagcttctcctttagtagtaatgtacatattccttgcagaaaaaacagtgacattttccattgagacagtagcgcacctatctctcctctgcttcagcagcctttatgctaattactgttttggaagtaactcctcattcactttttgcaacataagataatgagaaatacagcccagattttgtttgtagaagctcctttcatggcagcctttcaacagtttgggtaatttaaaagatgcagttgtaatcgtgactaactcattaagatgcttgatgagcatcttaatgagttaaaaaacctggacatttttaacgcacttttggaaagaggcaagaaaaatataagagtgggaataatccaaggaaaacatttcaagtctttgaacaatagaccctagaatttccttagcttgagataggttaggacaagaaaacagaatgttgcttaaaagaagcccagtgatcatttgtgtctacttgcacttctggaatatgacttttgtttgttagttggttcattttgacttaaaaagtgtttttcggccaggtgcagtggctcacacctgtaataccagcactttgggaggccgaggtgggcagatcacaaggtcaggagatcgagaccatcctggctaacatggtgaaaccccgcctctattaaaaatacaaaaaattagccaggtgtgttgacgggcgcctgtagtcccagctactcgggaggctgaggcaggagaatggcatgaacctgggaggcggagcttgcagtgagccgagatcgctccactgcactccaacctgggcgacagggggagactctgtctcaaaaaacaacaacaacaacaacaacaaaacccacaacatttttctttgttctctctcagtactcattaagaatttactactgcgtctttagattttatctcaggcagatcaatgctatgtatttgtcccctgtacttgatccctgtgctttccttctctcctactttcctactcttgtcatgagtgctgaggcagggatgatgttggggtggaaagctgaagggcgaagatgaatgagccacagtgtccacttagaatctacagccaactcttggcagcttatccgtggtaattcttgtttcagcttcttgttgactttatcacccactcaatgtgcttaattctatgatggatgttatcaccagctctgtttattcacaatgccaagaacaccagtggaacagggaaatattcaggaaaacccactttatggtgtcaacttgaccagaaaacgaaacacaactccatcattgctttattgaatttggcatcgttctagaaataaactatcatttatattttgtcaaacaaaaagaagaggagaagagatttcaaaagcactgcttctggggagggtctggatcaaaggtaaatgtgtgactttaggtgacagaaaagcatctccactcagatgcatccaactttgagggggcactgactacaggacagtagagacaagggacactcatgaacaagcagcttttccaattctgggtccttttcaaactgtagtatcaacatatatttttaagtttcataaattcttggaacattaaacatatccattcaaacagttctttcaatatggtggatatttgtaggctgccctggaaatcagaacaccttgaatttaattcctgctatgacactggctgactctgtaactttcaccttttttagttctccaagatgatataaataatggaaaacatataggactctaaaatggttgcaacataggttcaaatctgacccctaccacttgttagcttgtcaacattggataagttatttgacttctttgagcatcagtatctttatttgttaaatggagataaagatatctttcttgcaggaatgttgtatggatctaatgagatcatgtatgcaaaacacccaacacatagttgtcactttataaatggctgttctagtagccatttgcacagagatggggaaaggctaggtgacaaaaggcatgggcattctgagctcatcagttgatagggcttccttaatgccatagctttattagagaaggaggaggatacagcccagccacataggaactcaggcctcttttatttctgcaggatctggtcaccacaacaatcagaatgtgcaggggtaagactaaggaagagagagagaggaagaatggatggtgggggggggggcggctctcttcttcctagcggcagagaatcccgcagtattccttcagttgcagaaactaaatggaaggcaaatggctgtctgcttgtggtgcatgcaccaagacaaactactaaagtgtttcctgcccagtccccacaggtgttgcttctcagctttggataagtcctccagcaagtactttgttgaaagcgagaaaggcagctgcataactctccagtccacagagctgacaaatcactgtgtcatcaaagaagagggaatcatgggaaatagcctgtggttcaccctctaaggcagggagtcaggaggctgtgaggtggcacatttgattcttgctcattaacatagtttctctttgtgtcctcctcctcctctttgcctgcttgcctgttccactgggtaagcagcaagtgcctactcaaatcattatttatcaaatgtgtactatgttcccaacattcattcaatacacctatattgaaagccttttatgagaataacaaaaataacaagatagattcagagtaagattcagagactgaagcaagtccgcatatagtaatcacatgttcaactagttgttaagtggtatatataatacatagaaaccaaccgtggaggacctcagggaaaggagccaggaagctgaggaaggctttggagagaagatgacattggagctaggccttcacccaaaattccataggtgttggtccattttgcattgctataaaggaatacctgagactgggtaatttaaggggaaaaggggtttattttggccaggactggtggctcacatctattatcccagaactttgggaggctgaagcgggtggatcacttgaggtcaggagtttgagaccagcctccccaacatggcaagagcctgtctctactaaacatagaaaaattagctgggtgtggtggcacaagcctgtaatcccacttacccaggaggctgagggatgagaattgtttgaacctgggaggcagaggttgcagtgagcggagcttgcaccagggcactccagactgggaaacagagcaagaatttgtcacgaaaaaaaagaaaaaaagaaaaaaagaggtatgtttggctcacagttctgcaggctgtaggtgaagcagagtgctggcatctgcttctggtgagggccttgggaagcttacattcatgctggaaggcaaaggggagccagtgtgtcatatggcaagagagggagcaagagggggggggtgtcaggctccttgtaaacaaccaggtctactgtgaactaaaagagtgagaacttgcttatcaccaaggggatggcgctaagccatccatgagggatctgccctcaagatccaacacctcccattgggccccacctccaacattggggatcacatttcaacatgagatttggaggggacacacatccaaaccatatatcactatgggtcaactatatcactatggatccaggggaggatgggataggggaggggaggcagcaagggcattataggcaaagggaagtgcacatatgaaggtgaagaggacatgagcccacagcatgtctggggactggctggtagcttgatgtgcctggaacaaaggctatgcaatcctgggcagcagcagggggagaggtaaatgtggtcggaatgccaacgattttccatgccagtctgtccagtttgggctttaactgtagagaatggggagccattggtgagttttaagtatgaagtgatgggtttatacttgtattttggacaatcctgtgggcttcagagtactgaatggactaaaagagaggctaaaagctgggagacagttaagagctcactgaaattgccaatgatgtcaaatgctgcaaactcatcaaggaaaatgaagactgagaatgagttcattgcatttgacagttggagatctttggtgacatctaaaagtaatttcactataacgactgaagcagaagctggattactaagccagtagttctcaaagtgtggtccctagatcagcagcactggcatcacttgagaatgttataaatgtaatttatctggctcaacccacacccctttcaaaactttgggaatgaagcctagcaattggcatttttacaagtcttctggatgattctgataaatgctaaagtttgagaacaactagcctaaatgactcttcatctcttccccagacgttccttactctgatgacacctgaattatttgatatttcctaagtaatcattaatatggtttctcagttatctgcataaattgttcctgtcagtcatgtgcaatatatgtacagtctctgcctgataatattgaactcattgttcaaggcctaactcaaatgtcacctccctaggaagtctctccaatttcctccaggcagccccccatggatacttgtgcacatatttatgtcataaaatgtatattatttgttgtgttgatttggtttactatcttccctactaactagaagctcttcgggagtagggactgctttatcgatctctatttccatattgtttttacatcttaagtgctcaataaatgtaagaagaggaagctgtaataaattgcagaaataaaaacagaaagggacaaaccactgttttaagaggtttggaagtgaaagatgaatttgaaatagaaatacaatagaaaatgtgtgtgtgtgtgtgtgtgtgtgtgtgtgtgtgtgtgtgtgtgtgtctggaagaaaactgttggctgagggattaagccagtagagagggaaagatgaatgatgagacagtgggaatcagtgggtattgaatgcaaaatggtcctggagaaggcagaagggaattaaatcaatggccaatgctgaagaattagcattgaaagaaggaaagactctttttttctgagatacaacacaaggaagtaaaggtgggtacataagtgatgagttgtgaggttgagatgggagatggtagggagtccttagatggcctgtcagtgtagaaatggtgagggctagggaaggttttgcaggggaggtgatatttgaactaggagatgtctttagtgaagtaggaagtgaagccttttgctgggaagaaaatggggaacagaaagaaggaaagaggctacagcagagaggtgaagacttgtaaatgctagggaggggattggagaacaacagcaggggattcttttgggctgatccatctccctgattcaagacaaagaaagagtccacttattcatccaattgtgattggcaataaaagaagtatggagggattgtccccaaaggctgtctttgaaataagatggacaacttctggatacagatcccaatactaatatagaaagtattctagctctatatattaattaaggctggaatattttgcagacaataacaatgctatgtatggcaactatgtacaacaaaggaaaatatttatggtatatgaattgcctaagaaatctggataaaaactatatgtatgtcggccaggtatggtggctcacgcctgtaatcccagcactttgggaggccaaggcaggtggatcacctaaggtcaggagttcgagaccagcctggtcaacatggtgaaaccctgtctctagtaaaaatacaaaaattagccaggcatagtcacgtgcgcctgtaatcccagctactagggaggctgaggcaggagagtcacttgaacctgggaggtgggggttgcagtgagccgagatcgcaccactgcactccagcctgggcgacagagcaagactccatcttaaaaaaaacaaaacaaaacaaaactatatgtatgtcttgattacaactctgtaagaacatacatatgaagaacaaatgaataaaacacatgaaaatgctattagtggtggtattataggtcatttttcctttaaattttaaattgatgttttaatgtttataattagttggcaataaatagaattttttttccttgctggctttaaaaaatttactaggaacacttagaagagagtatttcaaaataaaaagttgtaaggtgaaaacaatcagtagaattgtatgaacacctcccatataagggacagatgccaggaaaagaagtccttaagttgagccagagttggaagctgacaagcaagaggttggatgccacgatatagaagagcacaaaagaggtatatgacctagcccttgactcacagtaaacttgagagactaggcttacaataaatgattcgaggataacttattcagttatctaaacaacggatgggactggatcactgaggcagtgacctgtgggcaggcgggacaatgcagaggtcaattatgtgccatcggagttgatcagatggacctgggcttaaatccctgtgccactgcttagcagctgtgtgatctaagacaacttactcaggtttcattttctgcactgtgaagtagaaataataataccttctcataagctgttgaagcattacaaacaataaagcaggtaaaatgcttaatacaatgtttgacacacaaaattgccattatcgttattaacgctttattgttgtgtcatctatgagtatttatgatggaggaaactgatttagactaggggcacattgaattctttggagggacttcagggaggtatcttaagagccgtgagagagtctcaggaggcagtgaagactccctcactgctggaacaatgctgtgggctcaccctaggccttcaggaggggagagagatgtgcaaggaggaactccatggtggttcttcttttgctagtgtttgtgctacttccccacttctaaacaggtgcatagtactccatagcaccctttcatcttcctttcccactcttctgttctgtttttcttctcttcaactcttcttacttcccttttctcctcaaaaccaagtggtggatgggtaaggaactatactatcttttgtgtgttctaactttgccgtttttttttttttgttgttgttgttattgtttgttttaatttttgttttttcttgagacagtgtctcactctgtcacccagactggagtgcagtggtgtgatcacagctcactgtaacctcaacctctggggctcaagtgatcctctcacctcagcctcctgagtagctgggaccacaggcacaagacacatgctaggctaatttttaaatttttcatagagatggtgtctcgctaggttgcccaggctggtctcgaacttttcgcctcttgtctcagcctccaaagtgctgggattacagggtgagccactgcacgtagctcggatataattgttgagtagctgaataggagacctaagtcagccttgaaaatcacctgttcctgcttattttcagggatctctttcctatttgccaataaacacattttagtggactaatcatgaatcgttttatggttggcctcacatttaaaatgttggtggtgctcctcctgccctccaaagccctttatggagcacattaacagagccctgccagcgttacaagctgggccccacctgaggttgtctccattgccccctccacccactttactggccacagaatgtttgtgctttggtgttttcatcagttgagttccttttgctcaccaaagaaacaccacaaaagacacttttgccagaaaacctttctcctcccttgcttcaaatacatcactttacaaagagtgttttaattaaaacagcttataaaagtttatgctttggatttttttcctcccagggaaacagtattcaggctgcatagagtcattctacttggtgggatgactgtcctaaagatgtcctttccctaagcccaatttccccaccagagagaagagcctgccagggttgttagggccgagaagatggtctcagatgcagcagcgtgctgggcccattgcagagtgctcagttcatcttctgggtagtctgtgtctggtttcatgccaggagggagagctaaagggaagctacagaagcatccacggttggcaggactgttggacatttgcggcttcagcagggtcaccctgtttggttgagcaggttgtttctgtacaaggcagcgagcatccagggtctgagtcagggactgagatccagactgtgccaggcttgacctatgcctgccatggggctgggtattagtttcctgtggctactgtgatgaactgtcaccagctgggtgccttaaaacaacacatttcttctctcacagttttggaggccagaagtctgaaatcaaggtgtcatctgggttctggaggctcagagggagaatctgttcttagcttctggcggctaccagaaatctttttttttttttttttttttaatcttaaaggttgtcttctaacttcagcactcagagtttacataagtaagcctgggtttaccctacccactttttcccttatttttaaaatatctatttccccaaccattgtctttagtaagtactctaaaatgacagtcatcagcagaaacgcaaggattccaggccataagagtttgatcaagaaaggattttttgaggtagctatatcttgcaaaagaaacagaggtgtgaactgtctgcagggctcttctcggcaatgaggtgttccttctggattcagatatagatcttaatggggtaaacattctaggtcttaccaccatctgttcttctttttctgcttagactgttagtacctgttataagaggaaaggaggcaaaagtgtgaaagaaaaatggttggatcagtggtctgagaaagaggataaagtagtcatgtgacattattcttaacagagattagaatgattaaaaacaaaaacaagttggtatccaggatattcaggtacaaccaccccttacctgctgattccaatttcacattccattccacattgatgaataataataatgatgtacttttagctttgtcagaaatcctatctgcatatttataaggtcattatgtttagttgttgctgatacctggtctgagtccagcaattaccacctctgtctctttgcacacactggtagacatacacaccactgatttgtactttcctataaaattactcttcccctttttaattagagtgttttcagaagcaaaccctatcgttaaggccatgtatgcttccattataaatacctgtttccagccattaattatctcccaatgaattacttacttagaaggagatttttaatgcattttttttttttttttttttttggagacagggtctcactttgtcacccagactggagtggtggagtggtgtgatcacggcttactgcagtcttgacttctcaggcacaggtgattcttccacctcagactcctgagtggctgggaccataggcgtgcaccaccatgcccagctaatttttgtattttttgtagagttagggtttcaacatgttgcccaggctggtcttgaactcctagcctcaagcgatcctcccgtcttggcctcccaaagtgctgggattacaggtgtgagtcattgtgcctggcctgtgcacactttttataatgggatttctcttccttacttttgatgtcccctctctcatacttagttaaccattttgaattccacttagtaagaaaagtttccattttctttttcttcgggggacttagatatgatctgcacctagatggtaagaagattttccatattttgaagtagaaactttctgtatgcctgaatcttgctgtcaagaatgtcttggctaattatgaaggaagaatataagaatgtgagtaaaaacaattcaacagtccctgagaacaacgtcaataaatattcaaaattgcataaccattttagtgactaaagcactgagactcatccaataatactgtggtttgataattacacagttgtgaatttatgatactgttaaattggggagacatcttggtgcatacaggtcaaccttttcatacatcattatatacaaaaagtacacacctacttaggaattgaagtgtaatacctcctagcataaaatgcttaaaagaagattttaagggagtgatacagtgagcattcctatatgaattttcctgcttatctcaagcatagcagaagatgtgaaatttctaggtaagtttttttttttttttttgacagggtcttgctctgtcacccgagctgaaatgcagcagtggtaacatggttcactgcagcctcaacctcctgggatcaagtggtcctcccacctcagcctcccgagtagctgggactagagacatgcatcaccatgcccagttagttttttaattttttgtagagacagggtctcactttgtggcccagcctggtcttgaactcctgggctcaagccatccttctgccttggactcccaaagtgttgggattacaggtgtgggccactgtgtccttccttaacataataaaattgagataatcacattcataaaagggcaaaactatgtcaacaagcccactgtattagtctgtcttcacagtgctgtaaagaactgcccaagactgggtaatttataaaggaaacaggttaactgactcacagtttagcatggctgggaaggcctcaggaaatttaacaatcatggcagaaggcaaaggggaagcaaggtaccttcttcataaggcagcatgaaggaaaattaatgcaggaggaactaccaaacacataaaaccatcagatctcgtgaactcgctcattatcaggagaacagcatgggagaaaccgcccccatgattcaattacctccacctggtctctcccttgacacatggggattacaattcaaaataagatattgggtggggacacaggcaaactatatcgcccatattacaattacttacattactgattcccttaattagagcagaggtaattaattgggtctaggctcagtggaagggtctggctggttcttaattctcagagctagtttgaatcttgaggttaacgtcttgccttctagaacttgtcctgtgtttggctgaactctgtgaacctttcagaaagtaggtctttattgagcacatactctatgcaaggcaaagaaccaactactgtggagtttacaaacatgaataaggggtaagaaatgactcttgtcacatggtttacagtccagctgtgtgggccaccacagttcatatctttcaggctggggactggatgagaggaaagtggactcaaaattaatcccagtgctctctactttcccatatccctgtgctttatctctgttgtagttatgttatttgtatgttggcctgcctcactgctctgtgatctccaaagaacagggactaggttttatttatttctgcattgccgcagagcctagtatgtgctttatagagaacaggctctcaaaaaaattttaaattaaaagaatgtattcacttgtttatgtttcctagttacagtgggccagcttgttctgtgctaatatggaagtgacaagaaactggtgtccctctacgcagaggtccccacactaaatatcatcttggatgtgcttcacattgttgcacaaaggtacagtggagtgagactgagtaagaggacagaaatagtggggggtttgtctcagctcactaattacttatttaaccttgggcaagatacttaaagctctatctcagtttcttcatctgcaaaatggggataataatgactggggtgcctatttcccacgattgttttgaggatcaaatgagataatataattaaaagtgtttttggaaggtctaaatcactgtgcaactgcaaggcattattaaaagaaatcttccttttaattcctgcttccacaaacatctcatcacatatccttgggtccctgggttacatggagagattcgtggtgtagctcaatctatgtgtcatagctatcccacaatctcttcttcaacttctccaacacaccaagacattcttccagtcttgcactgctccccagtttatatagatatatatgttcctcattcagcatttatgtaaaacatatattattgagcacttatgtgatagaaaccggggcaaaacagaaaataaaacagagttttattttgagagttttttacagcttgtcggctctgagaggacagacatgagaacaaataagtgcccaattctgcatttattttggaaggcagttttatgtgagtttaaatcagtaaagacatagatgtatatttttagttttgattaaaactaaaacaattggtagcccttactcatatttttctatcattaaaacttatctttaaaaaatgtcttcagtcatatttttcccttacttccattcatatttactctttacttctcttgtccttaccagaatgtatgcagtaagttttcatattgtaacacattcaacaaaagttatatgtgaacataatagctgctttctttaaaacggttactttgagaaactgcatacctatttttttttttttttttttgagacggagtttcactcttgttgtccaggctggagtacagtggcacgatcttggctcactgcaatctctgcctcctgggttcaagtgattctactgcctcagtctcctgagtagctgggattacaggtgctcgccaccatgcccggctaatttttggtatttttagtagagacgggttttcaacatgttggccaggctggtctcgaactcctgacctcaggtgatctgcccacctcagcttcccaaagtgctgggattatgacataagccgccacgcctggcctgcacatttattttaataatgttgtcatagctacagtcgcttctagagttgctctttggggataactatcttatattcttctgaatatattttaatagtgacaaaacttatctttgcaggtgatttttaaaatttgtatgcagccaagtcactatgaattatctttagtgagtaaagaggaagatcgaactggtaacactgtgggtaaacaactgaaaaataatgttatctttctctgaacatacttgcacaagacaaattccaaaaatattttgactacgttatttttgaaaagggtttccagtatttcaatgtgactactttcactaatgatacttgcttacctaaagtgcttgttaacatgcagttttggaacttcataggtctatgcccatactgacttgtacttgcttagtgttgttttacattctagttcaacatctattatgtgatagacactggggattaataggctgtggtctttgcccatgaggacctcaaaacttagttgagaacacagaaatacaaagagtcctgtgtgaaaaataagtatcggtgttaagataaagaagcggcagtggaagacagtggagggactgtctgttagagggaggaatttattgtggtgtcggcaaagccttctttggactgaaggatgaattatgattagaagttcattaagaggaggagggaaggggactacaggagtcattccaagccaaaggaacaaaagatacagggacagaaacagcaagatatgtttgggggaatctcaagtaatactgttattgtgtgaagttcacaacaggggcagggaggacaggagatggggcccaatgacgaaaaggccttgtatgtaccatgtttagaagtttgaattttatcctataggagtcagggagaggttctatgggtaggatttctcatcccaacaggattgtaaactcccacatccaattagtcacacctccattttttttttctgtttctttaacattgtctcagattcattccttctgaaatctaccttattagttcaggtcttcttaaatttgtgcctggactgttcaccaactcttgactggtcctggggctccagttcacctcttgctcccaacaatcaattttctacagaattatcagagcaatcttcctttccatcaatctcaactctgttcaaaaactttcaatagttttatgtgacctaagaggtagctgcctccccaccctttcagcttgccattcaaggctgcataatttggtcccaaccccctttccgtccttgactcctctcactgctaacagagacagaactcatttacttactcttctgactgtacctttgctttcacgagggctctttcctggaatgatatgtccatacaactattgttgttgttcttacttttagctcttttcttagcccacttgtacccaggtttgatcacaccccctactctcctgccctggaagtaactactattctggttatagtctcttaatatctatatctatatatatgcatccacagataatgtgtagtattgtcttgaaaaaaatatacataaatggtatactttgtctccctctgcgattattttcactgtcatttagtttttaagatttatccctattgacataaatagctatagtcttttcaattactgtgttgcatttcattttataaatataccatacattattcatccattcctctaagggtgggcatttatgttgttttcaaggttttgctattacagtgttacaacgaatatccttagcttagctggtctccttgtcttatacaaattttactgacctttcaagatcctgctttcatcccagctcctctgggaaagccttccctgaatcccccagcccacagcggcaaagtcttggtactcaaagttgcttgtgcatctttggtatcatcccactgccaagcacacagctacgcaaagtaaggcacttaagaaatattcgctacacggatgaacaaatgaatgaatgaatggggcagcaccactccgtgatggctctattcctttttaatggactttggcgccttggcccactttccttctttgacagcactggtcctactccagagcattcctctagctagcaaagcagtgtgtggatgtgtgggtgtaggtggcgatacagacctcactggatgaggaccgcctctccctgcaagttcacgatcccggcaaactccagtgcttgaagttcagagtcctaccccacccccctcacccccacgccccttctgcactggtcaagccagcgagccgctgcagccctgatcgagttaaggcgcggcggcccccggggccgctggagaaggatgcggacggggccagtgactcgtagtagatccctccgcgcggagctcgggccggcgcttcttcctgcgggaaacccctgggtgcccaaggcggcggggccgaggccgcggcgacagtggggcggggcttgcggtgggaggaggcggctgaggcggaaggacacacgaggctgcttcgctgcacacccgagaaagtttcagccaaacttcgggcggcggctgaggcggcggccgaggagcggcggactcggggcgcggggagtcgaggcatttgcgctgggcttcggagcgtagcgccagggcctgagcctttgaagcaggaggaggggaggagagagtggggctcctctatcgggaccccctccccatgtggatctgcccaggcggcggcggcggcggcggcggaggaggcgaccgagaagatacccgccctgcgccccgctctgctgtgggcgctgctggcgctctggctgtgctgcgcgacccccgcgcatggtgagtatcgggctgaggggcgctgtccgcggcgcccggggctgccacctggggcgacccttctccccctcggtccttctctgtgtgggaaggccaggctcggccgccggcgcggagcgaggccactcgctgggttcccgagagtttggacatcgccgggggcccctcccgtggtgccccgccaaccgccggggttccccgccaaccgccggggttccccgccaaccgccggggttccccgccgcctctgctccccgcggcccgggacccctcacacgcctcctcggcaggagggaggccggcagcaagtctcagaaactcctttttcgtagtgccagggtgcagggaggtgggcagttttgcccttcaggttccgcgtttcctggggtcgagcgagagccgacggcgggcctcggaggggctgagcgaaggaatgccagattctggcgtggagagcgggggcagggccgccaagccaaacggcctgcaccttcgcagccagcctcgcctttgccagggggcggcacatgggccgggtgtgtgggcttggtttggatggggacggggttttgcggcgcgcctgagttttgacactccaaccccaccgaaagtccggaggagccgggtgtgctgctcgcgtctttgaaaggtggaggcaggagaagtagggcaactggtgtggctgcatgctgaggcacatgatttaaaaatctcaactgctgttattctttctgaggcgcggagctctgctgctgtttcaggctgtgtccagacccaggaatgtggtgtgacgatcaccaattcctccaacctggcagcagcatttgctgctcctttggcatggctgggggtggggcacgggcgggtgagaaaaagtggatacgtcaattcaaagggcttccttagaaagcttctttgtggttggatgtttctaacacggttggaccaaggaaagggaatcaaatcatatcttccccatcccacccacacttttagattctacatttcttcagaccctttagtggaaataacttgggctttggagccctgctctgtaatcctggattcaaatccagctctgctatatgaactcaccaataaaatgggaatgaaattatccagctaataggattaattaaaataatgtatattaaacggatgacactccaaaggtgttcagaaagtcctttgagggccgaggctgtgttttactgcttctgagattgatgctcccagtgggatggtgtcttgtgcatatttgttgaacggaaagcagccccttctttttctgagcctaatctgaataaagatttttaccttcaccaaaaaactagtacatgaactacatctgttttcaaagaaaaggttaggaagatgatgagcttcagaaaaatatggtctttgttcattgttaacagtcagtcgacatgtcaatcgcagatgtttaaaaagagaacaaggttatttatcacccgaaaatagtactgggttgttcagcaccaactagatacttcttggaaagttcaaatttcgtacacgtctaggtcactaagaatttcagaagtggaccaggaggctttgtagtgatgaagcagagctgttgtttctgaagcatttaataaagagcatatatgatggtgtttttgcttttcctttttctttgagtgaaagctttaagtgtagctttaggatagagaggagtataatcaatgagacagtctgagggtaataatccttggtctatcattaacttgttttggtaaataacttaatcttcatgatatgtagtctcctcacctatgaagcaggactaaaggaataacctgctttagagaattgtagggaataataaatatgattgtaaagtgatttgaaaaattaagtattaaataatatgtcagaaatgggattactctgacacatagggcttcttttattataggatctcagtgcgtaaaactatgccctccacctctgctctgctgaggtgctgcgattattagctagcttttaggtagtcaagttgagtgttagtcaagttgactcaaaggataggatttagatattttgatttttagacaggtgttctttagatgctaaactaatgcagtagaagagatttagaagcctgtttcttggtacaaatcttaaatcttcttagagtctacagtgaaggcttcttgaatcctcctaatttattattgtgttttgctaaggtaccaattacagcacacccttctaaacttttgagtgttcctgtgtttggcttgtggccaattgttaatttaaacatcacggagtttctaaggcaaggagatgttagcagtatgtctgattgtctaaacagctatccaggaccatactcttgctccttgttttcttttgctttgcaatgggaagtgactccctgattttgctgcctgctagataatttctcagctgaattcttctcttgcttaaacaaaatcggagtaattttctttcagatggtgatgaaatttaacctaaaactatttttcctttcactttcttattattcctttttttttggtgtggtggagaggaggaggagagtgattcctagtctctcttatttttctgaatgtttagatttaaaaaatatttacccataacttcttgggatctctctgctccattcccaccctactgcctctcctgtaggcttctatgacatagagaagcaacttttggttcacctggattgtagttgctgacttcaggacctttagagaatgtttaaattcagtgggatatgcttggatggttcagagcagccttacaatacattttaaaaatatcacacccacagaaattctattttgcccacaaaatttgcattgatctagttcccactctgtgttgccattcctagtgatcctcctccctacctctcccattatggtagaaaaaaactctgtgtcctggctacatcaaaatctgttggggtggatcttggactcagcacccagggattctgataaggtaagtttgagaatccatattttttcaaggtttacaggtgattctgacaagtaacttggttgcaacccactgattaagtacattttttttttaccttcaggtgtgtgtatgaggtctttctaaatttaagaaatttccataacaaatgtaaccttagtcattccagtgtttaacacttctgactcaagaattttaaaattgctaacgtaagagatatagaatataatgtcatttcttctgtttatctgggtgcagtatgtctgcattgaccctttagaagggcttcatatatttagatgatataataaattctctacctctccttttcccttttcttctgttatctctttttccttaaatgtcattcatacatgttgttttttgaccctttatctatatacgtctgcaatgattttagagtaaaaaactgcaaggcgtgatttgaataaggatataagaaattttacatcattttctttatattgtgttcacagtccatagttacatgcttcctttcttgatgtctcagttcgaatgcctaaatttgaactattaattttccttccaccctttcctgattttcctgtttttgtttccccccctttctctgcaaatgacttgaaaccaaaaggtcttcttttctttctttgtcagtctaccatatgtgtagtattttggacagatcactgaactaggagccagaagaccagaattcttctccaggtctgttattaattggtttggtgaccttgtaggagagccactgttttggtcctccattttctgatgttcattgttcatggtcacagagccaattagagttgagactagaattcctttcttctggtgtccagtgcctcattcactgtccacattgcttccatctcgtgtacaaatgcgcttatgtgcacaaaaactcttataacatcctcaagtgcttattgttaatgcgtacatgaggaaggaatcgtgtattttcatttatgtgtttattctaatgcccataccctacccctgtacctggcatgatgccttggtatctaataggcacacaataaatacttgttcagtcgaacaattatttttagccactttcttattttggacaactgtggtactcctagacattttaaaaatagtatttgcaggagtcatgcttaccttacatttggggaaaaaccaaatttttcccttccccagatgtttcatttaaacttgtaattttgaatttctttgtgtgtggggtttctttctttctttttctgatcacttctgcaatttataaaggtcactttgactttggaatctcacttcaaaggcactgccatccaccccctgcctctcattcaagtttgcttccactgcttcctgtattactgtattactaggccagcaatttctgttattttgtccagaatagccacaccttattgtaatttcatcattttggggactagtcatttttggaatactatttttaaaattagagttaactaagtttatatttattttgataattttttttgagatttttttcattgagttggatattgcaaacttgtactggattgagagaatatgtacatttagtaaagtatatttgctttttttttttttgaaccaagagagtcccctgaacaccctactgacaaaaactaagggtgaaatatgatgaataaatatttgagagaatcacatggtgttgagttgtctctgccacatgattttgatccttgagggccaggtctgtgctacacacatttcttctctgtactacagaacttgtctggcatgtgccccaaattcagagtcaactgagcggcaggtcttagtcacagcatctgtgactcctgctttcccacctttagaacattctataggagaggctgatggtgagttggagtgtgtttctatgttcttttttcctttgaagagataggatcagttgaaagctgaccccacccacagactttttttgctatctcttttaattaattaaggagtggctgaaattttcctctttgttgacttatgcattggtgggaactttaaaattcatctagtctttctgtccatcccatgctggatctgatgtttacaacattctagtcaagaggtaccatattttctctcttcttgaacatctcttgtggtagacagctctccacagcagtttattccatctttggccagctctaattcttagaaagatcttcttatattcagctgtaatccatctcctcatgacttgtcctcattgacatctactcagaaatttgtctcagagtcctgagacctgtgcaggtgatagggacccaaagagatgcttgtctgtagactttactgagctgacacccagctctccataaaaggagtcaaacccagtgaggagcatgtctggggtgattgctcaggtaaagcatcttagccctacttgtttcatacctccctgcacaggtgggcactggtgggagaataacatttatcaagcagtgtttccctaacctctcttatgataagaatagctcaggtgttctcatggagattctgattcagtgcatctggaatgtcatctgggaatttgtgtgttcaagaaatagccaggtgattcttacattaggaaagttttagaatcactgcagagtgaatctgggaaatcaaagtgtttgtttttgtttgtttgttttttgagagtattagagacaggttgctttggctagatcctgtggtcatttttcccccttggaaatgcctcctacttgctggcctcacttagtacagagaagaaagctgctatggtataaggttagtaaagttgtttgttttgtcttaaaagaaatttgcgaaatccagcattttcggacttctgtttgtgttgtatgactttgttgtaagcctccttattcctccattagaatgttacctgagatgttagaatgcataggagttccacagcctttttggtgtccactaaagaattctgtcctcagccgttgcaaatggtgcttcctttgaggatttctgcttcgttagctcatgaacacatatttggtgtcggcagtttccctcagatgtgttagtgtggagagatataaaggtcactcatttctggtggtcctgcttttggggtttctgggctgctgcagcaaatgaaataaggaaaggaaaataaaggaggaatctagggcttcttgagcagaacaaaacaatctgcaagaaggggcacaggattgctcctctcacaaagacacttgataatactgtccttgataggaagaaggaagtggcttcagatctgaaaggatatgctcataggcttgagacgggacaaactgcatcactggtagtggtaggaggtttgccgtagatctgttttttctcctgtctctcttttttgaggagaatattatctgtatggcagaacatacattgtggtcttaaaaaggagagtaaagccaagaaagggggatgataaagccatagcttggaataagaaaagcaaaggaattattgtattaatttgtgtatgtaaatacataggtttccatgtaattcactggtaggatcactagcccttggcactaacatttgctatctttgtagctctgctgtcttagtggtgtattgggggagcattgtggtgtgttgtcacacttaatttgtgtgcttcccttggcatcatgtggtagcaagtacagggtattctactcttctagatgtgtgggaatcattgaccaagtagaaaatatggtcctgctcccaaggagctgacatcatcatggagacaagacagataagcacacaattaggaatatgaaatacagttattttatcatttatctatgctctctgaaagcagtttcctgcagtcagggtgactcagagctatagggtcttgggagtaaacttcaggtcttaataccaccagggaaaggcgacctccagctcacccttgctgggcttgtctgctgtcgtgagctgtctgccattttcctctttctgtgttgtaatttagaagtattagaacttggcttggggaaaagacaaaaacccctttgtctggtgagggtgtaaatataaatttggcacatgttgtggtgtctattatgtctgttagtgggtttgcggcaagagagagtgctgtgttcttagtcccgaatgccaagcctgaactaggacaagttatggtggaaatatcttccttggaagatgcagttctcagtggcagtggctgaaggaacttctcgtcacagccaggcagtgactgaagtgtggtgtggacacacccagagttgctgcctcaggtggcattgattaatcatactaatatctccctcacccttttgtacttgtcttggcaaaaccctgttctactagctccccaatagtttggcctttactaggtatgattgaacaagctcttgggggttcaccttagtgtcccttgcccctctcgcatttccagccagctacgtcgctccagccatggtaccccgggtcctctggccaggcagtgaggggctgggtttttcttcccattggactgaagcacctttccctggaggcttgcctagggcagtttctggtctctgagtcagttccttctgcaggatactggcagctggcagaactctgggttatttgaatacatcagccaaacatcttgccaagatggactcattgttgcataacgacaggttggatctatgggtgttgcagaacctgtttctgggttaagagtaactctctcacctttattatatatgtttattcatatgatgaatgtatgtgtgtattttgtgaagtaaggaaaacatgatgataatattgtggttggagttagataccttatcctaaatatgttgtctttttaacaaatagcattcctttaaaatacagttgtgcttgatgaataaggtgttgtacaagaagctgtggttacattctaaaataaactgccttgttctgaggcaggcacgttttaaaattgttgtttgcttctttttcatctctttttattttcatctttttttgtgtgagaagattctggaagtttttaagcctcaaatattttcaataatctattttaacgggtacctagcagggagaggttgttctattggtatacctaaccaacattcaaataagaataattgaatactgtttactcactaatctattctgttgagtttctaagtatgaataatcacaaaactagatagtgctgatatattaacttctctaaatggtaaatgtggtaagtagcaaagacatttttgtttaattctctccttacacatgctttggttcagacgctgtcaagacacattgaagtttgaggacatgtgtatttcgattattttattatatttttatttgctgtgaatatgggtttatttatttgctagatcttctttagttagaaacattaagggcatttactttattacaacatttaaagtgcattctaatcttcatgaggaattttaggtaaaagaccgtatcctgagattcatgcaagtctttggcattatgttactatttaaagtaagtaatatgtagtggcttctctgacatattctttctaagagagttaaggaaaatagttgtaactaaaagcaaacattgaaacagtttaaggtaggtttacgtagcaacagaattattcgttatgtttacagataattaactcatatttatactttgctgattttctctggcacctttacaagatttttttatttttgtaatataaaaagtaattatgtttgaaaaagtagttaaggatgtttgaagaatctagaaaagcataaataaaatgtccacaatcatgctgccattaattttttggtatacgtctttggtttttttacccttagatttagaaaagctgttgatttatttatatatatatatatatatatattttttttttagtttatgaacagatctacatatatatatatgcacacacacataatatactattgtcaacactaggttttatttttaaaaatctttaccatttgataagtggtaaatattacttaatcttaatatgcctctctcattacagtgatattgaatgttttttcatatcatcagtggcgtttgtattgccttttttcctacttcttttgtaaattgtgtcttttactcatttaattattttcttactggtttgaaaaagctctttaaatattaagggtgttagtcttttgtcttaaatatgtcacaatatgtatggaaataattagcagtatataacataacatcaaattgctaccaatgttgatataaaaattgttcatttcataggttaattttttttaatcctttggtttctaatgatattggttaattcatttgttaactgctattttctgtagctacttgaaagttcttatctgactgtatcgtaaatcagcatgctttcagctgtatatgtctaggaaattgacatttactttaatacttaataaaaaaatatgttggagaaaagcagtgtattctggagtcaaatacatgattttgggtgggtgacgtaatcggctactgtcctccttttctagatagccaagatttttgaagcatttaacatccctgaaaggcaggactaatgctatgtctaccatgcactgctaattctgacactttgacctaatggataaatgccagtacagtgggtctagccagttagcttggtcagagaacaagatgactaagattctctccccctttcctcaccaaattgattagttgtaggacagaactgactgaagcaacctgttgttttggcaacccatggacaccacctgtttcttccattcctccgtccagcctctcactgccctagtgcagtgctgtgtgcatagtgggtaggagatcaatgttgttgctaaagaaagtagcaataaagaagagtagattgctttttttccaagcttttgtgtttttaaggcaccccgctggttttgacattcgttgctccagctgaactgctctatgctgaagccctgcaggtctcaagtgtttggttcagagtaatttcaggccatatgaatgctttcttaagtatcattggaatttactgggctggctgtctgccagctattaccatatttagcatgaagagacctggggaatgaggacatttctgatcaaccaaggaaggaaacctatttgaaggattacaatattttctttttttttttttaatggtgtagttcagaaaacgccagttagactgagactcagatttatgtccactggtctttgtttctgtgccccatcccaaaattaatttatgaataggaaaagagatttgatagtgaagttctttctcactctgaagtctaatactgtttctgggaggaagtaagagaattattatgcccacactgtgcactgagaggcttaaccagcaggtgaagctgttgattaaaaacataggttgatgagtattctcatttttctcctttgaagctttcagaaattttctgctttgtcctggtctaaatttattttggcccagcccttgtctccaccctacatttcaaaccagtagccttccctctatggctcaacatttctctgcctcagttttttccattttaaagatgaagatattgtttggaaggaccagtaaatacaattaatataaaaattgcttctgtagaatcaaacaacctccaacatttctgttggaaatttatagtttatagagtattcttacacaatgatctcctttaatcctcacaaacttggtggaaatggagcctcacaggggctaggtgacttgtatacattgtttacccctacataataagtgacagagctggtacttaaacttgtggcttgatttttctttttttttttgagttggagttttgctcttgttgcccaggctggagtgcaatggcgcaatctcggctcaccgcaacctccacctcccgggttcaagtgattctcctgcctcagcctcccgagtagctggaattacaggcatgcaccacaacgcctggctaattttttgtagttttagtagagacggggtttctctatgttgggcaggctggtctcgtactcctgacctcaggtgatccgcccgcctcagcctcccaaagtgctgggattacaggtgagccaccgtgcctggtccttgcagcttgattttttaaacatcagatttttttttcttttttgatttttattattatgtgtctgtcattctgctaggggctttgcaaatattgctttatttaattcatatggctatcctttggagtagacaatatttttctacattataggtaaggaatttggaacttaggttcacagctttggatgttggcctatggttagtgaggggtgtagccagcattcaaacccctgtctggctctagggccgctgcaataaatcatggtgttttatgtacattcatacacttaacactttgcaacaaccctaagagacaggggtaggtatttagggaaactggggcttctaacttgcacaggataatgcaattagtaagtggcttagtcgagattcagagctagatctgtctccataaccctcactcattccaggatactgcagatgcctatttttatgatatgtataagtaaaaattaatttaaaaaactaccttctttgaagggtcagccagttagaactcttttgtatcttctgaataagtaagaagtggatggacattagctgaccgatacattgatggcttttaaccttctatcagttgatttccattaccaggacaagcaaatataatttggagggaaaagaggggagtttccattaaggatgaatctttaagccgaaaagggccacagtgatgaactcttcagaggactgctctcaggagcaatggcccttctcctctgggctctgcttggggcattcctgtttgtatttatggagacatctttttgaaaggcagatgccagctttggtggggagaaggttggaaaacatacaagccttgctctaaatttactagccccgtgtctttgggctagtttctgaagcatggtgtgcctcaattttattattttaaaaataaagatagtagcagtatattttggagttgttatgaagataatatcagttaataaatgttagattcattggacagtaccaggcacatagttaaagtgcagtaaatagtagttattgttggtattggtgttattttatgttgcagtacagactggcttcttggtgcattcacttttctttaatcaaaagtggatgagtgattgggaaccttcatgaggaaataggaacatcatctttgcagcctgtggattgttcactggtttcctgtgatctaataattatttaagggtttcatatttgagtcttttcccttaatgaggtacactttcagtttggggagattttatctataggcataccttattttattttgtgttcccttttattgtgcttcacagattttgttttattttttacaaattgaaagtttgtggcaaccctatgtcgagcaaatgtatcagcaccattttttccaatagcatatactcactatatgtccctgtgtcagtattttttagcaataaagtatttttaaactcaggtatatgcattatgctttagacataatgctgttgcatgcttaatggactagagtatactgtaaacataacttttgtatgcactggggaaccaaaaaatttctgacttgcttcattgtactgtttgctttattgaggtgagctggagctgaagccacaatatcacaaaggtatgcttgtattatgcaagttgcattgataggtgttaaatcattttcccaatttttattaaccacacatttgtgattggatgttatgtttagtaaagatattgtgattttctgaggtacagctttgagaacagtatcaggtctaacactcttgtttccaaatttcctatgatatgacaaacataatcacatgccatccagtgtcaccatgcagagtactaatgtgaagccaaaatacttggtgttttaattagccttaaagcagttaatgaactatctctgttagacattttgaaataataaaaatatcccattgtcttttattacaacctcaggggctcctggagattttgggatcttgtgtggggaaccacccatctaatccatccttgttttaaagagagaaaaccaaagaagcaaagtgactggcccaagtacctagagctgggtcagggttggggccagaatccaatctcttgacttttagtcaagtgatttttccactatgctcagtactcaaattatgtatcaatatgtcggcccttgttttttgaggtctgaaaagggttagtgccagtcaacaacagtagaggagtagaaagggtgttgggatgggagaggtgtggctatatttaaaatttcaatgacagcagtgaaaataatttgcctgtgaacctctgcctgtccctttggacttctttgtagtagttgagacagcccggcaggtctggtgtcattagtgattcagaattggattaacctggactggtggagttactttctcagaaaagggctttatattttaacatttgtttcccttgacagtttgcttcttctcaagttttggcagccttgaacaagtggttgtcaggtttttattttgttttgttttaagaaaaaattccaaattttattttgccgatttagtaagttatcctctacctgccactcccttctgctccctctataattatttctaagactttatttttccattgtgggaacattatggaaggttttcttttacagtctgagatatttataattatgtgtaagcacacagtttatagaatatgtaaatggtccatatgttaacttaaatacccttaaaatattttccaataatttaaatctttccataaaagtagctgaagctgcttataataaaagagaagtatacacgaaggatagcagaatttggatgtagttaatatagataaatatgaatgtcactttggaggaactggaagtatttgcatgaatactgatcaagtcatgcctccttgttaatagagtgaacaaaacagatgaatgtttctgttttcatgaagtttatgtgactatcagtagcttccatattctgagggtttattatgtgacagatgcttggggacaaaatactttacttgtttcctttagtccttaaaatagatgttaggattcttgtttacagaaaagttaaggaatgttcatccagatcacctagccagtcagtggtaaagaacagtcactggaacccctctttcctgatccaaagccaacatacttaaccataataaataatgccattgtctggtggaatcctgtagtcccttagatagtgtaattttgtatttaatgtaaacattttgtgcactaaactgacttacattttactttttaaaacaatattttaattctgaatgaacatttgcataataggagaatgatctaaattgcaaacttccattttgaagagttgtagttcttttaaatctttttgtaactgggaagaagaatggaattatgtttgttgtaatccaaggaaagttggttagcattctttcctgttactttttgatcccaaaagaaattctttagtagattaagaccaggaatgaatgtgtggatttttttaaataaaaaattgagagagattgcaactagcaattcagagccagatttatgttcagaaatgtttgatgccagccgttttagttacaaatagctttttcttgactgtacagttgtgttcttatggtaccattctgaaagtgatgtaagagaccatgtaaaatgattggaatgcctcagcatctgaacaatgcacatagccaattattaaaattacccagtactaacctgtcttggcttaggaactatgaaattaactgtgggtagcatttctacacatatcattacagaacaagcataaagacaagcttgtttttttccttttctttggatttgttttttcttattaccatatcttttgttactgaaaactggtggtcatctgtactaatagataagagaagtgtgtttgacaccaatacctaatcttagattatccctgctattttaaaacacagtccttcgcctgcatgctcagacatgtgggttctttcaaacatactggacttcctccttaggttttagttgtgttagtcaatagttgaatgttgaaggagaggatgccaagggatattaaagaaggtaaaagagataagtgacagcaaacattatttatttttaattatctctcagaatgacttttagatacccttccctactaccttttgatttttgctttagcatagctggtgagttttggaatcagagagactgggctctgatttgtactagctaagaatattagacaagccacttaacttctttaagtctcagtacccgtatttatataatgggaataatagtaatatctaacttgcaggattgtttgtaaagattgaaagcaacatatttaattgtgcttgcgtggttctgggcacagaataggcacccgagtgtaggggcccctgaactttaaagttcattactttcatggtaattcctcctttggaatatatagcctgggaacatttgtctctagaccttgtttcagtttcttttaatgactccctttaggctctgcttcatggccaatgcaagattatggatcacctaaagagtagactaaaagtactattgtctagtaacttcaagtttgtaggttaactcactgtgaatcaaaagcttttaaaaatcttttgtgtggtcatagtttgtagtgtcttgtacctctcatctcagaagcaattgattcatagaaaaaattatttaggatttcagattaaagatgaagaactctttcaataagaaggaactgatttggttggattatttgtttctttcacccctgagttttcatggaaatcaggtttaaaaggttagaagcagttggttttcagcattgggaaagcttatctgatcaggcatgcgaagtggcctatgtcggatttctgagctaggaaaggctaggggaggttgaggagattattgtacttgtaattcctgagcatggttgagacacaaggagaggattgtggaaattgtttttaaaaaattgttgaagttaatgcattcttgggtggatttgcaaaacagaacaaaacaaaaagttgttgaagttagttacactggtctaacaacgtatacttaccacccccatttgggctggaggaatggatctaataataatataggtgtttgtgatctaatttgaatcatgtaatcatttatcatttctgggttagatggtaaggattttctgtttcacagatttttagactgggaattgtgctattataaaataatattttacattaaataatgctatctaggttgtaatcaccttaatagacatgatttatttgggccacaaatgaactctggtaagaatggagggctggttacattattttagttttacagatgaaaataatcagtctcaaatagcttaagggaattcctttagaccatatggttagtatatggaaaagccagagctagaacccaggttctgatttccagagcagttcttatttcatgataccgcataattttataatgtccctaaatccgaatttcatttctcatgatgtgaaaggattctctttatttctgtttggttagctgcatcagagcatgacagaaatggagcagaatttgagtattctttccccagatgggtcagttagcttttcttaaagctattctgtgcttacattgttaatcagttgtccctggttcctagacaggatgttgatacatgtgaaataggcaggaatatgtgtctgactcagcttaactcatcacaactttcatatgtcctgctagtgggtctataacgtcaccctcgtttacaggcgtttttaattttctgatgtctatttcttagtatttttcctcagccatttttaatgtctcaagccatagttcttcctgagtggcctgaagtgattttgctgctctttaaagcttccttaaggtttttcaagagcgtacaacataggctgcttctaagtgtatttttatttcctagctcttagcatttctcaccttatcattataactttaaatttaaacagaatacaaattgtgtacacagatggtgtgtcactattgcactgtcacttatgtaagtgcagtttagcatttcttctttccttttaatcaaaatgaggaaatagaaaatgttttgttatggtagttttacacatacacccacaaggaaatgtgtatctagagtctgtgggaactgtgactgatacatttcagggaataaaatgtatgatggctaaaattttaactctgccaaatgttcacggggaaagaaaaattaacaaactcacattttacactttattttagcctagtctctgccttgtttacatctatatgataatgaagctatacttgtctttccacaacagtgtattttataagttgtaccttttgtttaagggagccttcttaacaaactttctttcagttgtccagtgtacagaagcttactggaaggagtggccaactagttaaaggtttgacacctcaatatcaacaaaatgccaagtggatcattttgactctcacagcaatccaactggacatttgaccatgccccgtggtcagtggagagcttcttctctgaaggccacttttatctagcacatcaaggctatacacctctttcactaagaagaatttgacacttttatgttgtgagagctgagattcaccattctccaccatcctgagaagagctttgatagaagggctactcgtgaggtacatagattatctaaaatacatacaattttttcatagaaaattatatatgtattataatttttattcacgacaggttgaaattaatagatttcttacattcactgcattaaaggaatatttatggctttggtaatattttaaatttcaaattaaaaaatttgaatatctgaattaagtatctctgatttaactctgtgtgtgtgtgcgtgtgtgtgtgtgtgtgtgtgttgggaggaggaatagaccttggaattgttttttcaaaactttttttataatagtgcctaatctcagttggcaaggaatagctgtccagaatgctgcatagatctagtgaaaagatttagggaagttgtaactagtttaataaccatctgtggagtgacatagattgacacacccaattacacaagacctgagtctgagaactgttgatgtgcaatcatcccatcagcatctgctcgtcattatcaacaacaataatggctcaactatttctttgaggccacatgaaaagacagtgtacccatagcaaaggataagtcagacctgaaaaaaacatagccctctgcatccccttgttcccaaacttctttttaaacataaccttttgtgaagttctgaaagaattcattttatgttttctttttattaatttttcttcttaaataccatgtctttctggctgaaatccttgccaaaaccaggaagggccagtgtactgtgggtgatttttctaattcatttctttgtcatttgaagccttctgtggcttcatgctgctttatgtgtgtgtaaatattcagtatcttttctagtttacacttttgtcacaactgctattaagccacctatggacacattctaatataaattattttggccactgtgagtgggagggaaagaatcagttcacagggataaatttgcatgttgagaagataatatataatagtttgcaaaacacttctatgtacattgtatcttttatagagacaaggccatgtttttatttgtggagactgagacagagaccccatgagatctaatgcagagtcacatgactccaaagccaggtcttctatctgctctttggtatataactggatcattattctattgacagaaataaggaatcttcttatttttcaaaggcacccttttgcccttggaaggtatatttagaaatcctttaccagactagaaagaagacagttatattttcctgccttttgataaaaaacagtgtgttttttctaaatcttgttgtgtttgactagagtctgattaaggtaccttttgggaaattaaggttctatagaaattactgggctcaatctagtgatacaaatatgtgttgtttgatttatcaacacattacaaaccttaactttggagttttaatatctggttatctttaatatctggttatcttctttctgaagtgtatgtacacaaaattgatgctaaataaggtcttgttgttttggcaaatagtgaaatgcaaggtattggtagatcagtactgttataactttggtgcaaagttgctgcatgcagattggctgtgggaccttgttcattttttgagaactaatgtagagtttgaaaaaacaccgtaagcctgcattccagaagttctggtatggatagtgtgagcccagggaatgtgcttagataaaagatcatttaacaaataggttttgcatttttttagcaatcaggctttgtgctgaatattagagtggttgtttcagagagtttgcagcaattaggctttattggtgcactaaggagaagcagagaggagaagcaattcttggtaacttccttggaagttgcagctaactctgaaaagtctgggttgaactaggtaagtaactaattcctagaatcaataaactttgcaggagtccgtttgattgtacatgtagctccctggaattgctattggtccctaaatcatcagtttgtaatgctggttttcaaacttgagtgcacatcaagttttggaggacttgttagaatacagattgctgggctcacccccagagtttctgatctggtaggtctggagcgggacctggtagattgcatttctaaaaagcatccaggtaatactgctgctgtttgggaaagtacactttgagagtcactggcttacagcaatctcaaggtgtttggatttttgggcaggggtgctgtgcaggcgttgctgggatctcttcacagcacctccactgcatagaggtgagcctccagatgttttcattcattcaacaaatatatgtacctattgtgtgctgggcactgcttaagttgcgaggggatattgtgaagaaagtaagcaaaacccctttgtttgtagaatttcagtgagcatagtcctgggttaacctgacaacagtcctactgtttattgatgcttataggtgagcctatttctctttctagctttcttccacttaatttactttcttttggaattcttgaatttaataataataatattgatgttattagtcatcactataactttttattgagtatgtattttatgtcagacacagtgtggctaagtgctttacatacattatctcatctaatccttagaaaaaaccctggtgtattagtcttaatttaaaagatgtactttggaaaggttagtagtttacccaagattatgcagctagttaaaagtggtgctggggctgggcttggtggctcacacctgtaatcgcagtgctttgggagtctgaggcaggaggatcgcttgacaccaggagtttgagactaacctgggaaacatagcaagaccccatctttacaaaaaataaaaaaattagccaggagtgggggtgcacacctgtggtcccagctacttgggaggctgaggcaggaggattgcttgagccccagaggttgaggctgcagtgagccatgattatgccactgcacatctgtctgggtgacagagcaagatcctgtctccaaaaaaaaaaaaaaaaaaaaaaaaaaaaaaaaaaaaaaaaaaaagtggtattgggcctgtctaattgcaaagccacattctttactgcatgctttagtccattgttttttaaactgcagatcatgaccacgaatgggtcatgaaaccaatttggtaggtctccaacagcactttgggggaaaaaggggtagaatagagagtatcacatagtatggacaagcattgtttcttgaaatttttgtttttgctatgcacgtatatatgtgaatattgaggtctggtacaagatatatttctcactgtaggtcacagtaaaacatgttggtaagctactattttcttggctatgggactatatgtcatctaatcactttttaaaaacagattacaaactgtaggccttagaaaggtaagtaatttttcagctgggcatggtggctcatgcctgtaatcccagaactttgggaggccaaggcaggcggatcacgagatcaggagttcaagaccatcctggccaatgtggcaaaaccccgtctctactgaaaaaaatgcaaaaattagctggacatggtggcgtgcacctgtaatcccagctactcaggaggctgaggcaggagaatcgcttgaacctgggaggaggaggctgccatgagctgagatcacgccattgcactccaacctgggcaatagagagagactgcatctcaaaaaaaaaaaaaaaacaccaaggtaaagtaatttttcaagagcacaaaaatagtcagtggcagtacaaagacaagatgactgacttttttttttttttttgagacagggcctcactctgtcacccagactggagggcagtggtgcgatgttggcttaccacaacctccacctcccaggctcaagcgattctcctgccttagcctcccgagtagccgggattactggggtgtgccactaccacccggctaatttttttgtatttttagtagagacgtggtttcaccatgttggccaggctggttttgaactgctgacctcaaatgatccacctgcctcagcctcccagagtgctgggattacaggtgttagccactgtgccaggccagatgtctgactttttagcccttggtccattgctttattcttcacaccataccacttccttagaagtgcacctgggaatgcctgggaattgaattttatctttccacatgatggcagatatgctatggaaccttcagggatgtcggtgaaacctgaaaagggaagttgaatctcagcctgctctgagtaggtgaaaattctgccttggatcccccaaagtctgcagataaagatgtgacatttctcgtgttctgctgtgcttgaaggaaagagggtaataatcttaacagtgccaagctgtaagcatgttgcatatattaacttgtttaattactaattattttgatacagcggccatgcctgggatatgaactcagctgttttgagtgagaaggggcatcctaccagtgtgagttaacacttctctgtactctccccggttcctcattttgttcctgctgagttcagagctatgttcctcatagcctggcttacctgtggatgttctcagcctcattttcttttgctagatcatatatcttcattaggtgggtgattttggtttctgttactttttccttaatattagtatattgctgatttggatcaggggccaggctgtagattttcagcatggtgaggtgataatacatgttggtcccccatgcagaatgctgcctctagcactttagccaaaggagctctacagtctgtccagaagtactgggggacactggtaataacctgagaacacttacagagccttccagaaagtgccctttcacatcatataaacagatcatgggaagctgagggaatgcaaagtcaaggcctcattggagagcggaaaggaggctgagattggtggagaggagtggctgttacattctaattagaagaatgacatgtgcagggccatgaagcaactaaagatgggatgaaaaacttaacttgtgaatcgcaaaatttgagtaggaaggagctggaaaggcctggaagtgcgaagtgattggcccttggtcagatggctagaagatagagagccaggcatagaacccagaatccaggccatcattttgtggcctcttttatcctaatgacgttagccagaggtgtcttccaaagcacctgattatagggaagaatgaatgtcacttaccctagagtgagtgaaatagagatgccaggaagatataccaggtttatccagtttctttgcatttttctggcatactgtatactcttgagcgcatatgtatcctactttgtgaaatctgggggtaaagcaggacccttcaaacccttaaaaaatgtataccccaagaaaaacatttttaaagcatgaacgcttcctcaagtaaatacatatttatacattatataaatgtctggctattaaaccatgtatgcatatgttaactctaagtaaagcttattatatgttttttagcccataaatatggagatgttttaaaatttcttccagtgccccagtggatgatcttacacctcccgtgcttctgggatacacacatctaattttgcagaccactggtccagaatgtaaattgaagagtttaatgtctaagatatttgttcttttgtttgtagcttatcttttactccccacgtttcaaatatccgtttgcaaaataatttttgagttaaaattttcaattaaaaaactgtatccttgaggtagaaaagataaagatagaagatatatgtgaattaggttgtatctctccttaagagggaatactgttttttatctaaggagaactaacaaccctccctttcattgtctgggttggtataagtaaaaatccttgtttgaagttattaagccttcccacccatatgatgattagtttggttcataagctagagttagggcttggtaaaggctcctttttttttttttttttttttttaaagtctttccaccttaactagcaagtaagctagaaatgacagagcagtagaagggggaatctaccagagtgtcctacaggaccttgttgaatgctactgctgcatgcaagggttgtggatttggtgtgggccttctgcagtatcacccaaatttgagcagtacatgtaactaaaagtaagaaaaataaattagacagtttatttcatttcagactttggaagcccaggactgtggggattagctattagctaagacaatgattcactgagcaaatgcagtgaaagattcttttgttacactgatcatcatttgtggagagactctgaagaaggataaagctctggctgcatagtcaaaccagacctactactcaaggacatgcatactagatatgtaggtgtttccaaatatttttttcagttgtgggggtgcaaatcatttcaatagtagagtaactcagttcattactgttactggaaaaacaagtttaaccaagcacatatcctactgagggtgagtcaacagtgtcattttaacataagaaggacagtacatgaagtgagttattccaagtcctgtggttttcctacagctgagcaaagacagctgttctttcggaagtggggctctaaaaagaagttgcccatctcctttctttcttgattatagccttttagttttcttttggcctgagacatttcaaaaattcacttcctccttagatttctatcaccaaataccctgaattttgataatttatttatagagtatattatttattatagacttattatagtttaaaactttattttaatttatctcccatttcaagatccacgtttgctatatgtgtcagataataaaaatgccataaggaaaacagaggagtgatcttttttaatatgtcattattttctatagttctttagtggtatggacatggaataaggtggcattttgtgggacagtataccaaacttagtgataaaatttatacttttaattttggaggacaaaagtcttgtattctcagccttgtggataagacagtgctctgagctgtctgaggtttcctaaattgggattcaacatcatgaagggtatgtgtctggatagtttatttgttggtttgggaaggtgagtttttgtcttttttccccctctgagttgatttctttagttggagagaagcagaccagatgaagaaaatactttatctcttatggcatttttggtttaccacattagtgatgacccgtcttctctgagcagcaggccatgcttctctgttcagtagttcagttttcactaacttaactgcagatgtgttcttggagggatttatttctaagcaattgaattatgggtacttggataaaatgatgatgggttacctacttttaatagggccatcatttttaagagtaaaatcttgtcaagatagggtatatcatacttatgatctggttccatctctaactccataatttccttgtgctcctgtgttgctactctattattgagaagagatggtatcttgtcagtgtcaattttacaaagaaaaaattctaaacaatttcagtcatagggtagtttttttttttttcctggagaaataatgcatagtgtagtatgttgaatcctagagttggcaggttttcaaaagtggggttcttttgttgtgtaggtaggggtgatgctagtcaatgggtgttagtcattagggcatgtgtatgagtggtagttctgagatacagcattggcagcccctcttgtccctggttttgtttttgataagcaagtcctggttttgttttaataagcaggtcattagctgatctttcgtgtaaatgtttttgatgtgcatagctggtatgtgggtggttacctacctgagaatgttgtagtcacaaatgtatattatggaagtttgcagattatggtggatatcaggtttttctaactgcgtatttacagatgtagtgagtgaaaggaatgttgggtcagtaggtaaaagacttgtgctctggtcctggttcagacatcttgatttgtgtgactttgggcaagccccttatttctttgagttgcagtttcttgtgtaaaatggtgctaataccaatttacatgcctcatagtgttgttgtggggatcaaatgagatcactgtttatgagcagccttctcaggagtgagaaatagagggttgtgagctgactttctgatttgtttggctgaggtgttcacacaagccatagaatgctttgtaggcttgggtggaggaatgtagatggaaatcagctgaaaatccctgcctattagaagctgagatgttaatcctaaatatattctatggagtactatcagatgccttgcttttcttcatgatgccctattagcttcatcttcaggtagcataggtgcctgttactctcattttacttgaagaaactgaccagccaactgatttaggatatggctggctatcttctggaactcacattagagttactccttgagagtaaagtcttgtattttctgaaggttgctgcttttggggtattttccgtggaggtgggtgggcacacacaaaaactcactgtgctcaaatttataaacttgttcttcttaacaattttaaagccagattacattggattgggggaggggaggatactagatttagtgttttttaatataaaactttgtatttgaaactttatgtggtaacatatatttaggctcatagccaaagtgattacaatgcattggttttaatattttcagtgaggtaatgtgtgctttagtggggaggaggagaaatattatttaatcaccagcactacactaataaccacatttactaaatcctttgtccctttgcttgaactgagggttccttgcttttatactggttttccaaaggacttaatcttgttaatgtgatgaggtgatgatgggaaggacattcccactgggcccgaagtggtgaaactggtaaaactccctttgtaagtccctcttgttcaacatgagtgtcactcccatgtccctaaagtagaatggagttttattgaagagagaattttaagagtgataaacaaaagagatggaaatatctcctgtgccaggtcattgttaccattaaagactagaataaactgtaattttgcagattttctttttgtcttatgggaaattaaagacttggttatcctctctcggaggaagatagaaaactactgggcctgctcattaacagtttagcttggctgacatttttcaagcacttaccatggtattatagctgggctgaagctaggtggagcagacctcacttaggtgttgcctagctccagaatctgtcttctggtggaattcccttaggcttccagacaggagtggcaacaaagcagatgaaatggaaggtaggccagggcatctgctcgttcgctcgctcgcttgctctttctctctttcccttttctttcctttcctttcctttctctctctcctttctttcttttgcttccttcctctctctttccctttcccttcctctctctcttttctttttttctttcttttttttcttttcttttctttcttttctctctctctctttctttagcagtttattactcatttgtgagaatcagggaagcactgggctcaagaaagccaataccccttctagggcttaccccccattttaaaatttaatatattggaatttatattgtttcttttgatccgagatcttcaggctgaagctggagagaaatcttttgacctctctagaacaaagaaagcctttatcaaagacaatgtaactttttgagtttgccaaattaggtgttgctgcaaatggagaaacctagagttctcttctgtgcttaaagacacaaacatggaaagttttaagttccaatatggtcacttaatatatacaaaattttctgtctttgctgtctttgtcattccagcaacaactggatgagcaaatagaatgattgtgagcacttgcaaaccaaattgtgactgttagtgtgttgagctgcttttttattaaaatgactgctacaactctgcagaaatctgagtagtcttgaagataaattcttgcttgcatttacaataaagaaagaatatgagtaatcaaaaggctgatggagttggaggactggcgtttttaagaggaactgatttggacattgagattatcagctcctcatcaaatatcattaagtacacattattatttttttctgttgaccaggagacccaagttgtgttgatgtgggacatagttgtatgtctgaagaaacaaagcaagggagaataaaataaataaaaattgaagttcaggaatatatatatatatatatatatttttttttttttttttctcaggcagagtcttgctgtgtcgcccaggctggagtgcagtggcacaatctcggctcattgcaagctccgcctcccgggttcatgccattctcctgcctcagactccctagtagctgggactacaggcacccgccaccatgcccagctaattttttttttgtacttttagtagagatggggtttcaccgtgttagccaggatggtctcgatctcctgacctcgtgatccgcccacctcggcctcccaaagtgctgggattaaagacatgagccaccgcgcctggccgtttagggctatattttatgttttcttctccctttggtatttaataaagatttgatatttttctattatctgctttcctctgttccaaggtttttggcctcaggtgtgttctctggaaatggcaatgataggcatttataatctccatatttagatatttccctcacagtgctagtttctgagcttattagaacctaatgttaaatgacgagttaatgggtgcagcacaccaacatggcacatgtatacatatgtaacaaacctgcacgttgtgcacatgtaccctaaaacttaaagtataataataaaaaaaaagaaatatcctggctatgagtcaagggtttaggaccttttgaggcacttgggtttagacaattctcagtgatgtgtacaggaatttgggtacaggaatactattcacaggtgaacagagtttgattttggctgaaggcatattatttgatccagataataatataaaaataatccaaatgttaggaccttagcttctgcgaaccctgacttgagaatagttagccatacatgtagttggactttatgtaggactaaccaatctcctctgcactatttttgcacagtacattgattatggtatccctgatgacctctgtccccatccttgtgagtagccttcattgctaccacccaaggatgttttaaaaaggctatgaggaaggatgcatgtagggaaatctgaggttgttctttggattttccctgttttgttttaggaagtatccatgattttatataataatatgtagcaatcttaggtttttccattttcatttttaacataattttgttattcattctgtttgggtgtctacctctaaattaacaaacatgagaaattgtgtactccatttaaaaagtgtcctgagcaatttaagctaaaagaatatgttgtttcttttgtgtgtatagcaagaagattatatatatttataaatttttttccagcaagtgtacttaaaagcatgtacttaaaattaaggacttaaaaaaactaagctgtacttaacaaaataatctttagaaagctttaaggccgggcgcggtggctcacgcctgtaatcccagcatcacgaggtcaggagatccagaccatcctggctaacacggtgaaaccctgtctctactaaaaatacaaaaaaaattagccggttgtggtggcgggcacctatagtcccagctactcgggaggctgaggcaggagaatggcgtgaacccaggaggaggagcttgcagtgagctgagattgcgccactgcactccagcctgggtgacagagcgagactccatctcaaaaaaaaaaaaaaaaaagctttaaaaagggagtttactaaaagcacaggaaattggtgacaggcaaaatttgtcttgataatagtacaaatacagatagtggaacagaacagataatacaagatataagacaagacatggaataacacttcatattcactttctttgaccactaagcagcacacaaatatatagcactttttgtagagaataattaaatttctagatatgatacagcttcttcctctctgttgggttttattacactgagatcctgaaccttttggacatgtaaactgtgatcatgttggtcagtgtcatttggatctcgttggtgcttattgttctgccgatgtgtattagtgaacctactcatggggaagataatactatacaatgaattttcccattcagttggaatttttttattactctgttttctatgtttttcatttagatgtaaattattttggcttccattcaacctatttcagctagtttttaccataatacacatggcttaagatttataggaggctaagagtggagagtgtatcttcattcaaacaaatggtaagaaaggaactttcaaaactgttttagttttgcaaagattagaaaagtacaattctactttctcaacttttcatccttgttaaaggcctggaaatttgcagcatttttttctttcttattttacttttctaatttgttacacaaagtgaaattccacacataaacatgcaagctgaaggttgggtttattcataggttttgtcttaattatagatatttagtttattgaatatcttattgagtattgagtacctgctgtggtccaggcatcttcttaggtcccaggtgtacaaagaggagccaattgtggttactgcctctatggaatttgcctagaagtgggagagagagagatgagtgagccagcacttataatacatctacctaggataaaatgggagcacagaagaggaacatctgtatcagtgggtctctgagagcttcttcaggaaaataatgctttatctgtgatttgaaatatagtaggaatttagcaagatagagaaaaaggaaaaggaggtaaaatatttttcaggtaaaagaatgtacatgggtatagaggtgatcattattagcaaattggctacatcctaatttgtaagtatttgtggatttttcaaaccttatatttcatgtagaagagctgaatgcattagtctcatctccaagatccaggtattgaaatttaacccatgcataaattgaatttttttctgaagtctttaataagagaaaaataaaaggaaaaactacacagtgtatagtagatttcaatatagcacagcaaacactgatgaattttttttgcaatgagttcaatattataaaatagaacaaaattggaatttttaaaaccaaaaattattctagatttatcagctaactggaatgatttttttatagtatgaaaagtctgttagtaatacaaaaaatattcatttataagttgttatcgttgattatattttcttaaggtatattttcagtttttgaaaagcagtaataatttgctatgaccctatagcccagttcttaatatctggatctgatactagcatctcttaggtagaaaacacactttctatatgataatatctgtaaagagcacataaatccttggaacactattaggaaaacaaaatcgatttatctcttattgcttttttttggtttttttttttccttttaatcaagacaaatttcaaggaggaagacatgtttctccgcttcgtttttatttaaatgtaccacttgggatttgaagcttccgcacttcttctgtttgtttggatttttttttcatggcttggtcccaaaaaatggaatacaaaatttagagaaagttttgtttgaaattgcagggcgctatgagaattattgcaaatccctgatgtctctttgtctgccctcaattctcctatttttggtaataatgcaggcagtcattttagaaaactttgctttgttcattttactgagcctcttccagaggccatgtgccagaatcaacagcagccaaccacagccaagatcctagggcgtaaactcagacttcatctctcaaatattgctacttgaaatttgcataaacattgaagaaaaagttaaaagagcctgtataactcctcttcatgtattttaggagcctcagacagtcaagacattaaaataccttccgattgagcagtgggtctaagcacagataccacactgcagatagggagaaggatatgaaaaaaatcatgtgagatagacgacagaggcttatttgaagaagctacaaagcaacaagtaatgccagtttaaaacgattacatgttaatgcaacaagtaaaacacattgaaggctgctcagattacactggctgaagtacagacttaattactcatgttagagattcctaaaacaaagggaggcttttaagccagtgatatgtagctggtatgatattgaaaagcattggaaaacctaggtaaatgcctagaggaaattttaaggaagagtccatcaagtctggataccttagccttatccttaaatgaataaatttctgaggcgctggaactggttaaaatcaatggcagcttgttctgttgttggcagttttgatgtataattggggctgataaacctgaataaataaaagagccttgtctggattgagttacagttagtgctaaacatcaagggttcctattgtatttcttaaaagttctttttggagtgattccaagattggtattaagagggtatgccaagggtatatattggcaatttttattttgtttgtatttatcttagagtcatttgggtaggtcacattctctctgcccctactcccaacttctcattagattgtaaggaccatgaggacagagattgtttgttttatttgtgcttagttttcatgcagtgcctagtaggggacaatgctgacagtagtttctcgacaaatattagtggaactgtattaaaattgagtttttgctcacatatattgtttattttacctttagtggatcacttctccttatgccttcagtgctatagttttttaaaagaagtatgttagtctgttttgcattgctctaaaggaatacctgaggctgaataatttataaagaaaaaaggtttatttggctaatagctttgcagattgtacaagaagtttagagccaacatctgcttctggtgagggcccaaaaaactttcgtggctgaaggtgaagagggagcaggtatgtaacatggcaagagaggagggagcaagagagatgtcagtctctttcaaacaaccagctcacatggtagcgagaactcactcattactgtgggtgggcaccaagctattcatgagagatctgcccccataacctgaacacctcccagtaggccccaccttcaacattggggattatgtttcaacgtgagatttggaagggacaaaatagccaaactgtatcaagcacaaagaagatacagagatagtcaatggtggagctagtattcaaacccagatttgtctgatttctgcatccatgctttcaactgcttaactgcattgcttccaatactcagaaaagacgaaatgttttccatatcccaggaacttaaaagtgaaaaagcagagagctagaagaccctgtagtgctgaattgagagtcatgagtgttacaaggatgggtgggggggtggccctgtgaggaccagaaccctccaggggaagctttctgggtgaggcaagaggtgaactgggccttgaaggaatgggtagaatttagatagtaatgaggaaggcagaaatcagtggaagcacagacatgcatggaggaatggaactgagttcaatgacgatctgttcaggaaagagggcataaactgggcagagaatgcagtggaagtggtggggagtaatactgggcacgtaaggtaagctctgatctggaaggccagcatgggagcctagactggttaaagtaagaaatggcttgtccttggaagaaaaagtgtcaaacttggtactgtgtgaaggtactgcacagacctcccaactggttcttaggagagccaaactgaggctaagttctgagaactaagtaagaactgacagccattgtaggttagaaagtagtggggcaacatgttacaagtagtgcttctggaaggttagatgcggttagaataaaatcattgccattttggggagctgggaaaatggatgtcttcagtctagtctaaaaagggatgacttgaataagcttatataagaaagaaaagaaaaacctttttactcactggaccatttcataatcttgacttttttcaaacataaatctgtgtcatttttcttatttaaaacagctgagcagtttactctcctacttagagctgtgatccttatcatgggctcttgtgatctaaccccagcctgcctccctggcctctgtccttgcttaataacctctagccatatgaacctggaataccagtctaattcccacttcaaggcttttacacttgttgtttcctctgcctggggtgctattccctcatatcttcatgacacttgttcatttacattgtagctcaaagcatacctcctcagggaggcctttcctagacactatctgaggtacactcctgcacccccagccttcatgattgctttttatacattactgggttttgtttccaatggaacttatcgcttattactgtcctaaattattttatttattaattttttagccacctttctcttatagaaataaggttcctgaggacagggagtttattctgtatactacggtatccctgacatcagggcttgtgcctgccgatagtagatgctttctaaatatgttctgaatattagatagctagttcccaaatgcactgcactgaaagtgtatgaaaattggaaattggcttctagatttttgtattatattgccaaatgatggagtgatgagattgaaatctactacttctttttgccttttttttttttttttttttggtggagtagaggagggcctgcacaaacagcagatacacacacagtaaataagatttatttcagccagcaagtatttattgacatgaaaattggggttaaatgtgactctttgtgagtgactagtttcttggagtctattaaagcatcagtttaaacatcaattctctatggtatgattaatgtttctttttttactttataagcatgaagctgccttcaattttattgttaaatttaagtgttttacattggaaaaaagtaaattgaattttgaaatgaggtctgtcccggtctcactttcatggcttcaggttatcaaagttttaatttctctttgtatggaagataattatagtattcatttttgctcctgagtaaagccacgagtctcaagattatttttcttttttaaaaattagaattgtcagtttatagttgtatacatttatagggtacaaagtgatgttataatttgctaatacaatgtagaacaattaaaaggtagttagtatatcctttatctcaaatatttaacattttttgaaatttactctcttagcaattttgaaatgtataataccctattattaactatattcaccacactatgcaatatatctcaaacatatacaaaaaaattcttcttgtgtaactgtagctttttgtacccattgatcatcaggcccacagcttccgtaaccaccattttcctctctgcttctatgattttgatggttttcaattctacatataagtgagaacatgctgtatttgtcttcctgtgccttatttcacttagcataatgttctccaattctatccatgttgtctcaaatgacagaatttatatctaaaggtggaatagtattccattttatgtatctaccacagctttttttttttttttttttttttttttgagatggagtctctctctgtcactcaggctggagtgcagtggagcaatctcggctcactgcaacctccgccccccaggttcaagtgattctcctgcctcagcctcctgagtagctgcgattactggcgtgctgtaatttttgtacttttagtagagatggggtttcatcatcttggccaggctggtcttgaactcctgacctcgtgatccacccacctcagccgcccaaagtgctgggattataggcgtgagccactgtgcccggcctatctaccaccttttatttatccattcatctgttgatggacacttccataacttggtatgggtgtacagacatcttttcaataaactgatttaaaatatctggggtaaatacgcagcagtgggattaccagatcatgtggtgattctattttcagttttttgaggaacgtctgcactgtttttcacaatggttgtactaatttacattcccattaacagagtagaagggttccatttctccacatcctgtttattcagacgatatgttatcatctaaatcatctaagacctctatattatatagcttttgagtatttttaaaagtggacactcaagcgttcatatagtcatagtcagtgtgtggttcctcagacctgtggtatcaacatcacctgggaatttgttaggaatgcagattcccaggctccctgcagacttagtcagaaattgtgggggtcgagtctaacactcttttttaaaaagccctccaagtgattccagtgcttactaaagtttgagaaccgtggctcagtaaatgctaaaggttcaaggtagcatgatcccacacatcagccaagtggcattaattattagcctggtaagcccaccttcttttcagtcactgagtttgattggttcactagggctaggctgtaaagttatttgctagattgattgctacatattgactttgggttgtttgtatttctctgaacctgtcactgtaatgatttgtcaggacacttaataggaacaggccgtgatttttgcacccatggcattctgagtcatgggtggctgggtcattatgtactccaggtttcttcaggcactgggcatgccattcatgtacttataaggagggagctgtcgctggtggatcacagggaacctttagggacatttagttcgctctcagcttggtacaggtagggaaattgagcccccatgaagttgtgctttgcttgcagttaggggtacagacaggatttcaggtctcctgagtccctccactgcaccaggattcctgcagggggacagagctacagctttttctgtgcctacaggacattcctttcctactgtgagggttttatttatttattattttatttaaagaaaaaaagtaaatagaaaaaaccccggaagttctcactgaaactaataaaagtgtctaaagagaatgaaaaaatcagtttgagaactttggtatggaggaaataacctgacattaactgttttaattatagttgttgcattgggcttatcagtgtgggaagagggagcatttgagccttacagggaagtgggatatggacaacaagatgaccctcttcctgaatttgcctgtttgggcctgcagcctggtgactctttgtgtgatcccaacagctgtcatagagatgggttggacttttactgagacctgggtcctaggcccagcactgccaccagctagtggcgcgatgccccataaagaggccacttattctctctggcctctactattggtaaatgggtataataatatccaccctgccaatcctgagaaatttcaggtagtgggaagcagtgtatcttggtggttaagggcagagtctctggattcaaattctagctttctaactcactggcatggcagtaggcaggccacttatcctccctgttttctcacctgagaatgggtataatgaaatttacttctaagggttgttgtgaagattgaattagttagctaatttatgtaaagtacttaggatagtgccggtatttagtaagttctatgtgttagcctattattattactattaccatttaaaaatactatttcaaggatgggatgcattttctgtaaacatgttctcaaatgattctactactggatacaatactgggcttttatgcagtaattgttgttggaggagttgttctgacatccagcttgcacctgggctactggtttcgtggccagggatggccaggcctagcgtctctgatcttgcacaatttatgcatagagtggtgtggttagaggaaacttggaggggggaacttctcagttttgctttcaggtatttatacattaactatcataagagatggacatcttaataacttccaagaaagagttcatgagcttcaatttgatatttattgtttgactaggtttctttctgtcttacctttccagttgttagggttcttgatatgtattttggtgatgaaaatttcaactctaaaagctaaacaatcaagatattgtaattatccagcaagtgattagcagatttcgagtagacttcttccattcttggctgaaatcaatgaaaatgtctactattgctgttgtttttgttcttttctctgaaaagtctgtttttgggagggcctgagatggtaaagtgcctttttattgtctcttaaagggaatgggggaatcaacagtttgagaatttttgttttatctgtatgtataaaattgccttctccttttatttcttttgatactctctctgcagtctctattcatgatctactccccatctttttatgggccccttaaagctagagattatgtttattcgtttatttatgtattccatttctccttttttctggatcctaattttgtgcctggtgcatactaggctctcaattttagtttgtcgaattactgttattgctgtttctgattacttcttgaagcggtctgttttaaaacttcacctgaaggctaagtaattcatcagtataatggtgatctattatttatctagcattttcctaaacactcattgatgaatccttataatactcatctgaagtatctaaatcccaagatgatgtgtcatgtcatagatggtatggctttaatttttaattgggagatggagatgtaacagctggagatactgaaacacagagaaataagagcatgattcaagaccacaaacgtggttattgttggaagatagttttgggatgggcttctgtgctagaagccaaaacataaaaaactgattaaaactctaaaaagaaacccagattaggtgggaatgaatgctgatctggattggattacacttctttggtgtctgagggttatgattagtgacttacttctaatgtgcatttgtttttatttttagcattgcagtgtcgagatggctatgaaccctgtgtaaatgaaggaatgtgtgttacctaccacaatggcacaggatactgcaagtaagtttttctcttcatatattttctttttgcgatagaacactggacaagatttgattctactcctctatttttaatgcttctgtggaatgttactggttcttgagctttcctggtacagattttggttgggggtgaggatggaaggatgtggatgccagataattggctaataagaacttcttactatcttactgttatctttctcactatgaaaaagacttttcagtgagtggctagttaatgtatatggggtagaccaggcatggtggctcatgctggtaatcccagcacttcaggaggctgagttgggcgaatcacgaggtcaggagttcaagaccagcctggccaacatagtgaaaccctatctctactaaaaatacaaaaattagccgggtgtggtggcgcatgcctggagtcccagctactcgggaggctgaggcaggagaatgacttgaacccaggaggcggaggttgcagtgagctgagaccacatcattgcactctagcctgggtgacagagcaagactccgtctcaaaaagaaataaaaaaaaataaaaaaatgtatattagattcccttgtgtttttcagattaaggaatactcttagagtctccccttaacatgttacctattatcttgtttttaagtaaaaccaaatagatatcaactttaatattcggcccagtatatgtgaatattatattcatatttttttctagtgtaaaaaatctaattctgaaagtgagacagtgagagaggaagatgtgtgcatatgtgtagattgagggggagcaggggctttgggtgtgtattattatatggggataaaagagtaaggatgaaggaaaatgtaggctagttcttggcttaagagcatttttttttcctttttctccaaccatctactctagccaagacgttttgtttgtttgaggaaggctgtgagataatttcataatagcttttctatgtttcctgcaaataattttttttcttctgcctcaattgaaaatttttaagaggaatatgtatccattctgtttatttcagggaagatgctggagaaataaaatttggtaatatgaaatttctcttcttttccttcatttttgtgaggagtagttcttctttgctttggtggaggtacttgcttagtaagcattttaagtgagtttatccaacacatttttatttcttaccaggaatgtaattacaacttttttccagtgagatctgttctgacaccaggatttagttttttaatgttataaacaagatttttttttcaagtcagaaataattttcttcactaaagtgaaaattaagctgtgatgacagtaaagcttaacaataggttgtttggattggaataaagataacattggaaataaaggttttatgtagcttattatgggctgctcatttagtttttctagctgggggaaaaaaaaatgtggtgcattctcctctaagaatggagatacaactggagataataagggagggaacttaataccttagagtaggccactgaaatcttgtttagtctttttgtggcatttggtgcgttagttgcttgctttattctgttatgcaactcttgtggtagttaaccccattgcattatggtcatttgttgatgtgtttcttttgctagaatgtgaggtcttagtcttatgcattttttgcatagttaatgcctagtacagtgcctggtgtagttattgttcagcaatgtgtttcttaaactaaaaggtgctaagtagataccgtcatgcacatgtttcttatctatttatgttaaataagaagacactggttctctcctttaaaaatttcagtgtggcgattcctcaaggatctagaaccagaaataccatttggcccagcaatcctattactgagtatatacccaaaggattataaatcattctactataaggacacatgcacatgtgtgtttacttcagcactatttacagtaggaaagacttggaaccaacccaaatgcccaacggtgatagactggataaagaaaatgtggcatgtatacacgatggaatagtatgcagccataaaaaagaatgagttaatgtcctttgcagggacatggatgaagctggaagccatcattctcagcaaactaacacaggaacagaaaaccaaacacggcatgttctcactcataagtgggagttgaacaatgagaacacatggacacagggaggggaacatcacacactggagcctgtcagggggtggggggaaaggggagggagagcattaggatgaatacctaatgcacgtggggcttaaaacctggatgacgggttgataggtgcagcaaaccaccatggcacatgtatgcctatgaaacaaacctgcacattctgcacatgtatcccaaaacttaaaagcaaaattaaaaaaaaatttatttatttcacatagcattcagggtggtaataccatacagagaggcaaattggttctatttgaagatcattcaacttggtgacttatatatggagaatttcaaatatgttctaagtgttcgcctatatatttttggtctgacatggggagagaaggtttctaggggagactaatctctgagcacttaccaggagaggacacctaagggtcactgttgggaagaagtccaatagttctttgttggactgttgggctgctagtctcatactctccaaccaaggttggagaccatcctggctaacacggtgaaatcccatctctactaaaaatgcaaaaaattagctgggcgtggtggcacgcacctgtaatcccagttactcgggaggctgaggcaggagaatggcctgaacccaggaggcggagcttgcagtgagccaagattgcaccactgcactccagcctgagcgacagagcgagactgtgtctccaaaaaaaaaaaaaaagaaaatggagctgcctaaattctgtccctggctacttgttaattgttgataggatggaatgcttatggatacagttctgggtatgtccctcagatgtctttcctgttttgagggaaacaaactccttgagagaaagaaaaaatttggtgaggccatccttttgggagaccaagatgaacaacaaaacttgtataaagagagtgattccctacctcagcaaaagtaatattagcatatttaggagtggcagggtcaacataagtggacaaagaaaaagcaagaacaatatcaaggcagccacgtcaatcattctacagtgctttgccagcctccacagaattttaagcaaaattttatgcaaaaataatgtgtacctagcagagctttcagtgtattttcaccaaccttacctttttttctgtggagaaagaagatgatctagcttgttcagtaaatattattttcacaaaatagaaaatagatattaaaacagaagatttataaaaattctatcaggcatgcagggcatgtgattatctttttattcatgcgattgcttagtggattaagaaaagaaagttgaagccaaattccttttacagggccagcgtgggggtgagtggtgagtggtgggatgggaactggtagaaagtgttttaaaatagaaggaatctgactatctgtttagacagcataatgctactgattcagctaaaatataatgattgtttatagaaattataaaaatccttgataagatcacattgacagatgaagataactacttttgaagattagttttgtactcagctcaactgttttttctcagtgttaggagcctaagtaccctatcagtctgtgattagattttgatgccagattaggagaacttgtataatcttgcataaaactcaattattgctgttaaataactactgtcaaatcttaataaagccctctcactacagggagataagatattttattctttcccttgtcctactgggaggtgtaaatatgtaattaaatttgatgtcattaatcactttcaagttgtttgcttcagattttcaaatataaaccattctaaatcccaatttgattaaagatcatggacaactcaagttcactaggattctgggggtaggttaggttatgatttgtataattgacaaaatatgtattttaaggacatttattgtagttatttaaaatctttgtctgctggttcttaacatctgggttgtctatggatgtgtttctgtttctatcacctgctccttctttggaccatgggtatgacttccctttactttacacatgtatggtagttttacattacttactggacattgtgggtgatagattttaaagtttatctcccactaaagaatgttgaattttgtcaagattggcagatcatcttgatcctatggatgctaggttttaggacacgttagggtgggcctacttctgttctgcccttagtccgatgacacaaatcttagtcatgggatagggctcttattcccaagatgtgacccttctaggggttcagtggaaagtgtgaggggcctaccaagccctgaggtgttcattaagcccctctaaggcagaacttgtcctcccagccccaggagccttctgctcagtcttttcagccgtccagctcttactttctcttgggtttctgaatcttatcttgctcatgcatagtcaggaattatttaaggatttgagcagagttgtatgcatactttgaagctacccactctgtggttctgtcttttccaggaatttttctcctcatattctagctgctgtgacagctccagatacctctgactcctcagtatcgcaggacttccgttttctgcttgcacactcttcctcttctgctgcatgaactggggtgtaccttcacgataaaaaaaaaaacaaaaacaaaactgtaaatgtgggtttcatatagtttgcttcgctttttctgaggcttatatcccttctagtttatgcctgctttcagtgattctccagtgcctttgatattttgtccagagcaagagggctagtctgatatgttactctgcaattatttttaatgatgaaaattggaaatataaaggggcctttcagaatttcatacataccacttggtaaatatctaacatagtgtttgtaaaacagcagaaagtcaccgtgagttgtatacgttcctgtagatgggtgcttgcatttgagaatgtccactttttgctaaagtgctgatctaaaaactacactttaaggtaaattattataaatataaagtgttataaaatataactttgtgtcacattttgtctaaaacttgtctgctagctgtaataaacattaaacattaacagctaacaattctccttgccaggattaggcagtcatgttggtggtccagatttcctgaatccatccaagaaaaactagagccattgccttctttgtcttcttggtaaatgtctgtatagtaagtagagagtagagacactcataatcccttagaacttagctttttatggaggatgcattcgcaatgtttctgttgtggtgcttctcccccaaaaaggcgttttcagaagtcatggctgactcagcatttccccctttccttcaccttcttgtgagtgcattcagggaggcacaggggcattgtcagatcaaagaaatagacagggaaaaatatcaactgttaaattactttctctttcttctcagctgaaactggttctgccagcctagttccttcaagtacggtgcctatttagctgaacattgtgtgtatagtttttctggaaaatgatagcagaagcttggccagttttccatagttcatttatctttttaacataaaacaaagaatgctgtttttttggctcattaaatacctctcatagagtaatcttttcttaaaatgtaatatgttcaggttttattaattcaagagttatttattgcatgctatttatgcgtaccacatataatagataactcaagtctgtggtagtagttgcagttaatcaatattgttatcatattatttcacacttctttgggaagtcataaaataattaccagttcattaacttgggcttcttagagaggttcagagtaaagccaagtatgaaaaaaactgactataatgtggccttctgtacaggggccaccagtgaatggcagggctgggaccatggtgaggcaagtaaggcacaggcctctcttgtgaaatttaagagagtgccaaaaaactcactaatcaaaataatgtttgtatgtagttgttcaaaaaatcaaaattaatgcaaaataagttgaaaattatcaaaattttaaataaggagatcagtagtactgattttttcttttgccttatgacctagtatggttcagcctgcactggtgagtggagtaagggtcctggaagatccttgactggtgacatgaagaggacatagttttttgttgttgtttttttttgagacagagtctcgctctgtggcccaggctggagtgcagtggcgctttcttggctcactgcaagctccgcctcccgggttcatgccattctcctgcctcagcctctcaagtagccgggactacaagcgcccgccaccacacccggctaattttttgtatttttagtagagacggggtttcactgtgttagccaggatggtctctatctcctgacctcatgatctgcccgcctcggcctcccaaagtgctgggattacaggcgtgagccaccacgcccagctgaggacataggtttttttatgccagatagacttaagtttgagtcctgattcctattaacaattggatctttggcaagttaaagtctataatgctagctaacattattgcgtattagggtctgttctcaagtagtttacatgtatttactttagtcctcatgtgagagagagactatatggaagctaagagaagttaaataattcactcaagatcccatcactctgtagctaacctgagatatactcgtggaaaatgtactgtcacgttgagtctcagtttgcctgtcaataaaatgggacagaattacctgttttaagttggtagttcaaatggaaccttctgaaaaggaagtgtggaacatttgaaagtatacaaaaaggggacttttcagatcaggaatatgattaaaacactgctttatgtaatttctaaatttaaagacagtagcattaggtaggcctgagtacctcatatcattctagaacactaaatctgcatatagttacatgagtgtacatgggccaggtttggtgaatactgcatttctgagaaatggcctttaacatgaaagctcaatgtaataactgtggatgaaatagaagaagagggcagtgaaggtggggatagaggatattgtctattaaagtgtgcttcagtagagagaactaatttgaaacttctcctttctttttactaatggaacaggagcaagtccagacagatttatgcagttgtgaaattgagacaggttaaattcagtgatttttgataaatgttgttgccagcacaaaagtcacaagttgttgaatatggcaccttacatttgcatagtgagttacagatgcataggagtatgtcctgtgaggcttttccttgtattaggacttgagatctggaccctttaacagtacctttcctaagtgattcttattaatacttatgtcctattaaaatcctttatcaaatatgatgtttccctaaggggtcttttgtaaaggaagtcttggttactagcatctccatctgtggcccaggcttgagtgcagtagagcaatcatggatcactgcagcctccacctcctaggctcaagccatccatcctcctgcctcagtctcccatttttaaaactttttatagagacacggtctcacatgttgctcaggctggtctcgaattcctgggctcaagtgatcctcccacttctgcctcccaaagggctggaattacaggcctgaaccactgtgcctggccagttagtagcttcttaacacatagcaacataatttccatactattttcaactaatttttattctttcagttgggacctttatatatttcagtgttcagtgaagaagtaggagaatctggttcttaggctctgcctatatccttttacctgtcttgggtaactgccaagaaattaaatcaacaaattttggcctgcagtctggcattaatagatgtgaatttagctaggtttctttcaacacagtctccaggtcaatcgtaatcttatgtgaagtttcttattcaggcatgtctcgttagcaccattaatttcacacaggaattctttttttctccctttttttgtgactaagcaaaatgagaaatatttctctttcaggatatggagaggcttaattaaattctttaattttgtctacatctgcccttatgaatgatagcaaaggaatgggggatatcagaatatgagaaaaagtaatcatctaaaaatttccaagcactttaaaatttattaagctagcataaatatgtgggtgtgatagaggttttcattaagcctcctctcaacatacagtagttaggaatgaagtttagtgtctctccgtcctcctgtcatatgtgtgtatgcacacgtgtgcacatgcgactgtgttatgcattttgttttcatatttcttttagttgggttttaccttacaacccaacgtaaggtaaattaaaatttctattggatttccgcacattttctagatcctatttattcactgtcagtgaccttcactagcacttagtcctctgagtccaaaaatgtattgccaattcttagactccatcagccttctcctatgaaaaagtaatgcagttaatttctgctcaaaatgctcttctcctaaacagtcttctacttgatctttatgaaaagagttttatgaaagaaaagtgaaaataaagactaagaaagacattatttaagtgatgggtgatattattcagtgaacacattcaactatagcattctatccagttttttgccttcacgtaaatatgaggagaaaggtaggtgttaataagaaaataatctgattaggatttatgtagaatggtagcatttagggtattaaatctgtatagattcaggtcattttcctgcagtcactgtctataatcctgtgtgctgaacactgaaagttagatggactctgaagcgctatagaatcctcacttttcaaacaaaagtttaatttttatcacactagtatttattgagcaggctactataactgatcactgtactgggtattgtgaatagacagaaaagcccaagaggcctgtgttacctgacttctttattcacaagtatacgtacccagagactgtctgacagtgaatgcagtttctcctgcataagacatggtggcagtcttctgaagtcttgctggggagatgaagcatacagagatgtgtaaaataaaacagtttgtaatatcccagtgtaggggcacagataataactatggacactcagacaaaggaacaagtactgtgggacaaaagagtaaaatcagaggacttttggtgcactgcttagatcctaaatctttgaatattagtggtgccttagaagatggataggtaggagaagggtgagaggaagggagctgaggagactagaagggactgttatttcctggaataatcattaccaatttcttcatcacgttttcttaatgacacggtttcaaacgttttcttcatcttgattgctgtcttctgtgtatatgctggtttgtgtgaggttttactaaaccagtatgtggattaatctagtttcacagtgacaggtaagtgatttagaaaatcattcctttagcacatgttaacttgaacgtttggaggtagaatgcctagagtgagggtgaaggagaggacctggggacaggaagagagggcagctgggagcaattatgctccttccctcagacctttttggccttgactcttgattcttgtacttctaccagacagagaggcggtaggcttgtggccatgttttgcgaggaaaatcagaatctaagaatctctaaggcaagagcaagaatggattgggataggggaagtgataggaaaacagaggcactaagaagagggttggttttcatgtactgcatagttcattcccttagttgagaaatcaggtatctcaacctcagatatcttctgtccagcatatcgctggccagatctgattcatatgagggatccagagtaaggaagcatctgttagccaagtctttggttaccccaaattagctcaggtcctttactgcttgtttcctctgattatatagtacatatccaaaccctcaattttccagaataaactaggtctgcctattctgtgtggaaaacatttgatggtggttaagattctcttgcctagacgatggtagtgccttagtcgtttaactgcctgtcactttaagattttgaaatactgattcttgttgtgtaagccagacacatcttgagaatattttacggggcaacttgccctttctgaaacctcagtcatcctgaaaagtaactctgtacctccttgactttaatttttctgtcttaattctatttgtatacaatgtttgtggtgtctgattctctgtctcgtattgctgaaactcatggccttgaatttctgggtcactcttaaaaaatagacataacttgattactaatgaaaaagtgactcattttcttccaggcaaaggctgacactgactgtcacagtttgtgacagaagcagactctctaattaggagacatcacctattcttttctaaattttataagaattgatgatagcatcatgagatgggaagtgagtaagataagcgtttatgcttgtagagaggatgcataaaaatgaaatctggataaagttctatctgaatttacctttttaagtggttgattccctgtgagcttaaatttagtgcttctcttcccagaccgttgtcttacatacacacttcagtcagttttagccttgtataactaatcagcaggtcagattccatcgaggctgaaatacctaccaccattctatgctcaagaaaacaggctctcatgttggccagttgtttgggatagaagatggttagacctttctatcctttttaaacacaagattctttttcattccccttatcttgtttaaatatattgttccttctctttggttgttctttgctttcttatgcatctgtgaggggctagctgaaagtgtgagttgtggaacaattcatttacataagtgtatattgaattatctgtgcacctagagggtgatgggcactgtgagggatattaaaaaagagacacagtacagttcttaccctaggatcccctgcttggagtgggacagtggtcaagacatatacaaccacaaacacccaaacattaacatcaacaagcatcattacatccttgggtggtattgccaagggacttcaaaggccaagattatagagtcatcacacttaggaggtcaaagggactttggaaagcacctttgtcactcattttgttttataagtgaggaggctgaggtgtaatacagctaagcgaattagcctttattacataactcattaggatgtagactgggactaagagctgtttctccagatcccattaggcaatctaaagattctgcactatttctttttcatttttggtatccaaataggtacagttgtttttgatctaggaaaatccttttagactaaacagtaagctttttaaattactctgcttttagatattttttggacttcagaactttgaaggtggtcatccaccaacattggggaatggaaagaaggctccaacacttttctttctagagatcttctttaattttcaatggcagtcactacagaatctagcagttcatgctattgaggccactttgtaggattttttttttttttttagtcagggctccaggtccctggtggtttatgtagtcagtcttatcaacaaccgatgaaagaccaataaaagtgcaagagggaatgaggactgtgtgtgtgtatgtctgcacatgcacacatgcctctctgtgtgtgttggttaacttcatatttggtaggtgggagggaaggtgattaaaaaataatctactttgcatggagttggcccaatttgactgatataggggtgagtgggggttaagaagtagtctatatatcaggaatcttaattagttttgaaaatcctttaggtaaatagctcaacccagttgttcccaaacttcaagtgtatttatagggtctttttaaggggtaaagattccacagagcccttcattttgaccttttgcttctgcactgaatagtcgaatgccttctatatgccagtcattgtgttaggcactgggagtatgagaattaataattttagtctgttgacagataatcataataagggctaatgagtaacacaggctcagggttataagaacagagggggtgtcaaggctgtttttcacaggaaataacatttaagttgatacaatgaaattttagggcttagccatgagaaggtggggaaaagcattttgggctgactgaacagcgtgtacagaggtctggaagtgagaagtagtgtactatagcattttctaggagctgaaaggcatttagcaagagtatagcgcataaaggagagagcttgagatgaaacaatttctcagtgtgttgtttgaatacaatgtatactgtcaaaatctaagaattcaagaatcatttaatatatctttatgttttactagtcataaaagcatatacatatatttaaatatggacaagatactgtttagtagtttagaaagtgatttatgaggattgcaatcccttgcaataactccacagcccataccttgggaacaactgagctaactcattcagttttgtccattacatcgaagggtgttttttgtaaactcatatgtctagaatgtgtttgccatgttttaatcacaagtagatattttctcagagtccagtgcagtgaagtatggtaagatcctgattgtgttctggaacacagaggaaagaccaccttctgttatagcaacaacacaagtcttttaacactgtgtgccccttcccaatctttcaagtgatgattgaagagactaggtgctcagctcagcctttgagttctgataaatgagcccagactgtaaactggaagataaggatgtttgtaaagttcttgtataaataaagcatggtttctcattgcagtggttactgatttcatagtctgagtgaagatgaatgatgctgtgaatcaacagctttaaagtccgtaccacttcagcttctttttggtttaggtttcttaaaatcagtgtgtatttaatgctttattcagatgagggggtgaaaaacctaacacatgtaaactaagtgaggtggggtttcagagataattcccagcctcacaattcctcatgaagttcttttcctgtgggaaacttttaatttggaagcatgcaacctaatgtgggaaccaagattaacattttctgaaatacttctacaagaaaagcagaaatggtctgtccaggaagctgaatttacatagtagaaaaatgagctgccctgcagtatttggtagtctttgtgtattggttgtgataaaagtgtgtatgtgtgtgtgtacgtgtgtgagagtgagagattgtatacttgtctttgtttccttcacatacaactagtaaggccctagaaaaactacactagaaagtgtgttttaccacaagcgtcccagttctggacaccaatctatacacaaatacttttttttaaagttctttttgtttttccttcttgctgagtaagctatagtatttccttttttttctttctttttatttgagagaagggggggttgagagtagagtgggaatggcaagaagtagtatgacagagcttcttctctttttttcccctctttaccaggaagttaactagaagtcttcatgcatgtttttaaaacaaagttggtaattagcataacctagttagttacctttacacagagtgacagaattaaaaagttgacaagcccatcagacctcagccaggaggtactgaaaggagggagaccagtgagtctagaccaataggtgggttaggcctcctgaatgccagcctagaagtttagacttgattctataggctctagggtacctacaagtttgtagtcgcagccttgggaattgaatgttacataggaactttcactggttccagctagccttggctgttagcaattatttttatctactttaacaggggggacagagtaggggggcaggaaactaagctggcattatggtcacaggaaagaacagactgatttggagcctttcaaactgcagacctttgttactgaccgatgcttaatttggtttctgggttttgttagttttttcccctgcccttacctcatttaccttaacgacagctcccccctctagagctcagctagggcaggctgccactgtggattggggggccaagaggcccagtgcaagaagaaagtgggttgaaagcagagttctgtttaaagaattttctgctggaaactagcccagagggagtaaagaggagctttaatgaggagcagctgcagtgccgacgcaacccacatgagacttttttttccccttcgttccacattctgtatagtttttttaaaaatcatgactttgaaatagctgttttgtaaagcatgcctctctttttcttcttgtatgtggtgggattttgctttgttgttgttgttgttgtttcttgaatggccaaatcctcgttttaaaaaaaaaaaaaaaaaaaaaaaaagctaaagacagagctgcagcaaagccctggatgcaatttggcctcaccctgctgatacagaacattcggtggagaaaacaaggggagagaacactggcttttatttggaaaaggggcttatttcctgctcagacttcagtcatcttggagctgacacaagctgctacactgttttaagcttttctgtagacgagtggctattcacttaggaaacgtgaaagaacaaatttttctgtcctgtattactagagagactgatcctgaactgcagccattgccagatagattggaattgctattcagatcccagcttcgttgaaatctgtaaagtggctacatgtaaactaatccaggctgctagtgagatgtgagggttggggtctggttttcatctgcttaagtgagaggaaactgtaggggtatccttcaaatggaatgttttctagttccattaggaggaatcccttgtttttctctgttttcttccttcctttgcttttctacatccaaccccatgcgtatgtttgaacagtaacaatggaaatgtggacctctcaatgtcagaaatgacacttttttttttttgagatggggttctcaccatgttgcccgtattgcctaggcaggtctcgaacttctgctctagcaatctgctcgccttggcctcccacagtgctgggattacaggtgtgagccactgtgcccagctgagacttttaaagaaaaagtcataaatatatctttatggacctggtaagtattcagattagtttatagagtttaaaatggaaaaatgctccccaaacctttctctgtattcacaacctcatctgcgaagtatgttctttcagagttccaatgctagagaagagagagtaagtagaagtcactgagagacattgaagagacagttatgaaaataattaataaactccctacaggagggaaacattcatatagttttgcggatgaaaggcatctgttagatttttgtggttattttttagaatatacacctttagttcaagtggtagactattttccaaaatgtgtgctgggtagcttaatggaattatagatacgtaagggatgttgggtgtttagccatgttttcactctctaaccaaattcaactttagccatctcaagaagacagctatttaagcccttgttttcaagcagagaaccttactttccaccaagactaacagagtatattttctccttataccacagttgaacagggatttgcaagttgaaagatctcctgccttaggaaacaagggtctgttatttctgactgtcttagctattactcccctttcttcccatgtccataatgctgcttagcttcctggggtgtgaaggataattctatacctcaggatgactattaggttgatttggcctgttattctaccagacagatcacagagtagagatggattttgtggaacatttggattgagagactgactttatccatcacatgaaatttagcctgctttggaaccagctgcttagtggggtttatgtactcaggtattcagggaacctacaccaagggttcaagacagggtcttccccacaaaaactatctagatgggagtttgagaaaggtacagcaaagacataacagtggcttaaataaagaagaaccataccagcggagacaatgtagtgcatgacatggcactacatctgctgttggaaggatcagagacaggtgggatgatttgtagaaggcttactataggacaggtttacagcagatttttgaaaaaagggtggaagaaaggaacctaagttggagatataccagaagggaagcatgatgtttctcactggaaattaaaaagatttcaatataggggacagtaaacaagattgtggaaataatatggagtgttcgagttatggattactaaagagtaagatggttagatgattggaatgggacagacaagcagatcagagattgtaaagaacttggatttgaaaggcttggtattaatactgttgctagtttctgagcagaagaatgacatgaaaattatgcttaggaaagattattcttttagtcatatgcttaggttcagcaaggaatttccagactgtccttagggagaggagaggtatggataggatgctggtccatttaggatgttagagctgattgaataagtgctagtcttggggcaagacttagtcatacactttcagttaagtactgtttcattgcaaggtctaggtgaagatagggatatatttgtaaaactggggaaattgctagattcacagataaccaactttgggtagatcagttagctttggtgtccttctcagtgctataggggttcagaccatttggtttctgagatcactgctgaaattctgtgattgtatgagtataatgtaaaagttgtctcaatcaaggaaacttggagtaaagactcaatatgatggatttaaaaggaatgaatgatagttccaattattgggttcaaaaaacatgtgctacaagtataagatgagaaaaatagggtacactagtagttcatgtgaaataaggctctgaatattttagctgagtgtgtattccatagcacatagtagtattttgtggcttctaaaaaagtacacatatccattgggtatgagtcggagcgttattctttcttgaactgcgctctcacgatgcctcctcagtttaagaacttactctgaaatagtaaaagcatagtgtccagatcaggaggtcatggttcagctctgtgctgcactggtaagaacatgtgttaagcctttttccattttgagcctcactttttaaagaggtttttgatgaactggagtcatccagtgatggggaggcaggatagcctagtgttgaagcacacgcactctagagtctacttgggtttgaatcctgcctcttccatctactagctgtgaattttttttttttttgagagggagtctcgctctgttgcccaggctggagtgcagtggcgcgatcttggctcactgcaacctccaacttctgggttcatgccattctcctgcctcagcctcctgagtagctgggactacaggcgcccgccaccacgcctggctaattttttatatttttagtagagacagggtttcactgtgttagccaggatggtctcgatctcctgacctggtgatctgcctgcctcggcctcccaaagtgctgagattactggtgtgagccaccgcgcctggcctagctgtaaaatcttaatctttctaagcttcgagttcctcatatataaaatggagattataatatagcactggagcgagtaatacaagagacaatagctatcaaatgcttagcaaatatacaatacatagttaagtacttagaaaatatgttttcagttacttcgggtatatacctgggaagggaggcagaaaattttggtcattctgattattattactactgttaagcatagaagcaccactaaaaaggtgaagaagcctggaaataaccctatactgaggaatatgccaaaccattgaatcctggaaaaaagaaaacaaaaggcccacataactatcttcagattcttgaagggctacgtgtaagagaagcagaaggcttgttcttttttgttctagagggtagagataacctggaaattgtagagagacaaagtttgttcttttcaaagttaagacataatttatgtatcataaaatttacccttttaaagtgtttaatttagtagacttcagtatttccagagttatgagaccaccaccattatctaatttcgaaacatttttatcaccctgaaagaaattctctactgcttagtagtcactgtctatttccctttctttacagctcctggcaacactaatctactttctatctctacggatttgcatattctggacatttcatataaatggaattatataatatgtggccttttgtgtgtggcttctttcacttagcatgttttcaaggttcatccatgttgtagcatgtatcagaatgtcattccttttcatggccacatatttcatttatggatataccacattttatttatctgttcatccgcttataggcatttgggttgtttctactttttagctattatgaataatgctgctatgaacatttttattatctgggcatatgttttcagttatctcgggtatatacctaggaagggaggcagaatttgaagaattaagaaagagctttctcacagtggaatccacccacattgaagactgttcttttgttgaagtagtcagccagtaatttcacttaacaaatgcatagtgtttactatgtgctggatagtgttctaagtgctttacccttatttaaaaatcctatgaagtaggcactgttattacatctcttttacgacagggaagtttagtaccttgcccaagattacacattgagtaaatggtggagttgggattgaaatccaggtggtctggttccagagtctgtactcttaagagcagaacaataataactccaagcatttattaaattctcaagatttatccggcaccatgctacatgcttgtattcaagcagaggctggtgatcatcttttagaaatattttagaaatgattacttaattggatagaaattaaatttcttgaatctgaaggttctgttattccaaggatggctggaaatgggggaaaagccagcaacaagatgatgtctggcctgaggcttttaagatgatcagaatttgtatcaaaaaggaaactgtgaacacgaatgataagtattataggaattcagttaacaagtcttgtcagaatgtggtaataaattatatacaacttaaagagatgaagttactttaaattgtgtgtggaagccttagaaaaattgaataattaaagtttcttgggaagatgatctccttttacaaatgtttagtttcaaatagtggcagcacatattaggatagagagatgacttctagaaaactgaacatatgggactggaacagtgtattttggagtcagttacaggaaggaagttgtttaaaaccaagtgaacaacaacagtaacaaatgcatttgagagaaagagcagtgcagtccagacttaaacattagggtggccataatagatggggaagaaggagaaatcagcaatccagactaagacttcactgggttttgagttagacagagggaggcatagaagccaaggtaaaatgattaaaacggtacatggagtggttagcaattctccctataggagagagaatttccttatgaagtttcagatgagaccactgaacttgactagaggaaagtcattgtttttagaaaacagtttctaaacaataattagaattaaagttttgttgcagagggataagtaagaagtagatggaaaagaaagaggaatatctgaaattaggctacagtcatagaaggttagctgtgaaacaataatttggaaagggaaatgggacctcatgaaagtgtgggttaaaagagacttgtatatcttctaaggtaaaagtaaagaactaagctgatgtccagccctctaaaacattttaaatagaaatcaaactttattaatacagtaggtctagtttcacgtaaagcaaatatatggttctgtacacgggctttaggagagtaagtctgttgtacctcatatgtaagtattatcccatttagaggaaaaccctaagtctttctttacagtggcttaaaggccccaattgatccacatcccagttacagctctcatctattttctgctgctccagatattcttgctgtttctcaaacacgctagggctgctctctgtgttatggcctttgcatttgctgttccctttctcatgaatgtgttttcctaagatacctgcatgattactctcaccttatttaggtctcaactcaagtattgtcagtgaaggtcttctctgattttcctattctaaactgagatacttctctttgctcaccccacaccctcatccccagctccattccttcctgtttaattttttttcacagcacttaactccatctattgtgcatcttttacttagtaattttgttttcgtcttccgctattagaatgtaaactccaagagtgtaagaatttttctagcactggaaaaatgcctggcacataataggcatttactaattgttgtgtgaatgaacgattataagtttaatattctttgtggaaactaataaggttgatttcctatcagaaaccgatcattattaataagcatattggatggtatttatagaattagccttcatatgttctctactcagaagttggcaaactttttctgtaaagtgccagagagtaattatttttgcaggctttgtggtctcattacagctacttgactctgttgttgtagtggaaaatcagccatagacaatctataaatgaatgagcatggctgtgttccagtaagactatttatggacactgaaatttgaattgtatataattttgaaatgtcagaaaatatccttcttttgttctttttttctaatcatttaaaaatgtaaaaaactattcacaggccaaacaaaaacaggcagtggtccaaattagacttgcaaactgtactttgtcaatctctggttttactgatttcttaaatatatcttaggttaaaacttatttttccatacttgatagggagcaacaatgtgaattaaactgtagaaacaaataattcagaaatacatctgtttagctttagaaacttccattttgcttcatttttgttttcctgggaaccttatatttccattatatgtttatgatgctaccatttaaatgactttgcattctcttagcatatgccacatgatagtgttagggtggtgtaatagttcaggagcaaagctgagcaaagcccacccacgtttaaaaatttgccattatttagaaggtgcataattcccatatgggagaatgaagagtcatctaataatgcccagagggctgcactgtgagtgagaattgtgttgcagtttttaacattcataacacatttcttgaataagctgcaaatgcttttaataatatatctcagagttaattttagctatgctacattggcactttttgctcctccacttcaaaaaaccaacacaagaaactattctcaaatcaagctgtgatttggatggggcattgtattttcctcaataagcacaaagaagagagaaaagatgttttcacttggcaaaacttttttttttgagatggaatctcactctgttgcccaggctggagtgtagtggcacaatctcgtcggctcactgcaacctccgcctcccgggttcaagcaattctcatgcctcagcctcccgagtagctgggattacaagcgtgcaccaccaccctggctaatttttgtatttttagtagagccagggtttcaccttgttggccgggctattctcaaactcctgacctcagatggtcctcacacctcagcctcccaaagtgctggaattacaggtgtgagccactgtgcccagcccacttgcaaaactttttaacatttataaggttttttacatacttgattttgttcagttcttagaataatctcatgatgtaggtgaccttattaactatttacaatgtgagaaaatggatagtcaatgaagataagtaacttgtccaaggtcacagcaccagaactccaaaccagaccttctgaccttcttgatacagactcctcacagtcacctgcatgccatctttggtttcagtgctatgaactttcttcactgcctgttggtctgtagctacacctactcatgaagatgcccagagccttagccgctccttgctctgccatgcttatcttatgcagctctgggaggggtgaagaggctgtggccagttacctcactaccactatagctattcaccaccctgttttctcctttagccattttagctactacacaattcttctgggcattttctgtcttagttccctagtatctggccttccctcttttctcagtaactgtgacccctgctagctagccttgccaaccaatggttaatgaaaggtcttggatatgactgtcaaagacaaaagcactcatgaccccaatgtttcaggtcacaatgattaggaaaatcaggacaacaaggcttgggcacagaaaagctggtttttgagagggggatttagagtttggtttaaatgtgtaatctttgaggtaatggtggaacagcctactagattcagttttctagtccctgaaaactaaaacgaggaataagttgaatcacatatttggggcaccagccaaatatatagcagcatttatagttagaatcaaagtgtttgtgtttcttaatttaaatgcttctcagagattccatttaaacaacttcattatgaaaatggagacttaccatgcctttttgatattgttcagagaaaattgtcataaataatacacacagtttgaaatggttgtacatcttatgaatcaaggggtggcatgtaaaaaggttcctcagtgcctcaatgtggaaaatatcatagaatgttattcttcaattgattccttccttgactttggtgtttatatggtatcttagatattttatgttattttaattatattttgtgtctttttatttggttaaaaatgcctacttaaatattaacagatttttaaatatccctttgaactcttccccattcctgtacctcctttccctttttccgttgtaatgtcagccacctgaacataacccagaaaactaggtatcatccaattgatgtttcagtggaaataagagaaagaagcacttactatttctcaatgcttaattgaggaaaagcacatgatatcttacatattttaaattggaggggataatagggtcaagttcatgcattatattgtggacatcttaatcctatcaaatggcttagtcaaaatgagaaagttaatgaatttaagcagacaagtacgaacagtgctctaaaaaaggtgctgttacaccatcccaacctgtacacacatgaaaaaaagctggggtgcattttgcgtttgaataagggtcatgttgactggccatggcagaccctgctagaccatacagctgatactctgtcacctgccaggactcaaaaggacatgggagtatgtggttaagttctctaaggactctttcttctaaagggaagcagttttataggtggtccttgtaggtctgttgattcacaatctcgtgctttcttgattggactgtattgttttactgtaattttttggacttacaagaagtcaggtgttttcatggactcttctcttttccatacagatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcgacatctcatccatgctttgtgtctcgaccttgcctgaatggcggcacatgccatatgctcagccgggatacctatgagtgcacctgtcaagtcgggtttacaggtaactaatgagaccaaagccagtgctttcctaccttcagcagatacctttatttagcatcttttagatcatggtgtctggctcttaaatgtcccccagctctggtgcacatttaacattatgataaggaactgggatgttccagacaactatccctaacttccttttaagagtttcagggggcagagaaagagaaagaaaaaggaccaaatactttgactgcttaaagtatatatgtcagggccaggtgcggtggcgcacgcttgcaatcccagcattttggcaggccaaggcaggaggatcacttgaggctagaggtttgagaccagcctgggaaacatagcaagaccccatctctacaaaaaaacaagaataaaaataaaacaaaattagtcatgtgtggtggtgtgcacctgtagtcctaactacttgggaggctgaagtggaagaattgcttgagcccaggagtttgaggctgcagtgagctatgatcgcaccactgcactctagcctgggtgacagagtgagaccctgtctcaaaaaaaaaaatatgtacaccaggatggggaatcagagtttacttcactaaaagaaataagtacactgtcaccagaggaaaagttgctgatgttattgactatttgcttttagaaatctccctccctagacattcagggcactggcttttctggttttctgaaccctgttccttttgcttcttcattaccttgttcttatccattaaatgtttgtgctccctggagcactgttttgcgccctcttttgagccacatcacagctctccctagggaatttcactgtctgtattcgcctccactgccactgtcttcattagcttgctgatgaatctcaccatcattcccttagctccacccaaccctgacattcaggctcatgtttctagttatcctttgtatgttctccttggagatattctacaggtactttcagctcaccttgttgacagaaatacgtagcaaccatgtacatcccaaatacccacgctagaaactccctgtcccttgttctgacctcatttcaactcagtcacccaagccaacctctgagttgcctttcacctgtctattcctcccatttcctctgctaccctgtagttgaaggccatgttatctctcacctgggcttctgaagtagtttctgaatacgttttcttgcctttattctctccccatctcattcacccatgatattactacatctttgattataaatgcaaatattctaacaatctcacctgcttacaatgtctaatattttttcatcatccgcagaataaactgcaaactcttttacatgacttccatagctctctacagcctagactttacatctttttatagcctggcctccccacaagcatctaggcctagtcacaccaaattctccttatttcctgaaaatgttgtacttattattgcttccatacagttacacacccttttgcctggaatgcccttttctacaactggtgattgtccaatgttatttaaaactgtgtctcagtgaccctttcatgattcctttaggcaaatggtctctaagttttattagttttatgtatcacattttattgtaattttttttacacatatctcacctgaatagattgtgggtttttctaggtgggtctgagctttattcaaaagtgtttattaaattagatgagaaaaggaggaacattcttcattttttctcctgctttaagcactaaaccaagagttctataaatgcaataagcaaaaaagtgaaaaatgtactcagaagactatactggatcagttagtgtagaatactgttatattaatttttcattgtattagggttctctagagggatggaactaatggaatatatatgtatgtatatatattccaacccaaagtgtcttggtggcaatcttaatatatatatattggcaatctttatatatatataaaggagagtttgttaagtattaattcacatgatcacaaggtcccacaataggctgtctgcaggctgaggagcaaggagagccagtctgagttccaaaaccgaagaacttggggttcgatatttgagggcaggaaacatccagcacgggaaaaagatgtaggctgggaggctaggccagtctcgctttttcatgtttttctgcctgctttatatttgctgacagatgatcaaatggtgtccatccagattaagggtggatctgccttccccagcccactgactcaaatgttaatctcctttggcaacaccttcacagacacacccaagatcaatattttgtatccttcaattcaatcaagttgacacactcagttttaaccaccacaaatctaccccttgtcaacttgaacccgtacacatctcctgagatcacacataatcttcaaataaagacaataattaggtcataattacacctgatgtagtacaactattcttcatacatccggaaacacactagtccccaactgaaacactcttacataaagttaacgatacttaaatgctgatgtgaagtcaataaatcttatgtcacatgataaaggagaaaggaaataaaatgaagatattttcttagtacaagtgtgtgcaagcacagacatgtttttaataaaagaaggaggaaatactgaggacaattacagtcctcatttctgcagctggtcacatggtagtagctggtattgatgactaccttcttctacccattttgtattccttttgccttcagcaaacacctcagcaggttgtgtttttttttttcctgatggagaggcccaaaccatttgtagtcccgcctggattgggctgttgtagttgcccattgaccttaatcacagggcatggtaatactaagagacgccctaatggatctcctgtattccatgaatactctttcttacctccgttctggagtagtagactgatttcatcttgatagcctgggtcttgatagccttgatgtcccagccaacactgtaacgcctttcttagcctgtttacttaaaggtaggaacccaaagtgtcctggtggcaatcttaactaccagtttaatggaattgttgttgtgtcttctgatggcagcgttcctccctctggaactaagacctctaggccagcagaacttaatgttgcgggaacaggaagcaaacattttgctagtggatcactaggggtgatggtgagtggtaccacttccatttccaccccttgattcctggacctgtgaatcctggctatgggagaaacagtaccacatattggacgctgattcagagcatacacagccttcttgagaactttgccccaaccctgcaaagtattctcacctagttggcattgtaattgtgactgcaaaaggccattccaccgttctgcttcaggatgttggggaacatggtaagaccagtgaattccatgagcatgagcccactgctgcacttctttagccataaagtgaatgccttggtcagaggcaatgctgtgtggaataccatgacagtggataaggcattccatgagtccgcggatggtagtcttggcagaaccattgcatgcaggataggcaaacccatatccagagtaagtgtttattccagtaaggacaaacatctgcccttttcacaatggaagaagtccaacataatcaacctgccaccaagtagctggctgatcaccctgaggaatagtgccatatcaaaggcgcagtgttggtttctgctgctggcaaattgggcactctgcggtggcagtagccaggtcagctttccaccggcccatcttgttttctgcactgggaaggtggggcatgagcacaaatgttaggacctgaaaggtggtgaactctgcctgggcagggcaaagccagaggaaactctggtggaggtccgtagcagtcctgatgtgcaaatcggtcatccaacctgggtgtaggggcgaaagactaattgaaccatctagtagctggttccctccaaagtttccctcgggatagctggcactctcgcaaaaaccccactcttggtaccaatttactgtattagtccattttcacgctgctgataaagatatccccgagaccgggaagaaaagaggtttaattggacttacagttccatatggctggggaggcctcagaattatggtgggaggcaaaaggcacttctttcatggtggtggcaagagaaaattaggaagaagcaaaagcagaacccctgagaaacccatcagatctcatgagacttattcactctcatgagaatagcacaggaaagactggcccccatgatacagttaccccactgggtccctcccacaacacatgggaattctgggagatacaattcaagttgagatttgggtggggacactaccaaaccatatcattcatcaaaaggtgttggtggggtagagggtagttaggatgatccatgatctccatcatgatgatgatggtattgatgatgtaagtcactgaaaatatttggtgttataagaataatttcttcctgattgtcagttttgagttgttttgctattaggaggcaaagtaggggggcatatacccacttaaaatattttaattctggctagtggaaatgacagtaatgccttcttcataattaaaatgtcactctgaaatggtcccaaattaaaacttcttcctttgttgttaagaaggatctcttcttggtgtgttctgcaagattctgatcaccttttttttttttttttttttttttttttttgagatggagtattgctttgtcatccaggctggagtgcagggtgcaatctcggttcactgcaagctccacctcccgggttcacgccattcttctgcctcagcctcctgagtagctgggactacaggcacctaccgccatgcccggctaatttttgtatttttagtagagatgggctttcaccttgttagccagaatggtctggatcgcctgacctcatgatccacccgcctcggcctcccaaagtgctgggattacaggtgtgagccaccacacccggccgattctgatcatcttttatacatatgctatttttgtctatcactttaggaatcatcacagatcaaggtcatccttttggtttttgtgatagcgctatacctcagtcagcttactagctcatctccactcagagatgaagaagcataggcagcaagttagtgcctatacataatatatatggaaaccaaattcagggttgattctttctttctttctcccttcctttctttctttctttctctttctttctttctttctttctttctttctttctttctttctttctctctctttctctcttcctctctctttccctctctctttctgtctttcttctcactctgttgcttagtacagtggcgcagtctcggctcactgcaacctccacctcttgggttcgagtgattcttgtgcctcagcctcccaggtagctgggattacaggcatgcgctatgaagcccggctaatttttgtatttttagaaaagatggcgtttcaccgtgttggccaggctggtctcaaactcctaaccacaagtgatctgcccacctcagcctcccaaagtgctgggattacaggcatcagccaccacttccggcccggggatctttctgtttcagttgtgggcatcactctgaaaatcacacttgctagaagtgagcatttatatctcttctccactgtaaataagtgcctcttagtgacatgagtggaaagacaagaagaattgcagttccttcattttctgtcttagctccctgagatgtatatgctgtgcctaaatttgtgttatagttttctcctttgatttgacattccttgataggcagagagcacttttctgtgctcatatgtcacatctcgcatctttttcccttatagaaaaactcttgtgtctcccatttacctttctatgaggtcagagatttagatactttcctagacaatcaactggagtattaacaaattcaaggagttctcgccatcccattactgggtatatacccaaagaattataaatcgtgctgctataaagacacatgcacacgtatgtttattgcggcactattcacaatagcaaagacttggaaccaacccaaatgtccatcaatgatagactggattaagaaaatgtggcacatatacaccatggaatactattcagccataaaaaaggatgagttcatgtcctttgtagggacatggatgaagctggaaaccatcattctcagcaaactattgcaaggacaaaaaactaaacaccgcatgttctcactcataggtgggaattgaacaatgagaacacttggacacaggaaggggaacatcacaaaccggggcctgtcgtggggtggtgggacgggggagggatagcattaggagatgtacctaatgtaaatgacgagttaatgggtgcagcacaccaacatggcacatatatacatatgtaacaaacctgcatgttgtgcacgtgtaccctagaacttaaagtataataataataataataaaaattcaaggagttcttatctctgtagtttaaataataagcaacttagactaatgacaacaaaaagccagccatgtgaataccaaatttactagttctgtgaggatatttttttctctttctctttctgcctcaaagaatctgctttgcttcccctggcatcatgatttagttttcaacccgtcagagtcttcctgctagtgctggtactttcctacttgagaaagtccacggaataccttcgagacctctgtcctcctgatggcttctatttcatttgttatatagggacccagaggtccttcatcattttcaaacacatcaacagatatttatagcaaggccacaattaataaaatgtttcccagaatatatgtgtgtgttacatttagaggaaacagaagtagtattgacttgtttctatcaccagaggtctatttagtaactatattttgtggaaaatatcgatatattttatccattcaacagacatgatttgagagcataccacggagacccaaccctgccagtgtggcaggtggtataatagaagaaaatagcaaacttggtgtatctgtgtttgcgcacatgtatgtatgtgaggggcactaaggatgactttacagaggttggaacttttgagtagagttgccaagatagggagagttcactaggaaaacagaagggaagttgatttttttttttttttgaaatggagtcttgctgtgtcgcccaggctggagtgcagtggtacaatctcggctcactgcaacctccgcctcctgggttcaagtgattcttctgcctcagccttccaagtagctgggattacaggtgcgcgccaccatgcccagctaatttttgtatttttagtagagacagggtttcaccatattggccgggctggtcttgaactccttacctcatgatctgcctgcctcggccttccaaagtgctggaattacaggtgtgagccactgctcctggcccggaagttgatattcaaacaggagcagcatatgcaaagacagtgagctctgagagagtagatggatccagactcctattgctgatagcgtcctgcaggattgggcttcaatgtgactaacctacaattgcctccaggtgctccacccactgagtccttgtgtctctgctgaggtccttggagagttactggagagggctctgtgtcagatgaccttgaggaggctctgatttagccttttgtaaaatgcaaagagttgaggtcttctccacgcaagagctcgctgatgtcaatgaggtattgaggatggggccatctcctatttctgtggccagtactgagttttgttatccttcctttaggtaaggagtgccaatggaccgatgcctgcctgtctcatccctgtgcaaatggaagtacctgtaccactgtggccaaccagttctcctgcaaatgcctcacaggcttcacagggcagaagtgtgagactgatgtcaatgagtgtgacattccaggacactgccagcatggtggcacctgcctcaacctgcctggttcctaccagtgccagtgccttcagggcttcacaggccagtactgtgacagcctgtatgtgccctgtgcaccctcgccttgtgtcaatggaggcacctgtcggcagactggtgacttcacttttgagtgcaactgccttccaggtaaggagctccctagtgtcccaggattaggggacaaacccctagcacaggaggtagtgggtgtggctcaattgctttttttaggaagcgcaaggaaaaagggaagtgagaattttgtgtggggtgggttgctagtgagggaggagttttatgggcccactgtggtccataaactgagcaggggataatttagcatgtcagggtttatgatgatgagtggctagaaaattgtttattgtcccttttgtagaaacagtgagaagaggaacagagctctgggaaagagacagggaagtctggaatggaaaagaacacgatgagaattagacactggaaaatatgtatgtgtggttaataaagtgctttaaactgaattgacattaacagtgggtgatcaactttactatgtgcttgtgcttttgcttttgatggagtaattcattgttttcttatccacctaaatgcacccagctgcccttgattttctctgggctactggccttcacaaccctctcccatgtaccctctctgactttggggtaaccctcccctaacttaaagctagagaattctgaaactgaggaggggatcctctgttaatcagtgagcactttttgatgagctgatagatgatatatgagagactatgcgtggcacaatactttgttacactcttcactgatacaagtgttctagagtgtacacacaacccaaagatagaaataaaaagaggagcagtgtcggggagcttggggcctggtgttccatggagagggagaaaggaacaagcttgaccaattcattcaactccttataaaaatgatgaggaggctgaaaaccaagaattttgattgggaacagaatacaagcagctgaatcagatgaattactaagcaacaaagatcctgtttttatacaaatatccttagtacaaaaacaaaagaaggaaaactgtaggggggagtaatgtgctaagtaagcagaattgcctcaaaaagaagttgttctagttactctttcagagtgggaatcttagattctggtattgtggatatggttcacatataatgggattgtgtgttttattttggagggattaaaggtcatagtttggtcctcagtataaaatcaactggtaatttattcatttcatttggtaaaaatgtattgactgcctgctatgttctaggcaccatgctatgtatttggaatacagctatacaaagcattgtcacataattgaaatgaaaattttatattatttaagtcacaagaacaagctatttaattatattacttttagtttctcttttaataaagaatagataatgctatcattctagatactaaataagtattttcttaacataatattactatccactttatcttgtagaagaaataactaaaatacatctgtcttcactcctgtatttgtttgcattttaaggattaaagacagaaatagaaatgtaaacaactttattttgaaaatatttcaacactgcaaatatctctgggtctgatattctagtaatctaattggctagtaattgatgttagtgtgatttattgttgaaggctaaatgtgtttttcagtttcaagaaaattgcttttaataattgcctagaacaagaggttgatttggcagcaagatgttgacgggaagttagagaagtcaataaaggaagtttttagctgagagagagtgattattcactcccatagcctctgcattgttatccattagccacgataagaaccttagggaattctgagagtgtgtccaggaaaggatctgtcaaactagaatagtatctcctccttgagaaaggaaataaccaaggattccgcagctgagaggctgccagggctagtgaaatagagtaaggaaatcttggctgtctcttattctctggttgtagtttaacgcaagacacttatttactcactgatggtgtgtgtgtgtgtgggaggggagattagcatgaggggtgggaatggggagattcgatgaagagaaaactaacatttttttggtgactcaggaactgtgccaggtacttccatgcttattagctcaattacacaaaaatcttgggaccaggtattatttttcaagtcttcccacatgaagtaactgaagtttggagatgttaagtgattcacccaaagttgtacagctaatatgtggttaggctgggtcctgaaaccgaggcagtttattttcaaagcctttgctttgtgcatcttactgcgccacattgcactgcacatctgcttcctgaaagcactttgtaggtgtgtaaaacttttcgttaaatgctttaagctgtttgggttaaaaatatatgttcatgttataagaaaaccaagacactcctaattataatcaaatagtacttgttacatatcaatatgtgtgtgtgtgtgtgtgtgtgtgtgtgtgtgtgtgtgtgtgtgtgtatggcgttgtgcagatgtttaaaagtagttacatagactagttcttgcttttcagggtcccataatctaaaccagatgacttcagctttggataaatatatagaaggaaatttaaagagaattcaaaacaatagatgatgcagtgacactgtgaataaatgttatttatacagtttgtaagatttcatgctcattgttcatatgtcccaggtggagttcagaaaatattctcttcatttccacaaaggggaatagtgcctggagatggttttcttttaaaaagtccttttcataatgcagtgcccttccttccattgcccttcattccattgcttcccatgcttgtcaagagactaaaatgttacttatagtaatagtcactatctcaatgtaaatagcacccttatttgatgagaattattatttcagttctaaaaatggggaaacaaagtcagcaggaggcaaagtagcttgttaaagtattctgcaactttcaaatggttgcttccactgcatttcacgtcttggcacttctaattgagggttactctaaccaccctatttaaaattgtaactgtcccccacccccttaattactaaccctggtctactttttgttttctttttctgtaactcttatcttcttactatataatttatactatataatttacttcattatgtctattgttcattgtctgtcttttccaaattctactgcctcttaccctctccagaatgaaaactagtatctttgtttttgtttactgatgtaacccaaacacctacaaacagtgcccagtatatactaggcccacaaatatatattggctgactgactgtatggtttagtatcatgtcatagtattgagactgtaactttggtcttctcattttcttctttgtattgtgcgtcctagacttagtttggcctctccttttgtccttgtatactctaatactggataagaattttggagtctttttcaactctgagtcagtgaatgccacataacttagtgactatatttaaatggttaatttacaattttttccctgcaaaggatactgtagtcactgtgagtattttagtattattgtaggactcaagagggaattaaaactacaaaaatgactcctcttgtatgacacagaaagaaatgtttcttcacagagggaggagaaaaatatcttcaagagagaactaatagaatcaaatcaatgaaccatgtctcatctttttggataagtaactgttagtaatccagacacttcatgagctttcattatgtaaagtctttagcagaagctaaaggaggggcaccaaccacagtaattttaacttaagaacaaaatggagcatgaaaataaattattaaatcatttactcccactatttttgggttagggccaataatggggagagaaagaggtagactagttttgtgtttgtggctattttaatagagtagcacaagtaatcaaaaaacagtaggctgttttgaatttactggctgtcccttatgagttcacagttagattggactgtcctcaatgtactttcttttttttctttctttcccacatctctttatttctctgattttgtttaaacttcataaagagctctctgatctttcctttccaaacaatgaaggtttatcctttgtaaactacctctgtactccacaggctgatgatatgtgatatccctatatcattaaagtaaagcctaagcacattctatggcttttgtgtctactctgttgttgctgagcttatgaactattagaaataactccctcttgcattttcacacatggggaatgtgatgttctcttgggtattatgctaatcatattttggcaggtttctctggagcagatgcagaaatgatcataccactttccagggtgtattattttagctcctttgacttgggccctaagtctgttttacctgatgttcctgaaagatgttcctgatgtccttcactgttctttcatgctggatgttcttgcctatgctgcctcctcagctatcaccctctcttcccctttttaatgtagaactcattcttaatgatttgtcaaaggcaccctatttcactgaaatgccttctatattccctaccctccaagtggattgtagaccttctaaggtcttttgacatctgcatatctctagcacagcacttatcacggtgattatttatctgttcatctttccaagtagacactctcattttaactccctaccctagtcgccagcatccccagcatagtgcctgtcataaaatggtgccacaatgaaaatttgaaaaatgaatgaacgtgataaacatagatgagaatcctatattctacaattttttaaatgtactgaaattattctttttgaatcctcctatttatttctgtgacttctttgatgacaaagttagaaaaaagtggaggtcagtagggagatatgaagggacgcaggtggaagcagtgagcctgggcgggtgatggagtgggagatacgtggcacaggggtcagtgagttaatctgggctcattcagagaatggaaggtgtgtgccaagaaaactggttggatagggataggtcagggattccctcttgcattctcacacttgggggcatgtgtcattttcttttcttttcttttttttttttttttttttgagacggagcatcgctctttctcccaggctggagtgcaatggtgctatctcggctcactgcaacctccacctcccgggttcaagctattctcatgtctcagccttccaagtagctgggactacaggtgcctgccaccatgctcagctaatttttgtatttttagtagagatggggtttcaccatgttggtcacgttggcctcgaactcctgatctcaggtgatccacctgcctcggcttctcaaagtgctgggattccaggcatgagccaccatgcctggccgcatgtgtcattttcttgggtgttatactgatcgtatatttgcaggtttgcttttgtgacagacttcttctgggggaaaaaaagtatccttctatctttttacttttgtccagttccaggtatccctgtttttttcttcactcttccttccttgttcatgggagtttttcttgaggacttcaagcccagcttcggagaatcctggttgtgtcatctcatctcctttctgctctcttctctacctagcctttccaccctcacacctcccggggtctgaaaatggaaagataagggtgtttccctgaaagttgctcttctgtgtggggatgacaggttctaaagactcttttctggtccctgccctcattgccatgattaatcagttaagtggcccgaggttttataacagcacagtcttaaaatgcttctcccaagtttaatttctctccatttgaccttttaaggatgtgaattggctttaagcagtagactccctttagtacggtgctgtgagcctctcagtgaatctgctacatccattccacccacgggtctggaaacttgtctgtttacctttccctaaaaacctaagatatatttttaagaagtgccttgtaacttttcatatagcctttcccctactttgggtagactgtttcttacaggaatttggtagatctttccaaagagaattctgtatctgtatttttaaagcataaatcctgtcaactttggaggagaactgatttggcttgagttttctcagacatgggaacttttgacctaagtttgtattttacattgttgaaagggaactccgggatcccagaaaacatatggactgcaattgggtaaagtttctgttccagaaatgcctcttctggacatttcatacaaatggaaacatgcagcatgtagtaatttatgacagcttctttcacttagcatgaggttttcaaagttcattgatgtggtagcatttgtcagtactctgtgcctttttatggctgaataatattttatcatatggatttaccacattttatcattttatttatccatcatcagttgattgacatttgagttgcttctactttttgagtattatcaataattctgttatgaacattcttgtataattttttggtagacatttatcttcatatttcttggatatatacctaggagcagaattgctgcgtcagatggtaatgctgtttaaccttttcaggaactgtcagactgttctgaagtgggtacattattttacattccaaccagcagtgtatgagaattccagtttctccacatcctcatcaacagttgttattgtctgtcttttttattatattcatctgtaatgtgaagtgtttatctcattgtggttttgatttacatttccctgatggttgatgattttcaacatcttttcatatacttattagtcattatgtatcttctttggagaatgtctgttcagatcctttacctactttataattggtttatctttttaatattgaactgtaatagtttttaaaaaatatatcctaaatacaagtctcttatcagataatatgatttgcagatattttctgtcattctatgtactgtcttttcacattcttgatgatatacttttcagcccaaatgtttttaacttgatggaatacaatttattttttcttttgttgcttgtgctttcagtcatatttgtgaaaactttgcttatcccacattacaaagatttactatttctaagtgatttataattttaccacctacctttaggtctctgatccattttgagttaatttttatgtgcgaggagggagtctaacttgattcttttacatgtggatatttagttgtcccaggaccatttgttgaattaagtgcccagaacaagtacatctatatatagagaaagtagattagtggttgtcagagactgtaagaagtggggaattggagagtgactgcccataggtacaggcatgctttttggcattatgaaaatattctggaattaggtagtggtgatggttgcagaacttttggaatatggtaaaagacactgaaatatatgcttaaaaatggtgatttttgtgatatatgaattatactatagaactaataataacagtaataaagcaaggtgtctttccacatctccatgccttgtattttcattaaaaaaaaaaaaaaaaaagcatttcagggccaggctcagtggtttactcttgtaatcccagcacttttggaggcctaggtgggaggatcacttgaggccagaagttcaaaaccagcctgagcaacatagcaagaccttgtctccatgaaaaataaaaaattagccagaaatggtgatgtgtgcctagagttccaactacttggaaagctgaggcaagaggatcgcttgagcctaggagttcaaggttgcagtgatctataatcaccactgcactccagcctgggtgacagaacaagaccctgtctcaaaaaaaaaaaaaaaaaaaaaaaaaaggcatctcactttaatagtaagaggccagaatatgatgctggcagcatgttgtgaggaaatgtattagatgaaagaagttaaattccagttctccttttttcagaaatgaggtataggggagagaaacacgtactttgaaagaattgacccagctgaattggaaaatgtgggaaggggatggggaagaggctgctccacctgagatctggctccaggacttacagcaaggggaacttgggcaagttacagactgtctatgcctcagtttctttatcagcaaaacagaatcatcccataaactataaggtcgatggtatcagcgggtccccaaactgactgcacatctgagtcatgttaacaaacacattccaggccccacctgagccctctgaatcagaatccctgtaaggaggatgatgaacttgaatttgcactgactttcccagctgtttcttactctgatcaacttgggggtaggacccattgagctgcatcacatcattccaaagccaaaacacaacagcaggacaagaatattttcaaggcagtctctaaagcagaggagaaactgttgagggaacttagaagtaaaggagatctggcttgctgggctccatttgaactttgagtacaacagagacatgagcccttcgggacacatgcctgaggtagtgacaatccaactttggaagagtggaagccctagtttcaaattcaagcatgctttgagtataaattaagtttacctctttttgcacagcaacatggccaatctttcctaagctgctcagcttacaagaaaaggaatcatactgctaagaattcaaacttcagcagtcataggtaagtaaggaagtcttataaacctattctagccacctaaccagaaactcgaaatttagcaggttctttcagtttcaggacagttgtgttcactagatcagaggcattgagacatgaagaacagacccttaaaaagggaaagtgttcccttcagtttgaggacatcactggaacattagggaagtgggaacacagctgctcactctacagtgtgggttgcctttgtgtctggaatgtgtctgacgtcctgatccctgtgcacatttcagggagccttgggaggaccccgaatcactgatggaattgcgcagtgcatggagatggctcagcaggatgagggtaaatgcaggggcaagtccaggccatactgagagacaatgagtggcgctgatgaggacaaagataaaatcaaaagtttgtgcttcatcttcaaaaactcaagctgataacaaacttggcctgatgagaaataataagtatttttctatttacatgagaatttaatctcaaaacagaaatcagaaaaatatgaagtccagggcataaaacctaaaactattgctcatatttattctttctaaatagagcaaagtgtaaaatcttctccataagacatacattgtggttataaaaaggcaaaagtcttagtgagaatcattggtattccatagaagagtgaattaaacacagccaagggaagacccacgtctcatacttctcttgtatattccaaagttccagggaaattccaggtgatagaggttatttcccatactgttaaagcaaggtttcagacacttctgaattttggtcccagtactctagaagggcacacctctgtcctggaaaataatacaggaatgaatactcttcccgtgacccattctggtcattcttccagcatcacaaaaaccaaaaaatggaaatatggccaaatacgtgattagctgtccctcatcttcaggtttcttatctgttacttatagataatagcattaccttaaggattatgatgaagatacaatgtccaaatataaacacagttttgagcaaaatgccttgtacgaattggtcaatgaataattactaaatatgtgaatatttctggattgtatggatcctatgaataattactgaataattattgtgattgcttttattggcagtgctgaaaactcatccctttgtgacctcaagtaacccatgacactttgtgaacctgcagttttttcatttagaaacttgacagattttcattctgacacagaatgtcaggtctcccagaccctagaaaatacattgacttaaagcctttgatacatctcaaagcagtatccttacagtgtcactggaagatggtgcgggctgcagagagggatgctttcaaatgggattaacca

SEQ ID NO: 2424 - DNA, 180596 bp, Homo sapiens
agctgggactagaggtgcacgctgccatgaccagctagctaatttcggtatttttggtagagatgggagttttgccttgttggccaggctggtctcgaattcctggcctcaagtgatccacccatcttggcctcccaaaatgctgggatttatacgtgtgagacacagtacctggccgagacttcagttcagttttatattggtattttggaaaactccctattacatacttgctttacctgaggtttaagaatggaatgaaactgggaatgtatattagagaaaataaggtaaagtttctcagctttttaatgatcatgagcccttttgccatgttaggctgtaataatgctagagtgttaccagcatccttttaaggaatgtgtagaggtaagtaacacttagcctaagggtcctcagaatactgtttgaaaatttctgttttcaggaaaggcttactatagtgggtcttaattcctctaaggattctgatagcagccttagatagcaaatacttctaatttaaaggtattcaaaggacatttctcctgaatggtcgtctaattatacctttacatcttacaaatgaaataatcaaagcctagattttgatattcaaccaagagtttggttaaccatggacagtggcaaatccaggaataaagtcagaactgttttggtttttttgtttttgtttttgagacagagtcttgctctgtcacccaggctaaagtgtggtggtgtgatctcagctcagtgcaacctctgcctcccaagttcaagtgattctcctggctcagcctcctgagtagctgggattataggcgtgtgccgccacgcctggctaactttttatatttttagtagagacggggtttcactgtgttagccaggatggtctcgatttcctgacctcatgattcacctgccttggcctcccaaagtgctgggattacaggtgtgagccaccgtgcctggccaactcagaacttttaatttcctacctcagtactttgatggccatgaaagaaatggtcagttttcttcatcattctagatactttcattcagaaaaccaagaagctctacattgacagttgtgctcgaagaaacctaggctccatcaacactgaattgcaagatgtgcagaggatcatggtggccaatatcgaagaagtgttacaacgaggagaagcactctcaggtatctaaaagcaatgagtcttatgaagaaatggttctcattccatagacaaggatagcttattttgcagtgccttttatgctattagattctacctagaactgttaagaatttatctcccagaagtacattacattacaatgcttccaatatattttttttcctagcatgattagtttttgttgagttggaacagtgtaaaggactcatccatattagaagcaatgattatttctaacatattcacaaaattaattaaattatataacttgtataaattaagggaaatgaatgagagaaaactcaacaatgtattgcagtggttttttgagtagcctctttgggagactttactgctgccagatcaatctttataaaatgccattttcatcaaagcattcctctctgaaaaacttttaaatctgggactacaagataagatccagtctgacttatttttccgtcagtcagccattgttattgagagcttgttatttgtaaggcgttgtgctctacatatggaaaataaggaagatgcaaatgtctgtcattctctagttcacaaacattcttctgtagccacaccagcttctttactatccttagtggtccttagaacagaatactgccttatgctggacctgttctgtatgtaagacctccataagaactgtctctttaaagaacctttctctgatccttatagcctgtatcacattaatctcttctgtcctttaaactcctaaagcacttagtaacataatggttttagcacatattacatgtatgtgtgtttacctaatttaccttaaatatatttattaaatacctcttaccatattaaatatatatttaatatatattaaatatatttccatataacataagtatatgtttcatatatttatattaaagtaggcaaacatatttggataattaaatatttttatataatttcatatatttttttgagacagagtcttgttctgttgcccaggctggagtgcaatggcacgatcttggctcactgcaacctccatctcctgggttcaagcgatcttcccaccttatcctcctgagtagctggggctacaggcatgtgccaccacgcctggctaatttttgtattttcttagtagagatggggttttgccatgttgttccggctggtcacaaactccagggctcaagcaatccactcacttcagcttcccaaagtgctgggattacaggcatgagccacaacacccagccctttatataattttaaaagtgtaggtaattaggtaaaattaggttaaaagtatatgtatatttacctgatatttaaatattacctaagtgtttaatgtggacatgtaagctctttaaagatagtgcttatgtattttatatctgtttcacatactccttatatatcccccacagaaatggtcacaaataggttccttaataagtatttttgaattcagccatgctatatattcattagtaagtgagttttcttttattatgaactacaaactttaacctttttttgagtagtgagcagttattcatttaccttcacactctttaaataccaaattttgagtgagtgagtgtgtaaggttttgtcatacagacttgcaattcctatatgggataaagtagactagcacaggaatttttcttgtatcactcatgcaagactctaaattccttaaaggcagggatcatgtatattttgatcactgttgtatcctcagcacttcacatggtgcctgtcacataaatatttgttaaatgacttctccaagcaatagctttgtctttatgttatcctgtatttcaaaacgttcatatataaattctctcaactatgacttgtttcatagggtctaataattgttcctctgctgagttattctcagcagatttagattcatttagcaaatgtttattgagcactaactatataccaggccctgttctgggcattcaggatatagcagcaaacacaataatttaaaatccctgtccagtgaagtgtatattcttgtaggctctgtaaaaagatgccctgtgcattgtcatggttatttctcagtccctgactcttcttccgtcactagatgtttttcttactcatgtgatcagttgctaattcagacgtggctgtcatgcctgtgttattaagtaacgccatgtttcccaatcaaaaccagtctctattaagcaactccaaatattccaaaagcattctttaaggaagaaacagccggattgcaaaatagttttttctgaaatttcaagaagtgaaaagtttgatcagaatttattatgtcaaatggagagtttgtgtttattattaaaatatgccctatattttaatatggtctagcttgtgtctatctggctatttctctaagtgtttagttaactgttataagaagataacaacattacaaatgtccttgggggtgaaaaaacttgccagaaaatactaaaaagcttaatttacttgcgtttttttttgtagtacttattgtattttagttacaactttcctatgtctattgaaatataaatcctgatagctttaacttcatagtagtctctactatgtggagaatcttagaaatgttagcagtcatcattgaagtatagcttaagactgtgtttggttaattgaattttctggttatctgagtttgttttacatggattatcattatcgtttttcaaaatataagagaatatgattcagaccattagaagattatgaagataataattattaacatgtaataattattataatttatcatgtgcaggcattgttgctcactttacaggcaatctcatgtacatacaactttatgacatagttactgttattatccccaattatagatgaagaaactaggttttaaataggttacatgacttgaccaatgtcacataacttgtacaggtgatatctgaaccaaagagtctgaggccagaacctgcacttctaaccaccttactatatagcctcaaaaattcagacataatctgatcagcatcatcagttaattagtatatgcaatgttagcctcaaaataaaaatgatgatttaagattcatggttgttgcagtgctgctcattttggttatttttaatgccttaatactttcggtaaaatacttccagggactaattaatgttttccttttttcctctttgacagcattggattcaaaggctaacaatttgtccagtctgtccaagaaataccgccaggatgcgaagtacttgaacatgcattccacttatgccaaacttgcagcagtagctgtatttttcatcatgttaatagtgtatgtccgattctggtggctgtgaaataatgaatacagtcactggtaagggagaacctagaacccagtaggtgtatattttcaggaaactgagctcacagagatgtgtattagaatccaagtggaacttctgcctctaaagaccttgcaagaaaagagatgtcctgaaaatgaaaggttgcacctcatttaatgaagcttaaccctatgtagaaagtctctttcgggggcagaggctttctctgggtgccaagccatatatattagggaatagtagattgttatttcgttttttccctcccagtgcattttaaaaacagcactggctggggcattctcattctctgatggagccatcaatgagatttaacttagtcaacctgtgctagcaacattctgaaattccttcaaagaaggcagtcctttgggaaggtgtttttttttttgtttttttgtttttttgttttttttgactctaatcaacattccttttgttggtgacatttgtgattttcagtaatctgagtttttgatggccttttaaacaagactccagtatgtgaaagttaattgctgtgctccacagatcttgtctattggcccctgtagaaagttaacctttgttgttttccttttataatttgcttattgcacaattgctttagggtaagtgaattatattaagatgccttgaaattatagcactccttgattaagaagctaaaatgtttctctcatttactccttaaacaaaagacttaaattagtttgggtcattattacttttattttgcagcatttggtttgttattagtgtaagagcaagtataggatatggagaggcccctggcttcatgagaacaaaggcaggcccaggttataattacagctttctcctgccccttctttactttctctaccacagttttctccgctgtttgttttcctcttgccacaatttgctaacacttaaaaaattttcctgcacccagtagtttcatatcctgtagacatcctcttaggacattctcaaatttcaaaataaaaaatattcatctatgtagttaattaaagttaaagtttctgcagatcaactactcaaactactaaatacatttacctgagaaaaagtctctgagagcacttcattcctgttttagttcgtgtaaattctctgagaatgttctggagatagataactcatttacagtggtttctattaactaattaaagtacccatgattttttccttttctgctcagggatgatggagatttccttttaccttttttaatggggtaaattttttaatggggaaaataggccttttaaatattattgccagggtctgcaatataacttaaaattcctgtacatactgcaaatatttctttaaattgcacaggaaaatgagcgaactttttatttcttaatatctttggcaaaaaactttaaccagtaagcaattttataaccctgagggatcatcaaagatactatcctgattcctggtaaggaaaaatatattatttccttataacaaggcaaggagaaatgctattttattcctgataatttatatagctagaataatttttttcctttcttttatggacctaaatctgccaattgggaattttgtgcatgaaatatgaagttactttttatagataatcagtgcttttaagtccctaaaaggctcctgctgaagtaatgatgatgttcataataaaagcctttgaaaggctgaaaacctacatagtggtaccatagtatttggagcttctataggagtggagaggggcagctcattgttgagagttgcatgctgcaacctaatggtcagcaatgaaagaaatacttgtagaatgttcacttcagtgtgaagttttgttatctagttaatttatatacatatatcctttgtagatacatttctatctaatcttgttgagctaattaagaaataaggggtggggtaattgtcaacaaagggagaagaaagtggtttaagatcagggcagcagaaaaattagagaacaagaatatcataatatggctcctggttttctttataagaggcagtgggaagatctgactagatgaaatgtatcatcaaccaaactggcatctaaaatagaatgggataaatactgtatggggttattggaggcatattaagaaaggacacctaatttattttgggaagaagtatgttaagagaagactttctagagaaggagaatggggcattctaggaagagtcaatggcatgtgcaaaggcatgaataaagacagtgaggcatgttttggaaatgtaacagcttgattcagcttagcccatagggtaagcatagacaacagaggagacttgaggaatgagaactagatgggtacactatcataaagggacttgtctatcatgctgaggagtttagaccatcttaatggtagtggccaaggatggcatcagatttatagtttcaagtgatcataatattggcataaaagatatattagggaggaagcctgaagtagggagatgaaaataaggagccatcaaaggcagaatgaaacttaggcagatttcaagtgattttcaaaaatgatgtgatcagaggtaccagataataactattacataacactttctttgttaggagcttatttctcacactgaccaaagcttttgaagtaagtactctttacaccactatataaataaaccttacaaaggattctgctttgaggcatgagagagttaagtcatttgcccaaagtcacagagttagaaagtaatagagctaagatttgaacctaggcagtttggctccagagtctgtgctcttacactatattaccaccaagaggtcaaataaataccaaagaatgtattttcgaatttaacaatgaggaacttaatcatacaggcagaagtaattccagagcaccggagacagaagccagattgccatatgggttaaagagtgtgtaaaccactaggaagtaaagacatagaactactctcacaagtgcttttctggttattgtgacgctgaacttcatggcttgttttaattaagacatcttacaagtgtcaaaatttggaaatatttggacactgtacactctggttatttaaatatctaacagtggttcttgagcattttgagaaacctttgaaaatctgatgaaaggtatgtgccattactctagaaaaatgttcctgtgtacatgcacatcaagtatcacatactgtttcaggctgttcaaagactacaaagtctgttcatgacctaatggtccatgttccctcagttaagagctccagagataaaggatgtggaactcaaaggtaagtacccagagccttgaaaactccatttgtgacttggaagaattctacaatttgaattaactttgtggagagagatatatttttgaaaaattgtgtgtaccaaaaaaatttcatatcaaataatattttcctgtagtgcattcaaggatctggttccacagcaaaaaattgttttggtctcagttcctcaaaatcacatttaaggagcttgagatttatattttctacttaataagtcttacaaaagcaagttaagaaggaaaatggacaatcatttctgcacatgtagggtttaataaaacatgtataatgaaatatttcatattttaaatttccaccttattggtagctttcatgacaaagggctagggtgctggtggccatacaattaaggtttttggttagttagttagcagaactaaatgactcctacctggtggctttttcttttgtttgtttgtttggttggttggttttttcccagatggctcaggaggaaggtaaatagcagtcattgtatgtgtgacagagtttgagatagaatgagcatattgaatcccacatcctgttcttattactgtcaggcagcgttgacctagcagtataaaactatctgaagcaatgtagtcactcagttctcataaagtttatttcaagtactgtaacaattcatgtttggattagaaaagtcactagaaatttgacttccatatagtaatctatacttttttctctcatttccttcactttttgagccgtaagtgtaaggcattttggtggtattattacaatggttatgaggagtttctttgcttgcccaaggtcacatagctagcaagttaaagtagattcaaatccaggcctgctagataccaaattattatttaagagtacttttcactactcctaaataatgacacagatatgtttgtcttacacatttcactttattgtcaagttattagtatgtttattttcaaaaggtattttttgcaatttctttttattattccgtactttttaaatttacttcattatcacgtcttcctttattctttttaaatagtttttgcttttgttattttgttttcccttttttactcttggtttgtaatacatctttccttatttgctcctttctcatttgatctcaatgttaatccaactgttttccacatctgattcactaaaattttagccctttaaaaaaaaattcctgtttttcctatctccttttgcccattctcttctccttgcctcacttcttttatctttttccattttactttcattttttgtttctctagatgttgttttgacatatgagttaatgtactggtacaattttgcatctgtaaattagagcttcagaatcaactgagtgtatttattctttatttttaggcctcaatttatcttaccttttattgattttataatatactatactctttcattttagtctgcatatgttagccaaagaagatatgcccctgttttaagaaatctctgtaaaaaatgtcaagtgtgacaagaattcttcaagaaacaagctcctctagtttgtcttctatatttagagcttcaacagttacctatattactggtaactcccaaatataccttcaaacttgttttttgggcccaagttttttgcttcatatatatctgttttgaatatcccataaataattgcatctaaagcatacctccactccattgttctcaaagataaaaccaaacctgtgctgcttcttatatttctagtatttaagcgtcacctgccacccctttacctgagctacaagtcacgcattgcattagactcctctgctttcttctttcacctctaactagactattcaccaaaaatttttaaatatataactttcaaaaggtattttattacatcatttccatcctttatgtttgggttcaagccctcattaactttaacatggattcttggagtaccctccttactgattttgttacacgtgtccctcttttagtcagtactaccatgataataccatggataataattttttcatttttatttttagtcttgctctgtcgcccaggctagagtgcagtggcgcgatctcagctcactgcaacctccacctcccgggttcaagtgattctcctgcctcagcctactgagtagctgggattacaggcacctgccacagctcctggctaatttttgtatttttagtagagatggagtttcaccgtcttgaactcctgacctcatgatccaccctcctcggcctcccaaagtgctgggattacaggcatgggccactgcgcccggccaataatttttcttttttttgtgctaatcatactacattttctttagaataaaagatcacatacttcagtttgccattcgcagtctggccccattgtgccattctagacttacctcctgccactccccaccagctttgttttgtcttagtcacacaaaataatctagcgtctctaaccagtcaaacattttaccttgtgccttggctcactctgtgccttttctccagaatatctttctgtgtacttttctcccatccttttacctttaaacctgctgctatggtttggatgttgtttggcccctccaaaactcacgttgtagttcaattgccaatgtaatagtgttgggagatgctacttttaagaggtaattaggttgctaagatggattaacatctttctcttgacactgagactgggttttcctgggaatggttagttcccaagagagtgagttgttataaaacagtgctgcctcttctattttgcgctttttgtttgcacaaactcggtccccttctgtttctctacgatgttttgatgcagcatgaggcagtcatgagaacccaccagatacagctgcctgatcctgaatttcccagccaacagaaccaagtgctaaataaaactctttttaataagttacccactctcaggtattctattatcgcaacagaaaacagtttaagacacctgctaggctcctaaccttgaggggctagaaaacaaagccagaggtccagtaccagcctcctcagagttagaatacacagctcatgagtgctgagctcagccttggcccctacaatcttccagaaatgaggccacttggctgagcccattatatgcaacattcagacccccaagggcatcaaagaagacaaaagcagaaaaacctatccaagaaacagcaacttcaaaggttgaagcaacatcagaccacacaggtgagaaccagcacaagaactccggcaactcagaaagccagagtgccttcttaccttcaagcaactgcgctatttccccaacagtggttcttaaccaggctgacatgacaaaaatagagttctgaatatggataaccttgaggaacatagatgcaaaaatcctcaacgactcaatttgctggactagcaaaccaagcccagcagcatgtcaaaaacgaatccaccacaatcaagcaagctttatccctgggatgcaagtttggttcaacatatgcaaatcaataaatgtgattcatcacataaacaactaaaaacaaaaaccacatggtcatctcaatagatgcagaaagggctttcaataaaattcaacatcccttcatgttaaaaaccctcagcaaactaggcattagaggaacatacttcaaaataagagccatctatgataagcccacagccaacatcataccgaatgggccaaatgctagaaatactccctgtgagaaccagaataagacaaagatgcccactctcaccaatcctattcaacatagtactgagagtcctagtcagagataacaggttagagaaagaaatataagacatccaaggaaaagaggaagtcaaactatctctgcagacaatatgattctgtagaaaaccccatagtctttgcctaaaagctctttgatctgataaacaattagcaaagtttcaggatacaaaattaatgtacaaaaattagtggcatttctatacaccaatagcattcaatctgagggtcaaaatcaagaatgcaatctcattcacaatagccacacacacacaaaaatacctagaaatatagataacgaggtgaaagatctctacaaaaagaattacaaaacactactcaaatcagagatgacacaaacaaatggaaaaagattccatgctcatggataggaagaattagtgttgttaaaatggctgtacttcgcaatgcagtttatggattcaatgctattgctatgaaactaccagtgacatacttcacagcattagaaaaaaaaacttttaaaattcatatggaactttaaaaagagcctgaatagccataacaatcttaagcaaaatgaacaaagctgaaggcattacactacccaatttcaactatactacaaggcttcggtaaccaaaacagcagggtactggtacaaaaacagacacatagaccaatggaacggaaaagagcccagaaataatgctgcacacctatgatctgatatttgaaaaaagttgacaaaaacaagcaatgagaaaaggactccctattcaataaatggtgctgaaataagtggctagccatatgcataagattgaaactggaccccttccttatgccatatacaaaaatcaactcatatgaagtaaagacttagatataaaacctaaaactataaaagccgtggaagatagcctgggaaatactattctggaataggacctggcaaagatttcataacaaagatgccaaaaacaattgcaactaaaacaaaaattgacaaatggaatctaattaaagagctttagcatagccaaaaacaaacaaacaaaacagtgaacacggtaaacagataacctacagaatgagagaaaatatttgcaaactatgcatcctagagaagtctaatatccagaatttataaggaactttataagcaaaaaacaacctcattaaaaagtgggcaaatgacacgaacagacatttttcaaaaagacatacatgtggccaagaagcatatgaaaaaatgttccacatcactaataattagagaaatgcaaatctaaaccacaatgagataccatctcataccaatcagaacggctattaaaaagtcaaaaagcaatagatgccggcgtggttgcagagaaaatggaacacttatatagtgctaatgggaatgtaaattcgttcagccgttgtgcaaagcactttggtgatttctcaaagaaccggcaacaattaccactcgacccagcgatcccattattggatatatacctaaaggaatacagattgttctgccataaagacacatgcacgcatatgttcatcgcagcactattcacgatagcaaagacatggaatcaacctaaatgcccatcagtggtagtctggataaagaaaatgtggtacacgtacaccgtggaatatacacagccataaaaaaataagattatgttctttgcagcaacatggatggagctggaggcaattatcccaagctaaattatgtaggaacagaaaaccaaataccgcatattctcacttacaagcgggagctaaacattgagtacacatgtacacaagggaacaacagacaccaagacctacttaacggtagagggtgggaggagggagaggacagaaaaactacctattgggtactgtgcttattaccaggtaacaaaataatctgtacaccaaaaccttaaagaaaagtgttttaaaaatgtaaaataaagcatatagcaaaacaaacaagacacctggtaaagttctgctcttccttcaaagacccagctcaaatgtctctttcataaagcctctctgacattctcataccccccttctctctgacctgggagaagctgtgttttcattctcccacaataacttgttcatatttctattataaaacctacaaatttaaactagctgtcagtgcatacttgtttgtctccttggctatgtgccttatgagatgcctgggatagagatcaattattattcaatttgaatccttggcattgggtgcggtggctgacacattggaggtgggcaacaaatattcgtggtataagttcactgaattacagagatgtatgcataagttttttggaactgggtttcatgaatcataggtacacacaatttgaataaaagaagaaaacaaagtggggcaaaagggtgtaggtctagtaatgaaatgggaaaagaaaggcacattgaaaagtcgcaacaaaagagagaaccagtacaattatatcaacatatagtaaacacattggagaagggaaaacaatacagcaagtgaaattgattctttggtggcagaaacaattgaaaggtatggaggcaaagaaggaggagaaattaaggcatagagataaattagacttggggagaaagcacagaagtcaaatatagcaacagatcttggactgggaatgtttccaattgaccattatgcttacgattacttttatgttgtggagacaatatttaatgagcatttcagatctgttaactaattttttgaaaaagtgactccagttcagtgataaataccttgaccaatatgccatataaagtaagaaatattttaccatacccaagaaactggttttaccggcttagttttgaccaactgatggcaatttgtacctgctaaactcccaattttttacttgctggttgtgtaggtaggcagtgaggtttgttggactgggcatgcagggacaagcagttaggccaatacatggactgaagattatatctatttatctgccttttgtttagctatttgcataaatatacagagtgggtttatttgcacacttagagctttagaataaaagaactttgactttcaaattggtttttcttgattttttaaaatttttatactccactttttcttccgtctttctcaaactcatttttccctagtagcagagttgagacttaatattacaaaactctgcttgctttaaagaatctaagaagaagaagaagaagaagaaaagacactaaagaacttccaagcagaagtttaagaagttctgctatagcccatccactcgtttgtggaatttaaatatatccgtttttgccacaataacagcgtagccttgctagaatcatatacaaagcagcagatttctttctataaattactggacactgtggtgtaatgtagacattgctgaggagggatgtaactgcaacagaaacaagttacttacattgcatgcagtagggaagtgggtgaaaagagcattgaactctgagtcgggagacgacttcaaggcccagctcagcactctagcagaactttaggtaagttttttagacactatgtacttcagtttccccatgtgaaaatgagaataacgtctgttctgcctacttcacttgaactatttgaggataaaagaaggtaaaatgcaataatggtcatgaagattttataaaccttgaagtgatgtacaagtataccatactgtttcacttttattactattataactgtttaaaaaagcatttgtgaccagtacaatcctggcttttctctggagactaacatccagtttcatagttattttacttttgatagggaaaagggaattattcctgttatatattgcaatatttaggatcctctagcaatttctcaggctaagacttcatgttcccagaagagggcagcaaaactccaaaggctctgccttttcctcaattaaaatgtctaaagcagtttttccttgagaggaaaagaactatactgtaaagaatagccctttaaaaatgatggtatttaggtgacaaagctaatcctattacaataaatataacattcattccaaataagatttttccttttctctgtcctgtgaagaaaataattgactgtttcttcaatctcatgttaattatttgacttatatttccagaaactcctacccatgtttttccatttaactctagatttgtagatcctacttagcaccagtttttaaataaattgtttcgtatgtgtaagagaaaaggtgttcaggcctgtttatagcttaggatgcctacctaagtccaaagagtgatcctcagcagtgtctaaatgtgttcctatcatagagtatatgtttgtcattcagataaaatgttgtctacatctaatctttctcattctttcattattcaaatatccccgtgcctttctatctttagtcagtgaattatcttgtaatgacaagagcaactaacatttgaactgttcttaactcacttaggccggaggttgcaatttttttttgtcaaaaaatcagaccttggtgataacttgagcagtaggctataagtaactagtaggctagcttactataagtaggctaggcatattaatagcgtataaggtgctctcacagacatgttttccctttgatactcaccatagccctgtgaagttgatagctactatcccccattttacagataaattttctaatctgtaatcaaaatagctgctctttgcttgaagaaaaagtccagagggacaccctatatgtcaagagagctccagggggtgggtaatttctttcataattgctagaagagccaattctgaatgtgaggctttttctatctgctttattacaaccagagatggaataggaaggctttcagttacagtttatcaattccttctgcttttgccagttaatctctagctttactcttttgaaaaaactacctgtttcccactccacttctgctaccaccactaccaagtcagagtcctctttctattccagccaaacctcttcctgttcttgagaattgcatcacattcttggcttaacgtaaccaacacccccacattggcaccagggagtgtgtagcccttctttattggctgaaagttcttgtctggtgagcatggaataagtcactcacttcctgaatttcagccctggctaaatttgcttctggaaaaacatatatatattcctcagatttttgtctgttggtttgcaaatctccttcactccagccctgtcctggaatgagcaagatttaccaaatagggacagcatgaaagggaatttagagggtagaggtagagggaaaaggaatagtatgtgtagcttgctgaatgagatgtctgctcttgctgtttccatttcttcacttctcaaacaatttttaacccaatctaaactggcatcagctcccattgtattgaaagggctttcactcaggacactaacgcccccccgccacctcccatattactaaatccagtggatacatcagccttgatcttacttggcatcagggtagcatgtgatgcttttggtcacatcctctttgatagattcactcttcctttgcactattattttttctctatcttagtcatgggtcttcagcatcctttgcaagctcctctttactcctaaagtactggtgttcctcagaaccctgttctatatcagcctcttttctctctaaacattttctgtgagaaatatcatccctttccatggcattattgagatccatctgccaattatttccaaatctctatcttccctgacctcttttgactgctttctagaacttcttcaattagaaattcctgaaagcctgttaaccaactccctccctcaaacctattcctccaataatgctcctcatccaaacatatgccacaccatctacccagtttttctaggcagaaatgtaggattcatccttaatgcctcttttgctcaccttccacattcagtcaataaccaaattcagtataatctacatatttgaatccatcagtttctccctgtccccactggcctaagtgatcaccatctatgtggcgttttgcacatccctttgctagtttcctgcccccaggttttctccccttggatcattttccactaaccactagatggttctttatgtaaatgcagttctgtaaattcaccacttgtgtttaaaatcctttagttgcttctcaccgtccttaggatggagtccgaacttcttatcacggttcataagcctctcatgatcagtaacttgccatcagtctgaactccactcacactgacctctagtgtttcaaacataccctgcttccttttgcctctaggccttcacagatgctgtttcctctgctcggagtgttctactgtagggcctctaacatctgtagactaaattctagcctcaaattatcagttatcttattcctgaatcagaactgaactgggattcttaatattttttttattaattcttgaattaaagccaggatttatattatcctatatatttctttgaaaaatgcaaagatattttctaatgaaactgtatttgaactaattaacttagggttcagtttttaaaaatcatagctgaatgtaaactggaacgtattttttttcatggtactggaatgttttcttggttgttattcatcatgacattctagctttggaatttttcatttccagctgacttctagcagtctcctttcttacctctcaaccccttacactctggttgccctatacttgcccctagatggatccagtttgcatgcagtggtagttgctgtgaggctgcggttaaatagagctgctcagactgcaacaggaaagcattgaatcgaaagcaaaggggaggaagcacaaaccgatacccaccacaaagctgctgagtgcccagcatgacccaagccgcaccctctgatgaggagtcttgtggaggagtaagaagccacagactttaataaaccatcagcacagcctgtcctccacttccctggtccagccttcccggatcaccatgagtatcaccgggtactgacctaagaagctgggtgatgacagaaaagtgaccagaaatgtagagtccagaggaaggtacccgaaatgaatgactgtagaccattttatctcaaactccctacacagtcaagcgtggtgagcacgaaggtccggggcatgagaatgtttctgaggagctccctgcttggggtgattcccagatgaagactcctaaaaatgttccctaaaaatgcctttgctacctccctgaaaggctgcttctagtagtggccaaaacaacttataaaaattttgtaactaaaaataaagcccttgcgagatacagttaagagaactttaaacatacactaaggtatgatgactatttttagattcctgacttcaatggagggaggagaaaggaaggagatggagcagcaaagacatatgttacctacttgattttgctcatggcctaccctgtttacatctgtcccttttgctatcaaaggagatattaaggaattataggaaagggaatgaaaagtgtggaaaaatatataggaactaagtacagattttaaacaccggtaaggtggagaactccttggaaatctagagcttcacagtggctctataattcacctgttcaggttcactacctcagaatctaagaaggtgagatctgggccctacttttgcagctggaaggtcagaacacaaagaatggaggtgactgactcagtctggaggaaaggttgcttggcttggctggaagtgggcacttgtgtcatcatagagtgccaacctcacacttcagataacagaacaggaaatattgttagttcagatgggagagcagaggactgactgtgtatccaagaccattaagttattcagtcacctctttgtgttgtactttctatcctacaagggaccagagctggctgtggggagcttgggcaatagatgaagcaggccatcaggccagtccctgttccttgcagctttcttctcccttctatcacgttcagcttctttaatctgctcaacccagaaagtcttccaagattgacatcattaccaaagtttaaatggaagaatctgaggcattttgataggagacaggggtgacaattctggagtagaggaactgtctctcacaaggcctctctactacaagtggtaaaaatttgtgctttattttaacaaccacaacaacagtgaattggaagggatctaataacagaacagaatttgtagtcagacaactttgttttgaaactattcttcctttcttcccttcctccctccctcccttccttctttccttccttcctttccttcggaaaggaaaggacagggaggatagccatagaatgggaagctccttagacctcagaggaatgccgcaagcttcccaagtctgagtgcctgcccagagtttgcctactttcttcagtagtcaaggatattcctcaagttgtgtttaatatctatgcatgagccaaactgtggtaggtgggtgactgcattccccaggtgcaatctttcagcatgtgacctgatgtagtacattacattccttagacaaggaaaaaatagcgatatgaatgcaaagagggggaggcagagagtgtaagctactctaaaacacttagttatgaaagaagaaagattggctagaaagcatgtgtaataaggaatgaattccatttttttaattgagagaggttcaggaatgtttatatacttgaggaaaaagcatagtgagagatcttaacaagtcacttcattcctaagctttgatacccccatccgaggtgaggaggagaggagaggagtttctataaagattaaaattgaattaaaatcatatgcacagtagtggcttatatgccacaaagccctttacacatgttaatttttataactattatcatctagtgactgtacagatgagtaagccctggtcacagctgttctatattttctaccctatatgacagagctgtcaagaggagacaggctcttgagtaggcagggctaagacacataaataagaggctaacattggtgtgatttgtatcttgacatgctttgagcttttggaggatggtgtgtgtatgtgtctgacttactagacacaatgagttaccatttatttcaacttgccctgtattcttattttaaaaatcttacttaaaacatggacacatgtcaaatccaacatgtctctaaaaagagctaatgtttggagaaaattttagaaatattcacaaactatgcatctgataaaggtctattcagaatctataaggaacttaaacaattcaacaagcaaaaaataaccccattaacaagcgggcaggccaggtgcagtggctcacacctgtaatcccagcactgtggaaggctaaggcaggcagactacttgaggtccggagttcaagaccagcctggccaagatggtgaaacctcccctactaaaaatacaaaaattagccaggtgtggtggtgcacacttgtaatcccagatactcgggaggttgaggcaggagaatcgcttgaactcggaaggtggagactacagtgagccgagatggtgccactgcgttccagcctgggcgacaaagtaagactccgtctcaaaaataaataaataaataaatagaatacatttaaaaagttggaaaaggacatgaacagatacttttcaaaagaagtcatacaaacagacaacaaacgtggaaaaatactcaacatcactaatcattagagaaatgcaaatcaaaaccacggtgagataccatctcacaccaatcagaatggctattattaaaaagtcaggccgggctcagtgcctcacacctgtaatcccagcactttgggaggccgaggaggatggatcacctaaggtcaggagtctgagaccaacttggccaacatggtggaaccctgtttctgctaaaaatacaaaaattagccgggtatggtggcacatgcctgtaatcccagctactcaggaggctgaggcaggagaatttcttgaacccgggtggcagaggttacattgagccaagatcgcaccattgcactcgagtctgggtgatagagcaagactctgtctcaaaaaaaaaaaaaaaaaaaaaaaatagtcaaaagccacagttgctggcgaggctaccaagaaaagggaatgcttatctattgtcggtgtgaatgtaaattagttcagctactgtggaaaagtagtttggtgatttctcaaagaacttaaaacaaaattaccgttcaacccagcaatcttcattactgagtatatatctaaaggaaaataaaccattctaccaaaaagacacatgcactcacatgttcatcacagcactattcacaatagcaaagacatggaatcaatctaggtgttcatcaacagtggattggattttttaaaatagggtatatacatagcatggtataatacacagtcaaaaaaatgagtgaaatcatatcctttgtagcaacatggatggagctagaggtcattatcctgagtgaattaaggcagaaacagaaaaccaaatgtgttagtaagatctcacaagtgggagttaagcattgggtactcatggacataaagatgacaacaataggtactggggactactagaggcaggaaggaggaagggggacaaagcttgaaatacttacctattggtcactatgctcattatctaggtgaggggatcattcacaccccaaacctcagtgttatgccatatacccatgtaacaaacctgcacatgtactcctgagtctaaaataaaagttaaaattattttttaaaataaataaataggtcgggcgtggtggctcacacctataatcccagcactttgggaggctgaggcgggtggatcacttgaggttaggagttcaagaccagcctgaccaacatggtgaaaccccatctctgaaaaatacaaaattaactgggcgtggtggcatgctcctgtaatcccagctacttgggaagctgaggcaggagaattgcttgaacccaggaggcagaggttgcagtgagctgagatcgagccattacactccagcctgggcaacgagagtgaaactccatctcaaaaaaaaaaaaaattaaaattaaaaaataaataaataaacaaaattaaaagttgccatgttgaaaaacactaatccatcttgagatgcaaggatctgtacaaataagactatatacatgaacttcaggttacataaaggagcagtttctgtttgtaggtggggggagtaaactttttgtgtttctttctggctcattgcaggatcacattataattttgctttgatacaaatttggcaacaggaatcataattctttttccaactgactacagtgcttgtatacttttaacgaataatcgctgtgagttgtacaaagccttatatattcaacaaatcagtgaagtttttatcctcttaatatttactttgtagctttgctttgaaccacctcagccccagttctacacagttggcagtaaagatatctgcaaattccactcccccatttcctttctgttttgcccttggtttttcaacagtgagatgattgtgccttcatttctgggtgcatcccttcacttattccttatttcccttctccatcccttactccttccttctcttccccaggccttcacaacctctagattttattactagcaacttcttaggccaatcccatagcatgctccttcatgcattacatgaacaaattttttgagggtgctgaaccaaacaatcaggtgtcttttttcaagagtgaacaagaagccactttttaaaaacagttttactgagatataatttgtattctataaaattcgcatttaaagtgtacaattcaatggttttcagtatatctatttagcagggcacccgtcaccataattaattttagaatattttcatcatctccaaaagaaaccttatattcattagcagtcactcatcaattctattctcccataccccacccctttattccctctagtcctagacaaacactaatctgctttctgtttctatggatttgcctattctggacattttatataaatgagatcatataatatgtggtcttttgtgactggcttccttcacttagcagaatgtttttgaggttcatctatattgtggcatctatctgtacctcattcctttttattgccaaataatatttcattgtatggatatttcacattttgtttatctgttcatcagttgatgacaaatgggttgtttctactttttggttattgtgaataaagtttctgtgaatatttgtgcacaagtttttgtatggaaatatgttttcattgcttttgggtagattcccaagataaaagaattgctgggtcatatggtaactctatttttagcatttagagggactgtcaaacttttccaatgtggctacaccattttactttcccactagcagtgtatgagctttccaatttctccacatccttaccaacaattattattttctgcctatattattatagccattccagtgggtgaaaattgatatctcattgtgcttttgatttatattttcctagtgacttttcatgtgcttatttgcatatttttctcttgaaaaatatcttgtaatcctttgcccattcccaacttagatcatttgtcatttcttattgatttgtgttttttatattctagtcccttaacagatagtataatttgcaaatatgctctctgattctgtggggctgttctttcacttgttggtgtcctttgaagcacagaagtttttcattttgattaagttcaacttatcaactttttttctcttttattatttgtgctcttgatgttgcatcaaagaaattactgcctaactcaaagtcacaaagatttactgcttaactcaggtcaaaagagttagttttcttctaaaagttttatatctcagcttcttttttttttttttttcattttttccatttttatttgatgtttccaaatataaaaaagtcaggattcttacatcaattatctcaaatgagaccatgcaaagcaattcagtgtatacaacaatcatttttccccttcagttctgctgctttatacaacagtgtgattgacagaaaattggatggcatgtgcctggtcagaaaatgtcatctgtttacaaaataacatcatgcagcacagtttctactttgtctgcaagtcaattcacaaaaactacttattttctgttttttatttgggaggcacatggaactgaaaaatttagctgcccaattttattcaactaccccaccaaaaaaaaaaaaaaaaaaaaatcacaaatgacagtcccaacactctgcaaattttggagggttgagatagtagacactatttgtcatactcagcagagttaactatttaacagaaataaatctccctagggcctttcctctcattttgctagactgggttccaggagaatcgtgaagaacccctcatgtaaaatttgaagtgtgaaaactgtgttgttgcattatgcagatttttgctagttgcatagactaaagacgttttgctaaatggcactgaaaatccttaccgagtgtcactattcagtccaagtgtttctgaccaaagaaaattatacaacaatatttataggctaactttaaagagatggttgacgttaatactgtacatattttacatgtcaaatacatagtccaagagtttataaaataaattcatgcatcattaccttattacctctaagaatatcatgtacaagatgggcactcccccacccccccagtacttatgacagcatttcaggtggaagcagtcttatatacaaaaacaatccagtttctctgctatgttaagtatataatttaaggaaatttcagagattactgaccaaaaaaatcttagtccattgaagatagaaagtgtcaatttgtgggatttaaaatgtttcctttataaaagaacacccagaatatgtaacctctgtacaaagaaaaaaatatacaaattctggatgatcatgtttgatcacactacgtacttgaaatgttgctggttaaaagttcttctgctttactcattcctttgacagcattaatttgtgaacatttatattcagttcagctgtatttatggcacaagatctcatttccaaaatggcactaattttccttaagtgtaacagcactctatttttagcagtaattatatttttaaaggttaatttgtagaacaaatgttttaactatactttttttctactctatactccccagttacaatatttacaaagggctgaagtctatataaaaaaatgatctttggctgggcatggtggctcatgcctgtaatcccagcactttgggaggtcgaggcaggaggatcacgaggttaggagtttgagaccagcctgaccaacatgaagaaaccctgcctctactaaaaatacaaaattagccaggcatggaggcaggctcctgtaatcccaactactcgggaggctgaggcaggagaatcgcttgaacccgggaggcggaggttgcggtgagttgagattgtgccattgcactccagcctgggtgacaaagcgagtctcaaaaaaaaaaaaagacatcttttactttcccccatccctcattttagtcaaacttctcccacctcatttctgccctggttggggaagtgcaagagtttcagataaggtacctatgtgttttagatgggattcttgattttaagtgagtataaagtaaaagatttaattcttagttcaggtatgttccagtgcctcgaaagttagttatgtgacaaatagtacctgttgacaacctagaaaagatgagacattctaaggtgccctaacaatcttcagtctctaacagctgaacaggaaggccatttcactcaactgtgatgcgatcatcactgactggcatttagaattagatttcaagactccactcctgtgggggccactaaataactgaatacattttaagagcaatctacactgagggaaataacggttctaaggtattctgcatagaaagagtatcgataatgggaactggcaactgagcatgctaaatcaaattccatgaatagagttttcataagatgtctttactacatgcattttgctaatatttccctaaaatattcaccaactctacagagttatactttgtgttaaggtactattgagttataagggaaatagccatatcaggtagctagtgacataataccagttgtgaaaattcagacaaaatgagtcgacaaatccccaaaaatggcaaattaagccctgtgacaaaataagttattggatcatacagaaatagcccaaatctggaaattttgaattaaaattgtaatcctgtaaaacaagttttggggtgaatggatttctttaataccaataatatttttaattcccaccacagatggatttgctgaatatgctaatgctgtgaatgagaaaacaattttggggtaggtatacccacaagtaatctgatgacaaaataaaccacagactgatgtcaaatggacaaaaaactgaaaatatgctgtgagaaatagacaaccaaaataatatagggggttgtggggtgtggcacagttaaggcatctaaacaaaaattccacatggctttggcttattaaaatattttacactatttttttaaaaaaagatttgaaagcatctgaaaaacatgcaaattgtttgaaaaccttgcatggcaaattcagacagtttgcaagcgtcaatcagatgtttgacgaggaaacgaaagaagcctctccccatgagactgcacatggtgggagaggcctacccagttctctctatcttacactagatggcaacccagaggtctgtgcagcggttacaaacaaggcattattatccgaagggaagggactgtagaatttccattggctggggaacaacccagctttagcttttccagatactctgcatgtacaggtttatgacactggagaactttgatagcatcttctactttgaaccactctctcttccttccaatattaacagaatcttcccaatcttctaatatttcagtgactgttagaacataaacatatgttctgtgctttcggtcttggttctgctcaaatatgcccagaagtctgcctagttttcctttgactccagcctcctcataaacttccctcacggcagcaccgccaggttcctcctcgggttccattcctcctcctgggacaatccactggtctgggtaccggctgctactcaccagcagcacctcgtcctcctgctcgctccggaagcacaggcacgccgcccgcttcttgaagccctcgcggtcgtaggtccgcgtctggttgggcttgaacttcatcatagaggcgggctcctgctgctgctgctgctgctccggccgccgccaccccgccggggagtgggggcgagggcgagtcgggcgcaggagcgcctgggagcgctagtcggtgcgggaggtgcggcgaggccggtcagtcccggggccggcggccgctccgacgcgggcgggacgggacgctagcgcgggtcactggaaccagggtgccgagatgaaagctccgcctctgcccagttgtccgccgctctccatggagcccgactcccgctcgcctccgctccctccggccgtagccgccaggggaagggcggctagaggcgcgcgccacgcggagacagttgcgaagacccgctcccactgagcagcagcaccacggcgactgtattttagcttctacatttaggcctatgattcactttgagttaattattgtgtacaatcttaggggtccaaattaattcttttgcgtgtggatatccagttgcccagcaccacttgttgaaaagaccattttttttttcccccattgaattgtcttggctctttcgttgaaaatcaattgattgtaactgttagggtttatttgtgattctcaattctgttccattgatctgtatgtttatccttctgtcagtaacacactgtctttgttactgtagttttgttgtaagttttgaaattgggaagtgtgaatccaccaactttgttcttcattgttttggcttttatgagtcccatgcatttccatatacattttaagagcagcagaaattgacaagttgattctaaaattcattaaaaaccctcacttctaagaaacaattaaaatattttctttccaacctaggatgaaattggataaggaggactgagcaggtacatttttgagttgtggtgatgggggatgggtcatttgaaagggggaccaacctgatggaggaggggaataaaggagccacaaagtttggtaaacttcccaccctggtgagaggaatgtttgttcagaggaggcagtttgttctaacaccagggaatattatgaaagataattgaaattgtaaagtccattgatatctccccagaagacaaaaaggtctctaagtaagcagtattgttagcttgttgattcttacagaagaagattttcatccaactaagggaagcagctgggactttctcagggctgtaagacagaaaaaaaatgaagaaatccctctgtatcttttcttacctctccctgtggccagccctaacttttgtccatttttgttacccttcccttttataagctccccaaaaagagagagaggagaaagagaaaaagaagaaaaccacagtgggagagagggttagagatcctggggatgggggaggaattctggagcatttcaaattaaagatccctaaggtactatgggtggaacctactaagtaatatgacaacttgtagcaagagtcataaggatgatcacatcttcaactcagtgatccaattcctgggaatttatgtaaggaaataagacaggcaaaaagtgtgagtgggaatgttaatgaaaatattacctataatagtgcaaacaggaacaacctaaatcaccaaaatagaagcatgttttatgacgtcatggcatgtaaagatggcagattataatactagcttcactgtcaaaatatactctgaattgcatcacttttcactgcattctgtatcactctggatcaagtcactattattcctcatctgaattattgcaatggcctcccaactggcatttctgctttcacccttgttccccacccccagtctactctcaacacagcacccttagcagtcctttaaaaacttaaatgtaaaattcatatggaatcataaaagggcctaaatagccaaagcaatcctaagcaaaaagaacaaatctggaggcatcacattacccaacttcaaattatactacaaggttatagtaatcgaaacagcatggtactgatataaaagtagatgcatagaccagtggaacagactagagaacctggaagtaaagccagatacttagaaccaactgatcttcaacaaagcatacaaaaacataaattgggaaaaggacaccctatttagtaaatggttctgtgaaaactggagagccactggatagaagaatgaaactggatccatctctctcaccacatacaaaaatcaccctaagatggaataaagacttaaatataagacctgaaaccataacaattctagaagaaaacataggaaaaattcttctggactttggcctaggcacaaaattatgactaagaccccaaaagcaaatgcaacaaaaatttaaacaaataaacggaacccgattaaactaaaaggcttttgtgcagcaaaatatataatcatcagagtaaagagaaaacccacagaatgggagaagatatttgcaagtatccatctaagaaaggactaatatccaggatctacaaggagctcaaacaaatcagcaggaaaaaaaaaaaacaaataattccattaaaaagtgggcaatttacatgaatagatgcttctcaaaagaaggtacacaaatggccaataaacatggaaaaaatttcaacatcactgaacatcagggaaatgcaaatcaaagccacagtgagataccactttaccccaaccagaatggccattgttaaaaatccaaaaagcgatagatgttgtcacagatggggtgaaaagggaacacttatacactgctagtgggaatgtaagttaatataacatctatggaaaacagtatgacgatttctcaaagaactaaaagtagcaatcccactgttgggtatctacccaaaggaaaataagtcattatatcagaaaggaaaataaatcattatatctgcacatgtatgtttatcgcagcacaattgacaatggcaaaggtatagaactaacctaagagctcatcaaccaattagtggataaagaaaatgtggtatatacatgccatggaatactactcagccacaaaaaagaatgaaataatgtcttgcactacttggatggagctggaggccattattttaagtgaaataactcaggaatggaaaaccaaatgccatatgttctcacttataagtgggagttaagttatgggtacacaaaggcttacaaagtggtataatggacatttgagattcagacaggggaaggttgggaggaaggtgagggataaaaaactgcatattgggtacaatgtatactacttgggtgacaggggtactaaaatatcagacttcaccactatacagttcatccatgtaaccaaacaccacttatacccttaaagttattgaaataaaaatgtatttaaaatttaaaaaagaaaacctaaatgtgtcatccactactcaaaagtttccatggctccttctcatttagtataaaagccaatgtctttgattagtcctgggccctacctcatctggcctccatctgtgacttcatctgatatttttcttcctgtaactccattctgaacatataggcctcctaactgtttcttgaatataacaggcctcctcctgccccagtgacttttgactcttccctctgcctcagagtctcttctcccagatatccattagtttgttccttcactgccttcagatctttgttcaaatgtaaccaatgatactttcttttcctgacaatcgtatttaaacttgctatcttcctcccatccctcagcctctagcatatcctgttcttccttgctttattcttccaacgcttatcattttacctgacttatttttctgggctgttgtctattcctccccctgtaacccatgctctatgagagcaaggatttatgtattttgctcactactatatcctcagtgtcttgactattcctggcacagagtagctgcttaataaataatttactgaatgagtgaatacatccacaaaaggagtgattatgaaaattgggtcataatttgaaaagtggaaagtacgttactgtaagctgtgatgtgcacagtggctgtggcaatgtggtgtagcatagtctgggagctgcagatgagagagatctggatttgaatcctgagtccactacttcctagttatgtgaacttcggcaagtgtacctaacctctcagttttatcatctgtggaacaggtagaataatacctccttcatagcatggtgaaaattaaatgagaagatgtaggaagaacctggcacataataggtgttctatgaacattaactctctctcttctcctaaagaatatatacacagtgggtaagaattgcaaaataattgggtgtttcaaagacagggatgatgcacttttataaaaaaattttaatacacaagtcctctctaagcatggatatatatataaaaacagtgccagactaggagtatggagacctgggttctgggttcacctctgatgcaggctgtgtgacattaagcaaatcctaacctcttgggactgtcttttcatctgcaaaatgaagaggtagaatttagtaagtttgagtcccatcaatgcttaaaattctataattcagaaaggcaggccattctacctagtttcatcccgctttagctcagccttactcagatatgctggccagatgtttctaatcttacacataaaagactctggtattcagaggccaaaagaaactggacaatttaagaaaagtactaagcagatgagttttccttctgtctgattcttaaacagctacatgacaattattcaaacttaagaaaacaggaaaagaaaagcaagtatgcacatttaggtttgaatcaactatgtgaatatttagccatgaagaaaaatgtgtttttttgtgtgtgttttattaattattatttgtacaacaaccaaaaagtagacgtcagcagttttcaactgtaactataaccttgtaccatgtggctgtgggccgaagtgcaggagggagtagctggaagggaatctggctagagccttcccctgctctggaaagctcgtggctttgtttttttcacattgctacaccgagacggaggaggggaggatgtttgggtttacaggccaccagccactgtcagcaagtttgtagccccagcttcacttccctgaaagggcgggggagtttcagctgccctggcctccctccagcaactgagccacagaggattcaaataccccatcagttgcaaggccctgactttacccagctgaaaactgactatctcatctgggaagggtcagttaaaaaatgacagaactgcctaaagtaaacaaagggaacaaccacaacagaaactttctctgcagtgtttccttataattaccggcccatcccaccagggctctggcttgagtccccatccactctccctgttgcccccacaggaccttgtttgagtaagccctagctgacctgaggatcgcctccctgtctacatgcctctgtcccaccctctccatggaggggagggagactcccgattgcaggaagttttgagaatggagtttgaggattgtcaggcaaaaagaccctctagagctcattcattaggacccctaatagatgagtaaacagcttaaatgaagtgcctaaagttgagagcaagtatgggacagaactggttttcttcttgctaaccgagtgctctttccagtaatcatatactgttgtaaggcactaaagataaggaaactaacattgaagttctttctccaccttttcattctaaccaaatcctactttgttggacttttacactttatagataggctgggcatggtagctcacacctgtaatcccagcactttgggaggtcgaggtaggtggatcataatgtcaggagttcaagaacagccttgccaatatggtgaaaccccatctctactaaaaataaaaacaaaaaaaaaattagctgggtgtggtggcgggcgcctgtaatcccagctactcaggaggctgaggcagagaattgcttgaacccggcaggcggatgttgcagtgagctgagatcatgccactgcactccagcctggctgacacagcgagactcaatctcaaaaaaaacaaaaacaaaaacagaaaaacacgctttatagataaacatattttgaatttagacttaaggacaaggactaaatcttacactctgtgtaccttgttcgtacttcagagttcatgaagtgtgttcatggtcagcagccaagtagagcgggtaggacatttgcttcagagttgagcaagcctcagaatcccatctctgcacattctagctgtgtaaacttgtaggcagattacctactctaaaacttagtttccacatttgcaaaaggggaacaataatagctccacctcattattttgtcatgaggatttcatggatgatacatgtaatgcacattgaaaaactcaacaaatgttagaaatggtaaatagttctggaaggcatttatcattcccattttacagatgagaaaattaaagctcagagagtttaagggctagagtcatacaattggttagtaagatagctaggatttagctcagcctcccagctccatatccacagtacttgctgccccaccattgagtgtagacaattgggggtggctctaagccatgggccaaatatgtctgtccctatcatcatggaatgacatgttatttattaagcccatatatgcttgaggtgccaggaaatggatgcttctggggtgaggtaggctcttcatgtgcagccttcatgtacagattccagccaaggaaaccaagcctggcactaatcccttgtccaagcccagagacgctgtgcccacggagtaggtcagaagtccttgaatatcctcagctttcctttcctctggcaatgcttccttgatgccctaagaatattttgcttaccctgacattagagccctcttcacactcccaagctttctagtattttgggtgtgcatctgattctcctgttgaaactggactccaaagtgaagtgctcaaaatggtacatagaggtatgagaaaaacatatgtgaatacttgcttctatttattttttaatctaaaatattaagaaaattaggctttactaatattaaaatgtcacagtagagtgtatggaatttatagcaaacatgcaattattaggcatgtatgctggttttcttttctttctttctttctttctttctttttttttttgatggagtggtatgaagaaaagagactagaggtaactgttctagaaagtaaggtcctacaggcagaagatgtgtctttttctaatgtgtattccacccctccctcattagcactaaatgactcctccctgattaaataaatttggcatctatgtaaacttggtggtctttcttgtttttcccctccttttgtcatccatctgatataatgtcttattcaatattctcccaagacctgaacaaataataaagctgtgttagtaaagagtgcaaattgccataaaaagactgaaaagtaagattcatagtccccaaggagatggttaatggtagtcaataaggcatatagcgggcaaaagaaaagctaaatgtaaaacttcatggaagaactcatggacacagtcaggcagggagccccagcactacagcctgagaaatcaaatgtaatctgagcatatgtgtgttttcaaactaaccactgccctctctctcctctgaaacttgcagaaagcaatgcaacacaatgcaatgagccagggtcttggagaaagaaagaaatcccaactctgtcactgtcctggttgggtgatcttgggcaaggtccataatcacccccactcccaggaaaaatagttcttcacctacaaatgaggttgagctaggtgattttggaggttactttcatgctttgaagcagcccatgttttcttcctgaggcaatttatacttcaagtgacaccatgaagctcactggaccaaaaatatcaccttaccaccaagcctttcatggtttgtgacatcctctcctcaggcaccgtgtctccatgcggtgcttcccaacctagcaataacttactggcatgaatccacttcaagtatcagttatgtccatgatgcatgtagagtgggaaagcaagatatgaaaggttatatatgtggtatgcgtatgtctataaatacctacaaatatatgtgcatacacatagaaaaagaactgaaagatactcagcatactttcaacactgattattcctagggagtaggaaagcaagatgaaggtatgaattttaccatttactttaaatcctcctatatttttgttgttttttaaaaataaatgattttactatttacaaataaaaattttaaaaaataaacattaaagtcctatacaaatgtttaataatatttgtaataagtagcaccagtttcttcaagaagccctaccagaagcaaatctgcatcttgatactgcattagagccttggctgaagtactaataatacccgaacattctatggaggattgggccctggactgggagaacctaatcacataatcagaaactcttattgagtaattttgggcaacttgagttttcccaaactttacttgagtttgtttttctcgactagaaaacaatgcttttgaactaaatcctctatcgggaactttctactctgaagtcctgtgattcttaacaacagtacatgcaaaagacacaggaaagtgagtatgtcatatggcatccaggatactttcccccaaagcaaagtgaaaactgatgtgaaactccttcttccttccttattttcctctctctctctctctccacctctgttatctaaatgctctatatttgaagcattcatcactttataggccttgatgggatacagaggacaaccttttactttagaagctgaaaatgtcagatacttgttttccagcttcccttacaggtatgcataggcataaggatctgcattgctttttgactcaggagctagtgacctcaaatagcaaagactgttgaatctgttctgcagcagggagtggcattagttgtaataacaacattcattttttagatgctacagtggtggtggttctggtggttctagcagcagggaccagcatccaggcttggggcattcactgagcagtggtttccatgcagtgggggcattgatgacttcatgatattgttctgcagtacaattttaggtgttgcttctggctatgtagcctctaaacctgggtttctagtcctcctggagagcttgtgaactacctaatattttttaataaattcatttaccgcttagattaactacaaattgtttctgttgcttgcgaccgaaaacatttactaatgtacctattatttttttaaaaaatcatgcacttggagattatatatatatacacacacatatgtttttaagggaaaaaaactccccttccctttgttgatcccttattttcccagtttcttctctggaggtagtaataatgatttgtttcttatgtattcctccagagatatcttgtgtgtacacaagcacatctatgtatttaagaaaagttacttaaaaatcactcaaataggatcactccatatacactgttccataatttgcttgtaaccttaagactacatgttagagataattccataaatataaagctgcctcattctttttcttatttttatttttagagacaggtcttgctctgtctcccacgctagagtgctgtggtgtgattatagctcactgcaacctctaactcctgagctcaggggatcctcctgcttcagcctcccaagtagttgggacaacaggtacgtgccaccactcctcgctaattttttattttttgtagagtcaggccttgccatgttgcccgggctggtctcgaactcctggcctcaactgatcttcccatcttggtctctcaaagtgctgggattacaagtgtgagtgactgtgcctggcctgcctcattctttttattggctgcttaatatccctctgaatgaatatactgtaatttatgtagccaatttcctcctgtaagcagttgggttgcttacagtttttgtgactacaaataatgctgcagtgaatatcgttgtaaatatgtatttttaaaaaaatatggaatgcttcatgcatgtcatccttgtgcaggggccatgacaatcttctctgtatccttccaattttagcatatgtgcagctgaagtgagcaagtaaatatgtcttaatgcccagtgcaagcagatacatgtctgatagggaagttgcagcgtcaaaaggtaaatgtaactttaacattttgatagatagcaccaaaatgcactgcaaatttagtaacaatttttaatcctactaaaaatattttagactcccccccaccaaatctttacgtcaccagtgtatattatcagattttataattttgctgttctaataggtgaaaactgattttctcattgttctgattttcattctttaatttatgagtgaggttgaacatttttcatgtatttaaaagccatttgtaagtattcacctgtgtagtatattcatgtcctttgcctgttgttttctattggatttttatctgtgtttaattgctttgtaaaaacttcatctttttttttttttttttttgaaataggttcttgctttgtcacccagactggagttgcagtctggcaccctcctgacttggcctttttttttttttttttttgagacaaagtctcactctgttgcctgggctggagtgcagtggcgcaatctcagctcacttcaaccttcgcctcccaggttcgagtgattctcctgcctcggtctcccaagtagctgggattacaggcatgtgctaccactcccggctaattgttttgtatttttcgtagagatggggtttcaccatgttggccagactggtcttgaactcctgacctcaagtgatctgcctgcctcggccccccacagcacccagccctgcctcagccttttaaagtgctaggatgacaagtgtgagccactacacctggtcaaaattccatattttaaagtaaatttgccttttgtcatacttgttgcaaaattttttcccaatttgtttttggttttctgatctttttaaatttgatctgatttttggtttttgctttgcataaatctttaattttcacaaagccaaatttgtctatatttttgcttatggctctggatttgtttggaatggcttttggctgggtagcttctcatggtttcaacattgaagctgctaatttagaaaaacaatacttgagacttctggttaaagacagcagattaaacacatgctccactccctcctagaactcaaccaaaatttaatgttttgattaagtgatacattcacatggttttaaaaccagaaaaatacaaagatgcacagcctgaaacgtttccctcatctatgtctcccatcagctcagtttccactttctccctgtccagaaataaggactgttatgctttcttatgcgtgtttccagagtttctttatgcatatgtaagcaagtaagaattttggtgagttttttttaaggagaaacctacaaggacaaaagaatataaaaaggacaagagtaagaaagataattttaaaagctggaacataaggccgggcacaatggctcacgcctataatcccagcactttgggaggctgaggcaggtggatcacttgaggtcaggagttcaagaccagcctggccaacatggtaaaaacccatctcaactaaaaaaacaaaaattagccgggcatggtggcgggtgcctgtagtctcagctacttgggaggctgaggcaggagaatcacttgaaccgggaaggtcgggggtgggggttgcagttagccgagattgcaccactgtactccagcctgggtgacagagtgagactgcgtctcaaaaaataaataaataaacaaataaaagctagaacatagatgaatgagtggtaactgaatcaagagacctgagaaagctgaatcctaagcctgcagatgagaaaggtaaagcaactcactttacatttcagaatcccccaaatgctcagcaattggtggcaccaggtacttttggaaataagggtgaagttgtggctaaaaacagtaagttgcattgaaaatcagttcaggaaacaatgaaagctccaggccccctcttcctcttgctgttagatggattgccccttccccacgatgtccaagaatggaggtttttctggtgggagagtaagacagagaagggacaaggcactattgtgtgaaaggacaacatgctgggaaaaaacaggagattataagcccattgccttctgccatcttctcttacttaggaaaccctgacagccagcctgaatattaggaaagccttctctgaaaccctgacacactggagagaaatgctccaaagataactcagaaatgacagcatctctgaaagaaaaagaaaacaagaagtattaataatatctccagagaaataagagaactagtgcatatatgaaataagaacagaatgctatgttttaaaaggaacattcagagaacaaaaaaaacttagaaatttaaatatgatagcaaaaatataaaaaagcttagtagatttggaaagtagaaaggaaagcagaaagataacagatagaaaataaaaaatatggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaagaaaataaaaaatataagagcaaaattagtttatttgggagatgaccccagtaaacatctgtacgggagtaaagtaacgagaaaaggatcctacggaagttaatatatcttgcaagttactgtgaaccagtggaacttgactccatcggggaactctgggagacctgtgtagaaagcatgcttcagggttaaaccgcctcatggttgagcaagctgggatatttatctactaactctcatcagtcattggttaagggtctctcccagggaaaagggggttaattccccagcacttcctgagcaaactttcagtagctagaaaaagccctcaggcaaacagacatatgtgctggcagttttgaaggcctggatgttaagtgccaagagaatttgggcagggcactgatggcaaatgttatatcttccctgcactctctcttaggaaactactgaagaatgtgctccaccaaaacagtgttgtgagtcaagaaagaggaagaggcggaattcaggaaccagagcactcaacacagaggtgaagagagtccccaggatgtgggtaaagggaagtcccaagatgacagatgcacagcaggcctagaggtcagttagcccagagaggagcagatcagtaggctctggaagagctctcttccagatgaaactgatggaataccaagtttgtttggacatattgagaggagacttaaacaactacagaggagtatggattaaattagtggcatatgcatagaaaaactaggcaaatgaaaaatgagacaattattaactccagagaaagcaaaatagttttgaagaaagtgatcataatttattatgcaacacaggtgtgaatagtatttatttgatcatagtaatataaacactgagtgtcagtttaatagtgacgtagaaatataggcccatgtggtataggaagaggcgaaaactgaatccccatcttccacagtggaaagtcaatagagaaaactaagaggtagctatttagagatacaatgatttccctcctccccctaaaaaaagatttagtgaaagcattgaaagtgatttcctctgaggagtgggaaatgaaggggtggagtaggggaatgctgtttcttgtaattagtaatttagaaatatttgattctttaaactatgtgcatatttaactttgatgtttaaaaaaactaaataaaactcagtaatttttttcctttgctgtatgaaaaagggaggaggtgagatggaaaatgtacctcattcctagctgataagaaaactgggcaggcaaaatgaaacttgcttgttccatgagtccatcaacccagcagggtcaatgtcttttccatcttcttcagtcagaagaaaagctatgagcaactgggaaatcaaaactgaaattcctttgaaagagccattgatgccaaactgacctgaaatctggggctaccctaagagggctttggcctaaataaatggtccagggtaagtacaaagaaaggattctatcaaatgcaaaaatgagaccaggattatattaagggagctagtaacagcacttgagtgcaagtagaatacattcttaattatgtctaatatgaatttctttaaattctttaaaagccagttgttttaaaatacagaaattaaaaatattactatattgatttatagttttaattttaaaaaccatgggagtactttgtacagtcttttaattaaccgtatctatgactgaaattgcacatcgtttaggtctctggcccgatcatgataccagagtctgttactttctgattgcaggcaaaataactacaggaatgaggcctcctgaaggcagaatcagttctcctttctcttcctgccttcaatctttacctactagatccttctcctcagcctagaaaaatgcccaaaaagttccaatctaaaataaaaataaagaaggaattctcacttaagctatcacccaaactttctcttttccttcatcataatacttctaaaaaaatatgctaacttccttttcttcctttacttcctcaccacatactacttcttaactccttgtaatctagctttcactttgaccgttgcactgaacctgctgtctcagaggtctcaaaggacttcttacttgctaaatttcggtcctgcttagccctcatcctcctcaacctctctgtttttgactttcaaaatgtctcactgtgtctctctctgttgctctgtctctctctcttctctctgtctctctcacccacccaccctctagcccccttattctgtgttattcctctcttttggttttctctcctcccttattattcttcctttgagtcttctgtcccgctcattctcttaagaataggcatccaatgagatcccatgactccctgcaatatctgggatctgcctatgtctccaaactcatatgcaccctgttcccccttgttcatttcactccagtcacactgatgtttcagttcctctaatgggccaatgagctctttattaccttaggacctgctctctctacctgggacactcttccccatgttcccccacacccaaagcgcttcatctggctatttccaaatcaactttcaggtctcagcttcatattacttcctcagagtggctctccctaagtgcatcccctccccacccctccaaattaaatctgtttccccattttttctattttagaaatagtttttttatcaaattattatatggtttaaaatgaaagactacttgtgtgtttatttgcttaaatctctacctttctctccagagtgtaatttccatgaggacaggaaccatgtcagttttgtttaacactgtatccttagcattcaacacagaccttgaagcagcagacaacaaatattggttgaataaatgagtgaacaaagtgccaggcactacagtaagtacttcttcctgccaggcgctatggcaagtactttacatatatcacctcgtttttattcttaccacaaccctatgcataggtactactatcagatgaggaaatggaagcttacagagacagaccaatatgcccaaaatctcacagaaaaatgaatgtagctatcacgacgtgaaaagatgtagaggaaccttaactgcagattattaagttaaagaagctaatctaaaaagccttcatactgtatgattccaactatgtgacattctggaaacagcagaactatagagacagtagaaaggtcaatagttgctgggggttgtcctcgggagggatgaagaggcagagcacagaggattttaaggaacgaaaatactctgtatgatatataatagtggatacgtgtcatacatttgtccaaacccatagaatgcacgatgccaagagtgaatcctaattgacactacggacttggatggtgatgatgggttgatgtaggttcatcagctgtaaaaaatgtaccactctgtgtggggatgttgataatggagagggcctttgcatgtgtggggacagggagtatatgagaaatttctattctttctgctcaattttgctgtgaatctaaaactgctccaaaaaataaaatattttaaaaatgagtgtcagaggtaggatatgaaaacatttgtttgactctatgtagggcttaattataatattatactgcttcccagttgacaaatctaatactttcaccgtccaaaacttccctcacacttacttcctgttgtctgtttctatggtttctcttgagtcctccttccaggatccattccaagccagacaatggtatgtgggtgagaaactgtggtcatggaggagactggacagaccggaaagcttttcttttctaacacatgtttctgaggagccctcaggaagcctgtgaaccaggaaaaccacggtgatggtcaatgctctgacagctcccctgcccctttctccatgctcttctcctgccgtgccttccccaaggctgtgggttgctccccactgtgctgctccccttgggccttctctccctgcccacatatgcatgtgccagccctttcccctcacaaaaatgtcaacatagaatggtaagtagaaaaaaaataagatgcaatatcgtacaaatagttgttatgggttgaattgtgtcctcccaaaattgatatgttggagtcctaacccccgttacctcggaaggtgaccttatttggaaataaggttgttgtaggtataatcaatcaagttaagatgaggtcataatgaagtaggagggaacttaattcaaaatgactattatccttattaaaagaatgccatgtggagagacagacatgcaccaaggatactgccatgtggagaggaaggcagagattggggtgatgcagcagaagctgagaaacaccaaagacttccagaaaaacagcagaagacaggagagaggcctgggacatattctttctcacagtcctcactaagaaccaatttgccaacaccttgatctcagacttctaacctccagaaccgtgagacggcaaattgctgttacttaagccactcagttgtggtaccttgttatggaagtgctagcaagctcatagaaataacagaatcctgatcttgtaaagcaaaataaactcatgtattacgggttatcatcttgcatacgcacatacacatatacatagatgaacacatagaaacaatgaaaggcaatatattttaaaagttatcaatacttctttggggataatggatgctgagtaattttgctttgtacttttctctgcacctttgggtattttctcagttatcttacctctctacaatattatgcattattacctagaccagcggtccccaacctttttggtaccagggacctgttttgtggaagactattttttccacaggtggggcagcagtggggatggtttcaggatgaaactgttccactgcagatcatcaggcattagattctcataaggagcatgcatcctagatcccttccatgcacacttcacaatagggtttgtgctcctatgagaatctaatgcttccacagatctgaccaggaggtggagttcagggggtatatggcctggttcttaacaggccatggactagtacctgtccatgccccgggggttggggatctctgacacagacagatccccagacctcagtttcctcatctgtaatttgagaatagttataccaatcttccagcattgttgtgaggaataaagtgcctgacacaaataataggtcagtgggtcttcctagaatagggagagcagctccaaagaagtaaacctggacagacctctgtacctctattcatcatcaggcttcagtgttgctgctaagcaggcatgcggatgctgctcagcactggcctccctgtgtggtaagggtgggtgtgcagagatgagatggcacaggggagctagctggatgtcttgggtttgggaaggtcagcaaagaaaggtaagagagggtgaaagtttgattgaagaatgttggctatgtaaggacaacttaacccattggggtaacatttcttagtttgggttggggtccaatggggcaactgaaaaggaaaaaggaaccaagagaatagaaagcatagccaagaagcccaacaatcccctcctacaggaagaatgccttgcctcctcatttcttctctgaaacccctctggaaatgggagtggacaatgtaacttacttatcattttccacagcccatgggaaggtgttctttccccaggaggaatgtttcccaaacagccctccttctggccttatctgtgataagttgttcttttctggggactgtttgggtatccttgactctgacatactcagtagggcaggttaattctcttgaatcttaaatttagccatctgtgacttcatattaatctttggtctccaaaaacattgggctgttttgcctctttctactcacttatgtcttctttatcttaattccaaatcccagcaactcagagaagaattgggtcctgcaaatgatattcacaatctattgctttatgggaggtcagtgaaggcctttcccatttactttgttaaaatctatatctattttcattcctaattttttatctgcaagattatgtagcaacatgggaaacatttataatattaaatagtgaaagaaggggacacaaaaattgcatgtaaattatgattctatttgaaaaaaagactgagcaaatagacaatcaaaaagacatacacacatacgagaaaaataaaactggaagaaaacaaagcaaaaaatgaataatgactatggtaaagtgctggaattgtggattttttaaattcttctctatttacctaaaaattttaaggtaataagaaaatacttttataattaagaaacagacttactaaaataaagtaggggcagaaatgaggaacaaagtttgctaaaataaataaaacaggaaagcttgtagataaggttttatggaagtaaatatacgtagctcccagcttagtgtgtgtgagctgatggagaaacacgactacagagctcttatggaaagcatttaaccatttgtcacccttgcagtctacttcaagagtgactaaaaggaagaacaacatgaggaagacttcaaatgtgttgaggatttgagaagaggggctagaagtccaggcatgttagaggttttggggctgtagagagatactgtagaagttactaaattgggggttttatgggaagtgcttcaagcatgacattgtgaggctatgatactgtttatttttagaagtcctgttgagaggagtatctttcacctctcactaaattagctatgctccttggaaccatggacatctttctgctgtagcagcaataggatcaaagcacgtgtttagaaagagaagtgaaaaacaccagatgtgagcaaaaccacaaggggaatttcagacaggcagcatgcaccagatgacccaatttggaacgtggcccaggccccaggacaggcagaccctgtaaggatcaggctggacagtcagaggttattgatcccgatttaagccaaatgttgctaaaacttgatctgtgaccttgcttaagccattgacctcctctaaaccactttcaccatctgtaaaatgcaaggactgtgaatttcctctcaggaatagctaatggaaaccatgctaaaaagtagagataagaatgaagcacgatcttgcgatcttgaacaatggtggtaaattgtatttgattatataaataccacaacatacacacacttacagtgtatagatgcgcacactttatgagaagaatgtgtataaaaaacatagaattggccgggcgcgatggctcatgcctgtaatcccagcactttgggaggccgaggcaggtggatatcttgaggttaggagttccagatgagcctggccaacatggtgaaaccccgtctctcctgaaaacacaaaaattactggggcatccacctgtaattccagctacttgggaaactgaggcacaagaatcacttgaacccaggaggcggaggttgcagtgagctgagattgcaccactgcactccagcctgggcaacagagcaaaactccatctcgaaaaaacaaaacaaaaaaaccccatggattaaagattgtgttccatcaattcacagagtaaataatctatgtgttgacaattgaaggggtagaaaaaatattttttctcttacacatagctctttaagattcctagggccagattcagcatactgtctagcacagttagtgacaaatgaatgttagtatagaatagagattatgcttcaaatttcaactgtcttcaccacttagttgctatgtggctttgggtaaggcactctatcattttgtgccttggtttcctaatctgttaaatgggaaaaatactagtatctacctcatagacttgtgaagattacataaagtgatatatctaaagagcttagatgagtgctgggtggataatgttagttattactatcttctaaagtcttctatgtggacttcaaagctctctgcatttctttatttcatctctgttttctcatttaaatgtttcccacattcttgctccattcaagaatatttcttgtttgtcttattcatctatgtaggatattgctccctgtagactttaaaccagcttactcattccccctcaaagccattactgttttcctatttacgtcaattttgagtcagtctctaagttgaccctacaaccagaaatctatgaagcgtcactcaatcctctgttctcccactcctgggcttcttatataacaggatgtcctcttaaccacaggggatgtttcactaaaattaaaatgtatatctttattttctttaatagaagaagtaatcagttatggcatcacagtatataacagaaaatcagcttgggatcactgagcatggctgtctttaagaggatggggcagtgaaaggagtcctgggtgcagtgaaaatgccttctaccctttggagagatgttgacattggagagaaagagggatgcagtactgggtccaggaagggaagatgttggaattcatcctaggtctcatgtaccaaggaagtgactctgtatgagaacagaggggaaaatcaacaactgatcagtgataactatggtattttggccttagggctattaggggatgatgagggcaaaactgagaggaatgttagggaatcactttctctaaagtatcaatataaattgactctacttttggcactcacggaaacagcagaaagaggacatcacaacccctacctggacaacttctgatccagtttcaccaacaacagcgtcactcctttcgaagagcactcttgtcttccactgttaccttgtatgattatgtgattgttatcgtccttatcattatcactctcaaatcacttgaatttcttgcatccctccactatgttatcttctaaaataattttactacaagatgatttaatcccatggaaatttttgagcccctattatgaaggctaaatcctagggaatacaaagatgagtaaaagagtcattgctcttaaggagctcatatcacaagatttaggcagattgaaattgctaaccaacatttaacccaggtccaggtgctcctaattatcttccctattggtttgtcttgtcctgttcatttatttaacacatatttatttatttctttatttgagacggagtctcgctctgtcgcccaggctggagtgcagtggcgcgatctcggctcactgcaagcttcgcctcccctgggttcacgccattctcctgcctcagcctccccagtagctgggactacaggcacccgccaccatgcccagctaattttttgtatttttagtagagatggggtttcaccgcgttagccaagatggtctcaatctcctgacctcgtgtgaaagtgctgggactataggcgtgagccactgcgcccggccttaacacatatttattgagcacctactatgtgctaggcactgggctagcctaaggatgcaatagcaactaaaataagcatcatatttacttttagagaatataactgcaatgtgaagaattaggctcaatgatatacctggttgactacagaagaaatattaagtattcctgtctctcctccacagagtgggatgcactccagtgcactcctcttccaaccattacgtagtgaagttttagctgagacatatttagttcttatgtgagtccaacttgagaggcacctgacaataagaggacaaatctccactgtaatgctgaatagctggtagtctcatgtccagtattcctgtgcaaacacccttgcaggaaccaagtacccttcatattatgccctgattctatatgggttagacatacacatcaaataattttggtttgtcaataaacaatctaaataatagaaggtacagtcaattatataaagtttccaaagaaggataggggaagagtttccaagaaaagttttttcttattggaagaagcatatcagatgaaggcaagcattactttatgtatatatgtatgtatgtatgtattttaaggcagggtctggcactgtcactcaggccagagtgcagtggcatggatcttggctcactgcaacctcagtctgctgggctcaagtgatgctcccacctcagcctcccaagtagctgggactacaagcatgcaccaccacatccagctaatttctgtatttttttgtagagatgggggtcttaccatgttgcccaggatggtctcgaactcttggctcaactgatcctcctgcctcggcctcacatagttctgggattacagatgtgagccaccacacctggtggctcactaattttcactaatggcaataaaaccactacttacaatatcagagtgtacaactaatgtattagctgactaaataagggatgtagtaaatttagtcagggcttctgcctatatagagtaagaccccaaggcatggaagaatgactcactgtaataaactaagccaactaaatattgatgaatagtgctcacataacagcataatattagaacagaaaagaaaattatagattgtactggataactcattcaagcataaaatttggaatctgatggtcctaggttcaaattccaactcagcttcctctttgccacctctgtggccttgggcaacttgagtatttttaaatttgaatactacagatctatattcctagctagtagagttctttctcttatggattaaataaagtaatacaattgaagtcacatggtgcacagtgggcacttcataaatactctagtcttcttttcattgtacagaaaaggaacaaaagcctggaggactgatctaactttcctgaaggcccacagttaaccaatgtcagatccagatgaaagcccctggcttcctgactcctggtccagctggctgtctatgatttccaaaacagggctgtgccaaagacaactgaaaatacatttacctctgtttttttaaagctgaagagaatgaagtaaaaagagaggaggaggctgatgtggggtgagaggtataagaagcagatttactttcctggttttgcattaccttcctgagtttacactgcctgagcacacacccactaacggtggggggaagtggcagagcgtagccaacatgggattaaaaattgtgttacatcaacccacaaagtaaataatctacctgcccacagttgaagagggtgtaacagggtattgtgttttttctcacacatagttctttgggtctgctagggtcattccagatctaattttccagaagatcctatatacgcctttccattggagttttgagcttgctaatgtgtggatttggcagacaaatgcaaattaaagaagatatatatgaaaaatcacttgtagcctaaacatgatttctgtgtgggactggtgctccacatggataaaaaagccatgggccagagacaggatgcttgactgcttccctgcactgctgttaacactcggggggacccaagaaaggagattaacttctctgggcatctattttgtcacctataaaataccatcaagtagtcatttgctatacattgaatgcaagacgtttgtcacattttatttttctgtatccttttaagagcttcatggggcagattgtactcccacattacaagtaaagaaataagggcttagagatattgtgacttgtccaacgtcatttagctggtaagtggtagaatctgacagaacctggatttgaacccagaatctgctttcaacctccaagctacactacttaatattgtgagggagggaaaggatgttaaccttcaaagtactttacatcagtttaaacaaatgttcaatacaatcatttattaggggtataattcctaggaggtgcctgtacttaagtcattttcagctcattgactttctcattcattgcctctcatctgacctgtgagcctcaaaccacagttatcctatttcatttcctttgtttttggtgtcagtactcctcccacattggctgatttcagggggagccggcaccacttctcttcaagtaggggagtgtaagtgtaggaagccactcatacacacacacataaatatgcgcgtgcacgcacacacacacacacacattcatattagtttgtgatacacatacgtggtttcagaaattgacaatttaagaatatgtcattattatgacagtgcatatatcatgtataaataattccccagaattggggttgggtgaaaaaaacgctgtgataaggtgatagaaagtgaagagacatgtactaaggagaatactaagagacttagaaccttctggcttcagcccccaccttgaattttaaaagaagttcatgaattttttcctgctcattcggtctcctgaaagatccttacccttggtaggaaatgagcttgatacaacccagtgttgtatcaactgatactgagctttcactctgttatctgtatctgcattccaggtagtggtggtcatcagactgtaaactttggaggctcagggtcacatctgtggaattctctcttctgtggtccggcatggcatacaattagcaaattggtgatgacaacgtttttcattccttctattgctttttatttggtttgttcaggagacagacacaaaatattttgagactcatttaattatagcccacaactgtcatggcattcaacaagtgcagttattcgttaaatatgtacttgttgaacatcatggtactattattgaacatcacaataatatttcattttttgcattaacccttaatggttacaaagtgcatctataattagtgtcacacctaggcttcctaagaatcctttgagaagggagaaaggaataaaagcattacctaccttatgaggatttgtgagaatcatacaataaaagacaaaagtgcttagcactggaagctgatgcagcgtaaacaatcatgaaatgttactactagcacagttattagcccatattactgatgatatacctcacttcctcaagtttgcacagtgaagtagtagaattcagctaagaatctgtttccagaccccaaatctgtcttaggaaactatcagttgagatcgcaattatggaaggcaaaaaaacagagccttaaagggagagcaaacatgacaggttttatggtgggtgagtaggcagaagtgtttagggaccttatgtgcattgtcaagtgctcaggggagagggtgaggcccaggctatgtaccacaggcagctgtacaattcatttttggttcctcaaatgttctatcttccctcagcaccttcacatagaatgtgttccttctcccctgtcttattctctgtcttcacctctcttcccaacacttcacccaacattcacgcttccaggctcaacccaaacatctcttcttccaggatgctctccctgagcccctgtctgcacctactgacaggcactcacagtactctgcatgcctcctttagagaacagttgtccaatatttgtcttcccagctaggaggtaagcactgagaagtctgcaactttcccttgcttgccggctgatgtctccccagcagcagtgtccagcacgtttgtcaagtgcggagcagctgctggccaccttaaagatggaaaggaacgagactgaaaaaagggtgggaagtcatgaaaacaaatttaaaatgctttactattttgccctagaaccactcggggtggtgctattgggaagagctaggcagtgagaaaacataaaggaggcaacggaaaggagcgagaaaaaagacacaagaaaggcatggagaagtcacttgatgcaaagagtagcagacataggtgctcatcctgaagaaggctgggccatggatgccaagccttccgcagacatatgaaaggttgctgagaattagccgtttctctttctttcaaacttccccttgtttatgtctgccgtcttttgtcagaaagagatgcaggggccctgctctctccagaagactaacccctgcagcagtccatggaatccagggctaagtctgctgaggggagagggagggagggaagagtttccaccaggatgacatatttctgactctgccctctgacaacaaagggtgccggtggtgggacttttggcaggaagcacccacctttgggggagtcagaatcatgttgcggggtgacagtgactgaggcggaccctggagccctggccgtcttccctgcgcggccctaggcagcggtgcctggatgatctcctgggcgcctcctccgaggttcaggcagggctgagggaggatgcgatgcccgagctccggcagggcccattttgtttatgttcccactccttcgccctgggaagccccgagttcccacactcactgaggcaggaaggtcaccacggacacctcatctgtctgggccgttgactaactacagataagcagcagctgccacatccatgttggggtcacctcccagtctgcccaccctggaaccaggggagaagcccccatccccgcccacttgcacatgatgcctccccagcaaggtcagctgctcctgaggccaggatggcgacatggggccacagaaaaacttgcttttgcgggagaagcaagacatgactaagggattgaaaggtcttagacatgactacccgagagcccaggcttatatttccaccttacctttttttttttttagatggagtttctctctgtcgcccaggctggagtgcagtggtgcgaactctgctcactgcaacctccgcctcccgggttcaagcaattctcctgactcagcctcccgagtagggattacaggcacgcacccccacgcccggctaatttttgtatttttagtggaaattgggttttaccatgttggcctggctgatctggaactcctgacctcaagtgattcgcccgcctcggcttcccaaagtgctgggattaaaggtgtgaaccagggcacccagcctaccttacatttgctgagcactttagagtttcacagcgctctactgcctgcatcttttcacatgactctgaccaccacccgtgaagatcgcagagcaggtgtttttgtgtccattttgcagatgagtaaacagccccaggatgttcgagacgcttgccaaattcacacagatagttagtggtaaaagtcatgttcacgggggctttgtgctaccccatgcaaacacaccacaccagctgaacaatcccaatttttatccctaaaagaggactctttctcccaggtttaacctgttttccacccaagcctgccgtgtagtgagaaacatagcagttttggagtttgaatctgattcctcttcttgttaaccaaatgatttagcagttgtgtatttgggacttgatttccctgaatatttgcttccacatgtataaaatgcagataatgctgcctaacttgaacggttgttgtaaggtttaagaataacaagaaacatctattctctgttttccataccctaagcttggttctaagcaccttatgttcattgacttattaaattctcacaacatgcctgtgtgatttcatgcatgctatcattatttcattgtacagttgaggaacaatggcagagaggtaaagaaacataccccaggttacacagagagcagatggcagagccaggattgcaacccagactacagagccgagtgcttaatctccaagctatattgactatgcaaattatgtttactgtccacaatcggcactcaatcaacagctattactaagaattggggaagggtttgtttgaattacaagaaaaatgatcagctaactacctgaactaattagatgaatcaatagtcctgtctactcaaaaatattttctatgtagtattctggtttctaatttcttcccactagattcatagctttagagcacgaagtcacccaagggacttttggcaatgtctagagacatttttggttgtcacaaatgtggggtgctactggcatctaatgggttaggccagggatactgctaaacatcctacacagaagagttcctcaaaaaagaattatctggcccgaaatgtcaatatgctgaagtttagaaactactttaaaattgagtatttagagttgagtcatgattacttaagttttgaagtgccctgctggatccaaatttgacacatatactaatttgtttattcaaattggacacatataccagtaaagtaatgccctgtttaatatctagtgatacattaacatggttccttatatgtgatcatttgtcattacttattgttgctgctgctattgttaccaagcaaagcagatgtgtgccctagaaatggtcaggctgatttggggtttgtggtagagttagaaaattgaagctgtttttctgttaaattacgttaccaacctccaaattgctgacatttcttccaatatattgaagtaggtcataaataaactcacagcaatgccatttcctttcagcatacaactctatgaatccctggtatctttcagtgcagtcagctcttgttttgtgtgttatgtacacaccaaacagatttttaaagtttaattttgttggccccttttgaaaactcctgtagctaatgacattttcaaaatgataaaagttttattttgtcaaacagaactttgaccaacagaacacccttggtacccgatgcacgtgtggcgcatctgtgatgcctggcagcatactgaactttcttactttgttggaaaacactgcgtgtcacatcatcaacactgattttcatatcatcatgcattagcttcaaagactgtgtttataatcctcaaaggagttgtatcagtcagttttagccaggttgtgatacagtaatggataatccccatatcctaataacaaaatagatttgtatttgttcatgttacatgtacaccgtaaattggccactgattacttcatgtcttttgcattcttaatctagactgaaggagctggccctatttgggatatggtagcatcatagcaagggaaatgagaaagatgaaaccacatgatgggtcttaatagtttctgctcagcatatatgacatatgtttgccttctattggtcaatgcaagtccatggccaaattccttccataggccccataggcaggggcagcaaatattttaaacaataagataatctgctataagagtctgtttttgccaccaaagtcacaaacttctaaagagccagggactcagccttgaatcattgctttctaaagatgtttttatcaagaaatggggagagaatgtaaaatgaaaaagttgaagaagtaaaattatcagattctaatggttaatttgataaggagcagagttgggtggcaatgccaaggaaaagacagaaatgaaaaataatttctaagattccagcttgggtgactgataaatgatagtgtcaacaagtgaggtagagaagagagaagaaaaagaggtttagaaggagacaaaacaagtttcatttttgatgcaatgaatataaggtgtctttggaacatccgtgtagaaatatgcagtggacagctggatatacgagtgtggctcctgagagagtactaagctggaaacaaagctctgagatgcaagaccatgtaaataataataatcactattagggttgcatttattgactatttgctatgtgtcaggcactatgctaagaattttcatacaatttgcgtatgttgtattatttaattttcatgtaaccatctaagctgggtatatatatatatagtcgatgttatttatactcatttagctgatgagtttaaaagagggaagcttagggccgggcgcggtggcccacatctgtaatcccagcactctgggaggccgagtccggcggatcatgaggtcaggagattgagaccaacctggctaacacggtgaaaccctgtctctactaaaaatacaaaaagtagccgggcgtggtggcgggcacctgtagtcccagctactcgggaggctgagtcaggagaatggcatgaacttgggaggcggatgttgcagtgagccaagattgcgccactgcactccagcctgggtgacagagcgagactccatctcgaaaaaaaaaaaaaaaaaagagggaagcctaaaagttgatataatttagcctaggtctcacagctaggaagttgcaaaaaagatgcaagtgtttaatctgtgtaactgacattttagccaggtacagtctcagttggaaccatgacggcaaatgagaacatccagaaaccaaagatagaaagaaaagagaagagcagtgggccaagggcaggaccctaaggaatatgaacacttaaggagcaggaagaaaaagagcccttggagaagacagagaaggaacagctagagggagacttgaagagcacagtctcagaagccaagtgtgcagagagtgacaacgaaagggagggtctaacaaagtcagggataacagagtagctgaagagcagaccttggaaatgttccttggtgttgagagttaggtctgctccctgacagcatctctaatctcagggaagcatctgtaaccagcctattccccacccacaactcaggaataataataataaaaaaacacaggtggctagtcacacactgactttggaaacatcaacctgttgctggttcactctctgaactttgtttctcaagactgccttgaattttttacctgtctggatagatctttgtttctgggtcttagtgacctggctttcagtctctacctatgtacacttctctgaggttctggactgttctctcagcttaggaaacccagccttacaccacatccttatttttggttactacccactcccacctacagtcagtgaggttgggcactgaccctcaatccacagggctgtatctccagctgattctctgaaactcagcctccatacgggaaatgagttgtggtctcagctggtggttgctgtatctgttctgtagatgtagcaaatgtctgacaacagggctgctgccttcgagatcacaggttgctggtcagatttgccaagtcttgcactgcctgttgccagagcaagctgtctgtcttcaggtgggccttcccagttgccatgttattttttgtcacagctccagtagcttatggagatagaaggcttatatttggggaagaggatacttatgtaaatgggacttctcatgtcttctggatagtggcctggctatagtctggaagcccacactgtgtggacaccactgggactttctcatagccctgattgattggcaagagtccttgaaatctgtagagtaggcaactacagcatcagagtgggtaagtatccagacctgcctcactctcagagatttgaaccgaatgagccagtattatgaagaaaagcaaaaagcatctcctcgaaagtcctgcaagaagagtcccctctgatgtgagggcaccagaaacctgtagcatctctattatttttgtttagttggaggctgcacccacccatcagccttccctgaccatatccctcagtgagggttaccagacttagaagatgaaaatacaggatgcccagttaaatttgaacttcagataacaaatacatatttggtataagtatatgccacacaatatttgggatagatttatattaagacattattcaacatttatttgaaattcaaatttaattggtgttctgaattttatctggcctccctgtggccaccacaacacccataacttgagacttggtaggaattcataggccttgaaatccactggggccctatctctcccaagaaggcagtggagaactttgtgaggaagaaaagcagatgactgggcctctgctaggattactgggatcctaatactgtctggttccctctcctgggccagctcagaaggaccataaaattagatcttctgagtgcctagcaccttgtctgccttccatcgttgcatttggatgacagagagtttgcagagaacacaatgcctcttgacctatggcagcagcatgatcagtatcctgcaggactttcaaggggatgctttttgctcttcttggaaaatgtcctaatatatcctgaaacatccacatgcaacctgactagctatgcttcatacaatactctagccccaacagttctgagttacctgaaacatcagcaccttcaaaacagcacagaaatgtgtgacatttctgaaccaagttcagtgtagccagttatctgtgattctggagtgagagacaccctggtcactgaggttacctagacattttcaagagatgtctaacaccattttgtctttttctgtgcaactgccctagtaatgacctcctaaaatagagaaggaagtttcctgatgtgctgaggttgacactatgtttggcaagtcaagactcgctgcacctctgctccagtacagcacaagcaagcactgacgatgtgccaggcactgctgaaagggcttgcctatattaactaatttaatactcatgataaccctatgagctatatgctattattattgctgttttgcggatgaggaaactgaaacatggagtgataaagtaactcctataaagccatacaggtaaaaaatttactaagaatagaaatgaatgcaagcaactcagctccacagtgtgtcctctgcacctgcatgccagctctacacagctggaacctagcttcattcagcatcacactgttgagactggtgctgccaacactgtggagtgggccaccctgacccaggagaagctttatgccacacttcattatccctgcgtggaaaggggaagggcctgtggtcaagcatgttttcaagccctagagggtccaatgtgtgatagggacttcagtctgccatagcctgaaagctcagctcatgctatgcaaggcagctcaccttatctgtgcttgggtgctccatcagctgtgtgcccagcactcagaatcacagaccagattctctatcctgaaagcctgagtacaagaggtaacagagagactcgctctggaagactatggcttgagtatttcacaatcattctgctcaaatgatgtattttagacattgatgcatggtcttaatcctgatacagggcctcttggggcaatttggattgatgttaaatgccacgaagctcttcataggagcaaggcagtgctcatccctgctaggaaggccagaatgcagcctcagcacagccactggccctccctgaggtgatatggtctggtacactaccacaaaagcacctggacccaaagcaaagatacctcagggttcctctagagccgcggtgactccttctgatccacactcgcatctgaaactccagttttgggacttctatttgttgtctgcccacttcctggattgattgattgattgattgttatagagacagggtcttgctatgttgcccaggctgaactcaaactcatgggctcaggttatcctcccacctcagcctcccaagtcattgggaggtctgcccctcttgacctcttccctgactctgccctcttccctccctgcattgctcctccacccattccagtcatttataccctgataggtaaaagagggcttctactttcatggtctctcaaagcactgctttccaaccacagccctcagctgtgcctcagtttgggcctatcaggtctacatccacatacccaccacccctagacaggtgacaaaagtagtgcttaagaaacaaatgtgcttttttgcctcccccacacaactgactgctctggctaatatcactgctacacactttgctttcactaattattattgcctgccctccagaactgcttttttgcatacaaaggtttttgtccttagtgttttttttacacctcttcttggtattattattattgttttttatttttttatttttcgagacggagtctcgcactttggcccaggctggagtgcagtggcgcgatctcttgactcactgcaagctccgcctcccgggttcacgccattctcctgcctcagcctcccgagtagctgggactacaggcgcccgccaccatggctggctaattttttgtatttttagtagagacggggtttcactgtgttcgccaggatggtctcgatctcctgacctcatgatccgcccgcctcggcctcccaaagtgctgggattacaggcgtgagccaccgtgcctggccctcttcttggtattattgatattcctgcagctagacagtacccgggaaggaatgcaccaactagaaggagctttaatgagcctactgtgttatggctggcatcagccttcagagaggtttgagcataggatgccatctaattccccgccagcccattcattctatccaactaatgggaaaactagaggattgctgataataatagcatcagcaaaaatagttaccatttatcaagcatttactatgggccaagtactacgctaaatgctctgcatatattttctcacttaattctcaaaaaatgcaatgaggagaatgctattttatctctagctcacagctgagaaaactgacctgccaaaaaagccgcataatgaataagtgatagagcaaaattttgaacgcaagttaatttaaagcctgggcattcagccactctgctgccattatcatacatcatctgacttccttcatgtcccatctcccaacttctgttttttattttctcttttcctgattctccagttacccaccctagcagtggaggtgatatatatgaactgcatgccaaagtgggtgtagactcataatgacaacataatgacaccaactggaccatgggaaatggtgaaggcaagagtagttatttcaacttggccctttgaaacagagaccctgccgcaagttatgaggggtttaagtattttcctgtttcatttgcccttagatcccaaacacctagaactgtgcctagctcatagtaggagcccaagaaataccagcatggaaacctggaaagctggggtaaatctgatgaagagcacaggagccttagtaaatccgggtgatctgaaactggctcttagttgagccagatgataggatcttaatgacaattgtgcaccacttctcatttcttgcgactctttgcaggtttgcttcttgctgtcttattccaactaaaaaattctgtttacttttcatgtattttctctacctcagaattgttgcttattcataaattctgccttcttatcacatggttctgcttcctcatagttttggtttgctataatcctccatggctccactccattgtatgccatcctttcagcttcagctcccatggctaactgcttctttctatccatgtttcccaattcaaatcccagaaggagagaatctgattgatcaaacttaccttttccactcaagccctggtttttgggaaggcagcccctaatgtcaagggccaatcactggtccaatcaggagccatccctgggcaaagaacaacctacctctgcttctcaaagcagggggctctgggtggggcactttcatctcaaagaggaagttgggtgtggcaggcactgtgttgacatatccagtataggagtgccctgggagcccatctctcatttctgaaagagatagcattgtagatctggacgtttcatcacatattcccaggaaagcccagccaaatgcagctggtaagttgctgaatgtggaattcctcttggccttccaactccttgcactcttccttctgggactactttggtttttcagtttattacctgtttggagttggcttgtttctggactctctcttctgctcaggtgagcagacttctaactggaacgcctggctcttggacaaggtgagtgtttggatccaactttggttctgcaccattctttcaacttggatgacattgcctcacctcttgtatccttgtcctctcccttctactcaatccactctgctctgggttattatttacctgagggtgccttcccttcccagacccaccaacatactcctgagggaagaacattcaaaagcagctggtggcttcagtgagatcaatttttagaggaatgatcggggcagaagctagatagaagcaagttgaggaagtggaaatagtgagtgcaagacacttttctgagaagtttagatgaaaaggaggggaagaaaacagctatgtgtcaagagtttggtgtgtgtgtgtgtgttttattttttttgaaagaatttgcttcttattatataacacatgattttgtaaaacattttgaaaaaaacaaaaattataaacaatatgtttacaattgcccattaaactactacctaagtaattacaatagttaccaatttttgaatacctactaaacagaagaattatgctaggaacttcatgaattatttttctatttcttgtgcaatacaatgtcccagatgggtcagaattcagacagatatggctgtgatgcagaattagacaatgtctcttccctttaagcaatgattggcatccattgatttataagggggctgagaagtttgctgggggcaaaatggaaatatttgcctcagtagggtcttcagcattcatgggcatgtctggagacagttccagaggtaggcagagtgctggcaggaatggtggggcccctggagagagcaccgttggttgaggaaggagtttgtaacggtaagactgggctttagacctggaaggtcgtggtaagtctgactgtcacagggaagggcctaacccagcttccttgcatgtgtcttcccagaagaaaacaaagaagggcctctgagtcatggaaagagccatgaaactctttaatgctctagggcctatcgcccagtaactggtaactcagtgttatattaaggaagagagcttttcttttcccactttgaaagaggatgctgacagacatcacaggggctatcatagccctcaatttcccataaaaccggcaccacagtgccagctgtgattgcagaaaaaggtttttatccaagttgtgttaaggaaatagtagttgatttcagttaattcagtcataacactttaccttgagcattaatgctgaaaaagtcaactctcttacttcctgtttttcaaaagcattattggctagggtaactgtgcagggctccacgctgacaccgtttgtggacttttagctcacagtggtgctgtcagtgccagcatcttggtgtctggctaactataacaatacacatgatgacaacactggcttaagaacacaggtaagatctgtccaccaatgacacccaaatgtctttgtacaaaaacacctactcgatgaggccctccctgaccaccttatgtaaaaccgagcaacccctctgccttcctaccctctgcctaccccgactttctttccatagcacttatcatcatctcatgttttgtcatttttgtttctttttcttcttttttaatcatcgtttttcctgtcccaaaaagcaaatgccaagaaagcagtgtccaggtctgtctgtttattgttgtgtccccagagcccacatcagtgactcacacagagtgctcaatatttattgagttaatccatttcatgaatttctcataaatatttggggaaggataagaactatgaagatttttaattaacatgatcacatttggatttatggctcaggagaaccaaggatatttgcttacatttataccacccttacaaggtccatactctaatatggccactttgcaggtgaggaaactgaggatcagagtgaaagcaacctgcctcagcccccatagataataacgatcagagccaatataaactggtgtagtaagtaagaagacaaagtaggtagtattgctataggtaaagcaagagctaaggaaagccttagttgatatggcagaaataggaacagagagaaagggacagaaaaggaagaaactgtgaagcctgattagaaatatggaaggcagaattcaatatactcctagaagcagcccatgaaaataaaatgaagaaagaaggattgtttttctaagaggagggtggcttcaatttctttcagaaaagattggctaactgaaaactaagaaagaaacagaccaaatccttgtagcttctagcacatctatgataaaattctgttaattggatttcatacttggattataactgcacaacacatgagagtaaaatgccttaagacaaaaagagtaaaaattgagtcataatatggagacgatactattctggcaatagtattcaaagaatggaccagggagcagtgcacagctttgggaagcaggggttgtcaacattaggactcagagttgttagtgatgaggttcccaggcaacataagagacccttgaaaaaggctttggcttagggaaaaagaattataggggccagacgcggaggctcacacctgtaatcccagcactttaggaggccgaggtgggtggatcacctaaggtcaggagtccaggaccagcctgaccaatatggtgaaaccccgtctctactaaaaaatacaaaaattagctaggcatggtggtgtgtgcctgtagtcccagctactccggaggctgaatgacttgaacccgggaggcagaggttgcagtgagctgagattgggcgccactgcactgcagcctggggcaacagagtgagacttcgtctcaaaaaaaaaaaagaattataggacccaagtaagaaggtctggctcccttggcatttctcaccccctggcccattagctggtgttgcagactccactgtggtactccaaggggttttagagaaagaaccagggcagatgaccatccaaatcagaagggccaggtaggatggtcagccacacatgtgaggggcagatagggaaacagaagattaatgcatatgggaagccccaggaagctaaatccatcccagatcacactggatactggctctgttgaggcaggtggtggggggtcagcctggtgacagcatatttgttcattcaatcaatatttactgaatgctctttatattctaggcactgtgccagacattgggctaggtgctgggaattgaaataataaactatttcctgatttctcttctctcttctggagaaagaattggattagaacaaggtatggttctcactggcacagggattgggcaaggccgtctgcaagaggcagacatcagcttgggcaatggggtcaagttggggatggcaggccctggctgatacaatacttatattttacctgaaatctgtgtttattttctatcttgaacctggtattgtttatatttgataagcaaattttatgttttaagtaattcctagacatacagttaggacattttgcaggggagggcttttgatttttaatcctaaaagcattagtttgtctgtattgccgggcttgacaatcacataaaataagtgtatttcaaatcactcaataggagtggctgcaaataggggaaagaacatgatctattactactttggattactactttttactggcaaaccataaatcacagtggggaagccacagtggagtataaggaacttaaatcatggcaagagtgatttaaggtcagtcagtgcagcagataatctggagagatgatcccactcataaccctttaagacatgacacttggtaaactacctaactcataagggtgtcctggcagtgaacctccacacctcctggttggggtgtgtgctccatctcacccagcttaagtaggcctgaaagaccaccctgttctctcaggcaagagtattcctcttcattactggaagggaattaaagacaaagctggtctaatcaataaccgcaggcccttgtctcactgagaagaataaaaatgaatacgcaattatttgccattgtggaatgtgttttccctagtatcaatgctgtatgtaatactaagatttctacagcctatttaatatagaatatatacatacacgcacatgcaaacacatacacacagatatatatatatatatagttgcctcttgtatggtatccagtcaagtgtctttactgtaactggaaatcaaaattacatcaatagaaaaaaatgctacaccagtagaaaaggtgggggggggaataggagaatgaaaaaggggaggagcaaaaatgaaaattcacttttaaacaaatgtaactttggctatatggttacaggtataggttctggctgaaaagatttcaatgtctgctttaatgtaaattataagtattccagaagacagataattttattttactttttttttttttgagagggggtcttgctctggcccccaggttggagtgcaatggtgcgatctcggctcactgcaatctctgcctcccaggttcaagcaattctcctgtctcagcctcccgggtagctgggactacaggcacccgccaccacgcccgcctaacttttgtatttttactagagatgggatttcatcatactggtcaggctggtctcaaactcctgacctaaggtgattcacctgcctcagcctcccaaagtgctgggattataggtgtgacccactgcacctgggtgacaagataattttaggagccactttaaaaagtttccggaactgtagtctattatttcagtctcagtcccatacaccatgaaaaatttagggcatttcattgctacaaagaattttaaagcagaatcaatccatgtaattaaatcttaacatttattaagtgcttattgtatatcaggtacttttacttttctaatcattgtacagttattaattcattcaaatcttacaaaagtctatgagttattgtttccattttacagatgaggaaattgaggcacaaatattgcccaagatctcacagttagtgattgacagtaagattcacactcagaccatctgactctggaggccacacttgtcattcatgttaatcttacttaacatgcttcatgctaactacagacttagttatctccatatgcatctttcaagtagatggcttatcacaacagcaattagacctgtttacatgtttggcgcttatttattgaatgattacctactacacactgaaattggttaagtttgtttctaaaactgacaagctttgttttaaaaacaattcatcttcttccgctctttttttcacaagaggtagttgtttggatagtaaccttttgagaaccaaaagaagtgaaggagagctacttttgtgagaatgaaaggtggagggtcattcattcaagaacttgtttttaccaggtaccagttgtcagtatgcaaaagcagcgaggtatgccaatgtaattcatgttcaataaacatcataaaatttatttctatacattaaaatcttcctgtgtaacaaaatgcatgttttatttttatctgccacttttcttaagtcagtagacaattccctcttctttctcccaggcttgatatgaggttagcttttcacaattggtacttctgggggggcaaaaaacaggcaaaataagtgaatgggaaagcactcagacttattatttattaatttgtgatattctagcctttcagtgactcttttcatgctattttttccaacttctgtgggatggggaaaaaacttatccggagtgacaacatttctattttccattattatttcttgcataaaatattcaaaaacaattgttttggcatcatctcacttcgaagataaagaaagcaatagtaaatatcagcctgcatattgggaattcttctagagaatattatttagacttcatgaaacaaaagaggagctaaaattatgctttgtgtaaatctcagatagtggttttggcttaaaatttgctatcccagcactttgggaggctgaggtgggcagatcacgaggtcaggagatcgagcccatcctggctaacacggtgaaatcccgtctctactaaaagtacaaaaaaatgagctgggcgtggtggcgggcgccggtagtcccagctacttgggaggctgaggcaggagaatcgcttgaacccaggaggcggaggttgcagtgagccgagatcgggccattgcactccagcctggtgacagagtgagactccgtctcaaaaaaaaaaaaaaaaaaaaagaactttctgttgtgttaaagttaactagcgaggagactcttgattcctaagaaatattaaccttatatccccaaatatatttcatgtgcagttcaacaaatgaaagttaggtgctctgaataggttttggggttaatgagtctattagaatacaggctttttgtatagcagcctcggagagctagcccagccaggcccagtttctgctgtttctcaagcacaggaggctgagagtagagaaaagtgctctgtaagaaggctgagcccctcactggaggtggaactactaccctacatgttttgtttgtttagatgatacgctgagaaccaaatctaccctgtcagcttactcttcaagaacaagccaagcaactgaaactgagtccacgctcagctaagtcaaagcccaggggattactggcatcaccacccaccccacctggagcatgacaatgtctgtgagagaataagagatgggtggtgtcaccactatctttctctttctgttctccaaattataataataacagtctcttttcctcctctaaacattttttataaaggaggttgaactcagttgaaatatcttgaaattactgtggctggtttacaagccactctggaaagttatgctctggcataaatttagcagctatgttttactgtaaaaagaaacccagggacatagcttattaagaaaatgtggtcaaagtgagaattttctttggttttatgaataaatatagatattatattacaaaattagatttatatcgttgagcttgatactagacagtaaatattatttcttaggaaaaggttaatacatcattaaattttaaaagttgaacacaaaatctctaacaaattaaatttaaatatttccatttcaatatcattgcagacagttcatggtagtgaagtacattgagaaaacttgttctttaagaaaacaaacttctgggtaaaagatagtaatatatcagcaaaaaaagatttttatcaagagggttgaaggctatagcatcatcaaggtaaagatcaaatagcatggaggctaaaataaacctgtgcttttttgagcgggtggtcaatagaaattggctctgttgctggagatcctgaattttaaattctggtgatcaggccagtaatatgctgatgaagcagaaatgtcacagcatattttaccaagtcaaagacaggcaacagttatgagagggacatggagaacctggtagagctctgtgtactatgctgaattaataaatagagaactaacttaaggtggacaaaactgctgggtgtctctcaggcttctaatgttttcaaaatgtatttgaagacttaaagccttataataataagaagaagagtagtccaagttctgtttatttccttttaaaaggagtcaacacttgaggagacaattctgtactcccacaacaggaaaaatgcatccttttaccgtgtgaataattgaaccagagtcattgcccactcttcaggaaatagctcatgtaaacttttggccgacctgtgcttcacagtgcacttacctcttgacatccacctctgtaaacttttatttgtattaccaaatattgactgcaaacaaaaaaaaaaaaaaggaagaaaaaggaacctcccttatacaattacagaacgttagagcaaaagagaactgaaagatgatcttgtgcaggccaccattttatagatgaagaaacaaaagcacagagtgacttgctaatgcttcaccaagctggcacagcctggcctagagctacattcccctgtgtcccagacccacatgccagcaccaacatcatggatcctctctctctctctctcttgtgagacagagtctcactctgttgcccaggctggagtgtagtggtgcaatcttggcttactgcagtctctgcctcccgggttcaagagattctcccgcctcagcttcttcagtagctgggactacaggcatactgccaccatagccggctaatttttttgtatttttagtagagacgggatttcaccatgttggccaggctgaagatcctctctcttattgcttgatgaaaaaatgtattaggcactgggaggatagaaattaaagagccccaatacttgacatctaggagctcacaacccaataagaaaagtacacatgtagaccaccctccaatattttactgtactctgtacactgttgctagaatgatctttctgaaaatacaaattgtaatgtatctaaccctgtgtaaaaccgtgcagtggctccttgttgcctgtaaggtaaagctttccccttgttctccagccttctgtctaactgggtctatgctgatgctcaggatccagccatagagaaccaattgcttttccctaaatatagcaggcttttccctaaatatagcaggccctttcatcctgccaggcctttgttatgctgttctctgcctggaatgacctcctctcattaccctccaggagggttatctctcttgtaatagatttccttaggtttctctccttccacctccaaccccacagacagaattaaccattccttcctttgtttatttgtcctgcccatatttctcctacagcacctatagtgctttgtaacattgatttttttttttttttgagacagagtcttgctctgttgcccaggctggagtgcagtggcgtgatcttggctcactgcaagctccgcctcctgggttcacgccattctcctgcctcagcctcccgagtagctgggactacaggcgcccgccaccatgcccggctaattttttgtatttttttttttttttttttttgagacggagtctcgctgtcgcccaggctggagtgcagtggcgcaatctcggctcactgcaggctccaccccctggggttcacgccattctcctgcctcagcctccggagtagctgggactacaggcgcccgccacctcgcccggctaattttttgtatttttagtagagacagggtttcaccgtgttagccaggatggtctcgatctcctgacctcgtgatccgcccgcctcggcctcccaaagtgctgggattacaggcgtgagccaccgcgcccggccaattttttgtaattttagtggagacggggtttcaccgtgttagccaggatggtctcgatctcctgacctcgtgatccgcctgcctcagcctcccaaagtgctgggattacaggcatgagccaccgcgcccggccgattgttttaaaatacataaatgtacttgccatttacacttatgtctttctctactaattgaagataagctccttaagagccatctttgtaagggccatctttatctttgtacccctagaatctagctcagtgcctggctcagaacaactccattgaatgaaccatccatacaggcccttacatcatgctatgggaatgcaacagaaggagcagtgaactgtgcttagaggagttgccttggaagctgaagcatgtataccaaatagaggaacatcagggcagggcaagggttggttcatagctggtcgccagaatagaatgctcaaaggtacaggggcctgagaagtggtggaaaggttggcaggtttgggaaatttgaggatacctgagaggatggactgtgggatgtggtggtttgctgttattattcttattgttaaaccagaagaagaggctatgagttagtcaggggctgtgtgttaaaaggcctggcaattcatgctgagaaaggagttttgattatattacaaagagctaaagaaagaagagttttgaaggtcagtattcaagagtagggatgattggatatgcctgtcagagacaaaggacaatgcagtgaccaggagaggttgctccagggaggagtgggactgcatcttagagtctgggtggggcattggtgatctgagggttcagagaactgagaatggtccaggtgaaaactgatgagggcctgaggcaaggcagtggagatggagaaaatgagaatgattggagaaataaacacagcagtggtggaatggtgactggcaatcagctgaagatggggaataaagggaaatgaggagtcaaaaatgatcccaagtgtttatcttgaatgtttaagcagatggcgttgtcctgatatggaatgcagaaaaataacatcgagttgagtttgtgatgctttcgagatacttaaatgaaaatgttgagaaagcagttgaaattacatgtctcatattcaggaaagagttgagggcatgagtctctctaggtaataactgattccataggacaggatgagagcatctgagagcatgtgagggcgagagaaggtctagaatgaggccctcggttaaggaggagagagaggagaatgagacaacaaagaaatccaatgtggagtcatgagagccatagaaaaagagtttattcacagggaagaaagagtttgtagtgttaaaaatcaaagaaaggatatagattgaaaaaaaggtcctgaaagaactgtaatataaggctacaaacatactcattgggggctggaggaagtccaacataagccagccccagcgttgagccagtgaatcggagacaaaaggctccctctcttttttagtcccagccagttcataagcctgaggttgaattgcaactatgatttatgctaaatagctttatctaattagggctggtaaaattgaagtggttggaatacctctggcaagaacttgataaaaatttgagagtctttcacgttaattttaatcttcgtttgcatgaaatgggatggttaaggagaagtaaaagaaaaacatgaaaaggaaggcacaataagaagcattcattctttaaaggaaaatggtgtaccaaagagtcgtcccagagctcttccttctcctgcctccacatagtctaaggtctgtttacaggaaaaacctaagctagcgtggccaatataggttttaatgggtgagccaaaaaaaaaaaaaaatgctttcatggcaaaaataccaaaagcaatttcaataaaagcaaaaattgacaaatgggatctaattaaactaatgagcttctgcacagcaaatgaaactatcatcagagtgaacagacaatttacagaatggaagaatatttttgcaatctattcatctgacaaaggtctaatatccagagtttacaaggaacttaaacaaatttacaagaaaaaaaaaaccccattaaaagatgggcaaaggacatgaacagacacttctcaaaagaagtcatacatgtggccaaaaacatatgataaaaagctcaaaatcactgatcattagagaaatgcaaatcaaaaccacaatgagataccatctcatgccagtcagaatggctattactaaaaagtcaaaaaacaacagatgctggcgaggttgtggagaaaaaggaatgcttttatgctgttggttggagtgtaaattagttcaaccattgtggaagacagtgtggcaattcctcaaagagctagaggctgaaataacatttgacctagtaatccaactattgagtatatacccaaaggaatataaatcattatattataaagatacatgcatgtttatgttcattgcagcacattcacgatagcaaagacatggaatcaacctaaatttccatcaatgacagactggataaagaaaatgtacatacataccatggaatactacgcagccgtaaaaaggaataagatcatatcttttgcagggacatggatggagctggaggccattatcctcagcaaactaacgcagggacagagaaccaaacactgcatgttctcacttataagtgggagatgaatgatgagaacacatggacacatagggggaacaacacatgatggggtcagtcagagcggggtgtgaggggagggagagtgtcgggaagaatagctaatggatactgggcttaataagcaggtgatgggatgaattgtacagcaaatcaccatggcacacatttacctatgtaagaaacccccacatcctgcacatatacccctgaacttaaaagttgaaggaaaaaaaaaaagtaaaaaaatgccatcatgatacaattaggcacttataaaaaatgtgttccaaatccctcaaaagtgttttagtaaggggcttactaagtatggagatttcaaatgtggtatgtggatggtgctaaaattgagagtaagcatttagaaatttttagagcaaatcgagaatgctgtaacatacaagcacattgtcagtggactcatgtcaatgagcagggtatggactggtctgggtgttgtggaattctcatagtgagtcacaggtggcatgacctgtgccctagtcatacgcaggaagacacttagaccacaagcttggaaattaaaaaaaaattaaccacacagatagtttgaaaatcactgctttagatcacaacctatttgtaagttaagaggccctacagctcgtttggtgcaaggaagttgacagagagcttgagcatacaccaaaaaatttagatataaagtgacgggaaatttgaagccattgtagaagatacgaattggagatggaactacccaaaattaccttctataaggatcttctagattaaatgcaagctaacttattcttaaaattgttttgttcattatgatatgaacagagtctatatcagaacctggaacatggcaggcactaaataaatattttatgaatattgaattagttgttctaacaacatcgtggagaatagcttgagaagggtaaaggctagaatcagaaaaagtggctaggaagactttaaagactgtctagacataggttgatgggtggattagcctagtggatacagagattcagaaaatatgaatctaagaaatattgggaggaacttccagtttttcccatgtcagtaagcacatggacattcatcaaagtccaaatcagaaatgtggggtcatccttgactcttctctttctccttgctcctcatatttggtcactctctgaatcctaaatatcgctaccctgccttctcctgctattcacactgctttagttcaagccccaccacgtccctccaggactttgttatagcttccttaaatggtctccctgccctgggttcttccccattaagcttttcttccaaaattgaaaattcagtgtttttccttttttgtgtgaaaccatgaaatggctcctgatttaccttctaagcttcagcatacctaagctccatggtagggctgctccttaccaggccttgtgtcatctggcacttgctttgcatgccagtgcattcttctgctccttacttggtggttcttaaaccagaccaacactaaacaactggtaacccctgccccaagggtttgccatgttatttcatgcctctgtgcctttgcttatgctattccttctgcctgaaatgctctcactcccagcaccctggctgcttttccatctgtattcatttcctgttgctgctgtaacaaattatcacaaacttactctttttgaggtcagaagtctgaaatgaggctatttcatgaggctaaaattaaagcattggcagaccttcatacctcctggagctggaggagagacactgttctttgcctcttccagcttctaaccacagtttttgtttttgtttgtttgtttttggttttggctgatggtccctcattgtcacatctctttctctgacactcctgcctcctttttctataaggacccctgtgattacatcaggttcgtctgaataatctaatcttcccatcttccttaaacgtagtcatatctgcaaagtcctcattgacatgtacggtaacatttacaagtttgggatgtggatatctctgagaagccattattctgcttactgcaccacccaaccccaattagtctcttaaagctctgctatcactttttctctgaaacatgttctgctcagagctaatcactctctattttgtgtcatatacatactaccttcactgcatgggttggcttgtattgcacataataacttttaaaacacatctacctctctattatattttgatttcttgaggggacagcttatttatctttgtattaccagcggtaagcatgttacatggtatatagcaagtagtaggagctaaattatactatttaaaaatgaatgtcccaggcagtgcaatgatccatttgaatgttaactagacatgtaggtttaaatggtgactacagttgtggtgcattcctaactttgcagggtcgttgcctaccactctccctgcccacgcttgtctgcttcccctccagtcacatggcctttctaaccttccttggtcatgctgttcctatcccatcctcatctctctgtctgtaatgcccttcctccaacttttcttttcataaatccctaattcattctcaaagcacaaatcaaaactttttccttctgcaatgccttttatttgtctcaagacagaattcatcacttcctcttttgagttgctaagacattttgtacagatctgtattacatatttcacattgtgttttgcttggttttatatatgtatctgttccatcacaagaatgcacaaaagccatatcttgtttatatcagtactaggcatatagcaagcactcaataatgtttatgaccttaaagcgaacatataaacagatgagaatggaggggcaacagaaaggaaccaaaagattaaaagagtgcctttgataaaagataaagaggaaggaagagactgagaagaccctcaaagacagcattcagaagaccctagaggcagagtgtgatgaaggctggagttagagtggctgacctctaattaaagaggagaatgtgagaggcagcaccacatgcagtgagctgcaggcctgagaaagagaaaggctgttggatgtgaccacgaagagatcctaatggttttaggaagcataatgagaatgcccagtcaggaccctgggtctgctcctgtttttaggttaggagagattaggttaggttaggatctccagaggataaatgacttgaggaaaaggaatatcacacttcatatccaatcaacttgcttgaatgcttgaggccatgaacacctcagcacagctccaagtcagtttggaaggcttggttctttcatctgataccacgacttcaaagtactaggagatgtagatggttctcagggaatacagaggccaacataatgtattcccctataataatcagagattttcatcaatagggcacagttggctgggtggtccaggctcctgaggaacaaaggcaaaatgtctaaatctggcttcagaactgagaataatttctctttcacggaacttttctggatgatgatatttctctatataaagcattctctgacccagtggacaaatatttctcacatctctgcctgccttgaaccttgccctcctatcttccatcaacactgctgtcagctgtattctccaacctgtgtcttgtttggctaacctgtatggccaactgtctgtctttacctttacaaagcctgatctagacaaacttctatgctggacatctgcactgattttcgcccaaatcaattgtctagcatctatttctgtgatctgcttctgctgtgtcctgaatcagtctgctgtggtctgataggttgcacattctcaatgggagtgagaattgatcttgggggataaaaaacaacttaattttttaaatgtacaaagtgcagatatacatacaatgcataaaccgatatcacaatatatctgcgtgtattagggctctccagagaaacagaactgatagcatatattatatatagatacacagaaatagatttattacgagagattggctcatgcaattatggaacctgtgaagtcccatgatcagctgtctgcaaattggaagcccaggaaagttactggtgtattataactccagtccaagccagaaggcctgagaaccaggagagccaatcctgtaagtcccagtccaagtccaaaggccccaaaaccagaaacactactgatatccaagggcaggaggagatggatgtcccagctccagaagagagagtgaacttgtgcttcctccacctctctgttttattcaggccttcaagggattgcttgatgcccactcacactgccaagggtgatcttttattcactctaccaattcaaatgctaaccttttccaagaacaccctcccagacacacccacaaataatgttttaccagtgatctcagcaatccgtagcccactaaagttgacacacaaaattaaccatcacactatggtaccaaaatttgatagaggagagcaatttttaaaaacatcggaaaagcctccttaggaaggcaataatgaaaagaaaagggttgagaaatattgtgataggtgatgaggctgcaattcctgtaacagaaggaacataaggagactggattgtgaggaaatggaggtagtcacagttatttgactgagaagtagactacagagagaattccgatgaagcaaacaaattatgagcacttattatgtgccatgaactgtgtgaaaccctttcacatttgttagcaaagagcttctcctttagtagtaatgtacatattccttgcagaaaaaacagtgacattttccattgagacagtagcgcacctatctctcctctgcttcagcagcctttatgctaattactgttttggaagtaactcctcattcactttttgcaacataagataatgagaaatacagcccagattttgtttgtagaagctcctttcatggcagcctttcaacagtttgggtaatttaaaagatgcagttgtaatcgtgactaactcattaagatgcttgatgagcatcttaatgagttaaaaaacctggacatttttaacgcacttttggaaagaggcaagaaaaatataagagtgggaataatccaaggaaaacatttcaagtctttgaacaatagaccctagaatttccttagcttgagataggttaggacaagaaaacagaatgttgcttaaaagaagcccagtgatcatttgtgtctacttgcacttctggaatatgacttttgtttgttagttggttcattttgacttaaaaagtgtttttcggccaggtgcagtggctcacacctgtaataccagcactttgggaggccgaggtgggcagatcacaaggtcaggagatcgagaccatcctggctaacatggtgaaaccccgcctctattaaaaatacaaaaaattagccaggtgtgttgacgggcgcctgtagtcccagctactcgggaggctgaggcaggagaatggcatgaacctgggaggcggagcttgcagtgagccgagatcgctccactgcactccaacctgggcgacagggggagactctgtctcaaaaaacaacaacaacaacaacaacaaaacccacaacatttttctttgttctctctcagtactcattaagaatttactactgcgtctttagattttatctcaggcagatcaatgctatgtatttgtcccctgtacttgatccctgtgctttccttctctcctactttcctactcttgtcatgagtgctgaggcagggatgatgttggggtggaaagctgaagggcgaagatgaatgagccacagtgtccacttagaatctacagccaactcttggcagcttatccgtggtaattcttgtttcagcttcttgttgactttatcacccactcaatgtgcttaattctatgatggatgttatcaccagctctgtttattcacaatgccaagaacaccagtggaacagggaaatattcaggaaaacccactttatggtgtcaacttgaccagaaaacgaaacacaactccatcattgctttattgaatttggcatcgttctagaaataaactatcatttatattttgtcaaacaaaaagaagaggagaagagatttcaaaagcactgcttctggggagggtctggatcaaaggtaaatgtgtgactttaggtgacagaaaagcatctccactcagatgcatccaactttgagggggcactgactacaggacagtagagacaagggacactcatgaacaagcagcttttccaattctgggtccttttcaaactgtagtatcaacatatatttttaagtttcataaattcttggaacattaaacatatccattcaaacagttctttcaatatggtggatatttgtaggctgccctggaaatcagaacaccttgaatttaattcctgctatgacactggctgactctgtaactttcaccttttttagttctccaagatgatataaataatggaaaacatataggactctaaaatggttgcaacataggttcaaatctgacccctaccacttgttagcttgtcaacattggataagttatttgacttctttgagcatcagtatctttatttgttaaatggagataaagatatctttcttgcaggaatgttgtatggatctaatgagatcatgtatgcaaaacacccaacacatagttgtcactttataaatggctgttctagtagccatttgcacagagatggggaaaggctaggtgacaaaaggcatgggcattctgagctcatcagttgatagggcttccttaatgccatagctttattagagaaggaggaggatacagcccagccacataggaactcaggcctcttttatttctgcaggatctggtcaccacaacaatcagaatgtgcaggggtaagactaaggaagagagagagaggaagaatggatggtgggggggggggcggctctcttcttcctagcggcagagaatcccgcagtattccttcagttgcagaaactaaatggaaggcaaatggctgtctgcttgtggtgcatgcaccaagacaaactactaaagtgtttcctgcccagtccccacaggtgttgcttctcagctttggataagtcctccagcaagtactttgttgaaagcgagaaaggcagctgcataactctccagtccacagagctgacaaatcactgtgtcatcaaagaagagggaatcatgggaaatagcctgtggttcaccctctaaggcagggagtcaggaggctgtgaggtggcacatttgattcttgctcattaacatagtttctctttgtgtcctcctcctcctctttgcctgcttgcctgttccactgggtaagcagcaagtgcctactcaaatcattatttatcaaatgtgtactatgttcccaacattcattcaatacacctatattgaaagccttttatgagaataacaaaaataacaagatagattcagagtaagattcagagactgaagcaagtccgcatatagtaatcacatgttcaactagttgttaagtggtatatataatacatagaaaccaaccgtggaggacctcagggaaaggagccaggaagctgaggaaggctttggagagaagatgacattggagctaggccttcacccaaaattccataggtgttggtccattttgcattgctataaaggaatacctgagactgggtaatttaaggggaaaaggggtttattttggccaggactggtggctcacatctattatcccagaactttgggaggctgaagcgggtggatcacttgaggtcaggagtttgagaccagcctccccaacatggcaagagcctgtctctactaaacatagaaaaattagctgggtgtggtggcacaagcctgtaatcccacttacccaggaggctgagggatgagaattgtttgaacctgggaggcagaggttgcagtgagcggagcttgcaccagggcactccagactgggaaacagagcaagaatttgtcacgaaaaaaaagaaaaaaagaaaaaaagaggtatgtttggctcacagttctgcaggctgtaggtgaagcagagtgctggcatctgcttctggtgagggccttgggaagcttacattcatgctggaaggcaaaggggagccagtgtgtcatatggcaagagagggagcaagagggggggggtgtcaggctccttgtaaacaaccaggtctactgtgaactaaaagagtgagaacttgcttatcaccaaggggatggcgctaagccatccatgagggatctgccctcaagatccaacacctcccattgggccccacctccaacattggggatcacatttcaacatgagatttggaggggacacacatccaaaccatatatcactatgggtcaactatatcactatggatccaggggaggatgggataggggaggggaggcagcaagggcattataggcaaagggaagtgcacatatgaaggtgaagaggacatgagcccacagcatgtctggggactggctggtagcttgatgtgcctggaacaaaggctatgcaatcctgggcagcagcagggggagaggtaaatgtggtcggaatgccaacgattttccatgccagtctgtccagtttgggctttaactgtagagaatggggagccattggtgagttttaagtatgaagtgatgggtttatacttgtattttggacaatcctgtgggcttcagagtactgaatggactaaaagagaggctaaaagctgggagacagttaagagctcactgaaattgccaatgatgtcaaatgctgcaaactcatcaaggaaaatgaagactgagaatgagttcattgcatttgacagttggagatctttggtgacatctaaaagtaatttcactataacgactgaagcagaagctggattactaagccagtagttctcaaagtgtggtccctagatcagcagcactggcatcacttgagaatgttataaatgtaatttatctggctcaacccacacccctttcaaaactttgggaatgaagcctagcaattggcatttttacaagtcttctggatgattctgataaatgctaaagtttgagaacaactagcctaaatgactcttcatctcttccccagacgttccttactctgatgacacctgaattatttgatatttcctaagtaatcattaatatggtttctcagttatctgcataaattgttcctgtcagtcatgtgcaatatatgtacagtctctgcctgataatattgaactcattgttcaaggcctaactcaaatgtcacctccctaggaagtctctccaatttcctccaggcagccccccatggatacttgtgcacatatttatgtcataaaatgtatattatttgttgtgttgatttggtttactatcttccctactaactagaagctcttcgggagtagggactgctttatcgatctctatttccatattgtttttacatcttaagtgctcaataaatgtaagaagaggaagctgtaataaattgcagaaataaaaacagaaagggacaaaccactgttttaagaggtttggaagtgaaagatgaatttgaaatagaaatacaatagaaaatgtgtgtgtgtgtgtgtgtgtgtgtgtgtgtgtgtgtgtgtgtgtgtctggaagaaaactgttggctgagggattaagccagtagagagggaaagatgaatgatgagacagtgggaatcagtgggtattgaatgcaaaatggtcctggagaaggcagaagggaattaaatcaatggccaatgctgaagaattagcattgaaagaaggaaagactctttttttctgagatacaacacaaggaagtaaaggtgggtacataagtgatgagttgtgaggttgagatgggagatggtagggagtccttagatggcctgtcagtgtagaaatggtgagggctagggaaggttttgcaggggaggtgatatttgaactaggagatgtctttagtgaagtaggaagtgaagccttttgctgggaagaaaatggggaacagaaagaaggaaagaggctacagcagagaggtgaagacttgtaaatgctagggaggggattggagaacaacagcaggggattcttttgggctgatccatctccctgattcaagacaaagaaagagtccacttattcatccaattgtgattggcaataaaagaagtatggagggattgtccccaaaggctgtctttgaaataagatggacaacttctggatacagatcccaatactaatatagaaagtattctagctctatatattaattaaggctggaatattttgcagacaataacaatgctatgtatggcaactatgtacaacaaaggaaaatatttatggtatatgaattgcctaagaaatctggataaaaactatatgtatgtcggccaggtatggtggctcacgcctgtaatcccagcactttgggaggccaaggcaggtggatcacctaaggtcaggagttcgagaccagcctggtcaacatggtgaaaccctgtctctagtaaaaatacaaaaattagccaggcatagtcacgtgcgcctgtaatcccagctactagggaggctgaggcaggagagtcacttgaacctgggaggtgggggttgcagtgagccgagatcgcaccactgcactccagcctgggcgacagagcaagactccatcttaaaaaaaacaaaacaaaacaaaactatatgtatgtcttgattacaactctgtaagaacatacatatgaagaacaaatgaataaaacacatgaaaatgctattagtggtggtattataggtcatttttcctttaaattttaaattgatgttttaatgtttataattagttggcaataaatagaattttttttccttgctggctttaaaaaatttactaggaacacttagaagagagtatttcaaaataaaaagttgtaaggtgaaaacaatcagtagaattgtatgaacacctcccatataagggacagatgccaggaaaagaagtccttaagttgagccagagttggaagctgacaagcaagaggttggatgccacgatatagaagagcacaaaagaggtatatgacctagcccttgactcacagtaaacttgagagactaggcttacaataaatgattcgaggataacttattcagttatctaaacaacggatgggactggatcactgaggcagtgacctgtgggcaggcgggacaatgcagaggtcaattatgtgccatcggagttgatcagatggacctgggcttaaatccctgtgccactgcttagcagctgtgtgatctaagacaacttactcaggtttcattttctgcactgtgaagtagaaataataataccttctcataagctgttgaagcattacaaacaataaagcaggtaaaatgcttaatacaatgtttgacacacaaaattgccattatcgttattaacgctttattgttgtgtcatctatgagtatttatgatggaggaaactgatttagactaggggcacattgaattctttggagggacttcagggaggtatcttaagagccgtgagagagtctcaggaggcagtgaagactccctcactgctggaacaatgctgtgggctcaccctaggccttcaggaggggagagagatgtgcaaggaggaactccatggtggttcttcttttgctagtgtttgtgctacttccccacttctaaacaggtgcatagtactccatagcaccctttcatcttcctttcccactcttctgttctgtttttcttctcttcaactcttcttacttcccttttctcctcaaaaccaagtggtggatgggtaaggaactatactatcttttgtgtgttctaactttgccgtttttttttttttgttgttgttgttattgtttgttttaatttttgttttttcttgagacagtgtctcactctgtcacccagactggagtgcagtggtgtgatcacagctcactgtaacctcaacctctggggctcaagtgatcctctcacctcagcctcctgagtagctgggaccacaggcacaagacacatgctaggctaatttttaaatttttcatagagatggtgtctcgctaggttgcccaggctggtctcgaacttttcgcctcttgtctcagcctccaaagtgctgggattacagggtgagccactgcacgtagctcggatataattgttgagtagctgaataggagacctaagtcagccttgaaaatcacctgttcctgcttattttcagggatctctttcctatttgccaataaacacattttagtggactaatcatgaatcgttttatggttggcctcacatttaaaatgttggtggtgctcctcctgccctccaaagccctttatggagcacattaacagagccctgccagcgttacaagctgggccccacctgaggttgtctccattgccccctccacccactttactggccacagaatgtttgtgctttggtgttttcatcagttgagttccttttgctcaccaaagaaacaccacaaaagacacttttgccagaaaacctttctcctcccttgcttcaaatacatcactttacaaagagtgttttaattaaaacagcttataaaagtttatgctttggatttttttcctcccagggaaacagtattcaggctgcatagagtcattctacttggtgggatgactgtcctaaagatgtcctttccctaagcccaatttccccaccagagagaagagcctgccagggttgttagggccgagaagatggtctcagatgcagcagcgtgctgggcccattgcagagtgctcagttcatcttctgggtagtctgtgtctggtttcatgccaggagggagagctaaagggaagctacagaagcatccacggttggcaggactgttggacatttgcggcttcagcagggtcaccctgtttggttgagcaggttgtttctgtacaaggcagcgagcatccagggtctgagtcagggactgagatccagactgtgccaggcttgacctatgcctgccatggggctgggtattagtttcctgtggctactgtgatgaactgtcaccagctgggtgccttaaaacaacacatttcttctctcacagttttggaggccagaagtctgaaatcaaggtgtcatctgggttctggaggctcagagggagaatctgttcttagcttctggcggctaccagaaatctttttttttttttttttttttaatcttaaaggttgtcttctaacttcagcactcagagtttacataagtaagcctgggtttaccctacccactttttcccttatttttaaaatatctatttccccaaccattgtctttagtaagtactctaaaatgacagtcatcagcagaaacgcaaggattccaggccataagagtttgatcaagaaaggattttttgaggtagctatatcttgcaaaagaaacagaggtgtgaactgtctgcagggctcttctcggcaatgaggtgttccttctggattcagatatagatcttaatggggtaaacattctaggtcttaccaccatctgttcttctttttctgcttagactgttagtacctgttataagaggaaaggaggcaaaagtgtgaaagaaaaatggttggatcagtggtctgagaaagaggataaagtagtcatgtgacattattcttaacagagattagaatgattaaaaacaaaaacaagttggtatccaggatattcaggtacaaccaccccttacctgctgattccaatttcacattccattccacattgatgaataataataatgatgtacttttagctttgtcagaaatcctatctgcatatttataaggtcattatgtttagttgttgctgatacctggtctgagtccagcaattaccacctctgtctctttgcacacactggtagacatacacaccactgatttgtactttcctataaaattactcttcccctttttaattagagtgttttcagaagcaaaccctatcgttaaggccatgtatgcttccattataaatacctgtttccagccattaattatctcccaatgaattacttacttagaaggagatttttaatgcattttttttttttttttttttttggagacagggtctcactttgtcacccagactggagtggtggagtggtgtgatcacggcttactgcagtcttgacttctcaggcacaggtgattcttccacctcagactcctgagtggctgggaccataggcgtgcaccaccatgcccagctaatttttgtattttttgtagagttagggtttcaacatgttgcccaggctggtcttgaactcctagcctcaagcgatcctcccgtcttggcctcccaaagtgctgggattacaggtgtgagtcattgtgcctggcctgtgcacactttttataatgggatttctcttccttacttttgatgtcccctctctcatacttagttaaccattttgaattccacttagtaagaaaagtttccattttctttttcttcgggggacttagatatgatctgcacctagatggtaagaagattttccatattttgaagtagaaactttctgtatgcctgaatcttgctgtcaagaatgtcttggctaattatgaaggaagaatataagaatgtgagtaaaaacaattcaacagtccctgagaacaacgtcaataaatattcaaaattgcataaccattttagtgactaaagcactgagactcatccaataatactgtggtttgataattacacagttgtgaatttatgatactgttaaattggggagacatcttggtgcatacaggtcaaccttttcatacatcattatatacaaaaagtacacacctacttaggaattgaagtgtaatacctcctagcataaaatgcttaaaagaagattttaagggagtgatacagtgagcattcctatatgaattttcctgcttatctcaagcatagcagaagatgtgaaatttctaggtaagtttttttttttttttttgacagggtcttgctctgtcacccgagctgaaatgcagcagtggtaacatggttcactgcagcctcaacctcctgggatcaagtggtcctcccacctcagcctcccgagtagctgggactagagacatgcatcaccatgcccagttagttttttaattttttgtagagacagggtctcactttgtggcccagcctggtcttgaactcctgggctcaagccatccttctgccttggactcccaaagtgttgggattacaggtgtgggccactgtgtccttccttaacataataaaattgagataatcacattcataaaagggcaaaactatgtcaacaagcccactgtattagtctgtcttcacagtgctgtaaagaactgcccaagactgggtaatttataaaggaaacaggttaactgactcacagtttagcatggctgggaaggcctcaggaaatttaacaatcatggcagaaggcaaaggggaagcaaggtaccttcttcataaggcagcatgaaggaaaattaatgcaggaggaactaccaaacacataaaaccatcagatctcgtgaactcgctcattatcaggagaacagcatgggagaaaccgcccccatgattcaattacctccacctggtctctcccttgacacatggggattacaattcaaaataagatattgggtggggacacaggcaaactatatcgcccatattacaattacttacattactgattcccttaattagagcagaggtaattaattgggtctaggctcagtggaagggtctggctggttcttaattctcagagctagtttgaatcttgaggttaacgtcttgccttctagaacttgtcctgtgtttggctgaactctgtgaacctttcagaaagtaggtctttattgagcacatactctatgcaaggcaaagaaccaactactgtggagtttacaaacatgaataaggggtaagaaatgactcttgtcacatggtttacagtccagctgtgtgggccaccacagttcatatctttcaggctggggactggatgagaggaaagtggactcaaaattaatcccagtgctctctactttcccatatccctgtgctttatctctgttgtagttatgttatttgtatgttggcctgcctcactgctctgtgatctccaaagaacagggactaggttttatttatttctgcattgccgcagagcctagtatgtgctttatagagaacaggctctcaaaaaaattttaaattaaaagaatgtattcacttgtttatgtttcctagttacagtgggccagcttgttctgtgctaatatggaagtgacaagaaactggtgtccctctacgcagaggtccccacactaaatatcatcttggatgtgcttcacattgttgcacaaaggtacagtggagtgagactgagtaagaggacagaaatagtggggggtttgtctcagctcactaattacttatttaaccttgggcaagatacttaaagctctatctcagtttcttcatctgcaaaatggggataataatgactggggtgcctatttcccacgattgttttgaggatcaaatgagataatataattaaaagtgtttttggaaggtctaaatcactgtgcaactgcaaggcattattaaaagaaatcttccttttaattcctgcttccacaaacatctcatcacatatccttgggtccctgggttacatggagagattcgtggtgtagctcaatctatgtgtcatagctatcccacaatctcttcttcaacttctccaacacaccaagacattcttccagtcttgcactgctccccagtttatatagatatatatgttcctcattcagcatttatgtaaaacatatattattgagcacttatgtgatagaaaccggggcaaaacagaaaataaaacagagttttattttgagagttttttacagcttgtcggctctgagaggacagacatgagaacaaataagtgcccaattctgcatttattttggaaggcagttttatgtgagtttaaatcagtaaagacatagatgtatatttttagttttgattaaaactaaaacaattggtagcccttactcatatttttctatcattaaaacttatctttaaaaaatgtcttcagtcatatttttcccttacttccattcatatttactctttacttctcttgtccttaccagaatgtatgcagtaagttttcatattgtaacacattcaacaaaagttatatgtgaacataatagctgctttctttaaaacggttactttgagaaactgcatacctatttttttttttttttttttgagacggagtttcactcttgttgtccaggctggagtacagtggcacgatcttggctcactgcaatctctgcctcctgggttcaagtgattctactgcctcagtctcctgagtagctgggattacaggtgctcgccaccatgcccggctaatttttggtatttttagtagagacgggttttcaacatgttggccaggctggtctcgaactcctgacctcaggtgatctgcccacctcagcttcccaaagtgctgggattatgacataagccgccacgcctggcctgcacatttattttaataatgttgtcatagctacagtcgcttctagagttgctctttggggataactatcttatattcttctgaatatattttaatagtgacaaaacttatctttgcaggtgatttttaaaatttgtatgcagccaagtcactatgaattatctttagtgagtaaagaggaagatcgaactggtaacactgtgggtaaacaactgaaaaataatgttatctttctctgaacatacttgcacaagacaaattccaaaaatattttgactacgttatttttgaaaagggtttccagtatttcaatgtgactactttcactaatgatacttgcttacctaaagtgcttgttaacatgcagttttggaacttcataggtctatgcccatactgacttgtacttgcttagtgttgttttacattctagttcaacatctattatgtgatagacactggggattaataggctgtggtctttgcccatgaggacctcaaaacttagttgagaacacagaaatacaaagagtcctgtgtgaaaaataagtatcggtgttaagataaagaagcggcagtggaagacagtggagggactgtctgttagagggaggaatttattgtggtgtcggcaaagccttctttggactgaaggatgaattatgattagaagttcattaagaggaggagggaaggggactacaggagtcattccaagccaaaggaacaaaagatacagggacagaaacagcaagatatgtttgggggaatctcaagtaatactgttattgtgtgaagttcacaacaggggcagggaggacaggagatggggcccaatgacgaaaaggccttgtatgtaccatgtttagaagtttgaattttatcctataggagtcagggagaggttctatgggtaggatttctcatcccaacaggattgtaaactcccacatccaattagtcacacctccattttttttttctgtttctttaacattgtctcagattcattccttctgaaatctaccttattagttcaggtcttcttaaatttgtgcctggactgttcaccaactcttgactggtcctggggctccagttcacctcttgctcccaacaatcaattttctacagaattatcagagcaatcttcctttccatcaatctcaactctgttcaaaaactttcaatagttttatgtgacctaagaggtagctgcctccccaccctttcagcttgccattcaaggctgcataatttggtcccaaccccctttccgtccttgactcctctcactgctaacagagacagaactcatttacttactcttctgactgtacctttgctttcacgagggctctttcctggaatgatatgtccatacaactattgttgttgttcttacttttagctcttttcttagcccacttgtacccaggtttgatcacaccccctactctcctgccctggaagtaactactattctggttatagtctcttaatatctatatctatatatatgcatccacagataatgtgtagtattgtcttgaaaaaaatatacataaatggtatactttgtctccctctgcgattattttcactgtcatttagtttttaagatttatccctattgacataaatagctatagtcttttcaattactgtgttgcatttcattttataaatataccatacattattcatccattcctctaagggtgggcatttatgttgttttcaaggttttgctattacagtgttacaacgaatatccttagcttagctggtctccttgtcttatacaaattttactgacctttcaagatcctgctttcatcccagctcctctgggaaagccttccctgaatcccccagcccacagcggcaaagtcttggtactcaaagttgcttgtgcatctttggtatcatcccactgccaagcacacagctacgcaaagtaaggcacttaagaaatattcgctacacggatgaacaaatgaatgaatgaatggggcagcaccactccgtgatggctctattcctttttaatggactttggcgccttggcccactttccttctttgacagcactggtcctactccagagcattcctctagctagcaaagcagtgtgtggatgtgtgggtgtaggtggcgatacagacctcactggatgaggaccgcctctccctgcaagttcacgatcccggcaaactccagtgcttgaagttcagagtcctaccccacccccctcacccccacgccccttctgcactggtcaagccagcgagccgctgcagccctgatcgagttaaggcgcggcggcccccggggccgctggagaaggatgcggacggggccagtgactcgtagtagatccctccgcgcggagctcgggccggcgcttcttcctgcgggaaacccctgggtgcccaaggcggcggggccgaggccgcggcgacagtggggcggggcttgcggtgggaggaggcggctgaggcggaaggacacacgaggctgcttcgctgcacacccgagaaagtttcagccaaacttcgggcggcggctgaggcggcggccgaggagcggcggactcggggcgcggggagtcgaggcatttgcgctgggcttcggagcgtagcgccagggcctgagcctttgaagcaggaggaggggaggagagagtggggctcctctatcgggaccccctccccatgtggatctgcccaggcggcggcggcggcggcggcggaggaggcgaccgagaagatacccgccctgcgccccgctctgctgtgggcgctgctggcgctctggctgtgctgcgcgacccccgcgcatggtgagtatcgggctgaggggcgctgtccgcggcgcccggggctgccacctggggcgacccttctccccctcggtccttctctgtgtgggaaggccaggctcggccgccggcgcggagcgaggccactcgctgggttcccgagagtttggacatcgccgggggcccctcccgtggtgccccgccaaccgccggggttccccgccaaccgccggggttccccgccaaccgccggggttccccgccgcctctgctccccgcggcccgggacccctcacacgcctcctcggcaggagggaggccggcagcaagtctcagaaactcctttttcgtagtgccagggtgcagggaggtgggcagttttgcccttcaggttccgcgtttcctggggtcgagcgagagccgacggcgggcctcggaggggctgagcgaaggaatgccagattctggcgtggagagcgggggcagggccgccaagccaaacggcctgcaccttcgcagccagcctcgcctttgccagggggcggcacatgggccgggtgtgtgggcttggtttggatggggacggggttttgcggcgcgcctgagttttgacactccaaccccaccgaaagtccggaggagccgggtgtgctgctcgcgtctttgaaaggtggaggcaggagaagtagggcaactggtgtggctgcatgctgaggcacatgatttaaaaatctcaactgctgttattctttctgaggcgcggagctctgctgctgtttcaggctgtgtccagacccaggaatgtggtgtgacgatcaccaattcctccaacctggcagcagcatttgctgctcctttggcatggctgggggtggggcacgggcgggtgagaaaaagtggatacgtcaattcaaagggcttccttagaaagcttctttgtggttggatgtttctaacacggttggaccaaggaaagggaatcaaatcatatcttccccatcccacccacacttttagattctacatttcttcagaccctttagtggaaataacttgggctttggagccctgctctgtaatcctggattcaaatccagctctgctatatgaactcaccaataaaatgggaatgaaattatccagctaataggattaattaaaataatgtatattaaacggatgacactccaaaggtgttcagaaagtcctttgagggccgaggctgtgttttactgcttctgagattgatgctcccagtgggatggtgtcttgtgcatatttgttgaacggaaagcagccccttctttttctgagcctaatctgaataaagatttttaccttcaccaaaaaactagtacatgaactacatctgttttcaaagaaaaggttaggaagatgatgagcttcagaaaaatatggtctttgttcattgttaacagtcagtcgacatgtcaatcgcagatgtttaaaaagagaacaaggttatttatcacccgaaaatagtactgggttgttcagcaccaactagatacttcttggaaagttcaaatttcgtacacgtctaggtcactaagaatttcagaagtggaccaggaggctttgtagtgatgaagcagagctgttgtttctgaagcatttaataaagagcatatatgatggtgtttttgcttttcctttttctttgagtgaaagctttaagtgtagctttaggatagagaggagtataatcaatgagacagtctgagggtaataatccttggtctatcattaacttgttttggtaaataacttaatcttcatgatatgtagtctcctcacctatgaagcaggactaaaggaataacctgctttagagaattgtagggaataataaatatgattgtaaagtgatttgaaaaattaagtattaaataatatgtcagaaatgggattactctgacacatagggcttcttttattataggatctcagtgcgtaaaactatgccctccacctctgctctgctgaggtgctgcgattattagctagcttttaggtagtcaagttgagtgttagtcaagttgactcaaaggataggatttagatattttgatttttagacaggtgttctttagatgctaaactaatgcagtagaagagatttagaagcctgtttcttggtacaaatcttaaatcttcttagagtctacagtgaaggcttcttgaatcctcctaatttattattgtgttttgctaaggtaccaattacagcacacccttctaaacttttgagtgttcctgtgtttggcttgtggccaattgttaatttaaacatcacggagtttctaaggcaaggagatgttagcagtatgtctgattgtctaaacagctatccaggaccatactcttgctccttgttttcttttgctttgcaatgggaagtgactccctgattttgctgcctgctagataatttctcagctgaattcttctcttgcttaaacaaaatcggagtaattttctttcagatggtgatgaaatttaacctaaaactatttttcctttcactttcttattattcctttttttttggtgtggtggagaggaggaggagagtgattcctagtctctcttatttttctgaatgtttagatttaaaaaatatttacccataacttcttgggatctctctgctccattcccaccctactgcctctcctgtaggcttctatgacatagagaagcaacttttggttcacctggattgtagttgctgacttcaggacctttagagaatgtttaaattcagtgggatatgcttggatggttcagagcagccttacaatacattttaaaaatatcacacccacagaaattctattttgcccacaaaatttgcattgatctagttcccactctgtgttgccattcctagtgatcctcctccctacctctcccattatggtagaaaaaaactctgtgtcctggctacatcaaaatctgttggggtggatcttggactcagcacccagggattctgataaggtaagtttgagaatccatattttttcaaggtttacaggtgattctgacaagtaacttggttgcaacccactgattaagtacattttttttttaccttcaggtgtgtgtatgaggtctttctaaatttaagaaatttccataacaaatgtaaccttagtcattccagtgtttaacacttctgactcaagaattttaaaattgctaacgtaagagatatagaatataatgtcatttcttctgtttatctgggtgcagtatgtctgcattgaccctttagaagggcttcatatatttagatgatataataaattctctacctctccttttcccttttcttctgttatctctttttccttaaatgtcattcatacatgttgttttttgaccctttatctatatacgtctgcaatgattttagagtaaaaaactgcaaggcgtgatttgaataaggatataagaaattttacatcattttctttatattgtgttcacagtccatagttacatgcttcctttcttgatgtctcagttcgaatgcctaaatttgaactattaattttccttccaccctttcctgattttcctgtttttgtttccccccctttctctgcaaatgacttgaaaccaaaaggtcttcttttctttctttgtcagtctaccatatgtgtagtattttggacagatcactgaactaggagccagaagaccagaattcttctccaggtctgttattaattggtttggtgaccttgtaggagagccactgttttggtcctccattttctgatgttcattgttcatggtcacagagccaattagagttgagactagaattcctttcttctggtgtccagtgcctcattcactgtccacattgcttccatctcgtgtacaaatgcgcttatgtgcacaaaaactcttataacatcctcaagtgcttattgttaatgcgtacatgaggaaggaatcgtgtattttcatttatgtgtttattctaatgcccataccctacccctgtacctggcatgatgccttggtatctaataggcacacaataaatacttgttcagtcgaacaattatttttagccactttcttattttggacaactgtggtactcctagacattttaaaaatagtatttgcaggagtcatgcttaccttacatttggggaaaaaccaaatttttcccttccccagatgtttcatttaaacttgtaattttgaatttctttgtgtgtggggtttctttctttctttttctgatcacttctgcaatttataaaggtcactttgactttggaatctcacttcaaaggcactgccatccaccccctgcctctcattcaagtttgcttccactgcttcctgtattactgtattactaggccagcaatttctgttattttgtccagaatagccacaccttattgtaatttcatcattttggggactagtcatttttggaatactatttttaaaattagagttaactaagtttatatttattttgataattttttttgagatttttttcattgagttggatattgcaaacttgtactggattgagagaatatgtacatttagtaaagtatatttgctttttttttttttgaaccaagagagtcccctgaacaccctactgacaaaaactaagggtgaaatatgatgaataaatatttgagagaatcacatggtgttgagttgtctctgccacatgattttgatccttgagggccaggtctgtgctacacacatttcttctctgtactacagaacttgtctggcatgtgccccaaattcagagtcaactgagcggcaggtcttagtcacagcatctgtgactcctgctttcccacctttagaacattctataggagaggctgatggtgagttggagtgtgtttctatgttcttttttcctttgaagagataggatcagttgaaagctgaccccacccacagactttttttgctatctcttttaattaattaaggagtggctgaaattttcctctttgttgacttatgcattggtgggaactttaaaattcatctagtctttctgtccatcccatgctggatctgatgtttacaacattctagtcaagaggtaccatattttctctcttcttgaacatctcttgtggtagacagctctccacagcagtttattccatctttggccagctctaattcttagaaagatcttcttatattcagctgtaatccatctcctcatgacttgtcctcattgacatctactcagaaatttgtctcagagtcctgagacctgtgcaggtgatagggacccaaagagatgcttgtctgtagactttactgagctgacacccagctctccataaaaggagtcaaacccagtgaggagcatgtctggggtgattgctcaggtaaagcatcttagccctacttgtttcatacctccctgcacaggtgggcactggtgggagaataacatttatcaagcagtgtttccctaacctctcttatgataagaatagctcaggtgttctcatggagattctgattcagtgcatctggaatgtcatctgggaatttgtgtgttcaagaaatagccaggtgattcttacattaggaaagttttagaatcactgcagagtgaatctgggaaatcaaagtgtttgtttttgtttgtttgttttttgagagtattagagacaggttgctttggctagatcctgtggtcatttttcccccttggaaatgcctcctacttgctggcctcacttagtacagagaagaaagctgctatggtataaggttagtaaagttgtttgttttgtcttaaaagaaatttgcgaaatccagcattttcggacttctgtttgtgttgtatgactttgttgtaagcctccttattcctccattagaatgttacctgagatgttagaatgcataggagttccacagcctttttggtgtccactaaagaattctgtcctcagccgttgcaaatggtgcttcctttgaggatttctgcttcgttagctcatgaacacatatttggtgtcggcagtttccctcagatgtgttagtgtggagagatataaaggtcactcatttctggtggtcctgcttttggggtttctgggctgctgcagcaaatgaaataaggaaaggaaaataaaggaggaatctagggcttcttgagcagaacaaaacaatctgcaagaaggggcacaggattgctcctctcacaaagacacttgataatactgtccttgataggaagaaggaagtggcttcagatctgaaaggatatgctcataggcttgagacgggacaaactgcatcactggtagtggtaggaggtttgccgtagatctgttttttctcctgtctctcttttttgaggagaatattatctgtatggcagaacatacattgtggtcttaaaaaggagagtaaagccaagaaagggggatgataaagccatagcttggaataagaaaagcaaaggaattattgtattaatttgtgtatgtaaatacataggtttccatgtaattcactggtaggatcactagcccttggcactaacatttgctatctttgtagctctgctgtcttagtggtgtattgggggagcattgtggtgtgttgtcacacttaatttgtgtgcttcccttggcatcatgtggtagcaagtacagggtattctactcttctagatgtgtgggaatcattgaccaagtagaaaatatggtcctgctcccaaggagctgacatcatcatggagacaagacagataagcacacaattaggaatatgaaatacagttattttatcatttatctatgctctctgaaagcagtttcctgcagtcagggtgactcagagctatagggtcttgggagtaaacttcaggtcttaataccaccagggaaaggcgacctccagctcacccttgctgggcttgtctgctgtcgtgagctgtctgccattttcctctttctgtgttgtaatttagaagtattagaacttggcttggggaaaagacaaaaacccctttgtctggtgagggtgtaaatataaatttggcacatgttgtggtgtctattatgtctgttagtgggtttgcggcaagagagagtgctgtgttcttagtcccgaatgccaagcctgaactaggacaagttatggtggaaatatcttccttggaagatgcagttctcagtggcagtggctgaaggaacttctcgtcacagccaggcagtgactgaagtgtggtgtggacacacccagagttgctgcctcaggtggcattgattaatcatactaatatctccctcacccttttgtacttgtcttggcaaaaccctgttctactagctccccaatagtttggcctttactaggtatgattgaacaagctcttgggggttcaccttagtgtcccttgcccctctcgcatttccagccagctacgtcgctccagccatggtaccccgggtcctctggccaggcagtgaggggctgggtttttcttcccattggactgaagcacctttccctggaggcttgcctagggcagtttctggtctctgagtcagttccttctgcaggatactggcagctggcagaactctgggttatttgaatacatcagccaaacatcttgccaagatggactcattgttgcataacgacaggttggatctatgggtgttgcagaacctgtttctgggttaagagtaactctctcacctttattatatatgtttattcatatgatgaatgtatgtgtgtattttgtgaagtaaggaaaacatgatgataatattgtggttggagttagataccttatcctaaatatgttgtctttttaacaaatagcattcctttaaaatacagttgtgcttgatgaataaggtgttgtacaagaagctgtggttacattctaaaataaactgccttgttctgaggcaggcacgttttaaaattgttgtttgcttctttttcatctctttttattttcatctttttttgtgtgagaagattctggaagtttttaagcctcaaatattttcaataatctattttaacgggtacctagcagggagaggttgttctattggtatacctaaccaacattcaaataagaataattgaatactgtttactcactaatctattctgttgagtttctaagtatgaataatcacaaaactagatagtgctgatatattaacttctctaaatggtaaatgtggtaagtagcaaagacatttttgtttaattctctccttacacatgctttggttcagacgctgtcaagacacattgaagtttgaggacatgtgtatttcgattattttattatatttttatttgctgtgaatatgggtttatttatttgctagatcttctttagttagaaacattaagggcatttactttattacaacatttaaagtgcattctaatcttcatgaggaattttaggtaaaagaccgtatcctgagattcatgcaagtctttggcattatgttactatttaaagtaagtaatatgtagtggcttctctgacatattctttctaagagagttaaggaaaatagttgtaactaaaagcaaacattgaaacagtttaaggtaggtttacgtagcaacagaattattcgttatgtttacagataattaactcatatttatactttgctgattttctctggcacctttacaagatttttttatttttgtaatataaaaagtaattatgtttgaaaaagtagttaaggatgtttgaagaatctagaaaagcataaataaaatgtccacaatcatgctgccattaattttttggtatacgtctttggtttttttacccttagatttagaaaagctgttgatttatttatatatatatatatatatatattttttttttagtttatgaacagatctacatatatatatatgcacacacacataatatactattgtcaacactaggttttatttttaaaaatctttaccatttgataagtggtaaatattacttaatcttaatatgcctctctcattacagtgatattgaatgttttttcatatcatcagtggcgtttgtattgccttttttcctacttcttttgtaaattgtgtcttttactcatttaattattttcttactggtttgaaaaagctctttaaatattaagggtgttagtcttttgtcttaaatatgtcacaatatgtatggaaataattagcagtatataacataacatcaaattgctaccaatgttgatataaaaattgttcatttcataggttaattttttttaatcctttggtttctaatgatattggttaattcatttgttaactgctattttctgtagctacttgaaagttcttatctgactgtatcgtaaatcagcatgctttcagctgtatatgtctaggaaattgacatttactttaatacttaataaaaaaatatgttggagaaaagcagtgtattctggagtcaaatacatgattttgggtgggtgacgtaatcggctactgtcctccttttctagatagccaagatttttgaagcatttaacatccctgaaaggcaggactaatgctatgtctaccatgcactgctaattctgacactttgacctaatggataaatgccagtacagtgggtctagccagttagcttggtcagagaacaagatgactaagattctctccccctttcctcaccaaattgattagttgtaggacagaactgactgaagcaacctgttgttttggcaacccatggacaccacctgtttcttccattcctccgtccagcctctcactgccctagtgcagtgctgtgtgcatagtgggtaggagatcaatgttgttgctaaagaaagtagcaataaagaagagtagattgctttttttccaagcttttgtgtttttaaggcaccccgctggttttgacattcgttgctccagctgaactgctctatgctgaagccctgcaggtctcaagtgtttggttcagagtaatttcaggccatatgaatgctttcttaagtatcattggaatttactgggctggctgtctgccagctattaccatatttagcatgaagagacctggggaatgaggacatttctgatcaaccaaggaaggaaacctatttgaaggattacaatattttctttttttttttttaatggtgtagttcagaaaacgccagttagactgagactcagatttatgtccactggtctttgtttctgtgccccatcccaaaattaatttatgaataggaaaagagatttgatagtgaagttctttctcactctgaagtctaatactgtttctgggaggaagtaagagaattattatgcccacactgtgcactgagaggcttaaccagcaggtgaagctgttgattaaaaacataggttgatgagtattctcatttttctcctttgaagctttcagaaattttctgctttgtcctggtctaaatttattttggcccagcccttgtctccaccctacatttcaaaccagtagccttccctctatggctcaacatttctctgcctcagttttttccattttaaagatgaagatattgtttggaaggaccagtaaatacaattaatataaaaattgcttctgtagaatcaaacaacctccaacatttctgttggaaatttatagtttatagagtattcttacacaatgatctcctttaatcctcacaaacttggtggaaatggagcctcacaggggctaggtgacttgtatacattgtttacccctacataataagtgacagagctggtacttaaacttgtggcttgatttttctttttttttttgagttggagttttgctcttgttgcccaggctggagtgcaatggcgcaatctcggctcaccgcaacctccacctcccgggttcaagtgattctcctgcctcagcctcccgagtagctggaattacaggcatgcaccacaacgcctggctaattttttgtagttttagtagagacggggtttctctatgttgggcaggctggtctcgtactcctgacctcaggtgatccgcccgcctcagcctcccaaagtgctgggattacaggtgagccaccgtgcctggtccttgcagcttgattttttaaacatcagatttttttttcttttttgatttttattattatgtgtctgtcattctgctaggggctttgcaaatattgctttatttaattcatatggctatcctttggagtagacaatatttttctacattataggtaaggaatttggaacttaggttcacagctttggatgttggcctatggttagtgaggggtgtagccagcattcaaacccctgtctggctctagggccgctgcaataaatcatggtgttttatgtacattcatacacttaacactttgcaacaaccctaagagacaggggtaggtatttagggaaactggggcttctaacttgcacaggataatgcaattagtaagtggcttagtcgagattcagagctagatctgtctccataaccctcactcattccaggatactgcagatgcctatttttatgatatgtataagtaaaaattaatttaaaaaactaccttctttgaagggtcagccagttagaactcttttgtatcttctgaataagtaagaagtggatggacattagctgaccgatacattgatggcttttaaccttctatcagttgatttccattaccaggacaagcaaatataatttggagggaaaagaggggagtttccattaaggatgaatctttaagccgaaaagggccacagtgatgaactcttcagaggactgctctcaggagcaatggcccttctcctctgggctctgcttggggcattcctgtttgtatttatggagacatctttttgaaaggcagatgccagctttggtggggagaaggttggaaaacatacaagccttgctctaaatttactagccccgtgtctttgggctagtttctgaagcatggtgtgcctcaattttattattttaaaaataaagatagtagcagtatattttggagttgttatgaagataatatcagttaataaatgttagattcattggacagtaccaggcacatagttaaagtgcagtaaatagtagttattgttggtattggtgttattttatgttgcagtacagactggcttcttggtgcattcacttttctttaatcaaaagtggatgagtgattgggaaccttcatgaggaaataggaacatcatctttgcagcctgtggattgttcactggtttcctgtgatctaataattatttaagggtttcatatttgagtcttttcccttaatgaggtacactttcagtttggggagattttatctataggcataccttattttattttgtgttcccttttattgtgcttcacagattttgttttattttttacaaattgaaagtttgtggcaaccctatgtcgagcaaatgtatcagcaccattttttccaatagcatatactcactatatgtccctgtgtcagtattttttagcaataaagtatttttaaactcaggtatatgcattatgctttagacataatgctgttgcatgcttaatggactagagtatactgtaaacataacttttgtatgcactggggaaccaaaaaatttctgacttgcttcattgtactgtttgctttattgaggtgagctggagctgaagccacaatatcacaaaggtatgcttgtattatgcaagttgcattgataggtgttaaatcattttcccaatttttattaaccacacatttgtgattggatgttatgtttagtaaagatattgtgattttctgaggtacagctttgagaacagtatcaggtctaacactcttgtttccaaatttcctatgatatgacaaacataatcacatgccatccagtgtcaccatgcagagtactaatgtgaagccaaaatacttggtgttttaattagccttaaagcagttaatgaactatctctgttagacattttgaaataataaaaatatcccattgtcttttattacaacctcaggggctcctggagattttgggatcttgtgtggggaaccacccatctaatccatccttgttttaaagagagaaaaccaaagaagcaaagtgactggcccaagtacctagagctgggtcagggttggggccagaatccaatctcttgacttttagtcaagtgatttttccactatgctcagtactcaaattatgtatcaatatgtcggcccttgttttttgaggtctgaaaagggttagtgccagtcaacaacagtagaggagtagaaagggtgttgggatgggagaggtgtggctatatttaaaatttcaatgacagcagtgaaaataatttgcctgtgaacctctgcctgtccctttggacttctttgtagtagttgagacagcccggcaggtctggtgtcattagtgattcagaattggattaacctggactggtggagttactttctcagaaaagggctttatattttaacatttgtttcccttgacagtttgcttcttctcaagttttggcagccttgaacaagtggttgtcaggtttttattttgttttgttttaagaaaaaattccaaattttattttgccgatttagtaagttatcctctacctgccactcccttctgctccctctataattatttctaagactttatttttccattgtgggaacattatggaaggttttcttttacagtctgagatatttataattatgtgtaagcacacagtttatagaatatgtaaatggtccatatgttaacttaaatacccttaaaatattttccaataatttaaatctttccataaaagtagctgaagctgcttataataaaagagaagtatacacgaaggatagcagaatttggatgtagttaatatagataaatatgaatgtcactttggaggaactggaagtatttgcatgaatactgatcaagtcatgcctccttgttaatagagtgaacaaaacagatgaatgtttctgttttcatgaagtttatgtgactatcagtagcttccatattctgagggtttattatgtgacagatgcttggggacaaaatactttacttgtttcctttagtccttaaaatagatgttaggattcttgtttacagaaaagttaaggaatgttcatccagatcacctagccagtcagtggtaaagaacagtcactggaacccctctttcctgatccaaagccaacatacttaaccataataaataatgccattgtctggtggaatcctgtagtcccttagatagtgtaattttgtatttaatgtaaacattttgtgcactaaactgacttacattttactttttaaaacaatattttaattctgaatgaacatttgcataataggagaatgatctaaattgcaaacttccattttgaagagttgtagttcttttaaatctttttgtaactgggaagaagaatggaattatgtttgttgtaatccaaggaaagttggttagcattctttcctgttactttttgatcccaaaagaaattctttagtagattaagaccaggaatgaatgtgtggatttttttaaataaaaaattgagagagattgcaactagcaattcagagccagatttatgttcagaaatgtttgatgccagccgttttagttacaaatagctttttcttgactgtacagttgtgttcttatggtaccattctgaaagtgatgtaagagaccatgtaaaatgattggaatgcctcagcatctgaacaatgcacatagccaattattaaaattacccagtactaacctgtcttggcttaggaactatgaaattaactgtgggtagcatttctacacatatcattacagaacaagcataaagacaagcttgtttttttccttttctttggatttgttttttcttattaccatatcttttgttactgaaaactggtggtcatctgtactaatagataagagaagtgtgtttgacaccaatacctaatcttagattatccctgctattttaaaacacagtccttcgcctgcatgctcagacatgtgggttctttcaaacatactggacttcctccttaggttttagttgtgttagtcaatagttgaatgttgaaggagaggatgccaagggatattaaagaaggtaaaagagataagtgacagcaaacattatttatttttaattatctctcagaatgacttttagatacccttccctactaccttttgatttttgctttagcatagctggtgagttttggaatcagagagactgggctctgatttgtactagctaagaatattagacaagccacttaacttctttaagtctcagtacccgtatttatataatgggaataatagtaatatctaacttgcaggattgtttgtaaagattgaaagcaacatatttaattgtgcttgcgtggttctgggcacagaataggcacccgagtgtaggggcccctgaactttaaagttcattactttcatggtaattcctcctttggaatatatagcctgggaacatttgtctctagaccttgtttcagtttcttttaatgactccctttaggctctgcttcatggccaatgcaagattatggatcacctaaagagtagactaaaagtactattgtctagtaacttcaagtttgtaggttaactcactgtgaatcaaaagcttttaaaaatcttttgtgtggtcatagtttgtagtgtcttgtacctctcatctcagaagcaattgattcatagaaaaaattatttaggatttcagattaaagatgaagaactctttcaataagaaggaactgatttggttggattatttgtttctttcacccctgagttttcatggaaatcaggtttaaaaggttagaagcagttggttttcagcattgggaaagcttatctgatcaggcatgcgaagtggcctatgtcggatttctgagctaggaaaggctaggggaggttgaggagattattgtacttgtaattcctgagcatggttgagacacaaggagaggattgtggaaattgtttttaaaaaattgttgaagttaatgcattcttgggtggatttgcaaaacagaacaaaacaaaaagttgttgaagttagttacactggtctaacaacgtatacttaccacccccatttgggctggaggaatggatctaataataatataggtgtttgtgatctaatttgaatcatgtaatcatttatcatttctgggttagatggtaaggattttctgtttcacagatttttagactgggaattgtgctattataaaataatattttacattaaataatgctatctaggttgtaatcaccttaatagacatgatttatttgggccacaaatgaactctggtaagaatggagggctggttacattattttagttttacagatgaaaataatcagtctcaaatagcttaagggaattcctttagaccatatggttagtatatggaaaagccagagctagaacccaggttctgatttccagagcagttcttatttcatgataccgcataattttataatgtccctaaatccgaatttcatttctcatgatgtgaaaggattctctttatttctgtttggttagctgcatcagagcatgacagaaatggagcagaatttgagtattctttccccagatgggtcagttagcttttcttaaagctattctgtgcttacattgttaatcagttgtccctggttcctagacaggatgttgatacatgtgaaataggcaggaatatgtgtctgactcagcttaactcatcacaactttcatatgtcctgctagtgggtctataacgtcaccctcgtttacaggcgtttttaattttctgatgtctatttcttagtatttttcctcagccatttttaatgtctcaagccatagttcttcctgagtggcctgaagtgattttgctgctctttaaagcttccttaaggtttttcaagagcgtacaacataggctgcttctaagtgtatttttatttcctagctcttagcatttctcaccttatcattataactttaaatttaaacagaatacaaattgtgtacacagatggtgtgtcactattgcactgtcacttatgtaagtgcagtttagcatttcttctttccttttaatcaaaatgaggaaatagaaaatgttttgttatggtagttttacacatacacccacaaggaaatgtgtatctagagtctgtgggaactgtgactgatacatttcagggaataaaatgtatgatggctaaaattttaactctgccaaatgttcacggggaaagaaaaattaacaaactcacattttacactttattttagcctagtctctgccttgtttacatctatatgataatgaagctatacttgtctttccacaacagtgtattttataagttgtaccttttgtttaagggagccttcttaacaaactttctttcagttgtccagtgtacagaagcttactggaaggagtggccaactagttaaaggtttgacacctcaatatcaacaaaatgccaagtggatcattttgactctcacagcaatccaactggacatttgaccatgccccgtggtcagtggagagcttcttctctgaaggccacttttatctagcacatcaaggctatacacctctttcactaagaagaatttgacacttttatgttgtgagagctgagattcaccattctccaccatcctgagaagagctttgatagaagggctactcgtgaggtacatagattatctaaaatacatacaattttttcatagaaaattatatatgtattataatttttattcacgacaggttgaaattaatagatttcttacattcactgcattaaaggaatatttatggctttggtaatattttaaatttcaaattaaaaaatttgaatatctgaattaagtatctctgatttaactctgtgtgtgtgtgcgtgtgtgtgtgtgtgtgtgtgttgggaggaggaatagaccttggaattgttttttcaaaactttttttataatagtgcctaatctcagttggcaaggaatagctgtccagaatgctgcatagatctagtgaaaagatttagggaagttgtaactagtttaataaccatctgtggagtgacatagattgacacacccaattacacaagacctgagtctgagaactgttgatgtgcaatcatcccatcagcatctgctcgtcattatcaacaacaataatggctcaactatttctttgaggccacatgaaaagacagtgtacccatagcaaaggataagtcagacctgaaaaaaacatagccctctgcatccccttgttcccaaacttctttttaaacataaccttttgtgaagttctgaaagaattcattttatgttttctttttattaatttttcttcttaaataccatgtctttctggctgaaatccttgccaaaaccaggaagggccagtgtactgtgggtgatttttctaattcatttctttgtcatttgaagccttctgtggcttcatgctgctttatgtgtgtgtaaatattcagtatcttttctagtttacacttttgtcacaactgctattaagccacctatggacacattctaatataaattattttggccactgtgagtgggagggaaagaatcagttcacagggataaatttgcatgttgagaagataatatataatagtttgcaaaacacttctatgtacattgtatcttttatagagacaaggccatgtttttatttgtggagactgagacagagaccccatgagatctaatgcagagtcacatgactccaaagccaggtcttctatctgctctttggtatataactggatcattattctattgacagaaataaggaatcttcttatttttcaaaggcacccttttgcccttggaaggtatatttagaaatcctttaccagactagaaagaagacagttatattttcctgccttttgataaaaaacagtgtgttttttctaaatcttgttgtgtttgactagagtctgattaaggtaccttttgggaaattaaggttctatagaaattactgggctcaatctagtgatacaaatatgtgttgtttgatttatcaacacattacaaaccttaactttggagttttaatatctggttatctttaatatctggttatcttctttctgaagtgtatgtacacaaaattgatgctaaataaggtcttgttgttttggcaaatagtgaaatgcaaggtattggtagatcagtactgttataactttggtgcaaagttgctgcatgcagattggctgtgggaccttgttcattttttgagaactaatgtagagtttgaaaaaacaccgtaagcctgcattccagaagttctggtatggatagtgtgagcccagggaatgtgcttagataaaagatcatttaacaaataggttttgcatttttttagcaatcaggctttgtgctgaatattagagtggttgtttcagagagtttgcagcaattaggctttattggtgcactaaggagaagcagagaggagaagcaattcttggtaacttccttggaagttgcagctaactctgaaaagtctgggttgaactaggtaagtaactaattcctagaatcaataaactttgcaggagtccgtttgattgtacatgtagctccctggaattgctattggtccctaaatcatcagtttgtaatgctggttttcaaacttgagtgcacatcaagttttggaggacttgttagaatacagattgctgggctcacccccagagtttctgatctggtaggtctggagcgggacctggtagattgcatttctaaaaagcatccaggtaatactgctgctgtttgggaaagtacactttgagagtcactggcttacagcaatctcaaggtgtttggatttttgggcaggggtgctgtgcaggcgttgctgggatctcttcacagcacctccactgcatagaggtgagcctccagatgttttcattcattcaacaaatatatgtacctattgtgtgctgggcactgcttaagttgcgaggggatattgtgaagaaagtaagcaaaacccctttgtttgtagaatttcagtgagcatagtcctgggttaacctgacaacagtcctactgtttattgatgcttataggtgagcctatttctctttctagctttcttccacttaatttactttcttttggaattcttgaatttaataataataatattgatgttattagtcatcactataactttttattgagtatgtattttatgtcagacacagtgtggctaagtgctttacatacattatctcatctaatccttagaaaaaaccctggtgtattagtcttaatttaaaagatgtactttggaaaggttagtagtttacccaagattatgcagctagttaaaagtggtgctggggctgggcttggtggctcacacctgtaatcgcagtgctttgggagtctgaggcaggaggatcgcttgacaccaggagtttgagactaacctgggaaacatagcaagaccccatctttacaaaaaataaaaaaattagccaggagtgggggtgcacacctgtggtcccagctacttgggaggctgaggcaggaggattgcttgagccccagaggttgaggctgcagtgagccatgattatgccactgcacatctgtctgggtgacagagcaagatcctgtctccaaaaaaaaaaaaaaaaaaaaaaaaaaaaaaaaaaaaaaaaaaaagtggtattgggcctgtctaattgcaaagccacattctttactgcatgctttagtccattgttttttaaactgcagatcatgaccacgaatgggtcatgaaaccaatttggtaggtctccaacagcactttgggggaaaaaggggtagaatagagagtatcacatagtatggacaagcattgtttcttgaaatttttgtttttgctatgcacgtatatatgtgaatattgaggtctggtacaagatatatttctcactgtaggtcacagtaaaacatgttggtaagctactattttcttggctatgggactatatgtcatctaatcactttttaaaaacagattacaaactgtaggccttagaaaggtaagtaatttttcagctgggcatggtggctcatgcctgtaatcccagaactttgggaggccaaggcaggcggatcacgagatcaggagttcaagaccatcctggccaatgtggcaaaaccccgtctctactgaaaaaaatgcaaaaattagctggacatggtggcgtgcacctgtaatcccagctactcaggaggctgaggcaggagaatcgcttgaacctgggaggaggaggctgccatgagctgagatcacgccattgcactccaacctgggcaatagagagagactgcatctcaaaaaaaaaaaaaaaacaccaaggtaaagtaatttttcaagagcacaaaaatagtcagtggcagtacaaagacaagatgactgacttttttttttttttttgagacagggcctcactctgtcacccagactggagggcagtggtgcgatgttggcttaccacaacctccacctcccaggctcaagcgattctcctgccttagcctcccgagtagccgggattactggggtgtgccactaccacccggctaatttttttgtatttttagtagagacgtggtttcaccatgttggccaggctggttttgaactgctgacctcaaatgatccacctgcctcagcctcccagagtgctgggattacaggtgttagccactgtgccaggccagatgtctgactttttagcccttggtccattgctttattcttcacaccataccacttccttagaagtgcacctgggaatgcctgggaattgaattttatctttccacatgatggcagatatgctatggaaccttcagggatgtcggtgaaacctgaaaagggaagttgaatctcagcctgctctgagtaggtgaaaattctgccttggatcccccaaagtctgcagataaagatgtgacatttctcgtgttctgctgtgcttgaaggaaagagggtaataatcttaacagtgccaagctgtaagcatgttgcatatattaacttgtttaattactaattattttgatacagcggccatgcctgggatatgaactcagctgttttgagtgagaaggggcatcctaccagtgtgagttaacacttctctgtactctccccggttcctcattttgttcctgctgagttcagagctatgttcctcatagcctggcttacctgtggatgttctcagcctcattttcttttgctagatcatatatcttcattaggtgggtgattttggtttctgttactttttccttaatattagtatattgctgatttggatcaggggccaggctgtagattttcagcatggtgaggtgataatacatgttggtcccccatgcagaatgctgcctctagcactttagccaaaggagctctacagtctgtccagaagtactgggggacactggtaataacctgagaacacttacagagccttccagaaagtgccctttcacatcatataaacagatcatgggaagctgagggaatgcaaagtcaaggcctcattggagagcggaaaggaggctgagattggtggagaggagtggctgttacattctaattagaagaatgacatgtgcagggccatgaagcaactaaagatgggatgaaaaacttaacttgtgaatcgcaaaatttgagtaggaaggagctggaaaggcctggaagtgcgaagtgattggcccttggtcagatggctagaagatagagagccaggcatagaacccagaatccaggccatcattttgtggcctcttttatcctaatgacgttagccagaggtgtcttccaaagcacctgattatagggaagaatgaatgtcacttaccctagagtgagtgaaatagagatgccaggaagatataccaggtttatccagtttctttgcatttttctggcatactgtatactcttgagcgcatatgtatcctactttgtgaaatctgggggtaaagcaggacccttcaaacccttaaaaaatgtataccccaagaaaaacatttttaaagcatgaacgcttcctcaagtaaatacatatttatacattatataaatgtctggctattaaaccatgtatgcatatgttaactctaagtaaagcttattatatgttttttagcccataaatatggagatgttttaaaatttcttccagtgccccagtggatgatcttacacctcccgtgcttctgggatacacacatctaattttgcagaccactggtccagaatgtaaattgaagagtttaatgtctaagatatttgttcttttgtttgtagcttatcttttactccccacgtttcaaatatccgtttgcaaaataatttttgagttaaaattttcaattaaaaaactgtatccttgaggtagaaaagataaagatagaagatatatgtgaattaggttgtatctctccttaagagggaatactgttttttatctaaggagaactaacaaccctccctttcattgtctgggttggtataagtaaaaatccttgtttgaagttattaagccttcccacccatatgatgattagtttggttcataagctagagttagggcttggtaaaggctcctttttttttttttttttttttttaaagtctttccaccttaactagcaagtaagctagaaatgacagagcagtagaagggggaatctaccagagtgtcctacaggaccttgttgaatgctactgctgcatgcaagggttgtggatttggtgtgggccttctgcagtatcacccaaatttgagcagtacatgtaactaaaagtaagaaaaataaattagacagtttatttcatttcagactttggaagcccaggactgtggggattagctattagctaagacaatgattcactgagcaaatgcagtgaaagattcttttgttacactgatcatcatttgtggagagactctgaagaaggataaagctctggctgcatagtcaaaccagacctactactcaaggacatgcatactagatatgtaggtgtttccaaatatttttttcagttgtgggggtgcaaatcatttcaatagtagagtaactcagttcattactgttactggaaaaacaagtttaaccaagcacatatcctactgagggtgagtcaacagtgtcattttaacataagaaggacagtacatgaagtgagttattccaagtcctgtggttttcctacagctgagcaaagacagctgttctttcggaagtggggctctaaaaagaagttgcccatctcctttctttcttgattatagccttttagttttcttttggcctgagacatttcaaaaattcacttcctccttagatttctatcaccaaataccctgaattttgataatttatttatagagtatattatttattatagacttattatagtttaaaactttattttaatttatctcccatttcaagatccacgtttgctatatgtgtcagataataaaaatgccataaggaaaacagaggagtgatcttttttaatatgtcattattttctatagttctttagtggtatggacatggaataaggtggcattttgtgggacagtataccaaacttagtgataaaatttatacttttaattttggaggacaaaagtcttgtattctcagccttgtggataagacagtgctctgagctgtctgaggtttcctaaattgggattcaacatcatgaagggtatgtgtctggatagtttatttgttggtttgggaaggtgagtttttgtcttttttccccctctgagttgatttctttagttggagagaagcagaccagatgaagaaaatactttatctcttatggcatttttggtttaccacattagtgatgacccgtcttctctgagcagcaggccatgcttctctgttcagtagttcagttttcactaacttaactgcagatgtgttcttggagggatttatttctaagcaattgaattatgggtacttggataaaatgatgatgggttacctacttttaatagggccatcatttttaagagtaaaatcttgtcaagatagggtatatcatacttatgatctggttccatctctaactccataatttccttgtgctcctgtgttgctactctattattgagaagagatggtatcttgtcagtgtcaattttacaaagaaaaaattctaaacaatttcagtcatagggtagtttttttttttttcctggagaaataatgcatagtgtagtatgttgaatcctagagttggcaggttttcaaaagtggggttcttttgttgtgtaggtaggggtgatgctagtcaatgggtgttagtcattagggcatgtgtatgagtggtagttctgagatacagcattggcagcccctcttgtccctggttttgtttttgataagcaagtcctggttttgttttaataagcaggtcattagctgatctttcgtgtaaatgtttttgatgtgcatagctggtatgtgggtggttacctacctgagaatgttgtagtcacaaatgtatattatggaagtttgcagattatggtggatatcaggtttttctaactgcgtatttacagatgtagtgagtgaaaggaatgttgggtcagtaggtaaaagacttgtgctctggtcctggttcagacatcttgatttgtgtgactttgggcaagccccttatttctttgagttgcagtttcttgtgtaaaatggtgctaataccaatttacatgcctcatagtgttgttgtggggatcaaatgagatcactgtttatgagcagccttctcaggagtgagaaatagagggttgtgagctgactttctgatttgtttggctgaggtgttcacacaagccatagaatgctttgtaggcttgggtggaggaatgtagatggaaatcagctgaaaatccctgcctattagaagctgagatgttaatcctaaatatattctatggagtactatcagatgccttgcttttcttcatgatgccctattagcttcatcttcaggtagcataggtgcctgttactctcattttacttgaagaaactgaccagccaactgatttaggatatggctggctatcttctggaactcacattagagttactccttgagagtaaagtcttgtattttctgaaggttgctgcttttggggtattttccgtggaggtgggtgggcacacacaaaaactcactgtgctcaaatttataaacttgttcttcttaacaattttaaagccagattacattggattgggggaggggaggatactagatttagtgttttttaatataaaactttgtatttgaaactttatgtggtaacatatatttaggctcatagccaaagtgattacaatgcattggttttaatattttcagtgaggtaatgtgtgctttagtggggaggaggagaaatattatttaatcaccagcactacactaataaccacatttactaaatcctttgtccctttgcttgaactgagggttccttgcttttatactggttttccaaaggacttaatcttgttaatgtgatgaggtgatgatgggaaggacattcccactgggcccgaagtggtgaaactggtaaaactccctttgtaagtccctcttgttcaacatgagtgtcactcccatgtccctaaagtagaatggagttttattgaagagagaattttaagagtgataaacaaaagagatggaaatatctcctgtgccaggtcattgttaccattaaagactagaataaactgtaattttgcagattttctttttgtcttatgggaaattaaagacttggttatcctctctcggaggaagatagaaaactactgggcctgctcattaacagtttagcttggctgacatttttcaagcacttaccatggtattatagctgggctgaagctaggtggagcagacctcacttaggtgttgcctagctccagaatctgtcttctggtggaattcccttaggcttccagacaggagtggcaacaaagcagatgaaatggaaggtaggccagggcatctgctcgttcgctcgctcgcttgctctttctctctttcccttttctttcctttcctttcctttctctctctcctttctttcttttgcttccttcctctctctttccctttcccttcctctctctcttttctttttttctttcttttttttcttttcttttctttcttttctctctctctctttctttagcagtttattactcatttgtgagaatcagggaagcactgggctcaagaaagccaataccccttctagggcttaccccccattttaaaatttaatatattggaatttatattgtttcttttgatccgagatcttcaggctgaagctggagagaaatcttttgacctctctagaacaaagaaagcctttatcaaagacaatgtaactttttgagtttgccaaattaggtgttgctgcaaatggagaaacctagagttctcttctgtgcttaaagacacaaacatggaaagttttaagttccaatatggtcacttaatatatacaaaattttctgtctttgctgtctttgtcattccagcaacaactggatgagcaaatagaatgattgtgagcacttgcaaaccaaattgtgactgttagtgtgttgagctgcttttttattaaaatgactgctacaactctgcagaaatctgagtagtcttgaagataaattcttgcttgcatttacaataaagaaagaatatgagtaatcaaaaggctgatggagttggaggactggcgtttttaagaggaactgatttggacattgagattatcagctcctcatcaaatatcattaagtacacattattatttttttctgttgaccaggagacccaagttgtgttgatgtgggacatagttgtatgtctgaagaaacaaagcaagggagaataaaataaataaaaattgaagttcaggaatatatatatatatatatatatttttttttttttttttctcaggcagagtcttgctgtgtcgcccaggctggagtgcagtggcacaatctcggctcattgcaagctccgcctcccgggttcatgccattctcctgcctcagactccctagtagctgggactacaggcacccgccaccatgcccagctaattttttttttgtacttttagtagagatggggtttcaccgtgttagccaggatggtctcgatctcctgacctcgtgatccgcccacctcggcctcccaaagtgctgggattaaagacatgagccaccgcgcctggccgtttagggctatattttatgttttcttctccctttggtatttaataaagatttgatatttttctattatctgctttcctctgttccaaggtttttggcctcaggtgtgttctctggaaatggcaatgataggcatttataatctccatatttagatatttccctcacagtgctagtttctgagcttattagaacctaatgttaaatgacgagttaatgggtgcagcacaccaacatggcacatgtatacatatgtaacaaacctgcacgttgtgcacatgtaccctaaaacttaaagtataataataaaaaaaaagaaatatcctggctatgagtcaagggtttaggaccttttgaggcacttgggtttagacaattctcagtgatgtgtacaggaatttgggtacaggaatactattcacaggtgaacagagtttgattttggctgaaggcatattatttgatccagataataatataaaaataatccaaatgttaggaccttagcttctgcgaaccctgacttgagaatagttagccatacatgtagttggactttatgtaggactaaccaatctcctctgcactatttttgcacagtacattgattatggtatccctgatgacctctgtccccatccttgtgagtagccttcattgctaccacccaaggatgttttaaaaaggctatgaggaaggatgcatgtagggaaatctgaggttgttctttggattttccctgttttgttttaggaagtatccatgattttatataataatatgtagcaatcttaggtttttccattttcatttttaacataattttgttattcattctgtttgggtgtctacctctaaattaacaaacatgagaaattgtgtactccatttaaaaagtgtcctgagcaatttaagctaaaagaatatgttgtttcttttgtgtgtatagcaagaagattatatatatttataaatttttttccagcaagtgtacttaaaagcatgtacttaaaattaaggacttaaaaaaactaagctgtacttaacaaaataatctttagaaagctttaaggccgggcgcggtggctcacgcctgtaatcccagcatcacgaggtcaggagatccagaccatcctggctaacacggtgaaaccctgtctctactaaaaatacaaaaaaaattagccggttgtggtggcgggcacctatagtcccagctactcgggaggctgaggcaggagaatggcgtgaacccaggaggaggagcttgcagtgagctgagattgcgccactgcactccagcctgggtgacagagcgagactccatctcaaaaaaaaaaaaaaaaaagctttaaaaagggagtttactaaaagcacaggaaattggtgacaggcaaaatttgtcttgataatagtacaaatacagatagtggaacagaacagataatacaagatataagacaagacatggaataacacttcatattcactttctttgaccactaagcagcacacaaatatatagcactttttgtagagaataattaaatttctagatatgatacagcttcttcctctctgttgggttttattacactgagatcctgaaccttttggacatgtaaactgtgatcatgttggtcagtgtcatttggatctcgttggtgcttattgttctgccgatgtgtattagtgaacctactcatggggaagataatactatacaatgaattttcccattcagttggaatttttttattactctgttttctatgtttttcatttagatgtaaattattttggcttccattcaacctatttcagctagtttttaccataatacacatggcttaagatttataggaggctaagagtggagagtgtatcttcattcaaacaaatggtaagaaaggaactttcaaaactgttttagttttgcaaagattagaaaagtacaattctactttctcaacttttcatccttgttaaaggcctggaaatttgcagcatttttttctttcttattttacttttctaatttgttacacaaagtgaaattccacacataaacatgcaagctgaaggttgggtttattcataggttttgtcttaattatagatatttagtttattgaatatcttattgagtattgagtacctgctgtggtccaggcatcttcttaggtcccaggtgtacaaagaggagccaattgtggttactgcctctatggaatttgcctagaagtgggagagagagagatgagtgagccagcacttataatacatctacctaggataaaatgggagcacagaagaggaacatctgtatcagtgggtctctgagagcttcttcaggaaaataatgctttatctgtgatttgaaatatagtaggaatttagcaagatagagaaaaaggaaaaggaggtaaaatatttttcaggtaaaagaatgtacatgggtatagaggtgatcattattagcaaattggctacatcctaatttgtaagtatttgtggatttttcaaaccttatatttcatgtagaagagctgaatgcattagtctcatctccaagatccaggtattgaaatttaacccatgcataaattgaatttttttctgaagtctttaataagagaaaaataaaaggaaaaactacacagtgtatagtagatttcaatatagcacagcaaacactgatgaattttttttgcaatgagttcaatattataaaatagaacaaaattggaatttttaaaaccaaaaattattctagatttatcagctaactggaatgatttttttatagtatgaaaagtctgttagtaatacaaaaaatattcatttataagttgttatcgttgattatattttcttaaggtatattttcagtttttgaaaagcagtaataatttgctatgaccctatagcccagttcttaatatctggatctgatactagcatctcttaggtagaaaacacactttctatatgataatatctgtaaagagcacataaatccttggaacactattaggaaaacaaaatcgatttatctcttattgcttttttttggtttttttttttccttttaatcaagacaaatttcaaggaggaagacatgtttctccgcttcgtttttatttaaatgtaccacttgggatttgaagcttccgcacttcttctgtttgtttggatttttttttcatggcttggtcccaaaaaatggaatacaaaatttagagaaagttttgtttgaaattgcagggcgctatgagaattattgcaaatccctgatgtctctttgtctgccctcaattctcctatttttggtaataatgcaggcagtcattttagaaaactttgctttgttcattttactgagcctcttccagaggccatgtgccagaatcaacagcagccaaccacagccaagatcctagggcgtaaactcagacttcatctctcaaatattgctacttgaaatttgcataaacattgaagaaaaagttaaaagagcctgtataactcctcttcatgtattttaggagcctcagacagtcaagacattaaaataccttccgattgagcagtgggtctaagcacagataccacactgcagatagggagaaggatatgaaaaaaatcatgtgagatagacgacagaggcttatttgaagaagctacaaagcaacaagtaatgccagtttaaaacgattacatgttaatgcaacaagtaaaacacattgaaggctgctcagattacactggctgaagtacagacttaattactcatgttagagattcctaaaacaaagggaggcttttaagccagtgatatgtagctggtatgatattgaaaagcattggaaaacctaggtaaatgcctagaggaaattttaaggaagagtccatcaagtctggataccttagccttatccttaaatgaataaatttctgaggcgctggaactggttaaaatcaatggcagcttgttctgttgttggcagttttgatgtataattggggctgataaacctgaataaataaaagagccttgtctggattgagttacagttagtgctaaacatcaagggttcctattgtatttcttaaaagttctttttggagtgattccaagattggtattaagagggtatgccaagggtatatattggcaatttttattttgtttgtatttatcttagagtcatttgggtaggtcacattctctctgcccctactcccaacttctcattagattgtaaggaccatgaggacagagattgtttgttttatttgtgcttagttttcatgcagtgcctagtaggggacaatgctgacagtagtttctcgacaaatattagtggaactgtattaaaattgagtttttgctcacatatattgtttattttacctttagtggatcacttctccttatgccttcagtgctatagttttttaaaagaagtatgttagtctgttttgcattgctctaaaggaatacctgaggctgaataatttataaagaaaaaaggtttatttggctaatagctttgcagattgtacaagaagtttagagccaacatctgcttctggtgagggcccaaaaaactttcgtggctgaaggtgaagagggagcaggtatgtaacatggcaagagaggagggagcaagagagatgtcagtctctttcaaacaaccagctcacatggtagcgagaactcactcattactgtgggtgggcaccaagctattcatgagagatctgcccccataacctgaacacctcccagtaggccccaccttcaacattggggattatgtttcaacgtgagatttggaagggacaaaatagccaaactgtatcaagcacaaagaagatacagagatagtcaatggtggagctagtattcaaacccagatttgtctgatttctgcatccatgctttcaactgcttaactgcattgcttccaatactcagaaaagacgaaatgttttccatatcccaggaacttaaaagtgaaaaagcagagagctagaagaccctgtagtgctgaattgagagtcatgagtgttacaaggatgggtgggggggtggccctgtgaggaccagaaccctccaggggaagctttctgggtgaggcaagaggtgaactgggccttgaaggaatgggtagaatttagatagtaatgaggaaggcagaaatcagtggaagcacagacatgcatggaggaatggaactgagttcaatgacgatctgttcaggaaagagggcataaactgggcagagaatgcagtggaagtggtggggagtaatactgggcacgtaaggtaagctctgatctggaaggccagcatgggagcctagactggttaaagtaagaaatggcttgtccttggaagaaaaagtgtcaaacttggtactgtgtgaaggtactgcacagacctcccaactggttcttaggagagccaaactgaggctaagttctgagaactaagtaagaactgacagccattgtaggttagaaagtagtggggcaacatgttacaagtagtgcttctggaaggttagatgcggttagaataaaatcattgccattttggggagctgggaaaatggatgtcttcagtctagtctaaaaagggatgacttgaataagcttatataagaaagaaaagaaaaacctttttactcactggaccatttcataatcttgacttttttcaaacataaatctgtgtcatttttcttatttaaaacagctgagcagtttactctcctacttagagctgtgatccttatcatgggctcttgtgatctaaccccagcctgcctccctggcctctgtccttgcttaataacctctagccatatgaacctggaataccagtctaattcccacttcaaggcttttacacttgttgtttcctctgcctggggtgctattccctcatatcttcatgacacttgttcatttacattgtagctcaaagcatacctcctcagggaggcctttcctagacactatctgaggtacactcctgcacccccagccttcatgattgctttttatacattactgggttttgtttccaatggaacttatcgcttattactgtcctaaattattttatttattaattttttagccacctttctcttatagaaataaggttcctgaggacagggagtttattctgtatactacggtatccctgacatcagggcttgtgcctgccgatagtagatgctttctaaatatgttctgaatattagatagctagttcccaaatgcactgcactgaaagtgtatgaaaattggaaattggcttctagatttttgtattatattgccaaatgatggagtgatgagattgaaatctactacttctttttgccttttttttttttttttttttggtggagtagaggagggcctgcacaaacagcagatacacacacagtaaataagatttatttcagccagcaagtatttattgacatgaaaattggggttaaatgtgactctttgtgagtgactagtttcttggagtctattaaagcatcagtttaaacatcaattctctatggtatgattaatgtttctttttttactttataagcatgaagctgccttcaattttattgttaaatttaagtgttttacattggaaaaaagtaaattgaattttgaaatgaggtctgtcccggtctcactttcatggcttcaggttatcaaagttttaatttctctttgtatggaagataattatagtattcatttttgctcctgagtaaagccacgagtctcaagattatttttcttttttaaaaattagaattgtcagtttatagttgtatacatttatagggtacaaagtgatgttataatttgctaatacaatgtagaacaattaaaaggtagttagtatatcctttatctcaaatatttaacattttttgaaatttactctcttagcaattttgaaatgtataataccctattattaactatattcaccacactatgcaatatatctcaaacatatacaaaaaaattcttcttgtgtaactgtagctttttgtacccattgatcatcaggcccacagcttccgtaaccaccattttcctctctgcttctatgattttgatggttttcaattctacatataagtgagaacatgctgtatttgtcttcctgtgccttatttcacttagcataatgttctccaattctatccatgttgtctcaaatgacagaatttatatctaaaggtggaatagtattccattttatgtatctaccacagctttttttttttttttttttttttttttgagatggagtctctctctgtcactcaggctggagtgcagtggagcaatctcggctcactgcaacctccgccccccaggttcaagtgattctcctgcctcagcctcctgagtagctgcgattactggcgtgctgtaatttttgtacttttagtagagatggggtttcatcatcttggccaggctggtcttgaactcctgacctcgtgatccacccacctcagccgcccaaagtgctgggattataggcgtgagccactgtgcccggcctatctaccaccttttatttatccattcatctgttgatggacacttccataacttggtatgggtgtacagacatcttttcaataaactgatttaaaatatctggggtaaatacgcagcagtgggattaccagatcatgtggtgattctattttcagttttttgaggaacgtctgcactgtttttcacaatggttgtactaatttacattcccattaacagagtagaagggttccatttctccacatcctgtttattcagacgatatgttatcatctaaatcatctaagacctctatattatatagcttttgagtatttttaaaagtggacactcaagcgttcatatagtcatagtcagtgtgtggttcctcagacctgtggtatcaacatcacctgggaatttgttaggaatgcagattcccaggctccctgcagacttagtcagaaattgtgggggtcgagtctaacactcttttttaaaaagccctccaagtgattccagtgcttactaaagtttgagaaccgtggctcagtaaatgctaaaggttcaaggtagcatgatcccacacatcagccaagtggcattaattattagcctggtaagcccaccttcttttcagtcactgagtttgattggttcactagggctaggctgtaaagttatttgctagattgattgctacatattgactttgggttgtttgtatttctctgaacctgtcactgtaatgatttgtcaggacacttaataggaacaggccgtgatttttgcacccatggcattctgagtcatgggtggctgggtcattatgtactccaggtttcttcaggcactgggcatgccattcatgtacttataaggagggagctgtcgctggtggatcacagggaacctttagggacatttagttcgctctcagcttggtacaggtagggaaattgagcccccatgaagttgtgctttgcttgcagttaggggtacagacaggatttcaggtctcctgagtccctccactgcaccaggattcctgcagggggacagagctacagctttttctgtgcctacaggacattcctttcctactgtgagggttttatttatttattattttatttaaagaaaaaaagtaaatagaaaaaaccccggaagttctcactgaaactaataaaagtgtctaaagagaatgaaaaaatcagtttgagaactttggtatggaggaaataacctgacattaactgttttaattatagttgttgcattgggcttatcagtgtgggaagagggagcatttgagccttacagggaagtgggatatggacaacaagatgaccctcttcctgaatttgcctgtttgggcctgcagcctggtgactctttgtgtgatcccaacagctgtcatagagatgggttggacttttactgagacctgggtcctaggcccagcactgccaccagctagtggcgcgatgccccataaagaggccacttattctctctggcctctactattggtaaatgggtataataatatccaccctgccaatcctgagaaatttcaggtagtgggaagcagtgtatcttggtggttaagggcagagtctctggattcaaattctagctttctaactcactggcatggcagtaggcaggccacttatcctccctgttttctcacctgagaatgggtataatgaaatttacttctaagggttgttgtgaagattgaattagttagctaatttatgtaaagtacttaggatagtgccggtatttagtaagttctatgtgttagcctattattattactattaccatttaaaaatactatttcaaggatgggatgcattttctgtaaacatgttctcaaatgattctactactggatacaatactgggcttttatgcagtaattgttgttggaggagttgttctgacatccagcttgcacctgggctactggtttcgtggccagggatggccaggcctagcgtctctgatcttgcacaatttatgcatagagtggtgtggttagaggaaacttggaggggggaacttctcagttttgctttcaggtatttatacattaactatcataagagatggacatcttaataacttccaagaaagagttcatgagcttcaatttgatatttattgtttgactaggtttctttctgtcttacctttccagttgttagggttcttgatatgtattttggtgatgaaaatttcaactctaaaagctaaacaatcaagatattgtaattatccagcaagtgattagcagatttcgagtagacttcttccattcttggctgaaatcaatgaaaatgtctactattgctgttgtttttgttcttttctctgaaaagtctgtttttgggagggcctgagatggtaaagtgcctttttattgtctcttaaagggaatgggggaatcaacagtttgagaatttttgttttatctgtatgtataaaattgccttctccttttatttcttttgatactctctctgcagtctctattcatgatctactccccatctttttatgggccccttaaagctagagattatgtttattcgtttatttatgtattccatttctccttttttctggatcctaattttgtgcctggtgcatactaggctctcaattttagtttgtcgaattactgttattgctgtttctgattacttcttgaagcggtctgttttaaaacttcacctgaaggctaagtaattcatcagtataatggtgatctattatttatctagcattttcctaaacactcattgatgaatccttataatactcatctgaagtatctaaatcccaagatgatgtgtcatgtcatagatggtatggctttaatttttaattgggagatggagatgtaacagctggagatactgaaacacagagaaataagagcatgattcaagaccacaaacgtggttattgttggaagatagttttgggatgggcttctgtgctagaagccaaaacataaaaaactgattaaaactctaaaaagaaacccagattaggtgggaatgaatgctgatctggattggattacacttctttggtgtctgagggttatgattagtgacttacttctaatgtgcatttgtttttatttttagcattgcagtgtcgagatggctatgaaccctgtgtaaatgaaggaatgtgtgttacctaccacaatggcacaggatactgcaagtaagtttttctcttcatatattttctttttgcgatagaacactggacaagatttgattctactcctctatttttaatgcttctgtggaatgttactggttcttgagctttcctggtacagattttggttgggggtgaggatggaaggatgtggatgccagataattggctaataagaacttcttactatcttactgttatctttctcactatgaaaaagacttttcagtgagtggctagttaatgtatatggggtagaccaggcatggtggctcatgctggtaatcccagcacttcaggaggctgagttgggcgaatcacgaggtcaggagttcaagaccagcctggccaacatagtgaaaccctatctctactaaaaatacaaaaattagccgggtgtggtggcgcatgcctggagtcccagctactcgggaggctgaggcaggagaatgacttgaacccaggaggcggaggttgcagtgagctgagaccacatcattgcactctagcctgggtgacagagcaagactccgtctcaaaaagaaataaaaaaaaataaaaaaatgtatattagattcccttgtgtttttcagattaaggaatactcttagagtctccccttaacatgttacctattatcttgtttttaagtaaaaccaaatagatatcaactttaatattcggcccagtatatgtgaatattatattcatatttttttctagtgtaaaaaatctaattctgaaagtgagacagtgagagaggaagatgtgtgcatatgtgtagattgagggggagcaggggctttgggtgtgtattattatatggggataaaagagtaaggatgaaggaaaatgtaggctagttcttggcttaagagcatttttttttcctttttctccaaccatctactctagccaagacgttttgtttgtttgaggaaggctgtgagataatttcataatagcttttctatgtttcctgcaaataattttttttcttctgcctcaattgaaaatttttaagaggaatatgtatccattctgtttatttcagggaagatgctggagaaataaaatttggtaatatgaaatttctcttcttttccttcatttttgtgaggagtagttcttctttgctttggtggaggtacttgcttagtaagcattttaagtgagtttatccaacacatttttatttcttaccaggaatgtaattacaacttttttccagtgagatctgttctgacaccaggatttagttttttaatgttataaacaagatttttttttcaagtcagaaataattttcttcactaaagtgaaaattaagctgtgatgacagtaaagcttaacaataggttgtttggattggaataaagataacattggaaataaaggttttatgtagcttattatgggctgctcatttagtttttctagctgggggaaaaaaaaatgtggtgcattctcctctaagaatggagatacaactggagataataagggagggaacttaataccttagagtaggccactgaaatcttgtttagtctttttgtggcatttggtgcgttagttgcttgctttattctgttatgcaactcttgtggtagttaaccccattgcattatggtcatttgttgatgtgtttcttttgctagaatgtgaggtcttagtcttatgcattttttgcatagttaatgcctagtacagtgcctggtgtagttattgttcagcaatgtgtttcttaaactaaaaggtgctaagtagataccgtcatgcacatgtttcttatctatttatgttaaataagaagacactggttctctcctttaaaaatttcagtgtggcgattcctcaaggatctagaaccagaaataccatttggcccagcaatcctattactgagtatatacccaaaggattataaatcattctactataaggacacatgcacatgtgtgtttacttcagcactatttacagtaggaaagacttggaaccaacccaaatgcccaacggtgatagactggataaagaaaatgtggcatgtatacacgatggaatagtatgcagccataaaaaagaatgagttaatgtcctttgcagggacatggatgaagctggaagccatcattctcagcaaactaacacaggaacagaaaaccaaacacggcatgttctcactcataagtgggagttgaacaatgagaacacatggacacagggaggggaacatcacacactggagcctgtcagggggtggggggaaaggggagggagagcattaggatgaatacctaatgcacgtggggcttaaaacctggatgacgggttgataggtgcagcaaaccaccatggcacatgtatgcctatgaaacaaacctgcacattctgcacatgtatcccaaaacttaaaagcaaaattaaaaaaaaatttatttatttcacatagcattcagggtggtaataccatacagagaggcaaattggttctatttgaagatcattcaacttggtgacttatatatggagaatttcaaatatgttctaagtgttcgcctatatatttttggtctgacatggggagagaaggtttctaggggagactaatctctgagcacttaccaggagaggacacctaagggtcactgttgggaagaagtccaatagttctttgttggactgttgggctgctagtctcatactctccaaccaaggttggagaccatcctggctaacacggtgaaatcccatctctactaaaaatgcaaaaaattagctgggcgtggtggcacgcacctgtaatcccagttactcgggaggctgaggcaggagaatggcctgaacccaggaggcggagcttgcagtgagccaagattgcaccactgcactccagcctgagcgacagagcgagactgtgtctccaaaaaaaaaaaaaaagaaaatggagctgcctaaattctgtccctggctacttgttaattgttgataggatggaatgcttatggatacagttctgggtatgtccctcagatgtctttcctgttttgagggaaacaaactccttgagagaaagaaaaaatttggtgaggccatccttttgggagaccaagatgaacaacaaaacttgtataaagagagtgattccctacctcagcaaaagtaatattagcatatttaggagtggcagggtcaacataagtggacaaagaaaaagcaagaacaatatcaaggcagccacgtcaatcattctacagtgctttgccagcctccacagaattttaagcaaaattttatgcaaaaataatgtgtacctagcagagctttcagtgtattttcaccaaccttacctttttttctgtggagaaagaagatgatctagcttgttcagtaaatattattttcacaaaatagaaaatagatattaaaacagaagatttataaaaattctatcaggcatgcagggcatgtgattatctttttattcatgcgattgcttagtggattaagaaaagaaagttgaagccaaattccttttacagggccagcgtgggggtgagtggtgagtggtgggatgggaactggtagaaagtgttttaaaatagaaggaatctgactatctgtttagacagcataatgctactgattcagctaaaatataatgattgtttatagaaattataaaaatccttgataagatcacattgacagatgaagataactacttttgaagattagttttgtactcagctcaactgttttttctcagtgttaggagcctaagtaccctatcagtctgtgattagattttgatgccagattaggagaacttgtataatcttgcataaaactcaattattgctgttaaataactactgtcaaatcttaataaagccctctcactacagggagataagatattttattctttcccttgtcctactgggaggtgtaaatatgtaattaaatttgatgtcattaatcactttcaagttgtttgcttcagattttcaaatataaaccattctaaatcccaatttgattaaagatcatggacaactcaagttcactaggattctgggggtaggttaggttatgatttgtataattgacaaaatatgtattttaaggacatttattgtagttatttaaaatctttgtctgctggttcttaacatctgggttgtctatggatgtgtttctgtttctatcacctgctccttctttggaccatgggtatgacttccctttactttacacatgtatggtagttttacattacttactggacattgtgggtgatagattttaaagtttatctcccactaaagaatgttgaattttgtcaagattggcagatcatcttgatcctatggatgctaggttttaggacacgttagggtgggcctacttctgttctgcccttagtccgatgacacaaatcttagtcatgggatagggctcttattcccaagatgtgacccttctaggggttcagtggaaagtgtgaggggcctaccaagccctgaggtgttcattaagcccctctaaggcagaacttgtcctcccagccccaggagccttctgctcagtcttttcagccgtccagctcttactttctcttgggtttctgaatcttatcttgctcatgcatagtcaggaattatttaaggatttgagcagagttgtatgcatactttgaagctacccactctgtggttctgtcttttccaggaatttttctcctcatattctagctgctgtgacagctccagatacctctgactcctcagtatcgcaggacttccgttttctgcttgcacactcttcctcttctgctgcatgaactggggtgtaccttcacgataaaaaaaaaaacaaaaacaaaactgtaaatgtgggtttcatatagtttgcttcgctttttctgaggcttatatcccttctagtttatgcctgctttcagtgattctccagtgcctttgatattttgtccagagcaagagggctagtctgatatgttactctgcaattatttttaatgatgaaaattggaaatataaaggggcctttcagaatttcatacataccacttggtaaatatctaacatagtgtttgtaaaacagcagaaagtcaccgtgagttgtatacgttcctgtagatgggtgcttgcatttgagaatgtccactttttgctaaagtgctgatctaaaaactacactttaaggtaaattattataaatataaagtgttataaaatataactttgtgtcacattttgtctaaaacttgtctgctagctgtaataaacattaaacattaacagctaacaattctccttgccaggattaggcagtcatgttggtggtccagatttcctgaatccatccaagaaaaactagagccattgccttctttgtcttcttggtaaatgtctgtatagtaagtagagagtagagacactcataatcccttagaacttagctttttatggaggatgcattcgcaatgtttctgttgtggtgcttctcccccaaaaaggcgttttcagaagtcatggctgactcagcatttccccctttccttcaccttcttgtgagtgcattcagggaggcacaggggcattgtcagatcaaagaaatagacagggaaaaatatcaactgttaaattactttctctttcttctcagctgaaactggttctgccagcctagttccttcaagtacggtgcctatttagctgaacattgtgtgtatagtttttctggaaaatgatagcagaagcttggccagttttccatagttcatttatctttttaacataaaacaaagaatgctgtttttttggctcattaaatacctctcatagagtaatcttttcttaaaatgtaatatgttcaggttttattaattcaagagttatttattgcatgctatttatgcgtaccacatataatagataactcaagtctgtggtagtagttgcagttaatcaatattgttatcatattatttcacacttctttgggaagtcataaaataattaccagttcattaacttgggcttcttagagaggttcagagtaaagccaagtatgaaaaaaactgactataatgtggccttctgtacaggggccaccagtgaatggcagggctgggaccatggtgaggcaagtaaggcacaggcctctcttgtgaaatttaagagagtgccaaaaaactcactaatcaaaataatgtttgtatgtagttgttcaaaaaatcaaaattaatgcaaaataagttgaaaattatcaaaattttaaataaggagatcagtagtactgattttttcttttgccttatgacctagtatggttcagcctgcactggtgagtggagtaagggtcctggaagatccttgactggtgacatgaagaggacatagttttttgttgttgtttttttttgagacagagtctcgctctgtggcccaggctggagtgcagtggcgctttcttggctcactgcaagctccgcctcccgggttcatgccattctcctgcctcagcctctcaagtagccgggactacaagcgcccgccaccacacccggctaattttttgtatttttagtagagacggggtttcactgtgttagccaggatggtctctatctcctgacctcatgatctgcccgcctcggcctcccaaagtgctgggattacaggcgtgagccaccacgcccagctgaggacataggtttttttatgccagatagacttaagtttgagtcctgattcctattaacaattggatctttggcaagttaaagtctataatgctagctaacattattgcgtattagggtctgttctcaagtagtttacatgtatttactttagtcctcatgtgagagagagactatatggaagctaagagaagttaaataattcactcaagatcccatcactctgtagctaacctgagatatactcgtggaaaatgtactgtcacgttgagtctcagtttgcctgtcaataaaatgggacagaattacctgttttaagttggtagttcaaatggaaccttctgaaaaggaagtgtggaacatttgaaagtatacaaaaaggggacttttcagatcaggaatatgattaaaacactgctttatgtaatttctaaatttaaagacagtagcattaggtaggcctgagtacctcatatcattctagaacactaaatctgcatatagttacatgagtgtacatgggccaggtttggtgaatactgcatttctgagaaatggcctttaacatgaaagctcaatgtaataactgtggatgaaatagaagaagagggcagtgaaggtggggatagaggatattgtctattaaagtgtgcttcagtagagagaactaatttgaaacttctcctttctttttactaatggaacaggagcaagtccagacagatttatgcagttgtgaaattgagacaggttaaattcagtgatttttgataaatgttgttgccagcacaaaagtcacaagttgttgaatatggcaccttacatttgcatagtgagttacagatgcataggagtatgtcctgtgaggcttttccttgtattaggacttgagatctggaccctttaacagtacctttcctaagtgattcttattaatacttatgtcctattaaaatcctttatcaaatatgatgtttccctaaggggtcttttgtaaaggaagtcttggttactagcatctccatctgtggcccaggcttgagtgcagtagagcaatcatggatcactgcagcctccacctcctaggctcaagccatccatcctcctgcctcagtctcccatttttaaaactttttatagagacacggtctcacatgttgctcaggctggtctcgaattcctgggctcaagtgatcctcccacttctgcctcccaaagggctggaattacaggcctgaaccactgtgcctggccagttagtagcttcttaacacatagcaacataatttccatactattttcaactaatttttattctttcagttgggacctttatatatttcagtgttcagtgaagaagtaggagaatctggttcttaggctctgcctatatccttttacctgtcttgggtaactgccaagaaattaaatcaacaaattttggcctgcagtctggcattaatagatgtgaatttagctaggtttctttcaacacagtctccaggtcaatcgtaatcttatgtgaagtttcttattcaggcatgtctcgttagcaccattaatttcacacaggaattctttttttctccctttttttgtgactaagcaaaatgagaaatatttctctttcaggatatggagaggcttaattaaattctttaattttgtctacatctgcccttatgaatgatagcaaaggaatgggggatatcagaatatgagaaaaagtaatcatctaaaaatttccaagcactttaaaatttattaagctagcataaatatgtgggtgtgatagaggttttcattaagcctcctctcaacatacagtagttaggaatgaagtttagtgtctctccgtcctcctgtcatatgtgtgtatgcacacgtgtgcacatgcgactgtgttatgcattttgttttcatatttcttttagttgggttttaccttacaacccaacgtaaggtaaattaaaatttctattggatttccgcacattttctagatcctatttattcactgtcagtgaccttcactagcacttagtcctctgagtccaaaaatgtattgccaattcttagactccatcagccttctcctatgaaaaagtaatgcagttaatttctgctcaaaatgctcttctcctaaacagtcttctacttgatctttatgaaaagagttttatgaaagaaaagtgaaaataaagactaagaaagacattatttaagtgatgggtgatattattcagtgaacacattcaactatagcattctatccagttttttgccttcacgtaaatatgaggagaaaggtaggtgttaataagaaaataatctgattaggatttatgtagaatggtagcatttagggtattaaatctgtatagattcaggtcattttcctgcagtcactgtctataatcctgtgtgctgaacactgaaagttagatggactctgaagcgctatagaatcctcacttttcaaacaaaagtttaatttttatcacactagtatttattgagcaggctactataactgatcactgtactgggtattgtgaatagacagaaaagcccaagaggcctgtgttacctgacttctttattcacaagtatacgtacccagagactgtctgacagtgaatgcagtttctcctgcataagacatggtggcagtcttctgaagtcttgctggggagatgaagcatacagagatgtgtaaaataaaacagtttgtaatatcccagtgtaggggcacagataataactatggacactcagacaaaggaacaagtactgtgggacaaaagagtaaaatcagaggacttttggtgcactgcttagatcctaaatctttgaatattagtggtgccttagaagatggataggtaggagaagggtgagaggaagggagctgaggagactagaagggactgttatttcctggaataatcattaccaatttcttcatcacgttttcttaatgacacggtttcaaacgttttcttcatcttgattgctgtcttctgtgtatatgctggtttgtgtgaggttttactaaaccagtatgtggattaatctagtttcacagtgacaggtaagtgatttagaaaatcattcctttagcacatgttaacttgaacgtttggaggtagaatgcctagagtgagggtgaaggagaggacctggggacaggaagagagggcagctgggagcaattatgctccttccctcagacctttttggccttgactcttgattcttgtacttctaccagacagagaggcggtaggcttgtggccatgttttgcgaggaaaatcagaatctaagaatctctaaggcaagagcaagaatggattgggataggggaagtgataggaaaacagaggcactaagaagagggttggttttcatgtactgcatagttcattcccttagttgagaaatcaggtatctcaacctcagatatcttctgtccagcatatcgctggccagatctgattcatatgagggatccagagtaaggaagcatctgttagccaagtctttggttaccccaaattagctcaggtcctttactgcttgtttcctctgattatatagtacatatccaaaccctcaattttccagaataaactaggtctgcctattctgtgtggaaaacatttgatggtggttaagattctcttgcctagacgatggtagtgccttagtcgtttaactgcctgtcactttaagattttgaaatactgattcttgttgtgtaagccagacacatcttgagaatattttacggggcaacttgccctttctgaaacctcagtcatcctgaaaagtaactctgtacctccttgactttaatttttctgtcttaattctatttgtatacaatgtttgtggtgtctgattctctgtctcgtattgctgaaactcatggccttgaatttctgggtcactcttaaaaaatagacataacttgattactaatgaaaaagtgactcattttcttccaggcaaaggctgacactgactgtcacagtttgtgacagaagcagactctctaattaggagacatcacctattcttttctaaattttataagaattgatgatagcatcatgagatgggaagtgagtaagataagcgtttatgcttgtagagaggatgcataaaaatgaaatctggataaagttctatctgaatttacctttttaagtggttgattccctgtgagcttaaatttagtgcttctcttcccagaccgttgtcttacatacacacttcagtcagttttagccttgtataactaatcagcaggtcagattccatcgaggctgaaatacctaccaccattctatgctcaagaaaacaggctctcatgttggccagttgtttgggatagaagatggttagacctttctatcctttttaaacacaagattctttttcattccccttatcttgtttaaatatattgttccttctctttggttgttctttgctttcttatgcatctgtgaggggctagctgaaagtgtgagttgtggaacaattcatttacataagtgtatattgaattatctgtgcacctagagggtgatgggcactgtgagggatattaaaaaagagacacagtacagttcttaccctaggatcccctgcttggagtgggacagtggtcaagacatatacaaccacaaacacccaaacattaacatcaacaagcatcattacatccttgggtggtattgccaagggacttcaaaggccaagattatagagtcatcacacttaggaggtcaaagggactttggaaagcacctttgtcactcattttgttttataagtgaggaggctgaggtgtaatacagctaagcgaattagcctttattacataactcattaggatgtagactgggactaagagctgtttctccagatcccattaggcaatctaaagattctgcactatttctttttcatttttggtatccaaataggtacagttgtttttgatctaggaaaatccttttagactaaacagtaagctttttaaattactctgcttttagatattttttggacttcagaactttgaaggtggtcatccaccaacattggggaatggaaagaaggctccaacacttttctttctagagatcttctttaattttcaatggcagtcactacagaatctagcagttcatgctattgaggccactttgtaggattttttttttttttttagtcagggctccaggtccctggtggtttatgtagtcagtcttatcaacaaccgatgaaagaccaataaaagtgcaagagggaatgaggactgtgtgtgtgtatgtctgcacatgcacacatgcctctctgtgtgtgttggttaacttcatatttggtaggtgggagggaaggtgattaaaaaataatctactttgcatggagttggcccaatttgactgatataggggtgagtgggggttaagaagtagtctatatatcaggaatcttaattagttttgaaaatcctttaggtaaatagctcaacccagttgttcccaaacttcaagtgtatttatagggtctttttaaggggtaaagattccacagagcccttcattttgaccttttgcttctgcactgaatagtcgaatgccttctatatgccagtcattgtgttaggcactgggagtatgagaattaataattttagtctgttgacagataatcataataagggctaatgagtaacacaggctcagggttataagaacagagggggtgtcaaggctgtttttcacaggaaataacatttaagttgatacaatgaaattttagggcttagccatgagaaggtggggaaaagcattttgggctgactgaacagcgtgtacagaggtctggaagtgagaagtagtgtactatagcattttctaggagctgaaaggcatttagcaagagtatagcgcataaaggagagagcttgagatgaaacaatttctcagtgtgttgtttgaatacaatgtatactgtcaaaatctaagaattcaagaatcatttaatatatctttatgttttactagtcataaaagcatatacatatatttaaatatggacaagatactgtttagtagtttagaaagtgatttatgaggattgcaatcccttgcaataactccacagcccataccttgggaacaactgagctaactcattcagttttgtccattacatcgaagggtgttttttgtaaactcatatgtctagaatgtgtttgccatgttttaatcacaagtagatattttctcagagtccagtgcagtgaagtatggtaagatcctgattgtgttctggaacacagaggaaagaccaccttctgttatagcaacaacacaagtcttttaacactgtgtgccccttcccaatctttcaagtgatgattgaagagactaggtgctcagctcagcctttgagttctgataaatgagcccagactgtaaactggaagataaggatgtttgtaaagttcttgtataaataaagcatggtttctcattgcagtggttactgatttcatagtctgagtgaagatgaatgatgctgtgaatcaacagctttaaagtccgtaccacttcagcttctttttggtttaggtttcttaaaatcagtgtgtatttaatgctttattcagatgagggggtgaaaaacctaacacatgtaaactaagtgaggtggggtttcagagataattcccagcctcacaattcctcatgaagttcttttcctgtgggaaacttttaatttggaagcatgcaacctaatgtgggaaccaagattaacattttctgaaatacttctacaagaaaagcagaaatggtctgtccaggaagctgaatttacatagtagaaaaatgagctgccctgcagtatttggtagtctttgtgtattggttgtgataaaagtgtgtatgtgtgtgtgtacgtgtgtgagagtgagagattgtatacttgtctttgtttccttcacatacaactagtaaggccctagaaaaactacactagaaagtgtgttttaccacaagcgtcccagttctggacaccaatctatacacaaatacttttttttaaagttctttttgtttttccttcttgctgagtaagctatagtatttccttttttttctttctttttatttgagagaagggggggttgagagtagagtgggaatggcaagaagtagtatgacagagcttcttctctttttttcccctctttaccaggaagttaactagaagtcttcatgcatgtttttaaaacaaagttggtaattagcataacctagttagttacctttacacagagtgacagaattaaaaagttgacaagcccatcagacctcagccaggaggtactgaaaggagggagaccagtgagtctagaccaataggtgggttaggcctcctgaatgccagcctagaagtttagacttgattctataggctctagggtacctacaagtttgtagtcgcagccttgggaattgaatgttacataggaactttcactggttccagctagccttggctgttagcaattatttttatctactttaacaggggggacagagtaggggggcaggaaactaagctggcattatggtcacaggaaagaacagactgatttggagcctttcaaactgcagacctttgttactgaccgatgcttaatttggtttctgggttttgttagttttttcccctgcccttacctcatttaccttaacgacagctcccccctctagagctcagctagggcaggctgccactgtggattggggggccaagaggcccagtgcaagaagaaagtgggttgaaagcagagttctgtttaaagaattttctgctggaaactagcccagagggagtaaagaggagctttaatgaggagcagctgcagtgccgacgcaacccacatgagacttttttttccccttcgttccacattctgtatagtttttttaaaaatcatgactttgaaatagctgttttgtaaagcatgcctctctttttcttcttgtatgtggtgggattttgctttgttgttgttgttgttgtttcttgaatggccaaatcctcgttttaaaaaaaaaaaaaaaaaaaaaaaaagctaaagacagagctgcagcaaagccctggatgcaatttggcctcaccctgctgatacagaacattcggtggagaaaacaaggggagagaacactggcttttatttggaaaaggggcttatttcctgctcagacttcagtcatcttggagctgacacaagctgctacactgttttaagcttttctgtagacgagtggctattcacttaggaaacgtgaaagaacaaatttttctgtcctgtattactagagagactgatcctgaactgcagccattgccagatagattggaattgctattcagatcccagcttcgttgaaatctgtaaagtggctacatgtaaactaatccaggctgctagtgagatgtgagggttggggtctggttttcatctgcttaagtgagaggaaactgtaggggtatccttcaaatggaatgttttctagttccattaggaggaatcccttgtttttctctgttttcttccttcctttgcttttctacatccaaccccatgcgtatgtttgaacagtaacaatggaaatgtggacctctcaatgtcagaaatgacacttttttttttttgagatggggttctcaccatgttgcccgtattgcctaggcaggtctcgaacttctgctctagcaatctgctcgccttggcctcccacagtgctgggattacaggtgtgagccactgtgcccagctgagacttttaaagaaaaagtcataaatatatctttatggacctggtaagtattcagattagtttatagagtttaaaatggaaaaatgctccccaaacctttctctgtattcacaacctcatctgcgaagtatgttctttcagagttccaatgctagagaagagagagtaagtagaagtcactgagagacattgaagagacagttatgaaaataattaataaactccctacaggagggaaacattcatatagttttgcggatgaaaggcatctgttagatttttgtggttattttttagaatatacacctttagttcaagtggtagactattttccaaaatgtgtgctgggtagcttaatggaattatagatacgtaagggatgttgggtgtttagccatgttttcactctctaaccaaattcaactttagccatctcaagaagacagctatttaagcccttgttttcaagcagagaaccttactttccaccaagactaacagagtatattttctccttataccacagttgaacagggatttgcaagttgaaagatctcctgccttaggaaacaagggtctgttatttctgactgtcttagctattactcccctttcttcccatgtccataatgctgcttagcttcctggggtgtgaaggataattctatacctcaggatgactattaggttgatttggcctgttattctaccagacagatcacagagtagagatggattttgtggaacatttggattgagagactgactttatccatcacatgaaatttagcctgctttggaaccagctgcttagtggggtttatgtactcaggtattcagggaacctacaccaagggttcaagacagggtcttccccacaaaaactatctagatgggagtttgagaaaggtacagcaaagacataacagtggcttaaataaagaagaaccataccagcggagacaatgtagtgcatgacatggcactacatctgctgttggaaggatcagagacaggtgggatgatttgtagaaggcttactataggacaggtttacagcagatttttgaaaaaagggtggaagaaaggaacctaagttggagatataccagaagggaagcatgatgtttctcactggaaattaaaaagatttcaatataggggacagtaaacaagattgtggaaataatatggagtgttcgagttatggattactaaagagtaagatggttagatgattggaatgggacagacaagcagatcagagattgtaaagaacttggatttgaaaggcttggtattaatactgttgctagtttctgagcagaagaatgacatgaaaattatgcttaggaaagattattcttttagtcatatgcttaggttcagcaaggaatttccagactgtccttagggagaggagaggtatggataggatgctggtccatttaggatgttagagctgattgaataagtgctagtcttggggcaagacttagtcatacactttcagttaagtactgtttcattgcaaggtctaggtgaagatagggatatatttgtaaaactggggaaattgctagattcacagataaccaactttgggtagatcagttagctttggtgtccttctcagtgctataggggttcagaccatttggtttctgagatcactgctgaaattctgtgattgtatgagtataatgtaaaagttgtctcaatcaaggaaacttggagtaaagactcaatatgatggatttaaaaggaatgaatgatagttccaattattgggttcaaaaaacatgtgctacaagtataagatgagaaaaatagggtacactagtagttcatgtgaaataaggctctgaatattttagctgagtgtgtattccatagcacatagtagtattttgtggcttctaaaaaagtacacatatccattgggtatgagtcggagcgttattctttcttgaactgcgctctcacgatgcctcctcagtttaagaacttactctgaaatagtaaaagcatagtgtccagatcaggaggtcatggttcagctctgtgctgcactggtaagaacatgtgttaagcctttttccattttgagcctcactttttaaagaggtttttgatgaactggagtcatccagtgatggggaggcaggatagcctagtgttgaagcacacgcactctagagtctacttgggtttgaatcctgcctcttccatctactagctgtgaattttttttttttttgagagggagtctcgctctgttgcccaggctggagtgcagtggcgcgatcttggctcactgcaacctccaacttctgggttcatgccattctcctgcctcagcctcctgagtagctgggactacaggcgcccgccaccacgcctggctaattttttatatttttagtagagacagggtttcactgtgttagccaggatggtctcgatctcctgacctggtgatctgcctgcctcggcctcccaaagtgctgagattactggtgtgagccaccgcgcctggcctagctgtaaaatcttaatctttctaagcttcgagttcctcatatataaaatggagattataatatagcactggagcgagtaatacaagagacaatagctatcaaatgcttagcaaatatacaatacatagttaagtacttagaaaatatgttttcagttacttcgggtatatacctgggaagggaggcagaaaattttggtcattctgattattattactactgttaagcatagaagcaccactaaaaaggtgaagaagcctggaaataaccctatactgaggaatatgccaaaccattgaatcctggaaaaaagaaaacaaaaggcccacataactatcttcagattcttgaagggctacgtgtaagagaagcagaaggcttgttcttttttgttctagagggtagagataacctggaaattgtagagagacaaagtttgttcttttcaaagttaagacataatttatgtatcataaaatttacccttttaaagtgtttaatttagtagacttcagtatttccagagttatgagaccaccaccattatctaatttcgaaacatttttatcaccctgaaagaaattctctactgcttagtagtcactgtctatttccctttctttacagctcctggcaacactaatctactttctatctctacggatttgcatattctggacatttcatataaatggaattatataatatgtggccttttgtgtgtggcttctttcacttagcatgttttcaaggttcatccatgttgtagcatgtatcagaatgtcattccttttcatggccacatatttcatttatggatataccacattttatttatctgttcatccgcttataggcatttgggttgtttctactttttagctattatgaataatgctgctatgaacatttttattatctgggcatatgttttcagttatctcgggtatatacctaggaagggaggcagaatttgaagaattaagaaagagctttctcacagtggaatccacccacattgaagactgttcttttgttgaagtagtcagccagtaatttcacttaacaaatgcatagtgtttactatgtgctggatagtgttctaagtgctttacccttatttaaaaatcctatgaagtaggcactgttattacatctcttttacgacagggaagtttagtaccttgcccaagattacacattgagtaaatggtggagttgggattgaaatccaggtggtctggttccagagtctgtactcttaagagcagaacaataataactccaagcatttattaaattctcaagatttatccggcaccatgctacatgcttgtattcaagcagaggctggtgatcatcttttagaaatattttagaaatgattacttaattggatagaaattaaatttcttgaatctgaaggttctgttattccaaggatggctggaaatgggggaaaagccagcaacaagatgatgtctggcctgaggcttttaagatgatcagaatttgtatcaaaaaggaaactgtgaacacgaatgataagtattataggaattcagttaacaagtcttgtcagaatgtggtaataaattatatacaacttaaagagatgaagttactttaaattgtgtgtggaagccttagaaaaattgaataattaaagtttcttgggaagatgatctccttttacaaatgtttagtttcaaatagtggcagcacatattaggatagagagatgacttctagaaaactgaacatatgggactggaacagtgtattttggagtcagttacaggaaggaagttgtttaaaaccaagtgaacaacaacagtaacaaatgcatttgagagaaagagcagtgcagtccagacttaaacattagggtggccataatagatggggaagaaggagaaatcagcaatccagactaagacttcactgggttttgagttagacagagggaggcatagaagccaaggtaaaatgattaaaacggtacatggagtggttagcaattctccctataggagagagaatttccttatgaagtttcagatgagaccactgaacttgactagaggaaagtcattgtttttagaaaacagtttctaaacaataattagaattaaagttttgttgcagagggataagtaagaagtagatggaaaagaaagaggaatatctgaaattaggctacagtcatagaaggttagctgtgaaacaataatttggaaagggaaatgggacctcatgaaagtgtgggttaaaagagacttgtatatcttctaaggtaaaagtaaagaactaagctgatgtccagccctctaaaacattttaaatagaaatcaaactttattaatacagtaggtctagtttcacgtaaagcaaatatatggttctgtacacgggctttaggagagtaagtctgttgtacctcatatgtaagtattatcccatttagaggaaaaccctaagtctttctttacagtggcttaaaggccccaattgatccacatcccagttacagctctcatctattttctgctgctccagatattcttgctgtttctcaaacacgctagggctgctctctgtgttatggcctttgcatttgctgttccctttctcatgaatgtgttttcctaagatacctgcatgattactctcaccttatttaggtctcaactcaagtattgtcagtgaaggtcttctctgattttcctattctaaactgagatacttctctttgctcaccccacaccctcatccccagctccattccttcctgtttaattttttttcacagcacttaactccatctattgtgcatcttttacttagtaattttgttttcgtcttccgctattagaatgtaaactccaagagtgtaagaatttttctagcactggaaaaatgcctggcacataataggcatttactaattgttgtgtgaatgaacgattataagtttaatattctttgtggaaactaataaggttgatttcctatcagaaaccgatcattattaataagcatattggatggtatttatagaattagccttcatatgttctctactcagaagttggcaaactttttctgtaaagtgccagagagtaattatttttgcaggctttgtggtctcattacagctacttgactctgttgttgtagtggaaaatcagccatagacaatctataaatgaatgagcatggctgtgttccagtaagactatttatggacactgaaatttgaattgtatataattttgaaatgtcagaaaatatccttcttttgttctttttttctaatcatttaaaaatgtaaaaaactattcacaggccaaacaaaaacaggcagtggtccaaattagacttgcaaactgtactttgtcaatctctggttttactgatttcttaaatatatcttaggttaaaacttatttttccatacttgatagggagcaacaatgtgaattaaactgtagaaacaaataattcagaaatacatctgtttagctttagaaacttccattttgcttcatttttgttttcctgggaaccttatatttccattatatgtttatgatgctaccatttaaatgactttgcattctcttagcatatgccacatgatagtgttagggtggtgtaatagttcaggagcaaagctgagcaaagcccacccacgtttaaaaatttgccattatttagaaggtgcataattcccatatgggagaatgaagagtcatctaataatgcccagagggctgcactgtgagtgagaattgtgttgcagtttttaacattcataacacatttcttgaataagctgcaaatgcttttaataatatatctcagagttaattttagctatgctacattggcactttttgctcctccacttcaaaaaaccaacacaagaaactattctcaaatcaagctgtgatttggatggggcattgtattttcctcaataagcacaaagaagagagaaaagatgttttcacttggcaaaacttttttttttgagatggaatctcactctgttgcccaggctggagtgtagtggcacaatctcgtcggctcactgcaacctccgcctcccgggttcaagcaattctcatgcctcagcctcccgagtagctgggattacaagcgtgcaccaccaccctggctaatttttgtatttttagtagagccagggtttcaccttgttggccgggctattctcaaactcctgacctcagatggtcctcacacctcagcctcccaaagtgctggaattacaggtgtgagccactgtgcccagcccacttgcaaaactttttaacatttataaggttttttacatacttgattttgttcagttcttagaataatctcatgatgtaggtgaccttattaactatttacaatgtgagaaaatggatagtcaatgaagataagtaacttgtccaaggtcacagcaccagaactccaaaccagaccttctgaccttcttgatacagactcctcacagtcacctgcatgccatctttggtttcagtgctatgaactttcttcactgcctgttggtctgtagctacacctactcatgaagatgcccagagccttagccgctccttgctctgccatgcttatcttatgcagctctgggaggggtgaagaggctgtggccagttacctcactaccactatagctattcaccaccctgttttctcctttagccattttagctactacacaattcttctgggcattttctgtcttagttccctagtatctggccttccctcttttctcagtaactgtgacccctgctagctagccttgccaaccaatggttaatgaaaggtcttggatatgactgtcaaagacaaaagcactcatgaccccaatgtttcaggtcacaatgattaggaaaatcaggacaacaaggcttgggcacagaaaagctggtttttgagagggggatttagagtttggtttaaatgtgtaatctttgaggtaatggtggaacagcctactagattcagttttctagtccctgaaaactaaaacgaggaataagttgaatcacatatttggggcaccagccaaatatatagcagcatttatagttagaatcaaagtgtttgtgtttcttaatttaaatgcttctcagagattccatttaaacaacttcattatgaaaatggagacttaccatgcctttttgatattgttcagagaaaattgtcataaataatacacacagtttgaaatggttgtacatcttatgaatcaaggggtggcatgtaaaaaggttcctcagtgcctcaatgtggaaaatatcatagaatgttattcttcaattgattccttccttgactttggtgtttatatggtatcttagatattttatgttattttaattatattttgtgtctttttatttggttaaaaatgcctacttaaatattaacagatttttaaatatccctttgaactcttccccattcctgtacctcctttccctttttccgttgtaatgtcagccacctgaacataacccagaaaactaggtatcatccaattgatgtttcagtggaaataagagaaagaagcacttactatttctcaatgcttaattgaggaaaagcacatgatatcttacatattttaaattggaggggataatagggtcaagttcatgcattatattgtggacatcttaatcctatcaaatggcttagtcaaaatgagaaagttaatgaatttaagcagacaagtacgaacagtgctctaaaaaaggtgctgttacaccatcccaacctgtacacacatgaaaaaaagctggggtgcattttgcgtttgaataagggtcatgttgactggccatggcagaccctgctagaccatacagctgatactctgtcacctgccaggactcaaaaggacatgggagtatgtggttaagttctctaaggactctttcttctaaagggaagcagttttataggtggtccttgtaggtctgttgattcacaatctcgtgctttcttgattggactgtattgttttactgtaattttttggacttacaagaagtcaggtgttttcatggactcttctcttttccatacagatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcgacatctcatccatgctttgtgtctcgaccttgcctgaatggcggcacatgccatatgctcagccgggatacctatgagtgcacctgtcaagtcgggtttacaggtaactaatgagaccaaagccagtgctttcctaccttcagcagatacctttatttagcatcttttagatcatggtgtctggctcttaaatgtcccccagctctggtgcacatttaacattatgataaggaactgggatgttccagacaactatccctaacttccttttaagagtttcagggggcagagaaagagaaagaaaaaggaccaaatactttgactgcttaaagtatatatgtcagggccaggtgcggtggcgcacgcttgcaatcccagcattttggcaggccaaggcaggaggatcacttgaggctagaggtttgagaccagcctgggaaacatagcaagaccccatctctacaaaaaaacaagaataaaaataaaacaaaattagtcatgtgtggtggtgtgcacctgtagtcctaactacttgggaggctgaagtggaagaattgcttgagcccaggagtttgaggctgcagtgagctatgatcgcaccactgcactctagcctgggtgacagagtgagaccctgtctcaaaaaaaaaaatatgtacaccaggatggggaatcagagtttacttcactaaaagaaataagtacactgtcaccagaggaaaagttgctgatgttattgactatttgcttttagaaatctccctccctagacattcagggcactggcttttctggttttctgaaccctgttccttttgcttcttcattaccttgttcttatccattaaatgtttgtgctccctggagcactgttttgcgccctcttttgagccacatcacagctctccctagggaatttcactgtctgtattcgcctccactgccactgtcttcattagcttgctgatgaatctcaccatcattcccttagctccacccaaccctgacattcaggctcatgtttctagttatcctttgtatgttctccttggagatattctacaggtactttcagctcaccttgttgacagaaatacgtagcaaccatgtacatcccaaatacccacgctagaaactccctgtcccttgttctgacctcatttcaactcagtcacccaagccaacctctgagttgcctttcacctgtctattcctcccatttcctctgctaccctgtagttgaaggccatgttatctctcacctgggcttctgaagtagtttctgaatacgttttcttgcctttattctctccccatctcattcacccatgatattactacatctttgattataaatgcaaatattctaacaatctcacctgcttacaatgtctaatattttttcatcatccgcagaataaactgcaaactcttttacatgacttccatagctctctacagcctagactttacatctttttatagcctggcctccccacaagcatctaggcctagtcacaccaaattctccttatttcctgaaaatgttgtacttattattgcttccatacagttacacacccttttgcctggaatgcccttttctacaactggtgattgtccaatgttatttaaaactgtgtctcagtgaccctttcatgattcctttaggcaaatggtctctaagttttattagttttatgtatcacattttattgtaattttttttacacatatctcacctgaatagattgtgggtttttctaggtgggtctgagctttattcaaaagtgtttattaaattagatgagaaaaggaggaacattcttcattttttctcctgctttaagcactaaaccaagagttctataaatgcaataagcaaaaaagtgaaaaatgtactcagaagactatactggatcagttagtgtagaatactgttatattaatttttcattgtattagggttctctagagggatggaactaatggaatatatatgtatgtatatatattccaacccaaagtgtcttggtggcaatcttaatatatatatattggcaatctttatatatatataaaggagagtttgttaagtattaattcacatgatcacaaggtcccacaataggctgtctgcaggctgaggagcaaggagagccagtctgagttccaaaaccgaagaacttggggttcgatatttgagggcaggaaacatccagcacgggaaaaagatgtaggctgggaggctaggccagtctcgctttttcatgtttttctgcctgctttatatttgctgacagatgatcaaatggtgtccatccagattaagggtggatctgccttccccagcccactgactcaaatgttaatctcctttggcaacaccttcacagacacacccaagatcaatattttgtatccttcaattcaatcaagttgacacactcagttttaaccaccacaaatctaccccttgtcaacttgaacccgtacacatctcctgagatcacacataatcttcaaataaagacaataattaggtcataattacacctgatgtagtacaactattcttcatacatccggaaacacactagtccccaactgaaacactcttacataaagttaacgatacttaaatgctgatgtgaagtcaataaatcttatgtcacatgataaaggagaaaggaaataaaatgaagatattttcttagtacaagtgtgtgcaagcacagacatgtttttaataaaagaaggaggaaatactgaggacaattacagtcctcatttctgcagctggtcacatggtagtagctggtattgatgactaccttcttctacccattttgtattccttttgccttcagcaaacacctcagcaggttgtgtttttttttttcctgatggagaggcccaaaccatttgtagtcccgcctggattgggctgttgtagttgcccattgaccttaatcacagggcatggtaatactaagagacgccctaatggatctcctgtattccatgaatactctttcttacctccgttctggagtagtagactgatttcatcttgatagcctgggtcttgatagccttgatgtcccagccaacactgtaacgcctttcttagcctgtttacttaaaggtaggaacccaaagtgtcctggtggcaatcttaactaccagtttaatggaattgttgttgtgtcttctgatggcagcgttcctccctctggaactaagacctctaggccagcagaacttaatgttgcgggaacaggaagcaaacattttgctagtggatcactaggggtgatggtgagtggtaccacttccatttccaccccttgattcctggacctgtgaatcctggctatgggagaaacagtaccacatattggacgctgattcagagcatacacagccttcttgagaactttgccccaaccctgcaaagtattctcacctagttggcattgtaattgtgactgcaaaaggccattccaccgttctgcttcaggatgttggggaacatggtaagaccagtgaattccatgagcatgagcccactgctgcacttctttagccataaagtgaatgccttggtcagaggcaatgctgtgtggaataccatgacagtggataaggcattccatgagtccgcggatggtagtcttggcagaaccattgcatgcaggataggcaaacccatatccagagtaagtgtttattccagtaaggacaaacatctgcccttttcacaatggaagaagtccaacataatcaacctgccaccaagtagctggctgatcaccctgaggaatagtgccatatcaaaggcgcagtgttggtttctgctgctggcaaattgggcactctgcggtggcagtagccaggtcagctttccaccggcccatcttgttttctgcactgggaaggtggggcatgagcacaaatgttaggacctgaaaggtggtgaactctgcctgggcagggcaaagccagaggaaactctggtggaggtccgtagcagtcctgatgtgcaaatcggtcatccaacctgggtgtaggggcgaaagactaattgaaccatctagtagctggttccctccaaagtttccctcgggatagctggcactctcgcaaaaaccccactcttggtaccaatttactgtattagtccattttcacgctgctgataaagatatccccgagaccgggaagaaaagaggtttaattggacttacagttccatatggctggggaggcctcagaattatggtgggaggcaaaaggcacttctttcatggtggtggcaagagaaaattaggaagaagcaaaagcagaacccctgagaaacccatcagatctcatgagacttattcactctcatgagaatagcacaggaaagactggcccccatgatacagttaccccactgggtccctcccacaacacatgggaattctgggagatacaattcaagttgagatttgggtggggacactaccaaaccatatcattcatcaaaaggtgttggtggggtagagggtagttaggatgatccatgatctccatcatgatgatgatggtattgatgatgtaagtcactgaaaatatttggtgttataagaataatttcttcctgattgtcagttttgagttgttttgctattaggaggcaaagtaggggggcatatacccacttaaaatattttaattctggctagtggaaatgacagtaatgccttcttcataattaaaatgtcactctgaaatggtcccaaattaaaacttcttcctttgttgttaagaaggatctcttcttggtgtgttctgcaagattctgatcaccttttttttttttttttttttttttttttttgagatggagtattgctttgtcatccaggctggagtgcagggtgcaatctcggttcactgcaagctccacctcccgggttcacgccattcttctgcctcagcctcctgagtagctgggactacaggcacctaccgccatgcccggctaatttttgtatttttagtagagatgggctttcaccttgttagccagaatggtctggatcgcctgacctcatgatccacccgcctcggcctcccaaagtgctgggattacaggtgtgagccaccacacccggccgattctgatcatcttttatacatatgctatttttgtctatcactttaggaatcatcacagatcaaggtcatccttttggtttttgtgatagcgctatacctcagtcagcttactagctcatctccactcagagatgaagaagcataggcagcaagttagtgcctatacataatatatatggaaaccaaattcagggttgattctttctttctttctcccttcctttctttctttctttctctttctttctttctttctttctttctttctttctttctttctttctctctctttctctcttcctctctctttccctctctctttctgtctttcttctcactctgttgcttagtacagtggcgcagtctcggctcactgcaacctccacctcttgggttcgagtgattcttgtgcctcagcctcccaggtagctgggattacaggcatgcgctatgaagcccggctaatttttgtatttttagaaaagatggcgtttcaccgtgttggccaggctggtctcaaactcctaaccacaagtgatctgcccacctcagcctcccaaagtgctgggattacaggcatcagccaccacttccggcccggggatctttctgtttcagttgtgggcatcactctgaaaatcacacttgctagaagtgagcatttatatctcttctccactgtaaataagtgcctcttagtgacatgagtggaaagacaagaagaattgcagttccttcattttctgtcttagctccctgagatgtatatgctgtgcctaaatttgtgttatagttttctcctttgatttgacattccttgataggcagagagcacttttctgtgctcatatgtcacatctcgcatctttttcccttatagaaaaactcttgtgtctcccatttacctttctatgaggtcagagatttagatactttcctagacaatcaactggagtattaacaaattcaaggagttctcgccatcccattactgggtatatacccaaagaattataaatcgtgctgctataaagacacatgcacacgtatgtttattgcggcactattcacaatagcaaagacttggaaccaacccaaatgtccatcaatgatagactggattaagaaaatgtggcacatatacaccatggaatactattcagccataaaaaaggatgagttcatgtcctttgtagggacatggatgaagctggaaaccatcattctcagcaaactattgcaaggacaaaaaactaaacaccgcatgttctcactcataggtgggaattgaacaatgagaacacttggacacaggaaggggaacatcacaaaccggggcctgtcgtggggtggtgggacgggggagggatagcattaggagatgtacctaatgtaaatgacgagttaatgggtgcagcacaccaacatggcacatatatacatatgtaacaaacctgcatgttgtgcacgtgtaccctagaacttaaagtataataataataataataaaaattcaaggagttcttatctctgtagtttaaataataagcaacttagactaatgacaacaaaaagccagccatgtgaataccaaatttactagttctgtgaggatatttttttctctttctctttctgcctcaaagaatctgctttgcttcccctggcatcatgatttagttttcaacccgtcagagtcttcctgctagtgctggtactttcctacttgagaaagtccacggaataccttcgagacctctgtcctcctgatggcttctatttcatttgttatatagggacccagaggtccttcatcattttcaaacacatcaacagatatttatagcaaggccacaattaataaaatgtttcccagaatatatgtgtgtgttacatttagaggaaacagaagtagtattgacttgtttctatcaccagaggtctatttagtaactatattttgtggaaaatatcgatatattttatccattcaacagacatgatttgagagcataccacggagacccaaccctgccagtgtggcaggtggtataatagaagaaaatagcaaacttggtgtatctgtgtttgcgcacatgtatgtatgtgaggggcactaaggatgactttacagaggttggaacttttgagtagagttgccaagatagggagagttcactaggaaaacagaagggaagttgatttttttttttttttgaaatggagtcttgctgtgtcgcccaggctggagtgcagtggtacaatctcggctcactgcaacctccgcctcctgggttcaagtgattcttctgcctcagccttccaagtagctgggattacaggtgcgcgccaccatgcccagctaatttttgtatttttagtagagacagggtttcaccatattggccgggctggtcttgaactccttacctcatgatctgcctgcctcggccttccaaagtgctggaattacaggtgtgagccactgctcctggcccggaagttgatattcaaacaggagcagcatatgcaaagacagtgagctctgagagagtagatggatccagactcctattgctgatagcgtcctgcaggattgggcttcaatgtgactaacctacaattgcctccaggtgctccacccactgagtccttgtgtctctgctgaggtccttggagagttactggagagggctctgtgtcagatgaccttgaggaggctctgatttagccttttgtaaaatgcaaagagttgaggtcttctccacgcaagagctcgctgatgtcaatgaggtattgaggatggggccatctcctatttctgtggccagtactgagttttgttatccttcctttaggtaaggagtgccaatggaccgatgcctgcctgtctcatccctgtgcaaatggaagtacctgtaccactgtggccaaccagttctcctgcaaatgcctcacaggcttcacagggcagaagtgtgagactgatgtcaatgagtgtgacattccaggacactgccagcatggtggcacctgcctcaacctgcctggttcctaccagtgccagtgccttcagggcttcacaggccagtactgtgacagcctgtatgtgccctgtgcaccctcgccttgtgtcaatggaggcacctgtcggcagactggtgacttcacttttgagtgcaactgccttccaggtaaggagctccctagtgtcccaggattaggggacaaacccctagcacaggaggtagtgggtgtggctcaattgctttttttaggaagcgcaaggaaaaagggaagtgagaattttgtgtggggtgggttgctagtgagggaggagttttatgggcccactgtggtccataaactgagcaggggataatttagcatgtcagggtttatgatgatgagtggctagaaaattgtttattgtcccttttgtagaaacagtgagaagaggaacagagctctgggaaagagacagggaagtctggaatggaaaagaacacgatgagaattagacactggaaaatatgtatgtgtggttaataaagtgctttaaactgaattgacattaacagtgggtgatcaactttactatgtgcttgtgcttttgcttttgatggagtaattcattgttttcttatccacctaaatgcacccagctgcccttgattttctctgggctactggccttcacaaccctctcccatgtaccctctctgactttggggtaaccctcccctaacttaaagctagagaattctgaaactgaggaggggatcctctgttaatcagtgagcactttttgatgagctgatagatgatatatgagagactatgcgtggcacaatactttgttacactcttcactgatacaagtgttctagagtgtacacacaacccaaagatagaaataaaaagaggagcagtgtcggggagcttggggcctggtgttccatggagagggagaaaggaacaagcttgaccaattcattcaactccttataaaaatgatgaggaggctgaaaaccaagaattttgattgggaacagaatacaagcagctgaatcagatgaattactaagcaacaaagatcctgtttttatacaaatatccttagtacaaaaacaaaagaaggaaaactgtaggggggagtaatgtgctaagtaagcagaattgcctcaaaaagaagttgttctagttactctttcagagtgggaatcttagattctggtattgtggatatggttcacatataatgggattgtgtgttttattttggagggattaaaggtcatagtttggtcctcagtataaaatcaactggtaatttattcatttcatttggtaaaaatgtattgactgcctgctatgttctaggcaccatgctatgtatttggaatacagctatacaaagcattgtcacataattgaaatgaaaattttatattatttaagtcacaagaacaagctatttaattatattacttttagtttctcttttaataaagaatagataatgctatcattctagatactaaataagtattttcttaacataatattactatccactttatcttgtagaagaaataactaaaatacatctgtcttcactcctgtatttgtttgcattttaaggattaaagacagaaatagaaatgtaaacaactttattttgaaaatatttcaacactgcaaatatctctgggtctgatattctagtaatctaattggctagtaattgatgttagtgtgatttattgttgaaggctaaatgtgtttttcagtttcaagaaaattgcttttaataattgcctagaacaagaggttgatttggcagcaagatgttgacgggaagttagagaagtcaataaaggaagtttttagctgagagagagtgattattcactcccatagcctctgcattgttatccattagccacgataagaaccttagggaattctgagagtgtgtccaggaaaggatctgtcaaactagaatagtatctcctccttgagaaaggaaataaccaaggattccgcagctgagaggctgccagggctagtgaaatagagtaaggaaatcttggctgtctcttattctctggttgtagtttaacgcaagacacttatttactcactgatggtgtgtgtgtgtgtgggaggggagattagcatgaggggtgggaatggggagattcgatgaagagaaaactaacatttttttggtgactcaggaactgtgccaggtacttccatgcttattagctcaattacacaaaaatcttgggaccaggtattatttttcaagtcttcccacatgaagtaactgaagtttggagatgttaagtgattcacccaaagttgtacagctaatatgtggttaggctgggtcctgaaaccgaggcagtttattttcaaagcctttgctttgtgcatcttactgcgccacattgcactgcacatctgcttcctgaaagcactttgtaggtgtgtaaaacttttcgttaaatgctttaagctgtttgggttaaaaatatatgttcatgttataagaaaaccaagacactcctaattataatcaaatagtacttgttacatatcaatatgtgtgtgtgtgtgtgtgtgtgtgtgtgtgtgtgtgtgtgtgtgtgtatggcgttgtgcagatgtttaaaagtagttacatagactagttcttgcttttcagggtcccataatctaaaccagatgacttcagctttggataaatatatagaaggaaatttaaagagaattcaaaacaatagatgatgcagtgacactgtgaataaatgttatttatacagtttgtaagatttcatgctcattgttcatatgtcccaggtggagttcagaaaatattctcttcatttccacaaaggggaatagtgcctggagatggttttcttttaaaaagtccttttcataatgcagtgcccttccttccattgcccttcattccattgcttcccatgcttgtcaagagactaaaatgttacttatagtaatagtcactatctcaatgtaaatagcacccttatttgatgagaattattatttcagttctaaaaatggggaaacaaagtcagcaggaggcaaagtagcttgttaaagtattctgcaactttcaaatggttgcttccactgcatttcacgtcttggcacttctaattgagggttactctaaccaccctatttaaaattgtaactgtcccccacccccttaattactaaccctggtctactttttgttttctttttctgtaactcttatcttcttactatataatttatactatataatttacttcattatgtctattgttcattgtctgtcttttccaaattctactgcctcttaccctctccagaatgaaaactagtatctttgtttttgtttactgatgtaacccaaacacctacaaacagtgcccagtatatactaggcccacaaatatatattggctgactgactgtatggtttagtatcatgtcatagtattgagactgtaactttggtcttctcattttcttctttgtattgtgcgtcctagacttagtttggcctctccttttgtccttgtatactctaatactggataagaattttggagtctttttcaactctgagtcagtgaatgccacataacttagtgactatatttaaatggttaatttacaattttttccctgcaaaggatactgtagtcactgtgagtattttagtattattgtaggactcaagagggaattaaaactacaaaaatgactcctcttgtatgacacagaaagaaatgtttcttcacagagggaggagaaaaatatcttcaagagagaactaatagaatcaaatcaatgaaccatgtctcatctttttggataagtaactgttagtaatccagacacttcatgagctttcattatgtaaagtctttagcagaagctaaaggaggggcaccaaccacagtaattttaacttaagaacaaaatggagcatgaaaataaattattaaatcatttactcccactatttttgggttagggccaataatggggagagaaagaggtagactagttttgtgtttgtggctattttaatagagtagcacaagtaatcaaaaaacagtaggctgttttgaatttactggctgtcccttatgagttcacagttagattggactgtcctcaatgtactttcttttttttctttctttcccacatctctttatttctctgattttgtttaaacttcataaagagctctctgatctttcctttccaaacaatgaaggtttatcctttgtaaactacctctgtactccacaggctgatgatatgtgatatccctatatcattaaagtaaagcctaagcacattctatggcttttgtgtctactctgttgttgctgagcttatgaactattagaaataactccctcttgcattttcacacatggggaatgtgatgttctcttgggtattatgctaatcatattttggcaggtttctctggagcagatgcagaaatgatcataccactttccagggtgtattattttagctcctttgacttgggccctaagtctgttttacctgatgttcctgaaagatgttcctgatgtccttcactgttctttcatgctggatgttcttgcctatgctgcctcctcagctatcaccctctcttcccctttttaatgtagaactcattcttaatgatttgtcaaaggcaccctatttcactgaaatgccttctatattccctaccctccaagtggattgtagaccttctaaggtcttttgacatctgcatatctctagcacagcacttatcacggtgattatttatctgttcatctttccaagtagacactctcattttaactccctaccctagtcgccagcatccccagcatagtgcctgtcataaaatggtgccacaatgaaaatttgaaaaatgaatgaacgtgataaacatagatgagaatcctatattctacaattttttaaatgtactgaaattattctttttgaatcctcctatttatttctgtgacttctttgatgacaaagttagaaaaaagtggaggtcagtagggagatatgaagggacgcaggtggaagcagtgagcctgggcgggtgatggagtgggagatacgtggcacaggggtcagtgagttaatctgggctcattcagagaatggaaggtgtgtgccaagaaaactggttggatagggataggtcagggattccctcttgcattctcacacttgggggcatgtgtcattttcttttcttttcttttttttttttttttttttgagacggagcatcgctctttctcccaggctggagtgcaatggtgctatctcggctcactgcaacctccacctcccgggttcaagctattctcatgtctcagccttccaagtagctgggactacaggtgcctgccaccatgctcagctaatttttgtatttttagtagagatggggtttcaccatgttggtcacgttggcctcgaactcctgatctcaggtgatccacctgcctcggcttctcaaagtgctgggattccaggcatgagccaccatgcctggccgcatgtgtcattttcttgggtgttatactgatcgtatatttgcaggtttgcttttgtgacagacttcttctgggggaaaaaaagtatccttctatctttttacttttgtccagttccaggtatccctgtttttttcttcactcttccttccttgttcatgggagtttttcttgaggacttcaagcccagcttcggagaatcctggttgtgtcatctcatctcctttctgctctcttctctacctagcctttccaccctcacacctcccggggtctgaaaatggaaagataagggtgtttccctgaaagttgctcttctgtgtggggatgacaggttctaaagactcttttctggtccctgccctcattgccatgattaatcagttaagtggcccgaggttttataacagcacagtcttaaaatgcttctcccaagtttaatttctctccatttgaccttttaaggatgtgaattggctttaagcagtagactccctttagtacggtgctgtgagcctctcagtgaatctgctacatccattccacccacgggtctggaaacttgtctgtttacctttccctaaaaacctaagatatatttttaagaagtgccttgtaacttttcatatagcctttcccctactttgggtagactgtttcttacaggaatttggtagatctttccaaagagaattctgtatctgtatttttaaagcataaatcctgtcaactttggaggagaactgatttggcttgagttttctcagacatgggaacttttgacctaagtttgtattttacattgttgaaagggaactccgggatcccagaaaacatatggactgcaattgggtaaagtttctgttccagaaatgcctcttctggacatttcatacaaatggaaacatgcagcatgtagtaatttatgacagcttctttcacttagcatgaggttttcaaagttcattgatgtggtagcatttgtcagtactctgtgcctttttatggctgaataatattttatcatatggatttaccacattttatcattttatttatccatcatcagttgattgacatttgagttgcttctactttttgagtattatcaataattctgttatgaacattcttgtataattttttggtagacatttatcttcatatttcttggatatatacctaggagcagaattgctgcgtcagatggtaatgctgtttaaccttttcaggaactgtcagactgttctgaagtgggtacattattttacattccaaccagcagtgtatgagaattccagtttctccacatcctcatcaacagttgttattgtctgtcttttttattatattcatctgtaatgtgaagtgtttatctcattgtggttttgatttacatttccctgatggttgatgattttcaacatcttttcatatacttattagtcattatgtatcttctttggagaatgtctgttcagatcctttacctactttataattggtttatctttttaatattgaactgtaatagtttttaaaaaatatatcctaaatacaagtctcttatcagataatatgatttgcagatattttctgtcattctatgtactgtcttttcacattcttgatgatatacttttcagcccaaatgtttttaacttgatggaatacaatttattttttcttttgttgcttgtgctttcagtcatatttgtgaaaactttgcttatcccacattacaaagatttactatttctaagtgatttataattttaccacctacctttaggtctctgatccattttgagttaatttttatgtgcgaggagggagtctaacttgattcttttacatgtggatatttagttgtcccaggaccatttgttgaattaagtgcccagaacaagtacatctatatatagagaaagtagattagtggttgtcagagactgtaagaagtggggaattggagagtgactgcccataggtacaggcatgctttttggcattatgaaaatattctggaattaggtagtggtgatggttgcagaacttttggaatatggtaaaagacactgaaatatatgcttaaaaatggtgatttttgtgatatatgaattatactatagaactaataataacagtaataaagcaaggtgtctttccacatctccatgccttgtattttcattaaaaaaaaaaaaaaaaaagcatttcagggccaggctcagtggtttactcttgtaatcccagcacttttggaggcctaggtgggaggatcacttgaggccagaagttcaaaaccagcctgagcaacatagcaagaccttgtctccatgaaaaataaaaaattagccagaaatggtgatgtgtgcctagagttccaactacttggaaagctgaggcaagaggatcgcttgagcctaggagttcaaggttgcagtgatctataatcaccactgcactccagcctgggtgacagaacaagaccctgtctcaaaaaaaaaaaaaaaaaaaaaaaaaaggcatctcactttaatagtaagaggccagaatatgatgctggcagcatgttgtgaggaaatgtattagatgaaagaagttaaattccagttctccttttttcagaaatgaggtataggggagagaaacacgtactttgaaagaattgacccagctgaattggaaaatgtgggaaggggatggggaagaggctgctccacctgagatctggctccaggacttacagcaaggggaacttgggcaagttacagactgtctatgcctcagtttctttatcagcaaaacagaatcatcccataaactataaggtcgatggtatcagcgggtccccaaactgactgcacatctgagtcatgttaacaaacacattccaggccccacctgagccctctgaatcagaatccctgtaaggaggatgatgaacttgaatttgcactgactttcccagctgtttcttactctgatcaacttgggggtaggacccattgagctgcatcacatcattccaaagccaaaacacaacagcaggacaagaatattttcaaggcagtctctaaagcagaggagaaactgttgagggaacttagaagtaaaggagatctggcttgctgggctccatttgaactttgagtacaacagagacatgagcccttcgggacacatgcctgaggtagtgacaatccaactttggaagagtggaagccctagtttcaaattcaagcatgctttgagtataaattaagtttacctctttttgcacagcaacatggccaatctttcctaagctgctcagcttacaagaaaaggaatcatactgctaagaattcaaacttcagcagtcataggtaagtaaggaagtcttataaacctattctagccacctaaccagaaactcgaaatttagcaggttctttcagtttcaggacagttgtgttcactagatcagaggcattgagacatgaagaacagacccttaaaaagggaaagtgttcccttcagtttgaggacatcactggaacattagggaagtgggaacacagctgctcactctacagtgtgggttgcctttgtgtctggaatgtgtctgacgtcctgatccctgtgcacatttcagggagccttgggaggaccccgaatcactgatggaattgcgcagtgcatggagatggctcagcaggatgagggtaaatgcaggggcaagtccaggccatactgagagacaatgagtggcgctgatgaggacaaagataaaatcaaaagtttgtgcttcatcttcaaaaactcaagctgataacaaacttggcctgatgagaaataataagtatttttctatttacatgagaatttaatctcaaaacagaaatcagaaaaatatgaagtccagggcataaaacctaaaactattgctcatatttattctttctaaatagagcaaagtgtaaaatcttctccataagacatacattgtggttataaaaaggcaaaagtcttagtgagaatcattggtattccatagaagagtgaattaaacacagccaagggaagacccacgtctcatacttctcttgtatattccaaagttccagggaaattccaggtgatagaggttatttcccatactgttaaagcaaggtttcagacacttctgaattttggtcccagtactctagaagggcacacctctgtcctggaaaataatacaggaatgaatactcttcccgtgacccattctggtcattcttccagcatcacaaaaaccaaaaaatggaaatatggccaaatacgtgattagctgtccctcatcttcaggtttcttatctgttacttatagataatagcattaccttaaggattatgatgaagatacaatgtccaaatataaacacagttttgagcaaaatgccttgtacgaattggtcaatgaataattactaaatatgtgaatatttctggattgtatggatcctatgaataattactgaataattattgtgattgcttttattggcagtgctgaaaactcatccctttgtgacctcaagtaacccatgacactttgtgaacctgcagttttttcatttagaaacttgacagattttcattctgacacagaatgtcaggtctcccagaccctagaaaatacattgacttaaagcctttgatacatctcaaagcagtatccttacagtgtcactggaagatggtgcgggctgcagagagggatgctttcaaatgggattaacca

SEQ ID NO: 2425 - DNA, 15629 bp, Homo sapiens
tcctgagtagctgggattacaggcatgcaccaccacgcccggctaattttgtatttttagtagagacggggtttctccatgttggtcaggctggtctcaaactcctgacttcaggtgatccacccacattgacctcccaaagtattggtattacaggcatgagccaccgcgcccagccaattcttccattcttcataaataaaaagttgattctggcaaaccaacctcatttatttttgaagttagcccaacattgatccctcgtcagatagttgagcctcttccatacaacctcccaatatggtacatcaccaaactagcctctggggccacaagtaatacattcagtccaaatacagtccaaaaaaaaaaaaaatcacaaagttttcttacttgcatctaaccaagtttgccaagtaaaatgagaagaaagagtatctcagccattagggagctttgttccccagtatttgtcattcagttgtaccaacaaattgcgtaagtgtagccacaacccccatcatcctttttcctgttgtggttgagacagggtctcactgtcaaccaggctggagtgcagtggtgcaatcacagctcactgtaatctcgaattcctgggttcaaaggattcttccgtctcagcctcccaagttgctaggactacaggtgcacactaccacgccaagctaattttttttatttattgtagaaacagggtctcgctgttgcccaggctgatctcaaactcctggcctcaagtgatcctcctgccttggcctcccccttcatcgttttgatttatcctttcttctttgcccatgctggcagactctgaattggcatgttctagttatcgtggttgtttaacaatgaccccaaaatttagtggtgtaaaacaaccatttatcatgtcatggagtctgtagatcaggaatcagacacagcagagctgacttgtccctgttccacaatgtctgggacctcagctgaaaatattaaacaggctggggctgtaaaggcatcacatctctctatctctccacagtctgcacacatgctctaacagagtggcttcaatgtaactggacttgttacatgttagctcagggtagcctatacttgtgttccaagatgaaagatgcagatggaaggtatagtggttgtcttttatgacttaagcttcaggagtcaagcagcgtcacttctgcttcaatctgctagtcaaagcagtttataaaggtctgcccaggttcaaaggaagggaatacaaactccagtttgataaaagaatgccagcttcacaatttaataaaaacaaacagccgggcgtggtggctcacgcctgtaatcccagcactttgggaagccgaggtgggtggatcaccaggtcaggagttcgagaccagcctggccaatacagtcaaaccgtctctactaaaaatacaaaaattagccgggtgtggtggcatgcacctgtaaacccagctactcagaaggctgaggcagaagaatcgcttgaacccaggaggcgaaggttgcagtaagccgagattgcaccactgcactccagcttgggagacagagcaagactccatctcaaaaaaaaaaaagaaaaaaaaagaaagaaaagcaacacaggacagaacatttattggtgcagccatcaatggaaaaaatacaatctgccacaactcttttatctgggacagcacctactctgcaagtctttacagagggatccccatttcatcaatacagtaaaagaggctagtcaaggctgaaagtttccattctagtaatgaaacatgaaaaattcaggttgagtgagcctctgcaacacatcagactcccactcctcactcttctccaactggttcctgccccataccccacaaacctggtttcaccactcatctctccagaaagagaggaactctttttattgcttgacttctacattcacatcgtttgtatttgaaaggaaacacatgcacaccctttacttgactttattgccatttccaaattcaaccacactgtgacatattttgtaattactcttgtgaaaatgaaacatcatttttactcagttacctacaattatatacaatttttgaccctaacttactgctgcttccacaactccaccaatgacactgcaggtcaaagtcacgagtgaatttaacttgtcctcatttttggtgcacttgacactatggcccattatatctatttgcttgaaactctcactttctctgtctctgtgacattgtgctgttctagttttctaccagttttctccttcctcttcctccactggatcccaatgtttctcagtactctttgtggcctctatgtgctcatcagcattcacaagttcaaagcacccctcttaagctgatgactcccccactatacttccaaccctaaccactcagccaggcttaattcctatatttttagctgcctataggatcattccatttgcctaaaaccaaattaatcatatcctccctacaaaacataatgtattcaaaacaaacaaaatagaaaaatctgcttccctttctagcttcctcattttagccaatagtgccaccattttccaagtttcaacacttgtctagacaagagtcatttttgactcctcctcctccttaccttgcacaacctctacttaaatccaatcactgaattttcagatctggaaagaactttcaagataatctagtttgtgctccttaaacataaataagagaccttggggctcagacatattggctgcttgcctcaagttcttccaaccctgattataagacactttctattaccaagacttatttaattgcatttttccaaaacttccacacaaatctttttttttttttttgagagggagttttgcactgtcaccagggctggagtgcagtggcgtgatctcagctcactgcaaaagagggttcaagcaattctcctgcctcagcctcccaagtagctgggactacaggtgcccaccaccacacccagctaattttttgtatctttggtagagatggggtttcaccatgttggccaggctggtctcgaattcctgacctcatgattcgcctgccttggcctcccaaagtgctgggattacaggcatgagccatcgcacctggcccacaaatctgttttctttgtagaatcagaagatctgggtttgaacccttaaaagctgactataagcaagtgaatagtaactgctagtttaaaaactgcctcctgatttagaatttatgatagaaatcagattaaatttaaactcctcaggcaggtattcaaaccctctcccactcctcctcctaacccaaactggctgactttagtatcaagcatggtttctcactgaacaaattctgtttcagttggcaggtcttcttcccatctttatctttctcattcctggttcttgacttccactcagttgtttccccagcctagaagagccttacacctcagcagacacttcctttaaggcccagattgaccagcattcccagcatgggtctttctttttttttcaatctccacagcatctcaactctactgcaaaatcttacacaatatatctttcacttatctgcatagtgttctccaaactaaggagctaaataatattaaacactcaaatttataataaaggcttgcaaatttgttcttacaacgaaacactggattctgctttttagaaagtattaaatttgatttacattcaattttactaggccaaaattaacaaacaagggttatttttttcacagtgactataccaatacagtttttcaacagtgaatagaatgcgtgatgccctcgaggagctcataatctagtgttaataaagctagatatgcagacagagaaggttaaagaacacaacataacatataccatcttactcatcagcttacttatgtcattatttcaacatcaatccacagccaaaaacctggaaataaaactgttatcatgctgggtgcggtggctcatgcctgtaatccaagcactttgggaggccgaggcgggcagatcacctgaggtcaggagttcaagaccagcctggtaaacacagtgaaaccctgtctctactaaaaatacaaaaactatccgggcgtgatggcgggctactcgggaggcagaggcagggagaagtgcttgaacccgggaggcggaggttgcagtgagccaagacgcgccactgcactccagcctgggtgacagaatgagactctgtctcaaaaacaaacaaacaaacaaaaaaaccatcctcggctgggcgcagtggctcatgcctgtaatcccagcactttgggaggccgaggtgggaggatcacgaggtcaggagatcgagaccatcctggctaacacagtgaaaccccgtatctactgaaaatacaaaaaaaaaaaaattagctgggcgtggtggcgggcacctgtagtcccagctactcaggaggctgaggcaggagaatggcgtgaacccgggaggcggagcttgcagtgagccgagatcgcgccactgcactccagcctgggcaacagagtgagactccgtctcaaaaaaacaaacaaacaaacaaacaaaaaactatcctcatcagacacacaaaacctccacagcaataaaatagcaaagagccatggtatttgtaccttttatccacaggagtggctcacttatactctgtctccacatgctcagttacatggttttcttcagggtttgtctgattagaaggtgcaaattctaaaaggaggctaattctaaaaacttgccaacaagggaggaaaaaaactacagaactaaacaatcaaaatgggttcactcaacaaacactgagtacatccttactgaatacaaagatgaagactacaagatttaaatatgatattttcacccggagattagtaaagatttttttaatgaaaatcccagtactggaatcaagggaattgggtccctcaaacactttgaggggcaagggggaatattctggaggacaacgtggtagtatgcatcaaacgctttgctgtgcctgccctctgaattagcaattatgctccaggaatacaggctatgaaaatcagaagcagcaatacagacctatgacaagtaggcttatcaccacattaattgtagtgtgatcataaatataatgtatcttccaggatgaacatttatatgacaaaatacaatgcagtcattaaaagctgccacccagaagtctgaaggatataaagaaatacagatgaaaacgtcataaaacaggccaggcgcggtggctcatgcctataatcccaacactttgggaagccaaggtgtgtggatcacctgaggtcaaagttcaagaccagcctggctaacagggtgaaatgccatctctactaaaaatacaaaattagccaggcatagtggcgcacattggtagtcccagctacttgggagggtgtggcaggagaatcgcttgaacccaagaggtagaggttgcagtgagctgagatcacgccatcgccattgcactccagcctgggcgacagagtaagactctgtcccaaaaaaaaaaaaaaaaaaaaaaaaaagaaaagaaaaagtgataaaaccatatataacgtataatcccaatttttaaaatgaccatattatatatataatatatatttgtaataaatatataaatcctggcccttctacgtacaagcttataaagttgaagttttttactaagtttcattttcctttttgtgaaatgatgacaataataatacctacttcataaggataaaagagcaatccctgttgtgggattctgttccgaacaggacattgacaatgtcaaaacctcccaaaaggagcttcaaacttccaagcactaaccactgcatgtataagttacaacagctttctaactggtctcctttttcatctttcctcacactgatgcatccaacactaccaccaaatcaatattcctaaaatcctaatttcatgtcatttccttgctttaaaaatctgtaatggcctcaagatgagattctccttaggccaacataacttgaccctattttacctgcactgggaagtattgacagtagtgtgaaatcaggttgttctaatttgaagcctgagtacaccacttattagctgtgtgaccctaggcaagtaagttaacccctctaacacttcctcagcttctcatctctaaaatgtggctagtattcatcatatgggtgtttttacagagtgaaaattcatataaagtgcttacttagcactttacatgtatgcctggcactggagatgcatcctttaaatgtgagctgttactacttccctaaactgtctactccacctgggctgctcttccagatcatttctaacacacattgcccaacttaggcctttggctggtggtgttctcacccatgaggcaccattccatcacaatcaccaccatcaacaaagagtatgtgttcaacatttacactatatattcaaggtgtaggctggaaatacagaggaaaaaaaaaaaaaaaacagtcccaaacctcagagctcatagtctaataatgaaagagagacagaggaagaggtccaataattaggggtgacaaaggaagcacttcctggaggcaagggagatgcttacactgactccagaaagctgcgtgggtgaatcaggcagtgtgggtgcatgtagagtaagagcatccagtacagcaatcacagtcactgtattgagtctggcactgctggagtactaaggctaagggagagcagaggctagatcagtgaggtcaggaagtgttggcactttattctgcaggccagcagcagccactgaataatattaagtagggtacacctgtctaggactctagaaaagcttacactgtgctgtccaacacggaagccacatacaactactgactggaaatgtggctagtgtgacagaaattaaattttaattaatgtaaacttggtaactgatagcaattcagttatcaaaaaccttttatgtatgtttggaacaattaaagagtatgtaggccgggcgcggtggctcacgcctgtaatcacagcactttgggaggccgagacaggtggatcacaaggtcaggagatcgagaccatcctggctaacatggtgaaaccccgtctctactaaaaaatacaaaaaattagccgggcgtggtggcgggtgccctgcccatagtcctaaaaatacaaaaattagccaggtgaggtggtacacacctatagtcccagctactcaggaggctgaggtgcaagaatcgcttgaacctgggaggcagaggttgcagtgagccgtgattgcaccactgcactccagtctgggcaacagaacaagactctgtctcaaaaaaaaaaaatgtatttaatgaactttaaatacagatcaattatttctgatgaaaatttaatgtccaaatttaaatgtgcagtaagtgtaaaatatgtatcagatttagaagacttagtacaaaagtaaaatatctcatcaataatctttaatcacatgttgaatattttgaatgtattagagattacattagaattaatttcacctgttcctttatattttactgcggctactagaaaatgtaaaatgacatacatggctggcattatacttctattggacagcaatgatccaatagatcccaggacagctgaaagaggaaatgagaccagaagcaggaagaacaattaaaaagactctgataagcatccaggtaagagagacaggcctgattatctaaattctgcccatcttcaaaacctaattcaagatacactactgcctccaaaagctctcctaatcctaacaattcccaaggagttacctttctctgaactcctgaggcacttatctgtagcattcacttcaacactcattcatttgccacctgtcatttctatttaattttggggtaatttgtttctcagattagaccagaagctcctaggctaagggccataatttaggcacctttaatttttgcatgctgtgtaatgcatttttgatacttttaataaacacaggtacatgactccccaaaaatctggatacaccttcatgggtgactttacctttccacagcagaaggaactgagaatctcttttccttcaagaaccttaaagataggagctaaaatgatgtaaaaatcaatcaaaactccctccaagccaatgttccgataaagtagtgatatttaatcagtgagcaagcattagtagactgtataggataccatcaagaaaaaaaaatgccaagacagaagaatttaggcttttgacaaattccataaaaagtcaaacaaaaaatttctgatcatctctgatctctaccgccagagataacctttgccaacctaagcattaagaactttcaatcaaggaaaaaacatctattttaaaaattaacccctaaatcaatccttctaataaatatcacattttctaggtagggatacacatattaccagtaaatttacaactcagcattttcccatctaaattagagtaaggtgaagaaaaaaaactttccagggaaatattaagaagtagtataaatgtattttactgcataatcgataaagtatttcacctaaaataccatttaaattttctacaacacttgactatacaacggccagcttgcaccactacagaaataggaagctagcagcaactagtaaaaagcaagggacattctgtggtgatcagtactgacctgggaactttgcagttttcagatttttcatgtttgacatttaaaacagaaaactgacaagtttctaataagaaactaaaagttacatcagaattgatcttcttgcatgtgtttaatggctacgaagtggatattacaaagtgcagttgaagactctatctccaaagaaacaatcgagcaatcaaagatgagctaggatagcttgtaagggaacagaaggcagtcctttctattctgaaaggcagaagaaataggagaaacctgtcaaacaacctggatgaaatcaaggagttaacaagcaacactcatttcctttagcactgtgagaaaattccggttgctaatagaaagctgaggaaagtttggtttggcttgtttcattttgttttccttccaaatcatcactgagtatgaacgactgctttcctctcctcacattactcagtaaaaactcccccattgaattgtcttccggtgccctgctccccagcctcccagaacggcccccgcccccgcctccctcccagcaaacgtgctcagacgcctctgggcttgttgtggtctcgccagtctgcggacaagcgctccaaactcaatggacaatggagctcacccccgtcaacgcgaactacaaagctcaggagggccatttcccttttcctgcccagatgctgttttcgctccttcgaagcaagatcccatgctcgactagacggccagtgtgcgccaggacccgcgtgtctccttccccacctgcagagctgctgagcccctcggcccccaaataaattgtaccgcagcacacaggccaaaaagggccccccaccaccaggggcttggctggggacagtggcttcacggtccaggtagggatggagggaacgtctcttgacgcttggtcatggccctcaagactaagccgtctccactgttccccctccccagctccaacttgcctcccctccccccactgcgagaagacctaggaggtgcgggcaggcagcaccgccacctcttcctccggtggagcgctcggccgacactcaccctttcaccacaaagaaggggtcctccatggacatggcgtcccggccccggccgccttcacctcctccgcgcacagggcgcccgtgcctcccggtctccctccgcccaccccgcctgttcccgcagctgcccgcgccttagtctgggtgaagccgagcagcgggcacgcgcacaggccaggtgcacaggacggccgctggtccagcactcgctcagcaccactggccgaatcccggactcgggcgccggccccctcggcagcctccagtcccggctcctcccgaagcgtcggagggcctgaccccacccccgggaccctcggccgcggccaatcacgaacgccgcctgaaacacgacttccgcaccccgctcacgtgaccagggcatatatctctctctctctctctctctcctctctctcctctctctcctctctctcctctctctcctctctctcctctctctcctctctctctctctctctctctctctctctctctctctctccccccccccccagtgggcggggcttacgcctgcgtccctcggccctggaggcggagccctcggggcggtggaggtgggcgggcttctacagccctctcctcaagcttgagggtgaggagtggcttgttccctcagaactaggcagtcggcttttcaggataagctgtagttgtacctgatttgcaaaatcctcttacctttcctctacttttaatacttaattttgacagtatgtaatttataaatctatctggtcctcgacttaaaatgaagcatagtatctgattataatgttacacagatcctttaagtaggtcttgctttgtgttggacagtgtgctaaaggttgtgtatgcatcatctcagtatcctttgggggaaagtattattcccccctccccctttttggggggcagggtctctctctgtcaccctggctggagtgtagtggcacaatcacagctcactgcacccttgacctcctgggctcaagcgatcctccggcctcagcctcccgagtagctgggactacaggtgagcgccaccacgcccggctaatttttaaattttttatagagatggggctctcagtatatttcctaggctggccttgaacacctgagctcacatgatcctcctgcctctgcctcccaaagtggtgggattatgggcgtgagccaccacaccatccatttttctcattttgtagataagaaaataagttcagagaggcttgaagacttcctgtagtcacacagcctggacagggcagaactgcagattctgtgcactttccaccagatggggtgtactttctgttgctgtacattctgcaaataaccatgtaaagtaatttttcatacagcatatggtgcttcccaggagagcacaccttcgaggaataaagaaggggccaggtatgacaacttcctctcactgtggttcaagagctattcgagaaaacattttgcccagaaccattaaccaactcatatgctagatatgctatgaaatttgtggatggggattgtggactttgattgctgaaaatcattgagcacttactgtgtgtgtgtgtcaggcaggatgttaagtgttatctcagttgctcttacaatgtgataattactgctatcatgcccattttataaatgagaaatctgagactcggaggttaagtgacttgcccaaggtcaccagtctggagctggcacagtccttggagcaacacaaaccccgtttaaaccttggctctatcattcagttcctcatctataaaacataaataataatagctagttcatgggttgttgtgatggttaaataaaaatgtgtgtaaacctcaagatcccaaaggactaagttactgaagtcaggaaaaccagtaaggacgctgctaaagtcatgtggcctgaagggatgaggtccagaccaggatgacagcgattgagaacagagaaggagtgaatctgacagatgtttcaaaaggaaaacaagactaaacacctagacatgatgaggggctgaatgggtttcaggaggggagagaagagaggggtgaaagccaaaatccctggaggagcgaatgatggaaggcagatgtggggaaaggaagcagtgtccaatactagtgattgctaatgtttattgggagagaactgtttaatttacttagctggggaggtgaaaacgtgtcatcgttcattcattcaacaagcacatgtaaattgaggggtaggtgagcatggtgttgaagaccatccttggagtctgattgcttgagttctgctgcttcctgactgttgcatctcaggcaagccgcttcatctctcactatcctcaactgtgaaatagacaccgtaataacagcttccttatagagtgtcatgaggtgatgtgtgaaaagtgcttaaaacagtgcctgacacatgttgtgctcctactgtgtgctaagcactgagacacaggcatgaacaaggcttggttcttgccttcaaggaactgtcagactggtgggagagacagactggtgggagagacacacagtgagagaagggcacaggttgccatagaaacacagcgacaagataccagtatatttgtgtgttttcggggctggggcagggggttcctaagcagtgactagaagcagccaggagaagggggccatgttgctggagtagaaggaaaaggatgggggcagcaggagctaagcctggaggtggacagggtcagattatcagggcccttgtttgtaatgttcagaatagtggacgcttcctatggacagttccccatggggactgagggaattgacagggtcagattggcatttgagacagatgcttcagtggctaggaggttatggtccagaggagggatgagggtatcctgagctgggcttgtgacaactaaggtggagaagagtgatgcatttgagacatactttagaggcaaagttagtatacttggtgactgattggttcagggtatgggggaattgatgaaagaagagggaggaaggcttctggggttgtaaatgggtagtgttggttccaaccatcaagaaagagaacacaagaggaggatttgatttagggtgaatgtaaattagctgttagcatgtcatttatccccaccaaacagtaaactcctggagggacaggatactatgttaatgttattatcacctaagtgcctgacacggcctcttattatctgttccatgaatttcttaattggaccacatatgacaggccagagttttataagtagtaatagaagatagaggacagaggcttgggttcccataattaggggattagaaaaagcaccaacaatggagatagtggagtgtcaagatataaaatgtgtgtatgtgtgtgtgtgtgtgtaggtgttcctttctttaatgtgtcaccctcctttaccctctctcaaactagaccttggcctccactgcccacaaggaaagggaagctatggctaaaatgcaaggagaaacaaaggaggttctttctttctttcttttttttttttttcatttaataggacccacgtcctggcataaacaataggttgggaagaatactcagcaaaaacccatctcttcccacacccccacccctaccccacccccaacccaaaagaataatttaaatttctcagggaataaaaaatcaaaacagtggttgtcttgggggacagagtttgactgggaagggaaactttcttgggtactagaaatgctctgtatcttgacggagtgtgtgttacatgagagtatcatttgtcagaattcctcaaaccgaaactcttaattggacttaacttctgttcatttttctgggggaggttgacatgccaactctgagctttctgtagagttctgagtgggcagccaggagaacctctggttcctgagtgagtctccaaagttaggagagtgaatgaggaagggagcacactgggtcctgcaatgcatcttctgcagaaataaggagatggcaacacagagaataaggcacaggcagccaaatgagctgaggatcagaaaggagccaaccatatcactggggatgccaggatagacctgagagggattgcagtgggtagccaccccctgcccctggaagctgcgggaatgccatgacacccctacaaggggatctcccctactctgaaataatgacattcagcctgctccttcactagcctgttataaggaacaactggatcatatatgggaataattttttattttttaaattttttattttttaaatttatgaggccggacatggtggctcacacctgtaatcccagcactttgggaggccaaggcgggcagatcacaaggtcaagagatcgagaccatcctggccaacatggtgaaaccccatctctactaaaaatacaaaaattagctgggcttggtggtgcgtgcctgtagtcccagctacttgggaggccgaggcaggagaatcacttgaacccaggaggcaggggttgcagtgagccaagatcacgccactgccctccagcctggcgacagagcgagactccatctcaaaaaaaaaaaaaaatttaattgtggtaaaatacacataacataaaatttaccatcttaaccatatttaagtgtacaattcagtagtgttaaatatatttgccttgttgtgcaaccaatgtccagaactcttttcatcttgcagaactgaaactctatacccattaaacaactccccattctcccccaacaatctctggcaaccaccattctactgtgtgtctctatgaattttactactctgggtacctcacataagtggaatcatacaggatctgtctttttatgatttgcttctttcagttagcatgatatcttcaaggttcattcattcattctacatattgcagaatttccttcctttgtaagcctaatattccattgtatatataccacattgtgcttgtccattcatccatcagtggacgacacttggctttctttcatcttttggctataatgaataatgctgctatgaacgctggtgtacaaatatctctttgagaccctgctttccattattttggatatatacccagaagtggaactgctggatatggtaattctattttaaatttttttgaagaacagtcatattgttttccattttacattcctgctaaaagacacacgcattccaatttcttcatatcttcatcaacacttgttattttctgggttttcttttcccttatagcagttgtactaataggtgtgaggtggtatctcattatggttttgattcacatttctttaataattagtgatgttaagcacctattcgtgtgcttattggccatttgtatatcttttttggggggtggggagaaatgtctattcaagtcctttgcccatttttgattgagttgttttgtttttgttgagttcaccctaaatccttcttgaaacaaggtaaagaaagggagaaaagtgttaacatagatataggatatcatactcttcatcattatccaaccttttagaaaccctgatatacatgtacatattccagaacattccacttatgttaagttccattgatctggctatgactgtctatgtttcctacctccaaccacagaaaatatccatacacatatccaaaacacactggccatgatttatttcctcttcctgtttgttaccaacacctccaccactgtcaccctctacacactgatttaaaataaacaaggaggaattccagtca

SEQ ID NO: 2426 - DNA, 24014 bp, Homo sapiens
ctagtaatgaaacatgaaaaattcaggttgagtgagcctctgcaacacatcagactcccactcctcactcttctccaactggttcctgccccataccccacaaacctggtttcaccactcatctctccagaaagagaggaactctttttattgcttgacttctacattcacatcgtttgtatttgaaaggaaacacatgcacaccctttacttgactttattgccatttccaaattcaaccacactgtgacatattttgtaattactcttgtgaaaatgaaacatcatttttactcagttacctacaattatatacaatttttgaccctaacttactgctgcttccacaactccaccaatgacactgcaggtcaaagtcacgagtgaatttaacttgtcctcatttttggtgcacttgacactatggcccattatatctatttgcttgaaactctcactttctctgtctctgtgacattgtgctgttctagttttctaccagttttctccttcctcttcctccactggatcccaatgtttctcagtactctttgtggcctctatgtgctcatcagcattcacaagttcaaagcacccctcttaagctgatgactcccccactatacttccaaccctaaccactcagccaggcttaattcctatatttttagctgcctataggatcattccatttgcctaaaaccaaattaatcatatcctccctacaaaacataatgtattcaaaacaaacaaaatagaaaaatctgcttccctttctagcttcctcattttagccaatagtgccaccattttccaagtttcaacacttgtctagacaagagtcatttttgactcctcctcctccttaccttgcacaacctctacttaaatccaatcactgaattttcagatctggaaagaactttcaagataatctagtttgtgctccttaaacataaataagagaccttggggctcagacatattggctgcttgcctcaagttcttccaaccctgattataagacactttctattaccaagacttatttaattgcatttttccaaaacttccacacaaatctttttttttttttttgagagggagttttgcactgtcaccagggctggagtgcagtggcgtgatctcagctcactgcaaaagagggttcaagcaattctcctgcctcagcctcccaagtagctgggactacaggtgcccaccaccacacccagctaattttttgtatctttggtagagatggggtttcaccatgttggccaggctggtctcgaattcctgacctcatgattcgcctgccttggcctcccaaagtgctgggattacaggcatgagccatcgcacctggcccacaaatctgttttctttgtagaatcagaagatctgggtttgaacccttaaaagctgactataagcaagtgaatagtaactgctagtttaaaaactgcctcctgatttagaatttatgatagaaatcagattaaatttaaactcctcaggcaggtattcaaaccctctcccactcctcctcctaacccaaactggctgactttagtatcaagcatggtttctcactgaacaaattctgtttcagttggcaggtcttcttcccatctttatctttctcattcctggttcttgacttccactcagttgtttccccagcctagaagagccttacacctcagcagacacttcctttaaggcccagattgaccagcattcccagcatgggtctttctttttttttcaatctccacagcatctcaactctactgcaaaatcttacacaatatatctttcacttatctgcatagtgttctccaaactaaggagctaaataatattaaacactcaaatttataataaaggcttgcaaatttgttcttacaacgaaacactggattctgctttttagaaagtattaaatttgatttacattcaattttactaggccaaaattaacaaacaagggttatttttttcacagtgactataccaatacagtttttcaacagtgaatagaatgcgtgatgccctcgaggagctcataatctagtgttaataaagctagatatgcagacagagaaggttaaagaacacaacataacatataccatcttactcatcagcttacttatgtcattatttcaacatcaatccacagccaaaaacctggaaataaaactgttatcatgctgggtgcggtggctcatgcctgtaatccaagcactttgggaggccgaggcgggcagatcacctgaggtcaggagttcaagaccagcctggtaaacacagtgaaaccctgtctctactaaaaatacaaaaactatccgggcgtgatggcgggctactcgggaggcagaggcagggagaagtgcttgaacccgggaggcggaggttgcagtgagccaagacgcgccactgcactccagcctgggtgacagaatgagactctgtctcaaaaacaaacaaacaaacaaaaaaaccatcctcggctgggcgcagtggctcatgcctgtaatcccagcactttgggaggccgaggtgggaggatcacgaggtcaggagatcgagaccatcctggctaacacagtgaaaccccgtatctactgaaaatacaaaaaaaaaaaaattagctgggcgtggtggcgggcacctgtagtcccagctactcaggaggctgaggcaggagaatggcgtgaacccgggaggcggagcttgcagtgagccgagatcgcgccactgcactccagcctgggcaacagagtgagactccgtctcaaaaaaacaaacaaacaaacaaacaaaaaactatcctcatcagacacacaaaacctccacagcaataaaatagcaaagagccatggtatttgtaccttttatccacaggagtggctcacttatactctgtctccacatgctcagttacatggttttcttcagggtttgtctgattagaaggtgcaaattctaaaaggaggctaattctaaaaacttgccaacaagggaggaaaaaaactacagaactaaacaatcaaaatgggttcactcaacaaacactgagtacatccttactgaatacaaagatgaagactacaagatttaaatatgatattttcacccggagattagtaaagatttttttaatgaaaatcccagtactggaatcaagggaattgggtccctcaaacactttgaggggcaagggggaatattctggaggacaacgtggtagtatgcatcaaacgctttgctgtgcctgccctctgaattagcaattatgctccaggaatacaggctatgaaaatcagaagcagcaatacagacctatgacaagtaggcttatcaccacattaattgtagtgtgatcataaatataatgtatcttccaggatgaacatttatatgacaaaatacaatgcagtcattaaaagctgccacccagaagtctgaaggatataaagaaatacagatgaaaacgtcataaaacaggccaggcgcggtggctcatgcctataatcccaacactttgggaagccaaggtgtgtggatcacctgaggtcaaagttcaagaccagcctggctaacagggtgaaatgccatctctactaaaaatacaaaattagccaggcatagtggcgcacattggtagtcccagctacttgggagggtgtggcaggagaatcgcttgaacccaagaggtagaggttgcagtgagctgagatcacgccatcgccattgcactccagcctgggcgacagagtaagactctgtcccaaaaaaaaaaaaaaaaaaaaaaaaaagaaaagaaaaagtgataaaaccatatataacgtataatcccaatttttaaaatgaccatattatatatataatatatatttgtaataaatatataaatcctggcccttctacgtacaagcttataaagttgaagttttttactaagtttcattttcctttttgtgaaatgatgacaataataatacctacttcataaggataaaagagcaatccctgttgtgggattctgttccgaacaggacattgacaatgtcaaaacctcccaaaaggagcttcaaacttccaagcactaaccactgcatgtataagttacaacagctttctaactggtctcctttttcatctttcctcacactgatgcatccaacactaccaccaaatcaatattcctaaaatcctaatttcatgtcatttccttgctttaaaaatctgtaatggcctcaagatgagattctccttaggccaacataacttgaccctattttacctgcactgggaagtattgacagtagtgtgaaatcaggttgttctaatttgaagcctgagtacaccacttattagctgtgtgaccctaggcaagtaagttaacccctctaacacttcctcagcttctcatctctaaaatgtggctagtattcatcatatgggtgtttttacagagtgaaaattcatataaagtgcttacttagcactttacatgtatgcctggcactggagatgcatcctttaaatgtgagctgttactacttccctaaactgtctactccacctgggctgctcttccagatcatttctaacacacattgcccaacttaggcctttggctggtggtgttctcacccatgaggcaccattccatcacaatcaccaccatcaacaaagagtatgtgttcaacatttacactatatattcaaggtgtaggctggaaatacagaggaaaaaaaaaaaaaaaacagtcccaaacctcagagctcatagtctaataatgaaagagagacagaggaagaggtccaataattaggggtgacaaaggaagcacttcctggaggcaagggagatgcttacactgactccagaaagctgcgtgggtgaatcaggcagtgtgggtgcatgtagagtaagagcatccagtacagcaatcacagtcactgtattgagtctggcactgctggagtactaaggctaagggagagcagaggctagatcagtgaggtcaggaagtgttggcactttattctgcaggccagcagcagccactgaataatattaagtagggtacacctgtctaggactctagaaaagcttacactgtgctgtccaacacggaagccacatacaactactgactggaaatgtggctagtgtgacagaaattaaattttaattaatgtaaacttggtaactgatagcaattcagttatcaaaaaccttttatgtatgtttggaacaattaaagagtatgtaggccgggcgcggtggctcacgcctgtaatcacagcactttgggaggccgagacaggtggatcacaaggtcaggagatcgagaccatcctggctaacatggtgaaaccccgtctctactaaaaaatacaaaaaattagccgggcgtggtggcgggtgccctgcccatagtcctaaaaatacaaaaattagccaggtgaggtggtacacacctatagtcccagctactcaggaggctgaggtgcaagaatcgcttgaacctgggaggcagaggttgcagtgagccgtgattgcaccactgcactccagtctgggcaacagaacaagactctgtctcaaaaaaaaaaaatgtatttaatgaactttaaatacagatcaattatttctgatgaaaatttaatgtccaaatttaaatgtgcagtaagtgtaaaatatgtatcagatttagaagacttagtacaaaagtaaaatatctcatcaataatctttaatcacatgttgaatattttgaatgtattagagattacattagaattaatttcacctgttcctttatattttactgcggctactagaaaatgtaaaatgacatacatggctggcattatacttctattggacagcaatgatccaatagatcccaggacagctgaaagaggaaatgagaccagaagcaggaagaacaattaaaaagactctgataagcatccaggtaagagagacaggcctgattatctaaattctgcccatcttcaaaacctaattcaagatacactactgcctccaaaagctctcctaatcctaacaattcccaaggagttacctttctctgaactcctgaggcacttatctgtagcattcacttcaacactcattcatttgccacctgtcatttctatttaattttggggtaatttgtttctcagattagaccagaagctcctaggctaagggccataatttaggcacctttaatttttgcatgctgtgtaatgcatttttgatacttttaataaacacaggtacatgactccccaaaaatctggatacaccttcatgggtgactttacctttccacagcagaaggaactgagaatctcttttccttcaagaaccttaaagataggagctaaaatgatgtaaaaatcaatcaaaactccctccaagccaatgttccgataaagtagtgatatttaatcagtgagcaagcattagtagactgtataggataccatcaagaaaaaaaaatgccaagacagaagaatttaggcttttgacaaattccataaaaagtcaaacaaaaaatttctgatcatctctgatctctaccgccagagataacctttgccaacctaagcattaagaactttcaatcaaggaaaaaacatctattttaaaaattaacccctaaatcaatccttctaataaatatcacattttctaggtagggatacacatattaccagtaaatttacaactcagcattttcccatctaaattagagtaaggtgaagaaaaaaaactttccagggaaatattaagaagtagtataaatgtattttactgcataatcgataaagtatttcacctaaaataccatttaaattttctacaacacttgactatacaacggccagcttgcaccactacagaaataggaagctagcagcaactagtaaaaagcaagggacattctgtggtgatcagtactgacctgggaactttgcagttttcagatttttcatgtttgacatttaaaacagaaaactgacaagtttctaataagaaactaaaagttacatcagaattgatcttcttgcatgtgtttaatggctacgaagtggatattacaaagtgcagttgaagactctatctccaaagaaacaatcgagcaatcaaagatgagctaggatagcttgtaagggaacagaaggcagtcctttctattctgaaaggcagaagaaataggagaaacctgtcaaacaacctggatgaaatcaaggagttaacaagcaacactcatttcctttagcactgtgagaaaattccggttgctaatagaaagctgaggaaagtttggtttggcttgtttcattttgttttccttccaaatcatcactgagtatgaacgactgctttcctctcctcacattactcagtaaaaactcccccattgaattgtcttccggtgccctgctccccagcctcccagaacggcccccgcccccgcctccctcccagcaaacgtgctcagacgcctctgggcttgttgtggtctcgccagtctgcggacaagcgctccaaactcaatggacaatggagctcacccccgtcaacgcgaactacaaagctcaggagggccatttcccttttcctgcccagatgctgttttcgctccttcgaagcaagatcccatgctcgactagacggccagtgtgcgccaggacccgcgtgtctccttccccacctgcagagctgctgagcccctcggcccccaaataaattgtaccgcagcacacaggccaaaaagggccccccaccaccaggggcttggctggggacagtggcttcacggtccaggtagggatggagggaacgtctcttgacgcttggtcatggccctcaagactaagccgtctccactgttccccctccccagctccaacttgcctcccctccccccactgcgagaagacctaggaggtgcgggcaggcagcaccgccacctcttcctccggtggagcgctcggccgacactcaccctttcaccacaaagaaggggtcctccatggacatggcgtcccggccccggccgccttcacctcctccgcgcacagggcgcccgtgcctcccggtctccctccgcccaccccgcctgttcccgcagctgcccgcgccttagtctgggtgaagccgagcagcgggcacgcgcacaggccaggtgcacaggacggccgctggtccagcactcgctcagcaccactggccgaatcccggactcgggcgccggccccctcggcagcctccagtcccggctcctcccgaagcgtcggagggcctgaccccacccccgggaccctcggccgcggccaatcacgaacgccgcctgaaacacgacttccgcaccccgctcacgtgaccagggcatatatctctctctctctctctctctcctctctctcctctctctcctctctctcctctctctcctctctctcctctctctcctctctctctctctctctctctctctctctctctctctctccccccccccccagtgggcggggcttacgcctgcgtccctcggccctggaggcggagccctcggggcggtggaggtgggcgggcttctacagccctctcctcaagcttgagggtgaggagtggcttgttccctcagaactaggcagtcggcttttcaggataagctgtagttgtacctgatttgcaaaatcctcttacctttcctctacttttaatacttaattttgacagtatgtaatttataaatctatctggtcctcgacttaaaatgaagcatagtatctgattataatgttacacagatcctttaagtaggtcttgctttgtgttggacagtgtgctaaaggttgtgtatgcatcatctcagtatcctttgggggaaagtattattcccccctccccctttttggggggcagggtctctctctgtcaccctggctggagtgtagtggcacaatcacagctcactgcacccttgacctcctgggctcaagcgatcctccggcctcagcctcccgagtagctgggactacaggtgagcgccaccacgcccggctaatttttaaattttttatagagatggggctctcagtatatttcctaggctggccttgaacacctgagctcacatgatcctcctgcctctgcctcccaaagtggtgggattatgggcgtgagccaccacaccatccatttttctcattttgtagataagaaaataagttcagagaggcttgaagacttcctgtagtcacacagcctggacagggcagaactgcagattctgtgcactttccaccagatggggtgtactttctgttgctgtacattctgcaaataaccatgtaaagtaatttttcatacagcatatggtgcttcccaggagagcacaccttcgaggaataaagaaggggccaggtatgacaacttcctctcactgtggttcaagagctattcgagaaaacattttgcccagaaccattaaccaactcatatgctagatatgctatgaaatttgtggatggggattgtggactttgattgctgaaaatcattgagcacttactgtgtgtgtgtgtcaggcaggatgttaagtgttatctcagttgctcttacaatgtgataattactgctatcatgcccattttataaatgagaaatctgagactcggaggttaagtgacttgcccaaggtcaccagtctggagctggcacagtccttggagcaacacaaaccccgtttaaaccttggctctatcattcagttcctcatctataaaacataaataataatagctagttcatgggttgttgtgatggttaaataaaaatgtgtgtaaacctcaagatcccaaaggactaagttactgaagtcaggaaaaccagtaaggacgctgctaaagtcatgtggcctgaagggatgaggtccagaccaggatgacagcgattgagaacagagaaggagtgaatctgacagatgtttcaaaaggaaaacaagactaaacacctagacatgatgaggggctgaatgggtttcaggaggggagagaagagaggggtgaaagccaaaatccctggaggagcgaatgatggaaggcagatgtggggaaaggaagcagtgtccaatactagtgattgctaatgtttattgggagagaactgtttaatttacttagctggggaggtgaaaacgtgtcatcgttcattcattcaacaagcacatgtaaattgaggggtaggtgagcatggtgttgaagaccatccttggagtctgattgcttgagttctgctgcttcctgactgttgcatctcaggcaagccgcttcatctctcactatcctcaactgtgaaatagacaccgtaataacagcttccttatagagtgtcatgaggtgatgtgtgaaaagtgcttaaaacagtgcctgacacatgttgtgctcctactgtgtgctaagcactgagacacaggcatgaacaaggcttggttcttgccttcaaggaactgtcagactggtgggagagacagactggtgggagagacacacagtgagagaagggcacaggttgccatagaaacacagcgacaagataccagtatatttgtgtgttttcggggctggggcagggggttcctaagcagtgactagaagcagccaggagaagggggccatgttgctggagtagaaggaaaaggatgggggcagcaggagctaagcctggaggtggacagggtcagattatcagggcccttgtttgtaatgttcagaatagtggacgcttcctatggacagttccccatggggactgagggaattgacagggtcagattggcatttgagacagatgcttcagtggctaggaggttatggtccagaggagggatgagggtatcctgagctgggcttgtgacaactaaggtggagaagagtgatgcatttgagacatactttagaggcaaagttagtatacttggtgactgattggttcagggtatgggggaattgatgaaagaagagggaggaaggcttctggggttgtaaatgggtagtgttggttccaaccatcaagaaagagaacacaagaggaggatttgatttagggtgaatgtaaattagctgttagcatgtcatttatccccaccaaacagtaaactcctggagggacaggatactatgttaatgttattatcacctaagtgcctgacacggcctcttattatctgttccatgaatttcttaattggaccacatatgacaggccagagttttataagtagtaatagaagatagaggacagaggcttgggttcccataattaggggattagaaaaagcaccaacaatggagatagtggagtgtcaagatataaaatgtgtgtatgtgtgtgtgtgtgtgtaggtgttcctttctttaatgtgtcaccctcctttaccctctctcaaactagaccttggcctccactgcccacaaggaaagggaagctatggctaaaatgcaaggagaaacaaaggaggttctttctttctttcttttttttttttttcatttaataggacccacgtcctggcataaacaataggttgggaagaatactcagcaaaaacccatctcttcccacacccccacccctaccccacccccaacccaaaagaataatttaaatttctcagggaataaaaaatcaaaacagtggttgtcttgggggacagagtttgactgggaagggaaactttcttgggtactagaaatgctctgtatcttgacggagtgtgtgttacatgagagtatcatttgtcagaattcctcaaaccgaaactcttaattggacttaacttctgttcatttttctgggggaggttgacatgccaactctgagctttctgtagagttctgagtgggcagccaggagaacctctggttcctgagtgagtctccaaagttaggagagtgaatgaggaagggagcacactgggtcctgcaatgcatcttctgcagaaataaggagatggcaacacagagaataaggcacaggcagccaaatgagctgaggatcagaaaggagccaaccatatcactggggatgccaggatagacctgagagggattgcagtgggtagccaccccctgcccctggaagctgcgggaatgccatgacacccctacaaggggatctcccctactctgaaataatgacattcagcctgctccttcactagcctgttataaggaacaactggatcatatatgggaataattttttattttttaaattttttattttttaaatttatgaggccggacatggtggctcacacctgtaatcccagcactttgggaggccaaggcgggcagatcacaaggtcaagagatcgagaccatcctggccaacatggtgaaaccccatctctactaaaaatacaaaaattagctgggcttggtggtgcgtgcctgtagtcccagctacttgggaggccgaggcaggagaatcacttgaacccaggaggcaggggttgcagtgagccaagatcacgccactgccctccagcctggcgacagagcgagactccatctcaaaaaaaaaaaaaaatttaattgtggtaaaatacacataacataaaatttaccatcttaaccatatttaagtgtacaattcagtagtgttaaatatatttgccttgttgtgcaaccaatgtccagaactcttttcatcttgcagaactgaaactctatacccattaaacaactccccattctcccccaacaatctctggcaaccaccattctactgtgtgtctctatgaattttactactctgggtacctcacataagtggaatcatacaggatctgtctttttatgatttgcttctttcagttagcatgatatcttcaaggttcattcattcattctacatattgcagaatttccttcctttgtaagcctaatattccattgtatatataccacattgtgcttgtccattcatccatcagtggacgacacttggctttctttcatcttttggctataatgaataatgctgctatgaacgctggtgtacaaatatctctttgagaccctgctttccattattttggatatatacccagaagtggaactgctggatatggtaattctattttaaatttttttgaagaacagtcatattgttttccattttacattcctgctaaaagacacacgcattccaatttcttcatatcttcatcaacacttgttattttctgggttttcttttcccttatagcagttgtactaataggtgtgaggtggtatctcattatggttttgattcacatttctttaataattagtgatgttaagcacctattcgtgtgcttattggccatttgtatatcttttttggggggtggggagaaatgtctattcaagtcctttgcccatttttgattgagttgttttgtttttgttgagttcaccctaaatccttcttgaaacaaggtaaagaaagggagaaaagtgttaacatagatataggatatcatactcttcatcattatccaaccttttagaaaccctgatatacatgtacatattccagaacattccacttatgttaagttccattgatctggctatgactgtctatgtttcctacctccaaccacagaaaatatccatacacatatccaaaacacactggccatgatttatttcctcttcctgtttgttaccaacacctccaccactgtcaccctctacacactgatttaaaataaacaaggaggaattccagtcaatttacatattcagcactaaggaatgatggagaatttgtggaacatccatttggtggtcattagaaatgttgtttaaaagtatgtaatgacataggaatggcttgagtaaaaacagcaagacacaaaattatacatatgatacaatttcagctctgttctttcttatacattaaaatgttttggtacatagaaaatttttacacgtaggaaaaaagaaatctatttaaagtttgtcaactactacagtgaaatatttacttggatagtcagaaatccaaaaagttttttaaaaagaagagaaaaagtaataaaagagaagtgaaaagccaagtgaccacatacgaaaaagtacatcaaaagttagcagttttcagcctgagcaacatggcaaaaccccatctctacaaaaaaaaaatacaaaaattagccaagtgtagtggcttatgcctatggtcccagctactcgtgagggtgaggtgggaggatcacttgagccaggaggcagaagttgtagtgagccatattcacgccactgcactccagcctaggcgacagtgagaccctgtctcaaaaaaataaataaataaataaataaataacagttttaaatcctgtttagaataaggcaagttaggagggtctgaatgaatggaaattggtgagtactaaaaagctgaaatacgttattggaattcagtgaatttcttgacaagacggtggatttgaaccactataggaaggggaggtatgttctttaccatcctttatgaatgtgactgtgtataaggaaagaaaaatcaatctgtgttggtaaactggctcattgcaataatagtactagtgattgctaatatttacatactatgtaccaggcattgtgctaagtgaccgatgtggttgggctgtgtacccaaccaaatctcatcttgaattctcatgtgttgtggtgggagggacctggtgggaggtaattgaataatggaggtaggtctttcccgtgctgttctcatgatagcgaataagtctcatgaaatctggcagtattataaggtggagtttccctacacaagctcctgtctgcctgctgccatccacataagatgtggcttactcttccttgccttcagccatgattgtgaggcctccccagctatgtggaactgtaagtccaataaacctctttcttttgtaaattgcccagtcttgggtatgtatttgtcagcagtgtgaaaacaaatacagtgacacacatgcattatcttcagaagctccagaatccccatatggggcaggttttagaatgtaatttggttggacagcagggctaggggacttgatgtggcatgggagacccctgtcttttctttttttttttttgagatggagtctcactctgtcgcccatgctagagtgcagtggtgcgatctctgctcactgcaagctctgcctcccaggttcacaccattctcctgcctcagcctcccgagtagctgggactacaggcgaccaccaccacgcccggctaattttttgtatttttagtagagacggggtttcaccatgttatccaggctggtctcgatctcctgacctcatgatctgcccaccttggcctcccaaagtgctgggattacaggcgtgagccactgcgcctggcctcttttcttaaattataggtttatttgggattacttaagacagctgatggccattatgcgtgtgtagtaaaagtactctaatgccccaacaagtgacaagtcacttcttggttccaccactgctgatttcattgaatcctcacaataatcctgtaaggcagaattggttattacctccattttctatgagaaatcccagacttagagaagttaataatttggtcaaaggtcacataggtaggaaatgtcagagcctcatttgaaaataagtttgactcctgaacccatgttctttgctacagtattctactcccatttgtacaaggactagccttggccaaaaattggcaaatggattttacctacccacagaaaagggctcaaatcaaactcgacacagacacagacacagacacacacacacacacacacacacacacacacacttctactgaattaaaaaagaaatagccaaggggaaactactgattaaatataataaaatatattatgttgaaaacaacattatttaacaaacaagacccttttgctaacttgataattcatcatttggtttttaaggatgaattgcactaactgcaaatgagtcagattcctcagaggggccttaaaatacatataataaatcaggtattaaaaagccaaacacataaagggatttataatgaacaggataagcacaacccactctgaaaagtgcggcctgagatttaagtttagactattgctcagaggtgaggcttgtttttccacaaagagaatgcgagggattctccctacctcagtgcctcccagcttagtggggcagtcttacctgtccttgaagatcttggcataattgaatctattaaaaattttaaggactattaaagctatgctattaaaaactgcatattaatattggaaaatataaatttgaaaagaatttacaaaatactattaggacgtaaaacccttttttggtaaaatgaacaaataaaggtatgcttatatgcagacatatgtagtcagcaaaaccactgaaaagaaatacactaaaatatgttaacagcaaattttttcctttcttcctccctccttctctctctccttccttccttccttcccttctttctttctgttgccatggttgtagtacagtggcgtctcagctcactgcagccttgacctccctggctcaagcaatcctcccacctcagccacctaagtagctgagactacaggcgcatgcaccacacctggctaattttttgtatttttagtacagataggggtttcaccatgttgcccaggctggtcttgaactcctgggctcaagcaatttgcccacgtcagcctcccaaagttgggattacaggtgtgagccaccatgcccggccaacagcaattttttctgatgggtgatttttatcttatcactctctgggttttttatatgtatttgccctgtactctggattaaatttactaatttgcaattagaatacaatgacttaaaaaatgaaagacatcggtcaggtgtggtggctcacgcctgtaatcccagcactttgggaggccaaggtgggtggatcctgaggtcaggagttcaagaccagcctggccaacatgggaaaaccccatctctactaaaaagacaaaaattagctgggtgtgtaatcccagctactcaggaggctgagtcaggagaattgcttgaacctgggaggcggaggttgcagtgagccgagatggcaccactgcacttcagcctaggcgacagagtgagactctgtctcaaaaaaaagaaagacatcgttgacatacctacatttttttttttttttgagatggagccttgctctgtcacccaggctggagtgcagtggcacaatctcagctcactgcaacctctacctcctgggttcacaccattctcctgcctcagcctcccgagtagctgggactacaggcactcaccaccacgcctggctaattttttgtatttttagtagagacagggtttcaccatgttccaggatggtctcgatctcctgacctcgtgatctgcccgcctcggcctcccaaagtgctgggattacaggcgtgagccaccgcgcccggcctcatacctactttttaatgtcagtacagcaggttatggtatggaatgcattttggaacaagatattaacaaaaattcaaaggaaaaaatacatggccatggaattccagtgctgagagacatttgggaatattgggggagttttccaaaagagaaatccaggtgactgtatttgttaaatgagtaacaaaaggaaaaacaatgtaaagaaacagaaaggaaaggaagagagaaatacaaagatctgagaagagaaggtgccaggggccgctgagagattgccaaatgttaatttcattatttggcttcttattttattctgggtaaaggtagacctattagtttcctgttgctgctataacaaattaccaccaacttagtggcctcgaacaatgcaaatttattctttcaaagttctggaggacagaagtccaaaaatgtgtcctatcagctgaaatcaaagtgttgtgttccttctggaggctctaaggagaatctgttccttctcttttctagttctagaggccatctgcgttccttggctcatgtccttctttcagcaatggcatcatcactctgacctttgcttccattgtcacatctccttgactctgacccttttgcctccctctaataaggcccctctgattacactgggtccaccagataatccaggatagctctctgtctcaagatccttaatttaatcatatctgccaagggttttgttttgttttattttgtttttgccatttaaggtaatatatccacaggttctggcaattaggttgtggacatctttggggcgacaattctcaacctaccatacaaccggtacataaggttctactacctactaaatgcatcataaacagaacttctgatccttcaacaactctgtgaaatatatgacaggatttgcttttaaagttgaagaaatcaggccttggtgcaatttgggattctgcccatggtcaaatagtggggaggcaaacccaggtccctgaacccagctcaagcctgcctgcctcatggccatgcctccattcacctctccccttcatgtctacttcctctttcctgtctgggcctgttccctagctccctggacaagcttaagctgctgttttccagcttgtcatgtgctccttatgacagtgtagccacagcttgatcttggggattgctgattgagcaagctgagtggctgcccctcagaatcttctgtaggcctttctcttgccttcttttattcagtaagtgttttgagcttattgtgctgggtgctagagtagcagggaggacagacctaagttgaagattacgggacaatctaagtgacacctgctatctcagacagagacttcagcatcatagggagccagagcagggagttccaagccgtgggaactgtgactctttcttactgacccttaagcaaaattctaagctccagggaagcagaggcagcagcttgagctccctgattgaccagatatgattaatctttgtttctctgtgctttgaacatgactatgctccataaatatttaaaaattgggaatagggtgaagatagatacaccaaaaggagcaagcagtgtctgaaaccagcaaagacttaaaagttaccgaagaaggtgttcatgctttcattttatcttttttttttaacctagcaactgatgacactgcatatcttcccctgttcttattgggagaaggccttgtgtgtcaccaagaggttctcagaagggacctgtcagtttttggttaaaagaacccggaaagagaaggactatgggggaactgatggcgttcctgttacctctcatcattgtgttaatggtgaagcacagcgattcccgtgagtatcccacgtcctcttctctcctaactccaaagtcgaggcagcctagaaggcacagcttttcttcctaaaacttgtggtgaaaaatatagaagccaggggcagaaacgtgtatgtattacactcagactccaggagcaatggattgcctgaacagtttcccagttcatatttgtaggattttgatgtcaccaccttctgagggagggggagccgttctagaaagactctggaacttcctcactttccctctgagcatggcctcctttcttttctgctcatattttttcttttacttttgtttctcctcttttctaacttccagagtctcatgaggatgtagtcagagtttcaggggcattaacagtggagtagatccattgttcaggtttatttatgtttttcctcaacacaagccctacctgtaataaaagatccaagaaagataaaaccatggctctgggtttgtttactgactgtgagaagtattaatcaagtagaagggagagtttttcattattcggggagctcaagtcactggggaagcaaatgccttctgttgcctcaaataggggaaagggcccatgggctagaaccaccaggcttctctgccctaatcacttgctccctgggctgaggactggtactggtgggcagtgtccagaacttagacttggccaccaccataggtgtgactgatgaacatgagaggaaggagttctttcaaatcacccatgcacatagagagtggaatgactgaccatggagatttggaagggcgaggggggtggatgattagaaattacttaatgggtacaatgtgtgttacttgggtgatggataccttaaagccccaacttgaccactacacaatctatgctataacaaaattgcatgtgtacatcataaatttatacaaataaaaaaattttaaatcatatggctgggagtggtggctcacacctgtaatcctagcacgttgagaggccgaggcagacggatcgcttgaggtcaggagtttgaaaccagcttggccatcatagtgaaaccccatctcactaaaaatacaaaaaattagctcggcacacccatctctactaaaaatacaaaaaattagctgtgcacagtgcgcacctgtgatcccagctactcgggagactgaggcaggagaatcacttgaacccaggaggcggaggttgcagtgagccgagatcatgccactgcactctagcctgggtgacagagtgagactccatctcaaaaaaaaaaaatccatatattaattgttcaaatattgattgatggcctactatgtgccaggcactttgggggatatggcagcgaacaagacaaacatagtctctgcttccatgaaaatttaatccagaaagtgtcatcatttatgggaaagattgggggtgagggtaagaggcagaagatgaaagaggaaaggaggagagaggcaaagggtgatatttttggaaataataaagcttatatattacctgcatgtgattctcaaagaactctccaataatatggaataatattccttaaacatattatctcctatgacaatctcactgactatttgtagtaggtgaagaaaatatccccatttaaagatgaggcctagatttttctctaggcctagagagtgaccacgctcacataaggagcaacctgaaggagactgcagatcttctggccctcggtccagggctgttccacaatgtcattgctcctttgggtgtgaagacttgtcactttgataattggggggacaggaaataaaacaagtaagttataaaggcaagggaaggtcacttggtgctggctgttctccttctgactccttagagtgcatccttctctgttctgttctgtgtccttgaggctgactgctagactgcatcacctagactctcttgcaagctgatttctgcttgggttcatacaatgggagacactgaaaggagagatgtcagagagcagggaggaaagagaggctgggatacatctttcttgctccttccccactttctgtgatgtctttggcagtagctatgttcttctgtaatgctgtcttccctgaataaccccttcttcatggttctagctcccattgggcttcagtaacggtatttgctattcttatctcttaagccctaggggtgataatggcttcccatagttgttagcctgcagatgcccatcatccttgtttgttccgttaaccttgaccatatctctgcaaggagtcccttcattaaggtctcctcacatgacccatctggcttgaaggctgtttcctgctaggaccctaactgaacattcctgggctttgagggatattggctggaaaaggatatgagattatgaaagaagactcagtctacttgatatttatgcctagtgctagccctgagtgggagctatataccagtaatagatggggaaacacggggaagagatactgcagggttgtgggtcattactccaggaaatgtcaacataactccaatatcactttcagtgtgttgctttcatcaactccacagcctgcagttgactcctccttcctttgtgctcccatggctcctgttcacagttctgtaattttccatttacaaaaatcttctctttgaggctctccttaaagacagaaagagatatcttcatttttttcttatttctctggtatacctagtgcccaacaggcacttagtaaatgtttgctgagtgaatttatgttcggaggtaatgtccctaagaaatcacagttatttgactgggagccatagagagctcgggcagtaataacgactgcaaattcaaaactgtggcttactgtagttgcaggatttgtattaaaaaggtgtttcatgcttttacaactcatcttgttcttcatttcagcctgtgtgaaactgtgaattggcgatatgggtgggtgtaatcagactgggggctggcatgagatttctcatgcattgccatatgtgatttgtatgtttcatctcgacataaccaaggtcagtctcttgatattactcataattttatggctgtataaatctgctatatcaatctacttcatgaatggtggagtccttcacaggcgaggtctgatgatggataagctccctaagctgccaactgggttactgttaaaaaacagacttgcatattatctgcttagaagtgaccttgagttcaaagagttaacatgagaaaatatgggctttttctttagactttattagatagacttcagtctgtttccatggagctgttgccaaggtatatgccatagaaatttctccaagacaatgtttcactcccctaaggccctcttcttaattggcattgaatctatctaaacttgagaaattcaactaatttgtagatttttcttttgactagttgaaatatctgtctattctcacttgaccccaatcctcttaccccacagtattgctaagagctggaggaaaggagcctaagttaaagatcaaacacatgactctttgaacacttattttagggaactcaaattgagaaagatgacaaaggatgttttttctgatgtatgaatttatatttatcggggaaaatctttcaagagtatacatattaagtcacattttgttataacttcaaaggatcattttagaaaaataaaatttataaaatcgggattttctgggaaacataagacatatagtcatcattgtgtacagagagtactgagggaaaaaagacaccagagctcattcattcgttttccaaaactccacatagtcctacagggctcactttcttactccattcacatctctgctcaaatgccacctgctgtggtccctctatctaaaagatcaggccttctcctctccacactctcttttctctgctttacttttcttcataatctttatctccacctgaccttgtattatatatgtatttattgccaatctcctgtctagaaattatctcacagggctgggactttcatgtgttcattgctctgtttccagcagctaggactgtgcttattggacattcagaaaagaatatacctatatgaagtgagacattggcaaccttcaaaagggtagcctcagaagagtagctcacaagccaaacttgtcacagtcgccacttttatgctctaagttcctgtagttagttagacatgtcattaggagaggggactaatggttcttgctgcacatagaaccatccatgaacatggcctgagatgtgtccaaaggtccccttaactaaaaatattgccacctacttctcccctcattcccacgatgctcgaaattctaaagagtcattcccaggaatcataatcattttgaccttattaaggcattggacttcttgagagagccaataaataatcagactgtgttgacctggttatccaatcaggactcacggccacctgtgtgtaggaaggtctggagcctgtggccccagggactgggaaatcagaggcagtgagtc

SEQ ID NO: 2427 - DNA, 13664 bp, Homo sapiens
gtggtttttcaggtcccaaaggccccagctcaaatgtttcttttctccacttttcagagtcctttatgtatattttatgtataatgttcagaatttttacttagtgggatgaaaaggcaaagaatgcctacttcagcttctagaaacagaagtcatccaggatttagttttaaatgaattggtcaagatgaatttctggtacataaaataggcctagtcaaaacatgaataatttatccatgaaacaaattccttttcgtgacatttttccttggtgggccaatctgctattccccatcagaaaagagcccaggtgagagaagaagaaaatagaagaaaacagaaaatcaggaggactttctctttctcactcctcacttcattcctgcctcactcccaaggcaagttcagagccccacagtaccaagagttcaggaaaatccaagggctgaattcaacatccatctagccagtagagatattttaaaaatcacacatattatactgacttgaaaaaatattttcagcacctactttttaagtactcttatgctaaacacaatggagaaaattaaggtacaaaggcatagcctctttcagaaaatccataaaacctgtatccaaagaactataataatgggcaggttctgaagaatgacatagaatgggccacacatctctaggataggatttaaaatgtcatttaaatataacacaaatgtttgtattgggaactctaaattgtccttgtctacagccttcttccttccctttcttacaacctataagatcagacttaagtaaactcctaagctaattttgaatcatttgtcctccctaagcccataatcacatggctaagccaagaattattcaaacctaattctcccgcaagacctcatccattgctcactgctcctgaagatggtcttgagtatccccctggatctgggcctcagactgtctttgccactctcctgtgttaccacatggagttggtccccgccatgtttggtcaggtctcttagaatgataacttctaacatcatggatcctgaaaattagctaatgtgatttccaactactgtgtctcatctagctgatattatcaatcaattcatcctgcctgaatttataacaccacatttggatatagtgtttagttgcttaacatatgttcaataagcataaattaaatacatatagacaaatggtctagagcagtcttcatcatgcttctccggaaggatctagagtacttatacaatttgagaagattgagtttcataccaagtagggacagggtctggaaacaggcagtacacaaacacttgaatgtatgttaagactgagacttctgctacagaaagtcagaggaaagaatgtgactttcaggtgagatcagcaaagaaggattccctctgccacaaaataacaccttctttcccagaaactcagatttcctttgatataattcactattaattttcactctaggagatgaagcatctgaatgaatgttcctggaatatgcttggaacatgggaataaatcatgctagttgatatggaagacaaacacaacactccagcaatactctcttaggaattccctcatcaccatttaaattgttgattttctgctcttctgtagaaatctctagttctggatgaacataagcactgtctatattcgttagacagcacaatacatattagtctttaatttatttcacctacaccaaacctaaattttttcttcttctaactttatgtcctaattttctttacttaattttgtctacatttttgtcatcattttctcttagatttttgttcagctttccttgaaacccaataaaagcaaaaattatattgagaaaagacaaaatttcacatcccatattctacagcttgctacctctgggcaccaatggacattcaactgaaatataattttttaaagaattttatcagtataatagactcttggacttgaattatgaagcctaacaactggtgctaaatcagatgaaattgtgaagaaatgtctgcagtgtagctctaactaaaagctatattctaacaagtcggcgatggagcctccaactttctcatgcctctggatggaatttattccctaaactcagtaaagccactgactttcagaaaatgaataatctaaaaaaactgcaaaggcaaggcttttgttctttaaaaaaagaaatgaagctaacttctgcttatggcaatggagatcagtttattttgcaccaatttcctactgaaaataactataaaggctgaacaaaatgtccaaaacccatctgtttgaagtcatcagagagccatcaaggtaaagaggggcttcagggcaaataatctgacagaggcaagccaagagatgttcaccccccaaagcagttactaaaggcttggaggttgacaggagtatttaaaagtcgcactgagaaggacaacacaaatttgagtttagtgccttccaggaatgaaaaatccttggataaagacttaggatatcactctgcaatctacagggcttcaccctgcaagtgagtgtaaacagaaaatagaacaagccttataaaggtttaagaaaagttttaggtcagctcaagtcctaaaggattaaggtgattggcatctcacttagctgcctggtagaagcaagttgaagtcccacctggagaaaaacattcactgaagcctcaaaatgccttgcaagttttcatctaaaatgtatgacactcaatgaaaaattaatagcatattaaatagatttgaccagcggggcgtggtagctcacgcctgtaatgccagcactttggaaagctcaggtgggcggatcacctgaggtcaggagttcgagaccagcctggccaatgtggtgaaaccccgtctctactaaaaatacaaaaattagctgggcatggtggcgggcacctgtaatcccagctactcaggaagctgaggcagaagaatcactcgaacccgggaggcagagggtgcagtgagccgagatcgcgccattgcactccagcctgggtgaaaagagcaagactccatctaaaataaataaataaataaataaataaagatttgaccagctaacaagagggaaagaaaaccagacagtgcaaaattatccatgagaaatgcagttgttgtatttatctgataggacttaagataacagtgattaaaatgtttaaaagattaaataaggcaatacaattcagtgaagaacaaaaaattataaaaacaaagaaaatataaattctagaactgaaattaagaactttacagatagatgtaacaataagacatacaggactattgaaaaaatagtgaattggaagataggtcagaaataaatattgagaacaaaagagggagaaaaaattacagaaaataaagaaaagagcatgcaaaatttatgggacaggtacaatgaaaagatctaatacacatgtaactgaaatttcagtaagacaatgaaaagaaaaatggggcacaagcaatatttgaaaagatagttgctgaggatttttccaaactgatcaaatactttattcaagaaatgctatgagccttaagaagaaagaatacaaagaaaaccacatagctagatgcatcatagttaaatttctgaaaaccaaagtcaaagagaaatcttaaaaaaagaaagagatagagaaaaaagtgtattaacttcaaaggggggacaataagaatgacagctaatagctgacttcttaattgaaacaatggaagccagaagacagtagaaagatatctttagaaaggggtgggggcagaggtcaacctgtaattatgtatcagtattaagtgcaatacaaaaattcacaaaataaaagcattttcacacaaataagaactgaatgcaccagcagcagatgaacagagaaaatactaaaggatattcaagaagaagtaaatttgtactaaaaaatgtgtaaaaaaaaaccccatctgtttgaagtcatcagagagcatggagaaaaacattcatttaagcctcaaaatagcatattaaaaatatttgaccagctaacaagagggaaagaaaaaccagacagtgcacacaaatatccatgagaaatgcagttattgtatttatctgataggaactttaagataacagtgattaaaatatttaaaagattaaataaggtgatacaatttattgaagaacaaaaatttggcgatgcagaaaggaatgaagagtaactaaaaggagtaaatatgtggataaacacaagtgaatattgactataaaacaataatactaaagtcttatggattcttaagtatttagaaaattgtaacacatgagaacataaattagagtatgggtaaatgaggctaaagtgtattctaacttttgcattgagttggtgttggtaaaaatagtaatttatgttagacttgaatttcagggatgtattatatttcataagctagggtaagcactaatacaatggtaaaagaatgtgtatctgaccagctagtactggggagaaagggaaaaataaataatactgaatccatccaaaagaatgtaaaaaaaaaaaaaaaagaacaaataaggaatatgctgggttaattagaaaataaatgtaaagttctagattttaaacttaatatatcaataacattaaatgtaaatggactaaacactccaattaaataacaaacattttcaggctggatttaaaaaataattatatgacacaagagactcaccttaaatataagaatataaaaaagttgaaactaaaaatagaaaatatatataccataaaaatactaatcaaagtatctttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaatcaaagtatcttaatctcaaagtagatggtatagcaagaagcaccactagagataaagatcactttccataatgatagaacagtcaatccatgaggaagacacattttaaaacttgtgcacagttaataaatagtgtcagaatatacaaaggtaaattattagaagtaaaaggagatatataaaaattcaaaattgtagtgagagatttccatacatatacttattaactgatggaccaggcagaaaaaaacaatcagtaaagagataaaagaccaaaaaaaaaaaaaaagattgcaaacttgatctagttgaaatattcaaaacattactactgtataataatattcttcccaaatgcataatttaccaaaattaaacattatctatctatctatctatctatctgtctacctacctacctacctacctagtttcaaaggtttggaaatgtgaagtatattttccaacctaaatggagttaacctagaaatgggtaagaaaaataagtagaaaatatcatggacttggaacatagactatttttcaataattcatgagcaagagaagaaattacaagagaaatttaaaaatagtttgaaataataatgataatgtaacatctcaatacttgtaaggttcaggtaaagtcatgcttagaaagaaatttatatttaatatatacatgagacaaaggctgaaaaatcaacgattaagcactaaactcaaaaaatcaacaaagagcaaattaaatgcaaataaagtgaaaactagaaaacaataaaaaataagagtggaaatcaatataactgaagcaaacacataatagaagaataactaagaaaaaaggtggttctttgaaaaggctaatatagttgatgataacttgtcaataccctgatcataaaaaaggcagaaaaaaatccataatgaacaatgagattattacagctcacataggcattaaaaaggtaatagaatattttgaatagctgtatgccaatgcatttgaaaattgacataaaatgaacaaatttctgaaaaaacacaagctaactaaactgacacaagaaaacgtatcatttctaaaaatatgaatatttctatatttgtgaaagaaaatacatttataattttaaaacttttcataggaaaatctataacctcagtgttgttactggtaaattttaccaaacacatttggaaaaacaaaataccaatcttacgttaagttctttcaggaaacagaaaaaacgtggaacattttccagctgtttttttgaggttaccataatcttcatatcaaacctgacaaggactttacaagaaaaatcaaacaccaatcattgtcataaacccgtatgcaaaaatattacaaatttgtgctaaccaaatccattaatatagaaaaaagataatatacaaccaaacagcctagttcggtttattccaagaatggaaaattggcataacatgtaaaatcagttaatgtaattcaccatatgaagagaataaaaggaaacaatcatctcaagaaatgtaaaaaaaagaagtcatctgattatttatctgatttatttataataaaagcccttagcaaacaaagaataaaaaaaaaagactttattggccggtctcacgcctgtaatcccagcacttcgggaggccgaggcgggcggatcatgaagtcaagagatcaagaccatcccagccaacatggtgaaacctcatctgtactaaaaaaaatacaaaaattagctgggtgtggtggcatgcctatagtctcagctgcttgggaggctgaggttgcactgagctgagattgcgccactgcactccagcctggtgacagagtgagactgtctcaaaaaaaaaaggactttatttatttagtaaacagtatctagaaataacttccagcaaacattatacagaatggtaaaatattaaaaatttttcctctaaaatcaagaacaaagtaaaaaatgccagtgttacttacatttgacatgtacaagaggtcctagtcaatgcaataaggcaagaaaaagccaaaacatgtgaggattttaatggaatgaatgacagaagtctagtcctcttccctttcaaaataagctgtggcttccagaaaaaaaaaaaaaagagaaaggatgatgggaatgaaaacaacagcagatatctactatgtttctctagatgaaaataaatatagttactctgtttttagctgacaactagtcagtgtcaggatattgatgaacctcagtccgtcaatcagaaaaactactgctatcatcacacagaaggggttagaattcaagctgtactgcctgctagctgtaggacctttgacaggtcatatagcatgtctagcatttagatccttcatctgcaaaatgtgggtggcagaagtacttgcttcctctgcctgtatgaagattaaataaaattatacaatgtaataaccctaacatataaatacaaaataaacgttagatgaattttactgaaattattagtaacaactccaaagccttggttccttcagttaaggcgaccactgaagttaatctcatgtgaaaataaattataccccaaatttaacacaaacaactataacaggtgatctggaactgaaaataataacaaaaaattaatgaagcttacattaatgagatatttaaatattaccttacttttttcaaaaagtgttccttttctctctctttcccatgatttttttaaaaaaagcttttaattgctgcaaaccggcagaaaaatacttatttatatcttaaaggtactgctcaatgaattttcacaaactaaacacgtccatgtaaccaacacccagatcaaattcttcccatgatttgatcattcagaaaatctttgacaaagaggttgacaaactcaagctggagtcagacaacccagatgctaattctggctctaatagggatgcactggttgacttaaattagctccttccctacatcctttgcatcctaatttttctcatgtggaaactaagagcaacacattcccctgcccctccaacctcttgtttcacagtggagttccaggaccataactgcaggcaaccaaaaccgtcttcctaaagctccctctcctttagcttccatgagtctagaccttcctgaatttcatccactgcccccggattattgcttagtttagtttctgttcatctttgaatgaagacatttcccaagattctgttctgcccccaactctcctcagtttctcattaaatttctcactgcactttctcattcaattcctggttagtttcatctgatcacctccatgtccagacttccaagtgcaaaatccaaccctaatttttctccccaactccagtccaagattttcaactacctgctgatatcttcaagtcctgttgatacatcagtcccaatctatcaaaagagaaatcatctttcctccccataccttctccctatgttatattctttactttgattaccacttctggtcacctctgtaagacacctgggaatcatcagctttctctggttcacttgccaaatcttgttaattctaccaccccaatatcctttgaaatgtccctttgtcactatgcctaccccacttctctaattcagttcatctgcctgagggatttcaagagtttcctgactgatctgctactcatggatctaatttctgcaatgcatctttcattctctaatggacttcttttcctaaaggtgtgtcagatcatgaaaatttcctgcctttagtcatcctacataaaagcagaataaagaacaaactccttggcctgtcaacctaaaaggacggttcctttccagaaccatccaccatgaaatagcatcatacaaattacactggagcctcaccagagtgtgcactgttcctgcatttccataaacccatgattttctaactttttgcctcttctgtactcaccaaagtgatatgtatccttaaatttcttccctggccttcacaatcagaataaattagcccttcatttcagaaccaacaccacttttttttaatacatatataagaacttaaaaataaaactacttttgtctactttgtgtcaagcatttgaataggtactttatatgctataattcatttaatcctcattagttgaatcttcacagcaactttacattttagagatgagaaacttggtctaattaaggctgaatggttcacccgaggtcttactaaagtgaagtaaacgtaggagccaggatcagaatccaagactttgggattccaaagtcaattttctttatacttcgcaaaataatttctacagctaattgtttatatgtgtctccctaaaagactgcaagctctcagctgagaatgtgaataatctatttcagcccactacctcaaccctgcaaacacacagacacacacagacacacacacacacacacacacacacacacacacacagagacaccctaattgggttacttccacaacagtttgactctgtaactgttgaggaggtgaatgaataaattatcaaggttcttacattaatacctactcagatcttatgatagatattaatgacaaaagaggtatttctgtacctgtctctgtggaacttgcaaacacagaaaagaacaataacaaaataacatcagttgtagcatttactagtccagaaatagctcacctatgaaacaaacacaattttaattcattttccccatcccctaataggaaaatagttctttctgtgggggccaagggaaaacttccctgtcacactctgaaggttcactgaaaatcactgacaaaaggcagattaacaagagaaaaggcatacaaattcatttggtcatagttttgcatgacacgggagccttcagaatgaagagccaaagagacaggagaaattgtccatttttatgcttagattcaacaaaggatgaacagctgtgttgaaacacgattgggcaaaaagggaatgatctaatggtaacagactgagtggggaagctcagcaacgcctgtctgtttagatttctgggcctctctgaagctttccttccttctgggtatgaggcaggcccctctctggaatgcaggtgttatgacctacagtcaaacaagtcagataagttctttacggctagtttttatacagaagtggggaggagtgtagggggcagttagagtagtatttttaggttttatggctggctttaggggaaaggggttctggcttctatgacccgccttcaggaaggggaattctagtttctatgcctaaccttgggggagagtaagaggccagagacaggagggaacgaggtcagagaaacatgcttctgagtccctcatattgggatatcattttctgagctttaacatttctgtaagaataatgacaactaatttgaggtgcagcactaaaaatagaaggaatctagcagctcttgaggggtccatcctgagttgctttgttctgatcacttagcatgtgatcttgctacctagaaaattattttacctgtggtttttctcattgaaacccaggccataaattccatcctgcactaccttccttccactcgatcacatttgcattttttggctgccacgagacttaccttgagttctgcttctttttttatttttatttttgagatggagtctcgctctgtcaccaggctggagtgcagcagcgtgatctcggctcactgcaacttccacctcccaggttcaagcgattctcctgtctcagcctcccaagtagctgggactacaggtgcccaccaccatgcctggctaatttttgtatttttagtagagacgggtttcactgtgttggtcaggatggtctcgatctcctgaccttgtgatctgcccacctcgggctcccaaagtgctgggattacaggtgtgagccaccgtgcccggcctgagttctgcttctttccaagatagatcctctggttttctgttgattctgtgagcaccaggtactccaaagaatatcatttcaacaaacagttttctgtttaaaccaatcaaagtaagatcctatggcttgaaattaagaatcttgcctgacataatccctgtctcttgataaacacaaacaggcaatcaccaaaccagtgccataactccacaactcaatttttaaaaattaaaatataataaatcccctctcttttcatttattcgttcgttcatggcaggtacatttctagataatgaagatacagttataaattttgatggattttacaattttcatatctttgttattggcaaccaaagggtataacatgcacagtccagacaaggaagttaatcagaaacagtaaaaacttatcttcccgaaatgataacctgaaggtcaaatacaacaggagctactcttgccctttcaaatggccaacaatctgaagatatcaactaaatgccaaatattaccaaaagtaaatactataggagttgcccagtttgttaggtgagagtttaaaggaaactttagaaagaatgagcctgaaatgatgggaggaacacaggtgtgtatagagaaggagggatggaaccatttatggtgaaattttctcagaaatggcacaaagaaaggagctcaagaatcacagtcaacacccaaggaggagggtaattcattggattgaaaggatcccagaggaataaaaagttgtagaagaaaagaccaaactattgcatttgctcaccaagttctagagaattattttatcctctaggtcacagagatgggctgcagggggtggatagataagatgtggtgtgcaagttcttaaaatatgtactgcatatcatacattttaggtgggtattggacaattttcttagtgaataaagaggaaattcatttagcaaaaatcaaaattaaggtaactctagcattctttttcctttctctctgaaaaggtaataattgtgatatctgccaatttataatagaaatgtttaaaaacaaaagaattaaacttagagagttctccttaaaagtcagacaaatttatcaacaaaagagaagaaaccattgtctcaagtgtctttttgttgtttctttattcttcttattttctgcaaaaaaaaaaaagaatgagcctatgaaaagcaatgttaatgatggcacactctggggttttcactaatgttttaaataggctttacatagagcagcaattatgtgagatgatatagttaaacagtatcgataataaaatattccatttgagcacctcaaaatactttggactaattcatattagaacatcttgctatcagaactgttgagtttaaaataatatacacatatgtatatgtatactcatatattatataaacacagttacacaaaagtaaatttatttattaatagattcatccctttttatctatggtcataaaattcaaggatcagtaatagaatccatagatcccctaaattcatttgtgatttttttttttttttttttgagatggagtctcactctgtcaacaggctagagtgcagtggcaccatcctggctcactgcaacctctgcctcctgggttcaagcgattctcctgcctcagcctccagagtagctggaattacaccactatgcacaccacgcccagctaattttttttttttttttcagtagagacggggtttcaccatgttggccaggatggtctcgatctcttgacctcatgatccacccgcctcggcctcccaaagtgctgggattacaggcatgagccactgtaaccgactgcatttgtcatcattttttaacatctttcttattcataaaccaattagctagtgggaaaaaattaattagcatttgtaggatatactttttttttttttgagacagagtcttgttctgttgtctaggctggagtgcactgacacgaccttggctcacttcagcctccaccccccaggttcaagtgattctcctacctcagcctcctgaactacaggcatgcaaccaccacacccagctaatttttgtatttttgtatttttagtagagacagagtttcaccatcttgcccagtccagtctcgaactctagacctcaggtgatccacccacctcagcctcccaaagtgttgggattacaggcgtgagccactgcacctggccaggatatactatcttgattttttcctaatcttaactttaaagatgctcctatgaataatactaataaggtcccaggtaatgagagagaacaaagggtaaagagtcttggtaattcccaggctagacaaatattaatagacctatggagaggtacaagacagctgacttgttagaactgtgcagtttgttactgaagccaaaaatttggcagtaatttctagacagtaatttcgtaagtgttttttttttttacatttatgcccccatgtttaacccactagcaaattcagt

SEQ ID NO: 2428 - DNA, 8117 bp, Homo sapiens
agttttattttgtatgcttggttctattaggtatttccaaacaaaagattatgagaaagcatgtagagaaaagatggaaggaagaaaaaggtattcatttttttgaaggttcaaaataaaggtgacattcataatggataatcatttttgaaaccaaaataggcagtgaatgattatccgaaaacattgttcattctaaaattgttagcatgcatctactttcaacatgttactatcatctacgatgtagcctcctttcccttggctaaatcagttccaaatagaaactgtcaatgaccataaggacatatttttattgctcctcatttcagatgctggatattagagaaggaagtagtatgtaagttaaagaataactaaaaagtagtttattcctgtgagcacagatgctatagtaaagacaaaaagaattatttttaggggctttttagaccaacaaaaaacaaaaggagaaagaggaattcaaattgaaaactggaaaacattgttacaaataatgataataataaaagatctaaagaacaaaagagcagcttattttcaaacatagctattattttagaaacatggaaaataatagctgaagggctgggaattgtaggttctactctgtcttctaagagctgagtttgggcatcttttatagcaaccaattttccatacactcagatggctcccaaggatcactgaattgagatgtatgatttaattttcctttcaaagattatgttcagattattatgccacgcacatgataactaattgtagggaaagtgtgtcaggccaggcttggtgaaaactgcagaggtttcagctgtgacacactgtacaaaatgtaagcattcagtcaagtcatatgcattgcaaggccaccactaccagaaggtggtcttctactagagtttgggtcttgaaaactagaatgcatgtcaaccaactaagaagagattcttagtaggcataagcctatgttcttgctgcggtttctactttagcaatgaataggttaatgtcaccctgtctctggcatttgtagtcacccatttccatgggatgacacctcattctggctaatcttgtgttgatttgaaacacagaatcctacctcatccctcacttgacctagtctattgctttgaaatgaatgaagtcttaatttagagatttcagcctatctgtggtcaccatagatgccactcgcaattcccctccaatgcaattatttctcttttgtgggttctactcccttttctcttcctccctcttggccacattctcctcctgtgacctcatcttgtatattttatcttctctttctctttcttttctcactcttgtttcttttttattctttgtctcttctctttctcttctcccttactcccttctattctcctgctagttaaaaccagagacacttgttactcttacatgtgaattggagaggtttctgctcctgggtttcacagaagttttaatgctacccatactggtaagttttaattgtatggcattttacaacctaaacaaatttcccacatatattgcattttttatatacatagcaagtctggagtataggaatggcagagattattagccccaattacaaaaaaaaattgatgtgcatgcaagattgtgccttgaccaagttcatactgtcagaaatgtgtagagtaggggtcaatcaagcctggcacttctaattcttgtcccatatttatactattccagtttgccagtttcatttattctcttaagggccaaaaatcgacacacagcaactctctttctcttgttttaattgtaaaagagtctagtttaccaagacactttagaaaaagtgatatcacttccatgaagggttttaattcacccatacaattaacagttgttaatttgttatgcgtgtggcactttgctatgctgtatgatggataaaaacaagaataaggctggggccctgctgtctgcaacatagaatgactggatgaaaatgacaccccagtggaaagaccattttgggaacagactcttttccctattagatcttaagcttcatggatgcaaaataaaatgtggcttattcacccacgtatttgtttattaatttattcattaaatttatttatagtgcacttttaccatagaccaggagttttcctaggcatttgtatccataaggcttgaaatcaaatagggaaaagagtaaagttaaaaaaacaaatgaacatgtaaacaaataaatagtaataaggtagtttcagatgctaatagatgtaaggtgaaaataaaactgggtcatatgataaaatacttgttggtgtggggagaatattagttgaaggaaagaataatgtctgaatcaagcttggaattgaaagaagaagttatgtactaacagtaagtgaacatgaatgacaaaaaagacaactgttacatttaaagtccagttggggttttaaaaatctgacccacagagatttcccaaaggagctaatttctctcttcaataagtaccataaaccatacataattatattaaaagataaaactaagtaaaatgagacaactgcataaaaaatacataatcatagataatcagagtgggcatgaatcatgatatttcacaatcacaaatgcctttgacctataccattatagaaactaatagttgaatggaaacttgatggtcaattagtctggggtctctcaactgtggaaataatttctacaaactccatgactaatagctgtctaatttcgcactgcatatttccacattaggggcccataactccatgggatagttttctttttgctagattgacagctttaactatcagctatttctttaaattcaacaaaaatctgctgaattcctcaaattggtcctagatctattctctggaacaacacagaatccactggctacagtgcatcatatatcagctcttgtcacccaggctggagtgcaatgggaccatcttggctcactgcaacctgtgcctccctggttcaagcgattctccttcctcagcctccctagtagctgggattacaggcatgtgccatgacacctggctaatttttgtatttttagtggagacagtgttttgccatgttggccaggctggtcttgaactcctgaccttgggtgatccacctgccttgggttcccaaagtgctaggattataggtgtgagccaccgtgcctggcctcaatgtttctttttatatactgtgcatgtatattattttcatgaaatacaatcctaaaggaaagagagtatattaatttaaatagtttagcatattatatcaaccattgtattgagtggaccagaactgaaaatatgccttttgtcaaaaactataagtctatataagttacatatgagtatcaaataaaattatatgtatggacctgaactatggcaaatttttaaatagtggatcttagagcatgtgcatgatctagacctgcactgttccacgcaggagcccctagtaataacatgtgtatattttgtacacacatacacacatcacacactagtattttgctaacgcgcttttaactgataatttcaaatgtttctgcaagaggctttgatgtcaatgaaaaccttttagtcatttgaagtaaaaatatttttctattgatataaattatttcagcattgaattttattaaaacaagtatgataaaggttgtaaagtttaatttaggcaccacattgtcaaaaaatacgaccaagttttttagattttgtgttagctgtgttcctagaacatctgttatgctattatgacaggtgtttattaatatggatgtctaatcaaatctcttggttgctaatagcttggcaattcaacatctaaatattgtcaaaatccttgattatatgttgaaaactgtggataattgattcaaagctgtttgccttgactagattaaaaaattaaaacctgtcaagtgtattaatactttcctttaaaacctcaacattctcctgaaatttctaaaatgtttcagtaataacaacttgtgaaggaataaaagtcttctacaggccaacatctgtcctgatccaagtttccttagacctttcattatacgcataattttttttttttatttttatcatgggctaggaatgaatgcacagaaggggagtaacaaaatgaaagtcctacgctacatacaaagaatgccctacagaaacgtgttttgggtgcatttaagctcagatttttaaaattaaacttttttgaaagtatttaataatttctgaatagtagaagcctgcaagaagcaatttggtggccttcagcaatgtggttgagtagcttcaatgggtgccatttgcagctcagttactgagctggaatttccttttgaatgtacaaaggcattacataaatctctaggaaggttctgtggtaatagcattcaatggaaatctttaaaattcttaaataacgattatagatttgaaaagttcccaatttatttccctctgacagagtagttctctcacttctatgagatagtctgccttttagtaaatgctttaatgactataaatgtgtttttggtctagtataagtactgtccaataacacttttgacaataatggacatgttttccatgtttccactgtgataaccgctaggccaatgtagctactgagtacttgaaatactttttacaactaagaaaaaaaagtttacattgtatttaactttaattaatttgtacttaaaaagccacatttggctaggggctactgcatggaacaatgcagttctagatcacgctatataactttttgatttgccaggtgcggtggctcaatgcctgtaatcccagcactgtgggaggctgaggcgggtggatcacgaggtcaagagagcgagaccatcctggccaacatggtgaaaccccgtctctactaaaaatacaaaaattagctgggcatggtggcgcacgcctgtagtcccagctactcaggaggctgaagcaggagaattgcttgaacctgggaggcagaggttgcagtgagccgagatcacaccactgcacttcagcatggtgacagagcgagactctgtctcaaaaaataataataataataataaaataaaataaaataaactttttgatttaataaaatttactttattggagttcaaaatgatgctaaatgatttttaaaaatacatacttgagctagaattccttgattctatcaggagaatattaaccatatcaacacctaatagactagtctttctaggcattgtttgctgtggtagaaatgaaaccactatagcaacagatagttcattaaaatagggatatattcagaatattgtccacatgacctaggagtgacaaactgtaacttccaagctaagttaggacaccacttgcttttgtgaataaaactttattggaacacagccacattccccacactccttcatttatgtattgtcaataagtgcttctgtgttacaatagcagaattaagtaactgtgactgagattgctgggttgcaaagcctaaattatatactggtctttccatagaaaaagtttgccaactttttcgttacctacataaatagcagaattaagtaactgtgactgagattgctgggttgcaaagcctaaattatacactggcctttccatagaaaaagtttgccaactttttcattacctacataaatgcttatgtgtaaatattaggataaagtcccttttatggagaagcacattcttctcagttcattcaccatacttaacacatataacacacattgctaattcctgtatcttttcatatatatgtaccatataacatgtaatatgttagatatgaaattatatgtacatatatatgaaaatatgcagcaatttagcaagtatgatactaaatatatatgttaaatatttagcaaataaacctctatgtgctttcactcagatcacgggaatttaatgcacaaacaatgatttatagcatctgttttctaatttaagttaaaggtgtgagctaacatgtctctccctagatcttgataatcagatagtatcagagctagagtggaacatgaaagtgcattccaaactcattttagagacaatagttgggagatgcctaaggacacaaagagataataaccagttaatcaactatttaatagctcatttattgagacacacctatttatgtaaccagccagaaggcctagtagttgttttgtaccattcagaaagacagtgccttaagagcccaggctgcagactgggagcaaaaccctttgtgttgtcacagtggctgtgctatgaatgacatatgcccttacttcaatccaacagggaagaaagacgattcttccctggaacacttatggtctatcatttagtgaaagaagcagttggcaaaactcaccaataatctatctatcccagagaagagtctctatctgctccattaagcacctgtattttaggctttattatttatttttacagtaattttgaattgttttgaagactgtctccaaaatagaaataaccccacttggattactgtctaaagagtgagtctaattccattgggattctttttaaaaattctattcattgataggaaaaaaaatctttaacttaaaagctactttctgacctcagtagaactagtccctatttttccttctttatacaggcaacatatcataaaagagatgtgcttctattctcatctaaaatattaagttttaaggtaaaatatgacagtattattttcataagatattttcattaaaatcatcatagatttctgggtgtcaaaaatagaaattacaattgaaattaaagtataatgacagaaatgtaaatttcaaattctgcattagtataacctctaacctttaccagaataatctcacttatcagatacttaaataaaaactaatatctcaacttagtatatttttctctcccttttttcaatctaacaatatggaacttgagtttataatacaataaagttcaccatataatctgaactacataaatgcctggactatattgccttttcttcagcaacatgtgtcgatttagacctttgattggattgtggaatgcagtaacagaacaaactaatcattacaattacattatatcatacaaccaagaataatttataatatgcttcttgtactttttggaatcattgttctcataccagtgtggtgccttattaatcctatgaagtcagtcatatggtgataaaacagatacaaaagacttgccttaatatgttattattattgacttagctctgaccacaccacctgatggacaggttccaagtaaagacctagatagtcaaagtgagtactattagtagacttgaaacatttaatttctgttggaagagatgactaaagctctccatgaattctttatttatatcacaatctgaaatattattaatattattgaatgaattttatttgaactggaagaaaaaggtaaaaataaagtcactatagtgctatagctgtgaaaatttggctgacttacaaaatggcagtgagttggtgaattaggacaagtggcttccagagactaaagaacctctaaacttttatcatcaacaggcacatttaggatggatcatcctaaatatcacttaatcatgtggccaaacagaactattgttaaccgacaaaatgctatgcattgaatttctggtttaacaaatgagaaaatgggttttgtttacagtggcagttcagaattacatacttataaatattgaggttagggtctattaatgggctgtttggttctaatcatctgaagaataattcattttctcacagagatacacatgatttgctttcatatcctatacggcctcctttatgtttattcaattttgttatcatagtgaggtatatgaaagcccatgagctcggaaggtactatctttgcatcatcttaatcctttggccataaaagaaaatgattggtcctatagaggtctcctcaacttcgtccagaaacaag

SEQ ID NO: 2429 - DNA, 18372 bp, Homo sapiens
acattcttgagatgagatatagtatctttcctagccaaacataacttctccaaagccaactttttccacatgctttagagtaagaaagataatatttttagagatgttgagaacttttaggctttatcactaaaactgaattcacccagtgaagaggaaccctaaggaaaatttcaaacataatgtcttcccagtgaatttcatctttactcctgaatctgaggcaataggctactttctcccttattaaacataaagaaaaataattacttaatgagagaatatatagccattctcaataaaagcaactgggattccacaaacattactatgtcatgactgaatgaatgaagtgctaagataaagagtttagaaagaatgaaaaacctaattacttataggaatctgtgtgattaagtctagaaaaataaaaggaagaaaagtgcattagtctaatgagatgtagacaaaatatttaaaattggctcaaagtgtttggttgaattatcttgaataataaaagattaaatttcctagaaaatctttgttccaaagtaaaatgattttctgattcatgcttttgaaactttataaagtgaaacaaaagggcattttcctattctttttagtgttgaaaaatggtaactgggcctcagcagaactgaatttgggaacctaaatggcaaacctaaaaattcacttaaagaaggtgaattaggaaactttgttcctcataacagagctccagtgcttgagaactaaagcataaaactactttctgtgaactgtagagatagatttctgtaagatgtctgactcctccattaggaactagtgatccacatttttaaataagcaggaggttcatggatacagatcccattttttgagaaatgttgacctaaacaacacttacctgttctgttgatgcagaatgaaatcaggtaaactgccctaagcttcctcaagatctactcaagctcagtttatcctgttagcctatatctatctctttttctttacacattttttaaaagcaattttccctaatttcatatcccatgatttggagtcgattgtccactctcaataagaaggtatttctcctacagctctaactctggaactgttttatgaaagcttgcaaacagttagtaagcattacactcacctctgaaagatttttcctacctgtaatttaatttagctccaagctatagcacgtgaatgcccctgcattctttatatgactctttacgtcaagtctctacacactggattatatgaagatcccctatgattcacacagtcaataaataaatcaacaaaaatgtagaaaggaaggaggaggatccagttttagatagtaaagatcagaaagaatagtctacatactttatcaaagcgtactgcaatgaaaagtgtaagcatgactactttcaaatgcagattcctagcatgttcatttcctttgttcttcaagtattcatggaattaaagaaacaggaaacaatcagttatgtatattagtgcttccttcactgcactaggtcatcataagcttctgatgaccaaacagaactaagactaaaatggctgatgttcctaaaaacctcccagttgacccagataataagctaggatcaaaaataacaacaagccaatgcagcttttttctctaagaaattctgttattgctgttattagatttacagttacattgggatgctaagatttcttgctgtatttttatggtaattgcagttttatatacataatatcatcaacagctcatatattctgtgggctggttttatgctgggttggatttaaatgctcttcaaggaactgtacttttttgtccccatttaaaaagactgtagacaggtcagataataatagcaataactcagaaacctgaagattagaaaattgaataaggctgattctaaaaaggcatggaaatttcatacccatgctattttgttggctcactgagtacatgatggagtaaaaagaacattgaaactaaaatctgggaacatcagctctaatttcagctatcacactgtcctttaaggtcactggcctccttgggcctcagttgcctcatgtgaaaaatgagaggtctactagattatacatggcacttactttcatctctcacatcaattacaatcaactgataatggctggctgaagcactgtgttaagaaggattatgaggctgattctggacaaaagtagagtgtcatgggtgatttgctaagtcttccataaggacattgaggaaatagctgtacatatgcaatatattttccttatttgacccaaaggaccactaggatttcctttagttacagtctataaagcatattttacaataaaatatcataagatcctttatacaaaatgtttggtcttgttgcttcctccagccacccaagctgctgaaaggaaagaaggccaaggcagagaaggtggttctagtcccttatcataaagaagcagaaggccaacaaggtggtgaatcccctgtttgagaaaaggtctaagaattttggcattggacagcacatccatctcaaaaggaacctcacttgttttgtcaaagggccccactgcatctggctgcatcagcaaaaagctatcctctatgaatggctgaaagtgcctcctgcaattaaccagttcatctaggctttggactgccaaacagctactcaaatgctgaaactgacccacaagtacagagcagagacaaagcaagagaagaagaaagctgctggcaaagaagatgttcccactaagataacacctgtcctttgagcaagggttaacactgtcaccaccttggtagaaaacaagaaggctcagatggtagtgactgcacgtgatgtgggttccatcaagctgattgctgagggctcgccctgtatcctaagatgggagttccttactgcactatcaagagaaggcaagcctaaaagacatccagtccccaggaatacttgtgccactgtggccttcacacatgttaactcagaagacaaaggagttctggctgagctggtggaagctatcagtactaactacaaggttagatataatgagatctgtcagcactgaggaggcaacatcctgggtccaaaatctgtggcttgcattgccaagctagaaaaggcaaagactaaagaacttgccactaacctgggttaatgtacactgttgagttttctgtgcacaaaaacaatccaaattctttaaaaaacagcttggttgtatagattatctataaaatgatttctatattgaaaatcacttaacttcatgacactgtttcctcaatagtatacacacacacacacacatatacacacacacattgatgagaaaaaaaaatctactgccagccagagccactgtcagtatggggtttccacattctccccatctgtttgagttttctcgtgggacaccagtttcctcccgtatcccaaagatgtccacattagattaattattgtatctacaatgtccaagttggagtgagtgtgggagtgtgtgtatgagtgaggctgcaatggaatggagtcctgtcaagggctggttcctgccttgcaccctgacctgccaggataggcaccagccacccacaaccctgaacaggaataagcaggttggaaaatgaatgaatataaattattgtaaaataaatttattttgacaccaaacagtggggtccaaaagtgctcagcaagcctgccatatttattgtttgtttttgaactgtgtggtgataggaggtgctccttataattctcactttgcaaacatttattccttgattcaacccatcaccactacaaccactatcactcactgattcaccaaaacttgggtaaataattatcttacttgtttttattaatctttcttgaatgtatgtttggctcacatttatttcaatgtttaatattaaaagtgttttgagtctttacttagaagtttgatatttctatgacaaacatgctgtaggagcttactgcttgtttatgtaaattagcctaaggtaaagttagttttattacatatcattttgcttaaagttgtagtctccaagaacctatcgacaacgttgagaacttactgtgtgtaaatgtgtgtatataaccttgttttattgtgcctcactttatggcacctcacaaatagtgtttttttttttttttacaaattgaaggtttgtggcaaatcggtgtcaactgctatttttccaacaccatgtgctcacttcctgtctctgtgtcacattttggtaatttccacaatatttcaaacttcttcattattattatatctgttacaatgatctgtgatctatgttaccatcgtaattgttgtggggcaccatgaacagcacccataaaagaaagtgaacttaattactcaatgttttatgtgttctggctgctccaataaccagttgtccccatctcctccatctctccttctcctagggcttttttattccttgagatacaatgttgaaattaggccaattaataatcctaaaatgactctaagtgttcaaatgaaagaaactgtagcaggtctgtcactttccaccaaaagctaaacatttccttaagccaaaacctaacccagagcaagacctacctcttttcaattctatgaaggctcagagaagtaaggaagcttcagaagaaaagttggaagctcgcagaggttggtttataagatttagggaaagaagtttccttcataacataaaagttcaaggtgaagcagcaggtgctgagggagaagctgcagcatattatccaggagattagcccagataattgatgaaagtggctacactaaacaacagattttcagtgtagacaaaacacccttttagtagaagaagattccatctaggactttcagagctagagaggaaaagtcaatgcttggtttcaaagcttcaaaagacaggtggactctcttgctggggctaatgcagctgatgactcttaaagtcatcaacttaattgaagccaatgttcatttaccatctgaaaatcctagggcccttaagaactgtgataaatctactctgcctgtgctttataaatgtaacaaagcctagatgacagcacatttgtttatggcatggtatactgaatattttaagctcactgtggagacctactgctcagaaaaaagattcctttcaaaatattacagttctttgacaatgcacctggtcacccaagagctctgatagagatatacaaggaaataaatggatttttcatgcttgctaacacaacatccattctgtagcccatggatcaaggagtaaattcaactttcaagccttattatttaataaatacatttcataggctatacctgtcatagatagtaattcctatgatggacctgagcaaagtaaattaaaaaccttctagaaagaattcaccattctagatgccattaagagcattcacgattcatgggaggaggtcaaaatcagcattaacaggagtttggaagaagtcaattccaacctgcttgaaaaactgtgagggcttcaagacttcaatggcagaagtaacagtaaatgtaagagaaatagcaagagaactggaattagaagtgaagcctgaagatatgggtaattgctgcaatctcatgataaaacttgaatggaggagtagttgcttctactgggtgtgccaagaaagtagtttcttgagatggaatctactcctggtgaagatgcagtgaacactgtttaaatgacaacaaaggatttggaatattacataaacttagttgataaagcagtagccgggtttgaaaggattgaccacaattttgaaagaagttatattatgggtaaaatgctatcaaacaacatcacatgctatagagaaatttttcattaaagtaacagccaattaataggtctaacttcattgtggccttatttttaagaaattgccacagccacccaacatacggcaactattaccctgatcaatcaacagccatcaacattgaggtaagacccttcactagcagaaagatcatgatccactgaaggctcaaatgatcattagcatttagcaataaagtatttttaaattaacatatgcacagtgtttttggatataatgcaattgcacacttaatgggctacagtatagtataaacataacttttatatgcactgggaaatcaaaaaatttgagcgacactttattgcaatatttgctttattgcagtagtctgaaataaaacacacaatatctccaaggtatgcctctatatataaagagagggagacctaggaaaatacttgaaatgtattaattaatttgtttcatcttcaggagccagattgtgttaggctattcttgtactgctgtaaagaaatacccaaggctgggtaatttataaagaaaacaggtttaattggttcacagttctgcagactgtacaggaaacatggagctggcatttgcttcttgtgagggcttcagtgagcttacagtcatggcagaaggaaagggaagctggcttgtcacatggtgacagcatgagcaaggtgtggggggaggtgccatatacttttaaacaatcagatctcatatgaactcaaagcaagaactccctcatcactaaggggagtacaccaagccatttatgagggaccgagggacctgcccccatgatccaaacacctcccaccaggccacagtttcaacactgggaattacatttcaacatgaaatgtggaggggacaaacatccacaccatatcagagaccaattcttctctttattatacaaatgccaataaagcccaggagagaaaataacagaaaaaaaaattgtagctaatggcaatcactgataaggaatcataaatgagactcagaatatcttaaaatagttgtgcaaatgacaggaaaatcaaaacaaccttcttccagtaaatgtctcatgaagcaattgtgtataagcaaactgcagtagcttgcctacaatagctaacaacatcatctcacttaagatggatgaggtaaaagacatttctgccaatcttgctgtagccaccaaaaagcaaaaaatatgtaacagtcttttcgatgtcaacatttctttgatgatatctgtaaacatttgtttccatgtaacaagcaacctattcttcaaccaatgaatacagcatgagataagagtcataagacttgaagtttgctcccctctttcatggaatcattggggtcttcataacccacctaacctcagctgcctcaataaattatgaaagttgaccaatatttctcttctagctcataagaaaatgaattgaagtcttgtagaatggagaagtggctgagttgcaaaaatccttggagaggctctagaccaggtactggttgtcacctttacatggccatggtgggcttcttgcaatcactcattcttcaggataaattctatccctgagcaaagaaagcaaaatcttgtccttattaagactatatttttattgtcttttttttccaaagtggacataaatcctagcttacctattagtaatgcacacataatcacatcaagtttgggcaaagctaatgacttatccaatatcacatggtggttcaataaagaaattaaatatcacaattcccagatcttgttccaactaaataatggcaatactgaagcaaaattaggatatacacgatatatcctaaggattataggcaaactcaaaagcctacaatgtttagttgttggagttagagtgacaatcagaaatgttaatgtttatccaactccggtattccataaaatatcccagtttcatgtcaaataagttatacctacaatactttttactacggagaactagaaaaatctaaaatgaaaagagaactaaatacaacatgttctgatatattatgctctaggcaatgatcatgttcctaatttacaaagtccatgaaaagaatactcttatgttgaaatagctgttattaaaagtgagtgctcttacagtgaaaatagatcagatgtaacatatctctaagaaattattgttgttctagccattactttgtgaagatgtgctttgttttgattgatttagaaaattgtaataaataagaactgttcagttggaatatgatgtttattccttatgccaatatacgaccaaaaatattttctcacttcagcctagaaagtgagatgtgtattatttatctccaaataaatgtgtaaaaagatgtgtgctttcagtttttcttctttatcccaaaatatttaaatgcctaataaaataatattgttcattaatatattaattgtcctgcttatattttcagtatccaattagtcatttcaagtatgagatatagaaaagaatgcttggaatgtttgctatggctttgtacaaataaaatataatacctaacaagggcaggaggaaggaggagggatttataagtttgcttattgtatttttaaaagtcaaatttcatttaaaattatgtttaaataatattaccagaatattccaaaataaaagtcaaaggtaagaaaaataatgttaaaatcttctcaaatttatgaagaaaaaatgaagtaaaaaataaaaaatcttgtgaaatttatctggtctttcctgaagctctttggtatctccatagacatggtttgaatgcaaaaaactgcccatgcagtgtctatgataagattgcctttaacacactcagcatgctaatatatcaggttcaaaaaatgatttcataattgttttacttaagactaacaggcaaagattgtcctgaatttgctgctctgctgtgtttttgtaggaccaaatcccaggtgcagtttggcctctaagaggcataatctgctccaggaaagccaatcaggaagtcttccttttaactatggcacaaccgttcagattcacctgctactgctgtttccccagaacttctactctaattgaatgtatcaagttgttaagcaattttacataagatgtggcttaaaataagtagctttttatatagaatgaaatgttctgatgaatatagtattacactttgaaaaggaagaaaaacatctagtggatattgtcatgtttgatatttctttttggtgtcaatggaaactgaatagtacatttttttcaacttttactacatattaaagggatggaggaagtagaagcgtaaacagagtaaacagggatggcaagacaaaggagtgttaagtcctcgaggattttacaatctagttattgaaataagacatataggtttttatttattttttcaatttttaatttttgtgggtacatagtaggtataaatatttatagggtacataaggcattttgatacaggcatggaaagcataataatcacatcatggaggatggggtatcaattgtctcaagcatttatcctttgtgttacaatcaaattacacttttagttatttcagaatgtataattaaattattattgactatagtcactctgttgtgctgtcaaatagtaggtcttattcattctttctactttttttttgtacccatttaccatttccatctctgcgtcacctccccacaactacacttcccagcctctggtaaccacattctactctccatctacatgagttcaattgttttgatttttagatcccacaaataagtgagaacatgcaatgtttgtctttctgtgccttgcttatttcacttaacttaatgatctccagttccatccatgtggttccaaatgacaggatcttattcttttttatggccaaatactactccattgtgtatatgtaccacattttctttatccattcatctgttgatggacacttaagttgcttccaaattttgtctattgtgaacagtattgcaacaaacatgggagtccagatatctcttcaatatattgatttcctttctttggggcatatacctagcaatgggattgctgcatcatttggtagctctatttttagtttttgagaaacctcaaaactgttctctataatggttgtactaatttataatcccaccaagagtgtacaatgactcccttttctccatatcctcattagcatttgttattgcctgtcttttgggtataagccattttaactacggtgagatgatgtataattatagtcttgctttgcatttttctgatgagcaatgatatttagcaccttccatatgcctttttgccatttatgtgtcttttttttgcctcaaactccatctattctacatagctattccagttttcttttgattcgtagtttcccagtatatattttttattcttttaatttatttatttttcttctttttttttttttttttttttagacagagtctcactctgtcgcccaggctggagtgcaaaggcgcggtctcggctcacggcaagctccgcctcccgggttcatgccattctcctgcctcagcctcccgaatagctgggactacaggcgcccaccaccatgcccggctaattttttgtatttttagtagagacagggtttcaccgtgttaagccaggatggtctcaatctcctgaccttgtgatccacccacctcggcctcccaaagtgctgggattacaggcgtgagccaccgcacccggcctgttggttgtatctttagctgagtgaatgatttgcaacttgacgtgatcccatttgtcctgttttgttttaggtgcctgtgcttgtggggtgttactcaaggaatctttgcccactccaatgtcctggagattttctccaacgttttctgtagtagtttcatagtttgagatcttagatttaaatattcaatccattttgatttgatttttgtatatggaagagataggggtctagtttcattcttctgtacatggatatccagttttcccagcagcatttattgaagagactgtcttttttcgccaatgtatgttcttggcacctttgtcgaaaatgagttcactgcaggtgtgtgaattagtttctggattctttattctgttccattggcctgtgtgtctgtttttatgccagtaccatgcagtattggttactatagctctgtagtaaatttgaagttaggtaatataatttctccagttttgttttgttttgtttttttctttttttggatggctttggctgttctggctctttcgtggttccacataattttccttttcttttgagtctgactcttgctctatcacccaggctagagtacagtggcacgatcttggctcactgcaacctctgcctcccacgttcaagcaattcttgtgcctcaggcttctgagtagctgggattacaggtgcaccaccatacccagctaatttttgtatttttagtagagacagtgtttcaccatgttggccaggctggtctcgaactcctgacctcaagtgatctgcccgccttggcctcccaaagtgctgggattacaggtgtgaggcaccgcgcccagcccatataaattttaggatagtttttttctatttctgtgaagaatgtcattggtgttttaatagggattgcattaaatatatagattactttaggttgtatggacattttaacaatattgactttttccaatccatgaacatggaatatctttccattttttggtgtcttcttctatttctttcatgagtgttttatagtttccattataaagatctttcacttctttggttaagttaatttctaggtatttaattttatttgtggctattgtaaatgggattccattttaatattttttcatattgttcactgttggcatatagaaatgctactgatttttgtatgttgattttgcatcctacagctttactgaatttgtttatcagttctaacagttttttggcagaatatttagatttttccaaatataagatgatataatctgcaaacaagcataatttcacttcttcctttccaattggatgctctttattttttctcttgtctgattgctctatctaggacttccagtactatgttgaataacagtggtggaagtgagcatctttgtgtgttccagatcttagtggaaaggctttcaattttttctccattctatatgacagatccccagctagtataacactacagcttttattatattatatattttatattttattatattatattaattatactttattttattatagtataatactatagcttttattatgttgaagtatgctcattctatacccaggttttttagggtttttatcatgaaaggatgttaaattttatgaaatgctttttcagcatcaatttcaattgaaatgaatgtatgatttttgtccttcattctgttgatatgatatatcacattgattgtttcatgtatgttgaaccatccttgcatcccagggataaaatccacttgttcatgatgaatgacctttttaattaattgttgaatttggtttgctagtattttgttgaggatttttgcatcaatattcatcagagatattggcctgtagttttctttctctttttttttctgatgtgtctttgtctggtttttgacatcagggtaccactggcctcaaagagagagtttggaatttttccctcctcctctattttttggaatatttttactagcattggtattagttcttctttaaatgtttactaggattcagcagtaaagccactgggtctgggcttttctttactaggagacttttactacagcttcaatcttgtcacttggtattgatctgttcaggttttttatttcttcatggttcaatcttgataggttgtatgtgtctacgaatttttccatttcttctagattgtttcaccttattagcttatagttgctcatagtagccactaatgatcctttgaatttctgtggtatcagttgtatgtccccctttttcatatgtgattttatttatttggatcttctctcctttttcttactctgcctaaaggtttgtcaattttgtttagctttttaaaacaccaactttttgtttcattgatcttttatattgttttcatttcaatttcatttatttctgctctaatctttatttatagtttcttctactaatgtggggtttgcattttctctcacttttccagttctttaaaattcctcattatgttatttatttgaagtttttttttcttttttgatatagacatttatagatataaacttccctcctggtactgattttactgcattccacaggttttggtatgttgtgtttccattatcatttgtttcaaaaaatttttcaatttccttcttaatttcttcattgacccagtggtcattctagagcaggttgtttaatttccttttatttgtatagtttccaaaattcctcctgttattggtttgtagttttatttcttgtggtcagagaagatgcttgatatttcaattcttttgaatgttttaagacttgttttgtgacctaacacatggtctatccttgagaataatccacgtgctgaaggaaagaatgtgtattcattggatgacatgttctgtaaatatctactagatccatttggttcatagtgcagattaagtccaatgtttctttgttgattttctgtctggtagatctgttcaatgctgaaagtggggtgttgaagtctccagctattattaggggcctctctctttagctctaataatatttgctttatatatctgggcgcttcagtgttgggtgcatatatatttaaaattgttatatcctcttgctggattgatgcctttatcattatatagtgactttctttgtctcttcttattgttttcgccttgaaatctattttgtctgatataaatgtatctacttctgctcttttttagtttccatttgcatggaatatcttttcccatccctttatttttagtctatctgtgtctttataggtgaagtgtgttttttgtaaggcacagatcaatgggtcttatttttttatccattcagccactcaatgtctttcgattggagagtttagtccatttacattcaatgttattattgttaaaaaaggacttactcctgccattttgttgtttgttttctagttgttttgtggtcttctcttccttctttcttcccttcatgtctccctttgaatgaaggtgttttctctggtaatgtttagtttcttgttttttttattttctgattgtatccattgtatatttttggtttgaggcttccatgaggcttgcaaatactatcttataacctattattttagcctgataactacttaagttgtttgtagaaagaaagaaacaaacaaaaagaaaactaataaaaactctatactttgttccctcactttttaacttttttgtttctatttataccttattgtactatctaggtctttaaaagctttgtagttattatttttattggctcatcctgtagtctttccacttaagagtagtttatgcaccacaattacagtgttataatattatgtgtatttctgtgtacttactattatcaatgagttttgtaccttcaggtgatttcttattgctcattaatatacttttctttctaattgaagtactctcttttccatttcttgcaggacaggtctggtgttggtgaaatccctcagcttttgtttgtctgggaatgtttttatttctctttcatctttgacggatgttttcaccagatatactattctagagtaaaagtttttttttccttaagtgctttaaattaaattaatgaataaatggaccttattagaacagacgaggcttggaccttaaagggcacactgtatatggacaagtagaaaatatggagagagaaacttctagttataagtgagtttctgcaggccttcctaatctcgtggcgatagatgagagttcattaatagaaataatccaaatttcttccctcaactatctaatgtcaggtctccttcctgaagaatttctgtgaagccttaaagagtgtcaagatcattccctcatgaacttacatttagaaaccctttcccactgatatcaatgccacatcattgtccctcctgcttgtgccctcagcttgagacagcagatgtgatactcaaagagctgcctgcctccaagggaccacagaggcattctatttcctgcagtcctccctgagtcagaatcactctaatgagttaaaattatgagaatttttttattattggaggaagttattttatctaattcttgatctacttataataagtaatcctagaatttttttttttttttgagacagggtctcattctgtctcccaggctagagatctcagctcactgcaacttctgcttcccaggctcaagcgattctctagcctcagcctcccaagtagctgggactatgggcatgagccaccaatgcccagctaatttgggttttgttttgttttgttttttgtagagatggggtttcaccatgttgcccaggctggtctggaactcctgagctcaaagccattttcccacctcagcctcccaaagtgctgggattacaggcatgagacactgtacccagccagtaatcccagaatttttacaaaagctcctattgttgcataatgaaacagtattctcttgccattatttaaagtcacttttttcactttctggtaaaaaaattcgttcaatcattgacaaatatttgctgaacacccactctgtgccgtgtactactatgttaggtgctggatatatgttgatgaatgaaacaaactgtatccttgtagaatttgagtctgctgaactcagaagtaaattctttgaaagttaggatggatagtaaagttgagtactcttagtttcaatatttaacatgttgctcttatcaattttttagtaaatgttagtgtacaaaggtaatttaggttttgaggtgtatccagaaaaatctggtttttttaatcaagagaatccactcaagagactactcatagaaaagaatttatatgatgcatcagatagaaagtaaaatttagtgttttcctgaaaaaaaaaaaaaaaacacaaaaaccaaatacaatggaggcttctcttccacattctgtggcatttgttttttcaactaaacaccaacactacactcatgaaaacaactccttcagcactacctgtactctgcttcaccaaaccagaaacgtcaatataaaaaacaagcagcatgccaaaggtcaactgatcttcaacaagggtgccaaaaatacacaatggggaaaggatagtctcttcaacaaatggtgtaaaaactcatatccatatgcaaaaacatgaaattgaacccttacaccatacataacattcaactcaaagtagattaaagacaaacataagacctgaaactataaaacttctagaagaaaacatagtggaaaatcttcatgaccttggtcttggcagtgatttcatgaatatctcatcaaaaacacaagcaacaaaagcaaaaataaacaaatgagcccacatcaaaggagaaagcttctgcacagcaaaggaaacaattgacagggtgaaaacgcaacctacagaataggaaaaaatgtttacaaaccatatgtattagtccattctgcattgccataaaggaatacctgagacagggtaatttataaagaaaagaggcttattttggcccactgttctgcaggctgtacacaaagcgtggcaccagcatctgctcccagtgagggcctcaagaagcttccaacaatggtggaagggaaagggggagcctgcgtttcacatgataagagagagagcaagagacagagggaggaggtgcccggcacttttaaacaaccagatcgcacatgaattcacagaatgagaacccacttgttactgcaaggacagcaccaagattttcataagggatctttccccatgacccaaacacctcccattaggctcacctccaacattggaggtcacatttcaacgtgagatttggaggggacaaaacatccaaaccatatcaccatatatctgataaggagataattcctaaaatatataaggaactcccacaactcaacagcaaaaagactaataacccaattttttaaatggggcaaaaaaacttgaacagactatgtcacagtatctatgtgaaaatatacgcaacatcattaatcatcaaggaaatacaaatcacaaccacaatgagatatcatctcacacctgttagaatggctattatcaaaaagatgaaagataagtgttgtcaaggatatggagaaactggaacctttgcacactgtcagtggaaatgcaaaatggtatggccgctatggaaaacaacatgaagtttttttaaaaattaaaaatagaactaccatatgattcagcagtcccactctgggtatttatccaaaagaactgagatcaggacttcaaagagcaattagcattcccaggttcattgcagcactatctacaatagctaaaatgtggaaacaatctaaatgtccatcaacaaatgaatgaataaagaaaatgttgtatctatatacaatggaatattattcagcctttaaaaagaaggaaattctgcaatatatgacaccagagatgactgaggaaattgtgctaagtgaaaaaagccagtcatcaaaggacaaatactgcatgattccacctatatgaagtatcgaaaatagttaaattcatagactcaaagaatggaatggtgattgccagggactcaagggagaagaaaaagggaagttgataatcaaggggagtaaagtttcaattaatcaagataaataagttctagagatctgctgtacaacattgtacctatagttatcaatactatattgcacacttaaaaaatttgttgaaagtagatctcatattaaatgttttacaacaataaaataacataaaaaataaaatgacaaagaagcatgctgtaatggctattccaggttatcttccagtaggctttgctaattgatttcctccaacctcagcctagagctcccaggcaaagcaactccttatgacctacacagttgttcaacactcatactcagacatggattaatcacacttaagtgggaacccctacacaggaggattaaggtaaggtatcagggcactcagtatatcagcttaattatgtcagaagatttgtgatgatgaactgtgacagacaaggctagtcaaataagatgagtcctgttgcagatggtaa

SEQ ID NO: 2430 - DNA, 12921 bp, Homo sapiens
ttctgtaggtggtaattccaatgtcaattaagtttgcacagccttttctatattccctgaagctgcccagtgcatgcattagtcaaggcttcatctaggacttgggccatggattatattgtggatcattctggataccttcactgcggtggtttttgtttagatttgttttgttttttggctctgtgctgcacgtacataggtcaagtttgattctgcatcttatgccatatcatacacaaaattagaggactctgttatctagctgtctcttaggtttttcctacaatttaggactctgaagagtcccttttcctgattattttggctaaaaatttgggtttctttcagggttttattactctacactgtcacacagtggggaccttctttaggttcttactgggactttgtttggagagatgtagtgggaattttaaaaaagagaaaactgatggataccacctccccactctttggacaacagaggctactttcctagtaactgtctcaggaaacaagtcctctttctgggttttatgccattatgctgctgccactgccacagctgccatggaagctcaggtctctggatgacactggccttgggagaggtctagaagggaaaagaagagaagggaaaagtgaatattctttggtcttggggggctcccagatacagttttaactacttctacttggacaactaataaagatgctaaagatgaacaggttattattgtgttgctagatatgtagattaagggcaatctactcttacttaaactttagataagatggaaattttttttcttgggcagtaacaacattaagaacggtgatgatgaaagtgtggttcatgatccagctgcatgaagtccctctatgaaggatgttgaatgtgcatatttctaggccttaactttggctcttgaatcttgattcctagatttgcattctgtattcctgtacacactaaagatttaagacattacttttagatggtgatgaacccctaagtcattgaagtttaagagaccagtagatgattatattattgtatgcggaagatatcaggggcttgaagttgggcctaggcaacagaaatgaaaaatacagggaaaatagaagagatattattgaggtaaggaggacacctgggaactgattaacccttgaaggtaaagaaggggtatgttaaaagatgactcagaggaagtattttggatgcatgtgagaatgatgataccataataagataagggaatgtcaaagtaaactctagatgatttaattagactggatttgagtatggggatttgagtaattctggcatgtctgtatggggtttttgagactctgtttaaggtagggttagtataagacacaccttccaagaatttacaatctgttagtgggattgagaaataaggaaaaaaacaactaaagctaacttggattgagctctttctatatgccaaacacaaatgatgttctaaacattttacatagataggttacgcaacttgcccaagatcacacagctactaagtgaaagagctgagatttaaaaccctgtgttctagactctatgcttttaatgtctatacaattaatattaccaaatttatggcaatttgacctctctagccatcagtttccttatttctaaattaaggataataatctggtagaatgtgtgtgataacaaaatgacaccatatacagaacctagaaatagtaggtgttcaaattgcatgatttagttctcatttttttaagtggttcagattttttaaaatgctgtttgaaaatactgtatctgtaactacaagaccagttttctaaactttcacttatttttggagatcttcatggtgcttcaataaaaattttataacactagaagaaaaaaattatctgtttttcttttccttttctatagctttgtagaactattattgaaagacaataaactacacatatttacagcatacaattgaataaatttggacttatatatatgagaaattatcatccctaaatttccctaatgacctttgaaattccttactccttccctgtctgcctctgcctctgagaaatcactaaatgacttatcttgttatagattatttcacattttctagactattatataaaaaatacaatatgtactgttttttctggcttctttcagtataattattttgagattcaaccatgtgtgtatcaatagttcatttaaaaatattattgctgacaaatatttcattgtgtagatatacaatagtttgtttcttcacattttgatgggcatttatgtcagtccaatttttaactttattaaaaataaagcagccatgaatattagtgtatgcatgctttcacatggtacatttacatttaactttttaagaaactgctaaactattttctaaaggaactgtaccattttacatttctaccagcagtgtctaagagttgcagttgctccaaatcctcaccaacacttggtatggtgagtctttttaattatcatattggtttgtgtatgttgaaccatccttgaatttgcgagatagatcctatttgatcatgatgaatgaagttttccatatgtggttgagtttggtttactagtattttcttggggatttttgcatcaatattcatcagggatattggcctatagttttctgtttttgatgtgtcttcatctggttttgatgtgtcttcatctggttttggtatcagaattgataccagaattagcatagcacgagtttagaagtattccctcttcctctattttttgtaatagtttgaataggattggtatttcttctttaaatatttgatagaattcagcagtgaatccatcaggtcccaggcttttctttgctgggagactttttattacagcttcgattttgttacttgttattggtcttttcagattttttatttcttcatggttcaattttggtaggtggtatatgtctagaaatttgtccattacttttagattttccaatttattggcatataattgctcatagtagccactaattatcctttacgttactgcaatatcaatagtaatgtctcatttttcatctctgatttttatttattttggtcatcgctctttttttcttaatctagctaaaggtttgtcaattttgtttaccttttcaaaaaaacaagctttaatttcattgatcttttgtattgtttttgcatttcaattttatttatttctgctctgatctttattatttattttcttctcctaattttgagttttgttgctcttgctcttctagcttctttaagacgcatccttaggttattcatttgaagtttttcttcttttctgatataggagcttatacactcccttgttagtactgctgtcatggtatctcctaggttttggtatgttgtgcttacattatcagtcatttcaaaaaatatttagattatactgcttgggtgataggtacaccaaaatctcacaaatcatcactaaagaatgtactcatgtaaacaaacactatctgttccccaattatatgtatatatatagcttccctcttcacttgacactcattctctctcctgctgccctgtgaagaggtgccttctgccatgattgtaagtttcctgaggcctcctcagccatgcagatctgtgagtcagttaaacctctttcctttataaattacccagtctcaggtattcataataaaatgaaaataaaaataaatttattcattaatttattcattgacccactggtcattcaggagcatattgtttaatttccagtgtttatatagtttctataattcttcttgttattgatttctagttttattccattgtgtcagagaagatgcttgatattagttcaatattttgagtgttttaagacttgttttgtcacctaacataagatttgtccttgagaatatgtgttctgagaagaatgtgtgttctgcagccgttagatgaaatattctgtaaatatctgttagatccatttggtctatagtccagtgtttctttgttatttttttggctggaagatctgtccaatgatgaaagtgaggtgctaaagtctccagctattattgtattagggtctctctctctctctctctctttagctctaatatttgcttcatatatctgggtactccagtgttcagtgcatatgtatttaaaattgttatattctcttgctgaattgaccctttttcattatacagtgatcttctttgtctcttcctatagtctttgtcttgaaatctattttgtctaatataagcatagctactcctgctcatttttggtttccattgacataggatatctttttccatcccttaattttcagtctatgtatgtctttataggtgaagtgtatttcctatagacaacagattattattattttttaatccattcagccactctgtgtcctttgattggagaattcagtccatttacatgtattattattgataaatagggacttgtttctggcattttgtgatttgttttctagttgttttgcggtcatctcttccttctttccttccttgctgtcttttagtgaaggtgattttctcttgtggtatgatttaacgtcttgctttgttttttgtttctattgtatatttttttatttgaggttacaaataatatgaggcttgcaaataatatcttataactcatcatttgaaactgatgacaacactaattgcatcaacaaacaaaaggaaaactaataaaaaatcagcacattaactttttcctcctgctttttaatttttttttgtttctatgtatattgtattataatctctatgtcttgaaaagttgttgtagttattatttttggttcattcatctttcgtcttcctacttagaataagaatagtttacataccacaattgcagtgttataatattctgtgtttttctgtgtacttagtaagaccagtgagttttataccttaagatgatatcttactgttctttaacagccttttcttcctgattaaagaactgcttttagcatttcttgtagggcagtctggtgttgatgaaatccctcagcttttgtttgttttggaaagtcttcaattctccttcatgtgaaggacattttcaccagataagctattctagcataaaagttttttttcctttggcactttaaattaatgttatgccactctttcctgacctgtaaaggtttcctctgaaaagtctcctgccagatgtgttgcagatccatggtgtgttatttttttctcttgctacttttaggatcctttctttatccttggcctttgggggtttgattattaaatgtcttgaggtagtcttctttgggttaaaccttcttagtgttctataaccttcttatacttgaatattgatagctttctctagtttaggaaagtcctctgttattatccctttgaataaactttctactcttgtctctttctctacctcctctttaaggccaattactcttagatttgctcttttgaggctattttctagattttataggtgtgcttcattattttttattctttgttaatcttttttcttttatattctctgactgtatatttctaaatggcctgtcttcaatctcactgattctttcttctgcttatcagctctgctgataggagactctgatgcattcttccttatgtcaattgcatttttcaactccagaatttctgcttgtttcttttaaagtacttgaatctctttgttaaatttatctgataaaattctgaattccttctcttcgttatcttgaatttctttgagcttcctcgaaacagctattttgaattctctgtctgaaaggtcacatagctctgtttctccagaattggtccctggtggttttttaagttcactttgtgaggtcatgttttcctggattgtctcaatgcttgtgggtgttagtcactgtctgggcattcaagtagtagatatttattatagtcttcatagtctgggcttgttggtacccatccttcttggatagtctttccaagtgtttgatgagatttgagtgttgtaatctaagccatatctacattaaggaacacgccaaacccataacactatgcttcttgcagactcatagagataccaccttggtggtcttcagtaagagctggaagaattttctggtttactaggcaaagactcttgttctcttcccttactttctcccaaacaaatggagtttccctctgtgtgctgagctgccatcaaaactgggactctgttgggttagaccttgtattaattcgttttcatactgctatgaagaaatacctgagactgggtaatttacaaaggaaagaggtttaattgactcacagttctgcatggctggggaggcctcaggaaacttacaatcatggcagaaggtgcctcttcacagggcagaaggagagagaatgagtgctgacgaagaaggaagccctttataaaaccatcagatctcctgagaactaattcactatcatgagacacagcatgggggaaaccacctccatgattcaattcttcaatcatgattcaagggtcctgccttgacatgtgggaattattacaattcaaggtgagatttggatggggacacagagccaaaccatatcagacctgaagccagcacagcactgagtctcacccaaggtccactgtaaccactacctggttaccacatgtgattgttcaaggccccagggctctacaatcagcaggtataaatccagccagactcgtgttcctctaggacacagatgggtccagagatgccatctgggagtcagagattggagtgaaaaaccttagaaatctacctgatgctttatttattgcacctaagctggcactcaaaccatgaaacaaagttgtttccactcttcccttccctttccacgggtagatgagccgctccctattgtcaccattaccacaggcccatgaggagtactgccagtttaccaccaatgttcgcttaagactcaagggctcttgggtcagcttgtggtgaatgctgccaggcctgggacccattcttcagggcaatgggttcccactctggctcagggtaggtccagaaatgccatcaaagagccaaggcctggaatcagggatgatcccatttttaagaagattatcctttgcttattgaattgccttggcatctttgtaaaacggtattcaattatgtacgtatacatgtgagtatatttctagacgttctgttttctttcattaacctatatttctatcttaatgccaatatcacatagtcttcatttatatagctttatatttagtcttaaataaatcagggtaagttctccaagttgttcaccgtttttgaagttgttttagctattttaggtcccttgcatttctatggcaattttagaatcagtttgccaatgtctaaaaaaaatcctgctagaattttgattgggattgtcttaaatctatagaaaaatttgagtaatattaaaatattgtttcaatccatgcacatattatatttctcttgtttttagatttatttctctcagcaacatcttatagctttgtttataaattgatcccttaatttcatatttctgtgctattctttgatttctgacagtttattgcttttatatgtacctttaattgatttttatgtgttgatcttgtattatgttacttacataaactcattttatagtcccagaagattcttttgtacatttggtgtgattttctgtatagctgatcatgtcttttgcaaataataacagttttctttctttctttccaatgtagttggactgttattgcacttgtttctgtttctttccttattgcactggtttaaacctccagtcatatgtctaacagaagtggggaagtggccatccttgtcaactttctgatcgtaggtagagtttttaactaaaaatttagtttttaaaatacacgatactactcaggctacatagctttttttttttttttaaatgactgttaatgttttgtaatttaaaaaaattttcaattttttcttagttgttaaaattattgacatgaaattgtttacaatgtccccttattatcccttaaatttccatagcatgatgtcacctcattcattcctgatattgataatttatctattttcttatttttcctgactgagtctggctaaagttacatggtgtttgtagtctttctcaaggccaactttggtttcatagatctttcttttttgttgttctcactattatggatctttgttctttattattatttctctactgcttacttagtgtttaatttcttcttttacaagtttataaatgtggaaatggaagtcattgatttgagatctttctttttttctaatatgacctctaatggtaaaaattttgctctgagtaatttttgttgcatcccacaattttggtatgttgtattttaatttgcaatttgtttaaaatattctctaagtattttggactcatatctctatttaatattttgtttctaaatattttggggttttacagttacttttctgtcactgacttctaacattattttggccagaaaatattctttgtctttgtatctttcttaacaatgtcacaatgtctttcatatagcaaatttttaaaaaaattttcctgagctctagtatgtcacattttcctctgatgaattgtattttttgctatcaactctaagaactcttttcctagtcctggatcatggggattttatattctggaagttttagtgttttatactttacatttaagtgcataatctattgtgctaaaattgtataaattgtgaggtttcgatggaggttcttttcatttcttatattttgttttgttttgctgatgaatgtccagctgcccatcataatttattgtaaactatctttctcttccattgaattgtttgttcctttattaaaaaataattgatcatatttgtgtagaacttttttgggttctgtatactgtttcattgattaatgtatctatcttgccaccaatactatactatcttgattattagacatatataataaaccatgacattgaggagagagatttctcccactttattcttccttttctttcccatataaattcaagaatatgtttctttatgtctataaagaatcttattgacaatttgataggcattgcattaaacctatagatcttataggaaaaaatatttttattcaacaattccacagtatattgagtcttccaattcatgaacatggtatacctcttcttgtatttaggtcttttaaaattactttcacctgaaattataaaatttcagaattttgtaatttttttatacaaattgtatatatactttattagatttatacctaagtatttcatgtatttgggtaattgtaaatggtattacattagttatttcagattccacctgtccattttcagtatatagaaaatgcaattgatttgtttgtattaatcttgtgtcctgacaccttattgaacttgcttattaatttcaggagttcttttatagactccttgaagtgttttatatagacaattatgctgtcttgtaacagagactttttttttcttttccagtttacctgccttttattttacttatttactttttaacatattgcctttcaagacttgttagttgggataaaaacagccttaatctacagctaattttgcccccactatatagagccaatgcctttctgggtcttgtacccagtgcaccatggtttactagattttccactctagttggtgggaacatgaactatcccagctctgtgtaatgtctgaagattgtttcctctggtcctttcaggtagttttcttctagctcttttctaaaaactcatgtagttgcctcccacatatcccctgactagtattcagctgaagacttgcaggtaactctctgcaactttccagagcttttttgatacagctctatctgctgcagtaatctgcctattgagatctagtcatcttaccctcccagctccatctcagcaaactgaagcaatgcttgaaaatacctcatttgttttccctctattaggacacactgtcctacgttgctctatatccaatgtctttcgtatattttgttcagtattttagttgcttcaggtgggtggagggtgggtatgaaagtgattcctgttagtttatctggttggaattgaaagtatcataaaactctatgttgactcagtgtgtttttgaagcttattgggtcttgattattacatttcaaactctactatctgtaagcaaaagagacataggccaagttatccttgtaaagaactcataagaatttcctgacttacctggctgatgcttcctttggggacattgccttcatgatcatatgggtgttggagtgtttgtcatgccaaagagaatctgcatgtgtgactaataagtcagcatttcaagaggcctggctatactctgcttaaaagtgaaaaagcactggattggcaggcataacaaggagaaagtggcattgatatggtaatagtgactttttaatggtctaaggaaagattccctctattctttaactgtgcattggtggtagggtgttgtgtaggtttcttgtctgccaaggcaatgaacagatacattatggtcacttttgtggattataatagggaaaatgatgattcgaaggaaagttaaaaggtatttaataatgagaattgtattagctttcaaatatctgttttcccttcacttacttccttgttatctcttcactgggagatgtgcttccatggctttcatcttttttttcccctcttttaaaagatatttcaaactttcttttcatacatttctcttatatattttaggcaagtagaagaaacccaatgttgtctgcatttgtgtagtttatgtgtgcccaggcctatatgactagtgttttgataacacagaatcatgatctgctttgacattccaaaattatggaggagagaaagtaccactctttgcacccttgttttcttgtaggacccttaaagactaatattaaaacatttgcccttctcaagacaattcaacaccccctcttcttcaggtaatgtctgccaccatgcccaccacttcaactcaagtataccccactgactctattcagtagagagatggcaaaagtgtgaaattgtattctcttccccctatttcagttctctttttgaagaggaaaccaaccaaccaagtttatatcttgaaattactatctgtgggatatttgcagctgagactaagtcctagtgctttcttaataaaagctatgcatgtaaatagggtcagcttttgggctgacattgcatttgaattaaaatctggcatctccacaccattgacaaatctgacagctggagcagcagtcacctcatcatatctctcagttgtgtctttcctggtttttggcatccttcctgtctaaatttttatcagatgagcacttttccttggcaagtactttaaataccttcaacttgttttatctctgaactgtaaccctttgccctcagatgtcatatctcacatgtatgactggaggatattcagaacaaattagttaagaatgcaacaccagagtgcaatttcatttggtcttctccctgccccatcctcttcccaaatattggagcttcctgttgaagagacctttatggacattgattaatttcatggaagctacttaatggtcttgcaaattggaacagttgtaagttttgattgtgacactgcagggctaactccacctgtgctaagcattcagcattgttttctttggctttgcttcattcacgataatcaaggacttgggttcattaccagcattagcaagcctcaaaggcctctcataaatccaagccaaacactgtgttaggaggttccttagattaatggcagccctggttctctgaggctgtgttgagatctgagagaaggtaatgttcactcggcttcagcatttctacttgtagttcaaagccaaacctggaggtacaggatgatctgcaggcaacaagagatagaatgtgggcctgcaaaaggtaccacctgtatacatgatgagctcttcctgcctggcacgcaaagaactttagagttttcctcaagccttttcctatgaaaactctcaggttttgtcagctgggtcaatccattgcctttccaatacacctggagcatttcttccttgatgaattaagggctgaacaaggatgcatgtcaggggtgaaaccctttgaagagtgcaaaaataaaaattggttgtttagtaagtagaaagataaatcaaaaccaatctataaaagttagattcatatctcttttcagggtcacaatttgcctttgttttctagcatcttcatcggtgcttgcaactgaaatgggtcttcttttgactcttggtctttccttagttaagggtgagggagactctttggttctccagcggacaaaagaagacagctaacaaataagtcactctttcttccatagtctatttataagccttacaagttaatgctggaaaggccaatgagaagaaaaataaaacaacagtagtagtagtagtaataagcatgatcatcatcatcatcattggccgcatttttagagaatttgctatgtaccaggcactgttgaaaagaaaaataactttactgagatataatacacattcaataaaattcattcacttgaagtataacagttcagaagtttttaatatatttacagagttgtgcaa

SEQ ID NO: 2431 - DNA, 11269 bp, Homo sapiens
atcagtttccttatttctaaattaaggataataatctggtagaatgtgtgtgataacaaaatgacaccatatacagaacctagaaatagtaggtgttcaaattgcatgatttagttctcatttttttaagtggttcagattttttaaaatgctgtttgaaaatactgtatctgtaactacaagaccagttttctaaactttcacttatttttggagatcttcatggtgcttcaataaaaattttataacactagaagaaaaaaattatctgtttttcttttccttttctatagctttgtagaactattattgaaagacaataaactacacatatttacagcatacaattgaataaatttggacttatatatatgagaaattatcatccctaaatttccctaatgacctttgaaattccttactccttccctgtctgcctctgcctctgagaaatcactaaatgacttatcttgttatagattatttcacattttctagactattatataaaaaatacaatatgtactgttttttctggcttctttcagtataattattttgagattcaaccatgtgtgtatcaatagttcatttaaaaatattattgctgacaaatatttcattgtgtagatatacaatagtttgtttcttcacattttgatgggcatttatgtcagtccaatttttaactttattaaaaataaagcagccatgaatattagtgtatgcatgctttcacatggtacatttacatttaactttttaagaaactgctaaactattttctaaaggaactgtaccattttacatttctaccagcagtgtctaagagttgcagttgctccaaatcctcaccaacacttggtatggtgagtctttttaattatcatattggtttgtgtatgttgaaccatccttgaatttgcgagatagatcctatttgatcatgatgaatgaagttttccatatgtggttgagtttggtttactagtattttcttggggatttttgcatcaatattcatcagggatattggcctatagttttctgtttttgatgtgtcttcatctggttttgatgtgtcttcatctggttttggtatcagaattgataccagaattagcatagcacgagtttagaagtattccctcttcctctattttttgtaatagtttgaataggattggtatttcttctttaaatatttgatagaattcagcagtgaatccatcaggtcccaggcttttctttgctgggagactttttattacagcttcgattttgttacttgttattggtcttttcagattttttatttcttcatggttcaattttggtaggtggtatatgtctagaaatttgtccattacttttagattttccaatttattggcatataattgctcatagtagccactaattatcctttacgttactgcaatatcaatagtaatgtctcatttttcatctctgatttttatttattttggtcatcgctctttttttcttaatctagctaaaggtttgtcaattttgtttaccttttcaaaaaaacaagctttaatttcattgatcttttgtattgtttttgcatttcaattttatttatttctgctctgatctttattatttattttcttctcctaattttgagttttgttgctcttgctcttctagcttctttaagacgcatccttaggttattcatttgaagtttttcttcttttctgatataggagcttatacactcccttgttagtactgctgtcatggtatctcctaggttttggtatgttgtgcttacattatcagtcatttcaaaaaatatttagattatactgcttgggtgataggtacaccaaaatctcacaaatcatcactaaagaatgtactcatgtaaacaaacactatctgttccccaattatatgtatatatatagcttccctcttcacttgacactcattctctctcctgctgccctgtgaagaggtgccttctgccatgattgtaagtttcctgaggcctcctcagccatgcagatctgtgagtcagttaaacctctttcctttataaattacccagtctcaggtattcataataaaatgaaaataaaaataaatttattcattaatttattcattgacccactggtcattcaggagcatattgtttaatttccagtgtttatatagtttctataattcttcttgttattgatttctagttttattccattgtgtcagagaagatgcttgatattagttcaatattttgagtgttttaagacttgttttgtcacctaacataagatttgtccttgagaatatgtgttctgagaagaatgtgtgttctgcagccgttagatgaaatattctgtaaatatctgttagatccatttggtctatagtccagtgtttctttgttatttttttggctggaagatctgtccaatgatgaaagtgaggtgctaaagtctccagctattattgtattagggtctctctctctctctctctctttagctctaatatttgcttcatatatctgggtactccagtgttcagtgcatatgtatttaaaattgttatattctcttgctgaattgaccctttttcattatacagtgatcttctttgtctcttcctatagtctttgtcttgaaatctattttgtctaatataagcatagctactcctgctcatttttggtttccattgacataggatatctttttccatcccttaattttcagtctatgtatgtctttataggtgaagtgtatttcctatagacaacagattattattattttttaatccattcagccactctgtgtcctttgattggagaattcagtccatttacatgtattattattgataaatagggacttgtttctggcattttgtgatttgttttctagttgttttgcggtcatctcttccttctttccttccttgctgtcttttagtgaaggtgattttctcttgtggtatgatttaacgtcttgctttgttttttgtttctattgtatatttttttatttgaggttacaaataatatgaggcttgcaaataatatcttataactcatcatttgaaactgatgacaacactaattgcatcaacaaacaaaaggaaaactaataaaaaatcagcacattaactttttcctcctgctttttaatttttttttgtttctatgtatattgtattataatctctatgtcttgaaaagttgttgtagttattatttttggttcattcatctttcgtcttcctacttagaataagaatagtttacataccacaattgcagtgttataatattctgtgtttttctgtgtacttagtaagaccagtgagttttataccttaagatgatatcttactgttctttaacagccttttcttcctgattaaagaactgcttttagcatttcttgtagggcagtctggtgttgatgaaatccctcagcttttgtttgttttggaaagtcttcaattctccttcatgtgaaggacattttcaccagataagctattctagcataaaagttttttttcctttggcactttaaattaatgttatgccactctttcctgacctgtaaaggtttcctctgaaaagtctcctgccagatgtgttgcagatccatggtgtgttatttttttctcttgctacttttaggatcctttctttatccttggcctttgggggtttgattattaaatgtcttgaggtagtcttctttgggttaaaccttcttagtgttctataaccttcttatacttgaatattgatagctttctctagtttaggaaagtcctctgttattatccctttgaataaactttctactcttgtctctttctctacctcctctttaaggccaattactcttagatttgctcttttgaggctattttctagattttataggtgtgcttcattattttttattctttgttaatcttttttcttttatattctctgactgtatatttctaaatggcctgtcttcaatctcactgattctttcttctgcttatcagctctgctgataggagactctgatgcattcttccttatgtcaattgcatttttcaactccagaatttctgcttgtttcttttaaagtacttgaatctctttgttaaatttatctgataaaattctgaattccttctcttcgttatcttgaatttctttgagcttcctcgaaacagctattttgaattctctgtctgaaaggtcacatagctctgtttctccagaattggtccctggtggttttttaagttcactttgtgaggtcatgttttcctggattgtctcaatgcttgtgggtgttagtcactgtctgggcattcaagtagtagatatttattatagtcttcatagtctgggcttgttggtacccatccttcttggatagtctttccaagtgtttgatgagatttgagtgttgtaatctaagccatatctacattaaggaacacgccaaacccataacactatgcttcttgcagactcatagagataccaccttggtggtcttcagtaagagctggaagaattttctggtttactaggcaaagactcttgttctcttcccttactttctcccaaacaaatggagtttccctctgtgtgctgagctgccatcaaaactgggactctgttgggttagaccttgtattaattcgttttcatactgctatgaagaaatacctgagactgggtaatttacaaaggaaagaggtttaattgactcacagttctgcatggctggggaggcctcaggaaacttacaatcatggcagaaggtgcctcttcacagggcagaaggagagagaatgagtgctgacgaagaaggaagccctttataaaaccatcagatctcctgagaactaattcactatcatgagacacagcatgggggaaaccacctccatgattcaattcttcaatcatgattcaagggtcctgccttgacatgtgggaattattacaattcaaggtgagatttggatggggacacagagccaaaccatatcagacctgaagccagcacagcactgagtctcacccaaggtccactgtaaccactacctggttaccacatgtgattgttcaaggccccagggctctacaatcagcaggtataaatccagccagactcgtgttcctctaggacacagatgggtccagagatgccatctgggagtcagagattggagtgaaaaaccttagaaatctacctgatgctttatttattgcacctaagctggcactcaaaccatgaaacaaagttgtttccactcttcccttccctttccacgggtagatgagccgctccctattgtcaccattaccacaggcccatgaggagtactgccagtttaccaccaatgttcgcttaagactcaagggctcttgggtcagcttgtggtgaatgctgccaggcctgggacccattcttcagggcaatgggttcccactctggctcagggtaggtccagaaatgccatcaaagagccaaggcctggaatcagggatgatcccatttttaagaagattatcctttgcttattgaattgccttggcatctttgtaaaacggtattcaattatgtacgtatacatgtgagtatatttctagacgttctgttttctttcattaacctatatttctatcttaatgccaatatcacatagtcttcatttatatagctttatatttagtcttaaataaatcagggtaagttctccaagttgttcaccgtttttgaagttgttttagctattttaggtcccttgcatttctatggcaattttagaatcagtttgccaatgtctaaaaaaaatcctgctagaattttgattgggattgtcttaaatctatagaaaaatttgagtaatattaaaatattgtttcaatccatgcacatattatatttctcttgtttttagatttatttctctcagcaacatcttatagctttgtttataaattgatcccttaatttcatatttctgtgctattctttgatttctgacagtttattgcttttatatgtacctttaattgatttttatgtgttgatcttgtattatgttacttacataaactcattttatagtcccagaagattcttttgtacatttggtgtgattttctgtatagctgatcatgtcttttgcaaataataacagttttctttctttctttccaatgtagttggactgttattgcacttgtttctgtttctttccttattgcactggtttaaacctccagtcatatgtctaacagaagtggggaagtggccatccttgtcaactttctgatcgtaggtagagtttttaactaaaaatttagtttttaaaatacacgatactactcaggctacatagctttttttttttttttaaatgactgttaatgttttgtaatttaaaaaaattttcaattttttcttagttgttaaaattattgacatgaaattgtttacaatgtccccttattatcccttaaatttccatagcatgatgtcacctcattcattcctgatattgataatttatctattttcttatttttcctgactgagtctggctaaagttacatggtgtttgtagtctttctcaaggccaactttggtttcatagatctttcttttttgttgttctcactattatggatctttgttctttattattatttctctactgcttacttagtgtttaatttcttcttttacaagtttataaatgtggaaatggaagtcattgatttgagatctttctttttttctaatatgacctctaatggtaaaaattttgctctgagtaatttttgttgcatcccacaattttggtatgttgtattttaatttgcaatttgtttaaaatattctctaagtattttggactcatatctctatttaatattttgtttctaaatattttggggttttacagttacttttctgtcactgacttctaacattattttggccagaaaatattctttgtctttgtatctttcttaacaatgtcacaatgtctttcatatagcaaatttttaaaaaaattttcctgagctctagtatgtcacattttcctctgatgaattgtattttttgctatcaactctaagaactcttttcctagtcctggatcatggggattttatattctggaagttttagtgttttatactttacatttaagtgcataatctattgtgctaaaattgtataaattgtgaggtttcgatggaggttcttttcatttcttatattttgttttgttttgctgatgaatgtccagctgcccatcataatttattgtaaactatctttctcttccattgaattgtttgttcctttattaaaaaataattgatcatatttgtgtagaacttttttgggttctgtatactgtttcattgattaatgtatctatcttgccaccaatactatactatcttgattattagacatatataataaaccatgacattgaggagagagatttctcccactttattcttccttttctttcccatataaattcaagaatatgtttctttatgtctataaagaatcttattgacaatttgataggcattgcattaaacctatagatcttataggaaaaaatatttttattcaacaattccacagtatattgagtcttccaattcatgaacatggtatacctcttcttgtatttaggtcttttaaaattactttcacctgaaattataaaatttcagaattttgtaatttttttatacaaattgtatatatactttattagatttatacctaagtatttcatgtatttgggtaattgtaaatggtattacattagttatttcagattccacctgtccattttcagtatatagaaaatgcaattgatttgtttgtattaatcttgtgtcctgacaccttattgaacttgcttattaatttcaggagttcttttatagactccttgaagtgttttatatagacaattatgctgtcttgtaacagagactttttttttcttttccagtttacctgccttttattttacttatttactttttaacatattgcctttcaagacttgttagttgggataaaaacagccttaatctacagctaattttgcccccactatatagagccaatgcctttctgggtcttgtacccagtgcaccatggtttactagattttccactctagttggtgggaacatgaactatcccagctctgtgtaatgtctgaagattgtttcctctggtcctttcaggtagttttcttctagctcttttctaaaaactcatgtagttgcctcccacatatcccctgactagtattcagctgaagacttgcaggtaactctctgcaactttccagagcttttttgatacagctctatctgctgcagtaatctgcctattgagatctagtcatcttaccctcccagctccatctcagcaaactgaagcaatgcttgaaaatacctcatttgttttccctctattaggacacactgtcctacgttgctctatatccaatgtctttcgtatattttgttcagtattttagttgcttcaggtgggtggagggtgggtatgaaagtgattcctgttagtttatctggttggaattgaaagtatcataaaactctatgttgactcagtgtgtttttgaagcttattgggtcttgattattacatttcaaactctactatctgtaagcaaaagagacataggccaagttatccttgtaaagaactcataagaatttcctgacttacctggctgatgcttcctttggggacattgccttcatgatcatatgggtgttggagtgtttgtcatgccaaagagaatctgcatgtgtgactaataagtcagcatttcaagaggcctggctatactctgcttaaaagtgaaaaagcactggattggcaggcataacaaggagaaagtggcattgatatggtaatagtgactttttaatggtctaaggaaagattccctctattctttaactgtgcattggtggtagggtgttgtgtaggtttcttgtctgccaaggcaatgaacagatacattatggtcacttttgtggattataatagggaaaatgatgattcgaaggaaagttaaaaggtatttaataatgagaattgtattagctttcaaatatctgttttcccttcacttacttccttgttatctcttcactgggagatgtgcttccatggctttcatcttttttttcccctcttttaaaagatatttcaaactttcttttcatacatttctcttatatattttaggcaagtagaagaaacccaatgttgtctgcatttgtgtagtttatgtgtgcccaggcctatatgactagtgttttgataacacagaatcatgatctgctttgacattccaaaattatggaggagagaaagtaccactctttgcacccttgttttcttgtaggacccttaaagactaatattaaaacatttgcccttctcaagacaattcaacaccccctcttcttcaggtaatgtctgccaccatgcccaccacttcaactcaagtataccccactgactctattcagtagagagatggcaaaagtgtgaaattgtattctcttccccctatttcagttctctttttgaagaggaaaccaaccaaccaagtttatatcttgaaattactatctgtgggatatttgcagctgagactaagtcctagtgctttcttaataaaagctatgcatgtaaatagggtcagcttttgggctgacattgcatttgaattaaaatctggcatctccacaccattgacaaatctgacagctggagcagcagtcacctcatcatatctctcagttgtgtctttcctggtttttggcatccttcctgtctaaatttttatcagatgagcacttttccttggcaagtactttaaataccttcaacttgttttatctctgaactgtaaccctttgccctcagatgtcatatctcacatgtatgactggaggatattcagaacaaattagttaagaatgcaacaccagagtgcaatttcatttggtcttctccctgccccatcctcttcccaaatattggagcttcctgttgaagagacctttatggacattgattaatttcatggaagctacttaatggtcttgcaaattggaacagttgtaagttttgattgtgacactgcagggctaactccacctgtgctaagcattcagcattgttttctttggctttgcttcattcacgataatcaaggacttgggttcattaccagcattagcaagcctcaaaggcctctcataaatccaagccaaacactgtgttaggaggttccttagattaatggcagccctggttctctgaggctgtgttgagatctgagagaaggtaatgttcactcggcttcagcatttctacttgtagttcaaagccaaacctggaggtacaggatgatctgcaggcaacaagagatagaatgtgggcctgcaaaaggtaccacctgtatacatgatgagctcttcctgcctggcacgcaaagaactttagagttttcctcaagccttttcctatgaaaactctcaggttttgtcagctgggtcaatccattgcctttccaatacacctggagcatttcttccttgatgaattaagggctgaacaaggatgcatgtcaggggtgaaaccctttgaagagtgcaaaaataaaaattggttgtttagtaagtagaaagataaatcaaaaccaatctataaaagttagattcatatctcttttcagggtcacaatttgcctttgttttctagcatcttcatcggtgcttgcaactgaaatgggtcttcttttgactcttggtctttccttagttaagggtgagggagactctttggttctccagcggacaaaagaagacagctaacaaataagtcactctttcttccatagtctatttataagccttacaagttaatgctggaaaggccaatgagaagaaaaataaaacaacagtagtagtagtagtaataagcatgatcatcatcatcatcattggccgcatttttagagaatttgctatgtaccaggcactgttgaaaagaaaaataactttactgagatataatacacattcaataaaattcattcacttgaagtataacagttcagaagtttttaatatatttacagagttgtgcaa

SEQ ID NO: 2432 - DNA, 8525 bp, Homo sapiens
taggcatgagcaactgcgcccagctgaaattttcttattttaattcatatttaattgcacatagttgaacattatctgagtgtgagttgcgtacactaataccatcatcctttgccctttagtggaggattttatatttgatgttcctgtgttgtggttgaaaactgtgttgtaaactcgtcagttataagaaataatattgaccataggaacagtgttttaaagtaatccgttgaatattttcatgaaaatccaggttgattttgcctgagcataagttggtcttcatcaataacctcttcactgtatacattgcctggttttgcctggctaaccgaaatctggcctttcatgtaggtatagagaagaaaccttttttgttttttttcttttgagatagagtctcactctgttgcccagactggaatgcagtggtgccatcttggctcactgcaacgtccgcctcctgggctcaagcgattctcctgcatcagcctcctgagtaactgggactacaggcatgcgccaccatccccggctaatttttttgtatttttagtagagatggggtttcaccatgttggccaagctggtcttgaattcctgacctcaaatgatccacccacctcggcctcccaaagtgctgggattacaggcgtgagccatcatgcctatccagaaacctatttttaaaaagaagaaaaagatggaggaggagaagggagaactataactagaatcacctttttttttttttttttttttttagaatttttaaaaagctcattcccttttgctgttatttaatggtagcaggtcatgtatgactcatgacttaggtcatacaacttaggatattaaatggttcagatacccagcaaacagttcaaagattgcattaacaagctagctaacattttgtaaaggagttcaaaatgaaagactgtcagtacctatattccgtgtgcctagctgttgttgccccactggaatgtcacaatgcaaggatgtgaatctccctttctcctaacagaagtttttaaagctaacagattttaatagatttgcaaacagaagtttgcaagcagaagtttgtaaatctgttaaaatgttttacattaaaatttgatgcactgatttttagattggtgtctaaagtaggcaatatcatcaggttgtgcatttgagatttaccagtttacatcttggcttatgataaattggattggaagatcaggtactttattttcctggaagaaaaaaaaattaggtatattcatcattcccatttcacaatttcttgtcatatctcacttgcttcagaaatactcattttggatccttcttgtgaatatgtaactcttaatactaatgtcctgagagaaaggagaatttcttgtctaacctcagtaataaccataccatcacaaaagaaggcctcacaatgtatcaggcaatcaaatagccaataacctattctcctgctaaattccataaactggatggggagggtagataatgttcatttttgttacttaccagggaacatgacacttggtctttgaaattgttatttatttcatatattgtagctgccaatcagtcagtgatttgcaaatagcaaagtaaatacactgctgaaaatgagtttcttctttgtgctgatctgtgatgtgcgggaaatcagatgtaatatggttgcatttatttatgtaggcatctattctctttcttaatgagcaagtaattttcttttctctacttctacacaaaagttaaattaaggagtacccaagagggctgggaaacttggtttgcagtcattgaaatactgctgagtatcgggatcctttcatgagtggagtttccctctccttaagaagaaagctccagatagctcccttttgaactcattgttagagcaaacacatctgtagaggaagatgatccataagtctaatgctaaggatttgcctcctctccctatcaatgagaagggtttgcctcctctccctgtcaaaggattttactctggcttatttggctgtttttgcctgggaagtgaggggcaagagctctgatctttcctatgacggccagcctggccttaatatgtagattattaacatgataccagcctctgttgagtcatagcaactgctatgaacaaacatgtaaatccatctaggggaagaaaagagtgttgcaaatgcctttcatcaaaatggaagactacttcaacttctatttgctcttcttgttataaccaagctttttcttttttcattttcctctgcctttctttccctccttttttccgtccccactatcctccatctttcagaaatatcaaaagctgaatcttcccaccgaacactgcaatcatttgaaatttgtgtataggccagcttcacatcatcagaaattgtgtaaccccatgattcccaggcctcagctggtagtgtagttatttcaaataatatttaatacaataaattctatggcaataaaagaatttggacagtcccttcgaacttattgcaatgagatttgacttgaatttaatacaatgaagtttcagaatagccaagtaattttgttgtggcatgatttaaagggtatttaagtacaggtataggtgattgagtttgtaaaacctaatcagaggtaaattgcagttttactcttatcacgtgaatgagcattcaaaaatacagaaattctttacttagcataaggtgatttttaacagtgtggcaaagagtgtaagtgaacatccttaactttttgttctgtcaaggggagaataaagataccacctggctgtatgtataaatttgcttactaagatggttgattgatttcttttaggtgggtattaaaagtggcttttttggtatagaaaacatgtagcatcaaagcagtgttgtgatgccctgctgtcttctgatgttgaatattttatgggattaaaaacaattgtttttatcttactctttcagattcaacaatcttatagtaaaagcagccatagactaaatatttagaatttattatgctgatacaaatgaaagaaacataaaatacaaatattgagtgaattaagaaaaagaggctgcttgcagtggctcacacgtgtaatcctggcactttctgaggctgagtcgggaggatctcttgaggccaggagtttgaggctgcagtgagctatgattatgccactgcactccagcctgggtgacagagcgagacctcatctcaaaaaaaaaaaaaaaaagaaaaagaaaaacaatgtttctttctagagtgcttagcagggcaaaaaaagaaggaaaaaagaaaaacagaatgttgatgttagaaaaatttggttattgtcttatgctctggagttcttacctcaagccagtgacttttaagatctgttgttttctgtactgaagcagaatagtgaaaatgtttttataggaagttatgaaaaaaagtctatattaatttgctttgggtcattctagtctctctggtaaattcataattaggaaggcctttttaaggctgtatgctagtctcacaggtacacagctacttcatatctgataaatctaaattcatatgtgaggaggttatgtttttttaaagcatattatttacacaattcactggaatggctcctttggaagttgggtgactctcttatgtaattatatacttagtaaccctgctctacaaagcagtagaaattcaagtaagaataatttactgcttatgcatagttattagaattttaaagcatttgtttgttcaaaattctagtttatcagtgttgtatttgactaattgcctacttaataaataatgaatataatttattttagaaggcacccaaattttaacaattgtaaataaacattaggagctgctccccctcttcgctttcttgtttaaagggattctcatccctttagtccaagtttcgtggagaaaataattcctatcttaaaaattctatattagaagtattatagatggacttaaattacagaattgtggaattttattgctgtaaggtagttagaaatatcttattctatccattttaccagcaaagaaggtgaagtgtatagaaattaagtgaacttctcaaagtcatacaattggtttgaggacaagtctgttccacaacctgatatgtcatgccttctcagttgtcatgataattcagcagttcatttcaccagggattccttgaacactgctgtgtgtacaacagtgggctaagcatccagaggttataacaatagtgtgagtttatatggtctaacaataatgatatcagactagtaatattttacatttgaatctcagttttatctggtgttttctaatgtttataaatgttaatgtgtggtggctaaacctttaaatctctttttctctactagattataacctctttaaaagcagggactcatttagcttttgtaaagtcaatccagtttcatttttaaagacttaaattaaaatttctaagcattgatggcattgttggaataaatgtagcttcctgaggtgtcttctctggggacgatacacattttaaaattgtatttctgttttcatcaagtactttccatttcaagtaacagattgcttcattccccctttaagcaagaagggagagtattttaagggtacagagatagctcatggaactaaagggaaaaagatggccagtaaggccccataaggacttggaaccaggcattggaatacctttaggacacaaggcagccgcccttgcattcctaagataaatcctacttagtcatggtgtatattcctttttctgtgttgctggattttatttgccattattttgttgaggatttttgcctatatggccataagggatattggtctgtaatctccattctgctgttgagaccatccagtgagtttaaaaattttattttcagttttctcattcccatttagttcttcccctgaccccctttttttacttccccactttgagacaggtctagctctgttgcccaaaccagagtgcagtagcatgatcatggctcactgcagcctcgacctctcaggctcaagagatcttcccacctcagcccctcaagtagctgggactacaggaatgtgccaccaggcttggctaattttgtaagaaattttctgtagagacagggtcttaccctgtttttcaggcttgtctggaactcctgggctgaagcaatcctcctgccttggcttcccaaagtgctgggattataggtgtgagctactgcacctggcccatttagttctttatatctgttgtttctttgctggtactctctttctttcaagagtgtttttagttattggaacattttaatcctatctatgtgtatgtgtgtgtgtgtatatatatatatatatatatatatatatttttttttttttttttttgagacagagtctcgctctgtcacccaggctggagtgcagtggcgcatctcagctcactgcaagctccgcctaccgggttcacgccattctcctgcctcagcctctcgagtagctgggactacaggtgcccgccatcatgcctgactaattttttgtatttttggtagagacggggtttcaccgtgttagccaggagggtctcaatctcctgaccttatgatccgccctcctcggcctcccaaagtgctgggattacaggtgtgagccaccgcgcccagccaatcctagctatattacagtctttgcctttaaagttaatttcaccgtctgtgccatcttggtattggcatctgttgataccagttgaagttttcccctttttagtataccaagtaatttttgcgttatatccttggcttttttaatattatgcaactcagttttgtttaaattgtattgaaaatgttgatatttttgtcaggcattcaacccagttggcttcagtctacaagttgagatttctgtaggattgtggtttcaatgtctgttacattttgaaagcctttgcagttctattgagatatattccatgcgtgtgccacttgatggccattgtggaatctggatgatagtccatcttgtagttcagttctcaaagtctatgcctggccgagtgcagtggctcacgcctgtaatcccagcactttgggaggccgaggtgggcggatcacgaggtcaggagatcgagaccatcctggctaatatggtgaaactccatctctactaaaaatacaaaaaattagccgggcgtggtggcgggtgcctgtagtcccagctactcaggaggctgaggcaggagaatgggatgaacccaggagacagagcttgcagtgagcctagatggtgccactgcactccagcctgggtaacagagctagaatccatcttaaaaaaaaaaaaaaaaaaaaagtctatgccttactgttttgggttatatccacccatgtgcagcttgggggtgaacataggagttcattaaccactttatggggccattttcttgagttcctccctctgtacaatctccccagtactatctggttccctggggccgcctttttcagtcctccagccagaaagctaggactttatttaatcctgcatctgttactgcatatggggctacgcaatgggaggctagaggaaaaaaaaaaagcaatgaggttttgtctcacccttttaggatcacaactcctctgatcagagaggaaggtttccttacttcagagttttagccttctttgggtctctgcttctgctgtggctttcctcatggaattgctttgagagaatagcaagaactttaaagaaaaatgggagatttttgccattctctctgagtgttacgatactccttctgcactccttaagctagaactagagggcttttcctggagctctctttactgacaccaatacccacttgtgggtttcaggcagcagtccaggctggtggatactggaggaataataaaaagataaattcattattggttcagtgttatgtaaaagtcttctccaattacctgctagtatttaattttttgagtcttcaaatagttgttctatatgttctgtccatttcttagtggttgccttcagtgggaaatacaggatggagtgcacttactccatcttacatggaactagaaccccttctagttaattatccttttgatattgatttatgctagtcaacaacatacactgcaagttcagtcctttgaacttccttcatggcccatcttaaggtctgttttggtaaagtgtagcaagtgtgcttgaaaagaatgtgtgtgtatactgcagttgttgggtgaagtgttctagataaatcattacatcaagtttattattactgtgcttgtcacttctttgttgcttattctatcaatagctgagagagttatgttaggctctcaaactatgtagatttgtgtattttccctttagttctgagttttttgcttattttgaaattgttagtagtggtacatatacttttaggattattctcgatgaattaacctttttataattatgaaatagtcctctttattactgcttatacttttttttttttttgagatggagtctcgctctgtctcccaggctggagtgcagtggcgctatctcagctcactgcaagctccgcctcccgggttcatgccattctcctgcctcagcctcccgagtagctgggactacaggcgcccgccactacgcccggctaacattttgtatttttagtagagacggggtttcaccgtggtcttgatctcctgacctcgtgatccgcccgcctcagcctcccaaagtgctgggattacaggcgtgagccactgcacccggcctactgcttatactctttgttccgaggtaaactttcatgttaacatagccatctcaggtttcttttttttttttttttttttttttttttgagacggagtctcactctttcacccaggctggagtgcagtggtgtgatcttggctcactgcacctccacctcctgggttcaagtgattctcctgcctcagcctcccaagtagctggagttacaggcacgtgccatcacagctagctaatttttgtgtttttaatatagacagggttttgccatgttggccaggctggtcttgaactcctgacctcaggtgatccacccacctcagcctcgcaaagtgctgggattacaggcgtgagccaccgtgcccggcctcagctttcttatgactgtttttatgatacagcttctttaagctttttacttttaatttattggtatacattaatagataattgtgtcggtttttaaattaatcatctgtcctgatcatctgtcctgatcatctgtccttctttgtttatacttgcactgtccaatagaaacatttaccacagatgccaaccaagtatatacttttaaattttcttgtagccacattgaaaatgtgaaatgaagctgggcaaggtggctcatgcttgta

SEQ ID NO: 2433 - DNA, 39995 bp, Homo sapiens
gtagtgtacactgaacccattcagtaatttctcatcctttaaacccctcccacctttaagtctccaatgtctatgagtccacactgtatgtccatatatacaccttgaggtacagtaaaaatgtgacattaatcttatgaaactaccatcatatatgcagcccgtcattgactggaaaatcattatgcagagcatgactgtacttctttagcctaaacaacctacatgccaataaaagtttcactgtttcttgattctgtatctttcaaaatgtttctttcttcttgaatgcctccctcattttccaactattcatcaaaatagtataaattgttcaagtgatgggtcaatctttttctctattccctgacttaccttaattaaaataactctattacatccacggatacccagagtactttatttagtacctcttgtaaacaaatattgtatgtatacagggtagttacataccaaaaaaacttggaaatgaaataaataaaggtgttctccaagataaaattttaaacattaacatatatttcaataaagtgtcatcttttcaaaaatttctggtccacaagcctggtccacaagccaaaccaacacaaaactaacggcatttacttaaaaatatattctcaaaagaattatattaagtagaaaggaggtggggagaaatgagaaatattcaaatactcaacaataaaaactcagtgagtataccaatagtcacagcagtattgttcataatagccaaaaggtggaaacaaccaaaatgtccatcaatagatgaatggataaacaaaatgtgatataagcacacaatgaaatttatttagtcttaagatggccggaaattctgatacatgccacaacctgaatgagcttggaagacattatgctaagtgaaataagccagacacaaaacaatacatattggatgattccacttatacaaggtacttagaatggtcaaattcctagagacagaaaatagaatggtgattatgagaggatgaatgatgagggaaatggggttattgtttaacgggtacagcatctgtatgggctgattaaaagttctggggatggatagcagtgctgattgcataacaatgagaatatacttaatgccactgaaccatacactttaaaatggttaaaaaggtatattttatgttatatatattttaacacagttatataaacttagtgaaggaagagttgacaggtctcacccaaacactgacacaggtacagatgacccatgtccatcttatagatataactttaccgtgaaaaataagcacataaaactattagacgctgggcgcagtggctcatgcctgtaattccagcactttgggaggctgaggcgggcaaatcacttgaggtcaggagtttgagactagcctggccaacatggtgaaacctcatctctaccaaaaatacaaaaattagccgggtgtggtcacacacgcctgtagtcccagctactcaggaggctgaggcaggagaatcacttgaatctgggaggcggaggctgcagtgagccgagattgtgccacagcactctagcctgggagtcagagcaagattccatctcaaaaaaaaaaaaaaaaaaaaagctattagaacctagtacaactaaacaatcaaaacagtaattcccctcttcctaagttccaagcatgaggccagaatgctaaataaaatgcaattccttttttcttcttcaatttccagctccaggggctatgaacaaggagtttctactataaaacgtaacttataatattgcaattctcacacaccaaaatccaagaaaatggtatctgagaaataatttttgaaaactcaacagcacaccttctagggattgatacagctactaagtatcacagaatacctactatactcaagatactatgctaacaaattaagtccaatgaagtataatactatcctcactctctgggaatacaatgcagtttgggactaggtaggtaagcattaaaaactatatacaatatgaagcaacatatacaaggttcaaaatgagtggcacaaacaacagattttaaaggagctaagacaagaaagaaacctccagaacagacatgatacaaactttcctataaacttgcctatagatttcaagaaacatcagttctctacttgattactgtccttctccacagaagtcttccctaattattctagcctctgtatgtcatttgctgtactctacactataacctatattcaattttcttatacaccagcttgtcaccataacaactgagctaacaaagtacattattaagtataattctgtacataaagaaagtgctccataaagacccaatgaactgaaatgaatgcttccgttataagctctcaggaatgttgcctgcatacataataaagcaaacaattactagttaatgtctgtaatacagataattttgggggtagggaggctgcatagaggaggaactgtatctcatcatttattccactccaaaaagtattggcattatggatatggcaggtattcaaccattacttgctgcctttattttgagacaattctatactttctaggtgacccagtacataattttgtggtttcctgcacaaggagataaagaaagcacgaactgatctaaaaccaagacaactgtcggttatgatgaaatgttagttcttggtagatttctaggagtttttgagttttgcttccctgatttctcttacttggaagaggcccagaagttatcagtacaatttggattagtcaagtaatagtttagctgaatttatttgtactgtaaaatgtaacaactgtaatctgatttttaagaactttaaaataattaaacatttcaagactaccaaagataaactcacctacaaaggaaaaataaagcaaaatatgatctgaagacaatatttagagaaaataactcttccaatcacttataaaagtagagaaaaagcaaagttagtaattttgagaaacagaaattaaaacaagtcccaagggaacagtaagggtctcaggccctagaaagatccatcatttggcaatcaaaatgattactaatatgctaatttttttcttggagataacatatacatgattttaatttttctagaaaatgggtaatttttattgttatatttagttttaaaacattttaccctaaaaagaaggactctgtaaatataaggccgaagttgtaatttttgcagcttatgtatggctgtgattagctgatgaatgaaatgagaagtgaaaaactttgacttgcctaagacagaatctgattttcccatacgattatcagaaaggagtatatcattaatcatttgtgctaccatgcaatcatataactccactaagccatttatcacagatctgttttcgctaacattctagaactagaaattaattctggcagatctaagtcaatttgctatctgtacagaagccgtaatttctattggtgaaaggaatgaaagagggtacgatttagaggaagagaacatccattaatgctaaaataaagggatgacacatacacacgcatttaaattcaagagttaactaatggagcttgaccaacaccaaagtgagagagaaagaacatcatgaatgcagtgtaggcaattttacttgatattcctctcagtaagattataccctagaacgagcataagattcaaaacaaaaacatgctatccacagtttacctcaatttaggaatgccttttaggaaaaaaaaaatagaatacatttacactgtgtatgattcaagtattgaagtcacaattcctcattttcttttccttctttctttttttttttgtttgagacagggtcttgctgttacccaggctggagggcagtggcatgaaccctgatcactgcaacttcttcctcctgggttcaagcgattctcctgccttagcctcccaagcagctgagactgcaggtgcatcccaccatgcctagctaatttttgtattttcattagagacagttttgccatgttgaccaagctggtctcaaactcctggcctcaagtgatccaccagcctcagcctcccaaagtgctgggattataggtttgagccactgtgcccagcctacaattcataattttagatcaatataaactccaaatatactaacagcttcatccagtggtcagctggaaaaaaaaaaaaaacaaaaaaaaatttcttccaatcttgaaagaataagctgctttagatgtaagatttaattttatattacctctgtaattatacagataatttatcaatttcttaagacatccttggtaataccagattttttccttatgtgttaactttagaacccagttatcacatacgatgtacatatatgtactaaaaaactatacatgataattaacatatgctaaatatctatctagttttatttcttaaagcaataaataatagatatgtgacttctagtctcccactaaactgtgattgtttcaaaaataataacttttaaagtacattctcttttgctaaatacagaaaggttagcctgaaatacctttgtgtacagtaaataccaacttgggatattctgtagtggagcgaaatcttgaaaaactgtaggaagataggtaaataataccaacattcttgtcacaaataaatcacaaactacatacagtagttaaatagacacaataaagtttagacaatcccattcagtaatggtaaggtggcataaacattaaaaagcattaaaaaatacaaacaaggatatttggtaaagcataaaatttggaaagtacttctcagagtttcctaaaagttcctataaatatattaacttttggccgggtgcggtggctcacgcctataatcccagcactttgggaggccaaggcaggtggatcacctaaggtcaggagtttgagaccagcctgaccaacatggtgaaactctgtctctactaaaaatacaaaattagtggtggcgcatgcctgtaatcccagctactcggcaggctgaagcaggagaatcacttgaacccaggaggcagaggtggcagtgagctgagatggtgccattgcactccagcctgggcaacaagaacgaaactccatctcaaaaaatatatgtatatatatattaactttttattcaaaataaggcctgtaatttcccacttccatttagaatcattttcaacatatagacatttatttttaacaattaaacctgactgcctataaaggttgtgcatatgagtctgtgggtatgtgactacatacagtcaaaaaaattattttccctactacaaatacacacagattttttttttttttttttgagacagagtttcactcttggtcttggctcactgcaatctctgcctccgaggttcaagtgattctcctgcctcagcctcccgagtagctgggattacaggtgcccgccacgacgcctggctaattttgtatttttttagtagagacggggtttcaccatgttggccaggctggtcttcaactcccgacctcaggtgatccacccgcctcggcctccttaaagtgctgggattataggcatgagccaccgtccctggcccaaatacatacagattatatctgtattaatatcatatgatttttgggtggtggtaacggggagtgggtatcactgacaagccttcttagactcatgaagcataaaaaaaaataaaaaggaatcccacacaatcacatttttaaacagcataggttatggccagctgagaaaaaaaagaaaaaaggaaccatcgaagccataaaatatataaaatatataaaatatatcctaccttggctttctgagtagctgggactatacaggtatgcaccaccatgccgagctaaatttttttttttgtacagacaaggtcttgctatgttgcccaggctagtctgaagctcctggcttcaagcaatcctcacatcttagcctcccaaaaagctgggattagagacataagccacagtgtcctgcctatatttggtttttaaggagtacaataatatcaccttcaagttattgtaaacatttaaatagtaagaaaatattatcaacaatgaagtaataggatttagtctgtatcagcactaaaatgacaactcctgatgtaagaccagagggctaaacatgtgcagagaatgcaagatatcacttgcacacaaacttaagatacataacatagaaatactttaatgaaaacagatttaaacccacaatttagtactttcaacagccaactatgacagtcttatacatttcttccccaaataaaaaggaatatcactgaactccacaagcttttttaaaaaaaatcaactgctgctaggtgtaataatatggcatagagtaagaaaatcaaagcacatggtatatttgatgagtcatgttccaaagaaaatagtccattttttaaaaaggtttaaaagaaagttccatgaggataagaagaggattcaagtttttgtctcagagaacaaacggattttaatcacacatactgattttaatcacacgtactgcttttaatcacacgtactgattttaatcacatattacctgtttctagacttaatgaaccttgtattacacagttgagcaaaatgtcccaaataaaacagccatatagagtctcagagcgggggaaaaaaagaagtatgctaacatcagaagaacatacctaaataaataaatgttatttttatttcaacctgccattgcttagttactttaactaagtgactattcaaaagtaaactgaaccaggagccacaaccagtgaactatttcaaaagtaaactgaaccaggagccataaaatgccctaacatctaataaatacaaataaaccatgccacactgactcaacacaaaggagaccttcataaacaaatctctccatactttaaaaatatttggctaaatagatgctagaggtttcctaaaacaagataattgtatttttctacatgtcagctagtttatcatcaagttttaggtatagtttacaaacaaagatttaaaatcaaaactacctacacattaataaacaatacaggtgaatcaagattttgctttgattgatatataagatttagtatataacaaaataaaatattttccctagaaatatgtatttttaactactcaatttgattagccttataagtcaaagttctgtaaaaaaaaaaaaaaaaaagtaatgaaatgagccaaaaggtcttacttatctctattactttatcaggaatcagctatttaaatctaaattccttgctgtccattacacaaggcattaacaatattgttatcataacaatactttaaaaaagccttacgagacttagaataaagtaattatgcaagtacaaaataacagaactgctcaaggtctggaataaatattcacaaaatctcatacaagcggtgtcttttaaaaatattacttttctgataatgtcaaaaggcacctcaatagtacatttgtgacaataataatgcacttttttatcaccttgcaatgagtcattactttttctcataaaacttaagggaaaatattctcttataaagtacaaaacaatttgctttccaaattatagtgctaatcattcattttttttctgacaccactacaggcagcaacaatagaaattaagagaaaattggacatgtatataaaggatgaataaagaaataaatgcaacacatttacactattcagtcactatgactttctctagaacctactattctcattgctatggtctaaaaggcccctaaaattcatgtgttaaaattttatcaacaatgtgatagtattcagaggtgaggccttcagtagatgattaagtcatgagaatacaaccctgatgaatggaattagcaaccttaaaatggagcttgaggaaatgagttcaccctgtccgtcactttcgccatttgagaacacagcattctctcctccagaggatgtagcaacaagcacttgacaacagagaacaagccatcaccagacaacaaactttctgcaacctttaagcgtggatttcccggccttgagaactgtgaagaaataaatatctattctttataaattactgtctgtagtattttgttataaaagcacaaacgggctgacacattgacacaatttggttctagattaaacaggtaaaaacgaggcagtgaaacagtattactttccaggcaagtgcctgtctattcaggcagagaccacgaaacaaaattaacaaaatttaaaatattccaaaacacattctttaaaaaaagcttattagaaaggaaatcctcaaaaatttggcatcaagatgtagaaataggaaatttcagccatcgtcttcctgcagaaacaatattgtcaaccacccacagatgacagtagctttgtgggagcccaaaagtccagcagatatggccaacaccccagtagaaaaaaagcttaaataaatagatgcattgaaaagggtaagaacaatttcactttagctatttcttcatccctcccctaaagccgcacagcccagtgccaagagagatccaatcagccttggatctgtctcacaaaggaaagtaaaagcatagtgagttcctgtcttctacagctctgagagtcactgcctaagaggcctacttctttctcaccccaccgacaacacacagaagactcggaggagaagctagaaacaggagaaaagggtggggactcaaaacaactagggcacagaacgcaacaaagcaccatggtttctgctaaatgcctcccacactccaccaagaggtattcccaagaacatctcacctatggtcccatctgccaactaggctatatgttcccctaacataccatgcacccctctctcctgtacatggcaccctatatgtgcccctgcagacaatacatacaagcatccacagacttggtttgattctgaacatttcaggacactaccgtagagaaaattaaaggaggctctcaacaatggacctacctttgcaggattgagagaaggaatgtaaacctaagatttcttccctgaaaaagggaagaagtagagtagttatatccacagaaaaggtctgaaggacctccagaatccccacctcagctgactggtgaagtcttttctcctgaagccagtcactacagagcaaagaagataacatcttctttgaatgtgaagatggcaaggcaaggcttcaaggaaaattaaaaaaaaaaaaacaaagaaatatgataccaccaaagaaacaaagtaaatttctagtaactaacaccaaagaaatggagatctatgaattgcctgacaaagaactcataataattgtttaacaagctacaagaggtcacagacaactcgatgcaaccagaaaaacaatatatcaacaaaatacaatcaacaaagacaaaaaatgcacacacacacacacacacacacacacacacacacacacacgaaattctggagctgaagaacaccataaatgaaataaaaatgtaacggccaacttcaatatcagacttgataaagaaaagaaagaatctacaaactcaaaaacaggtcatttgatttccagtcagaggagaaaaagaaaaaaaaagaatgaaaaagagtgaggaaagcctgcaggatttatgagacaaaatgaaccaaaccaaaatatgcatgatagaagtctcagaaaaagaagacaaaaaggatttatgggacaaaatgaaccaaaccaaaatatgcatgatagaagtcccagaaaaagaagacaaaaagaaagaagcaaaaggcttctttagataaataatgccttaaaactatccaaatcttgagagagatatggacttccatgttcatgaagctcaaaaaatcaagaccaatccaaagaaaattacactaagacatgtgctaatcaaattaccagaagttaaagacaaagtaagactttgaaaggagcattagaaaactgactcatcagagacaaagaaacaccaattagcctatccacaagcttctccctaaaaatgttacggaccagaagaaagggataatatattcaaagggctgaaaaaaaccatgtgaaccaagaatactataactagcaaaaatgtttttcagaaatgaaagagagattaaaaactttcccaaacaaaagctaagggagttcaaaaacagtaaacctgccttacaagaaatgctaaagggggttctttaacctgaaacaaaactattctaattaataacctgaaaacatgaaggtataaaactaactggtaaaggtaagtagatagtcagtgtcagaatattacactataacgatgatacacaaatcatttttaactctggtacaaaggcttaaagacaactattaaagtgactatagccataataatttgttaagtatattaagataaaaagttgtacattgtgacatcgataacaaactgttggggtggggggaataaaagtgcagagtttttgtatgtgagggaatttaagatgttatcagtttaaaaaagactgttaaaactataaaatgtttgatatgtcttatgaaaaccaaacacacacacacacctctaatagaaacaaagagaaacaacaaatagaaagaaatcaaagtatgccactataaaaaaataaagttacaatgaaaaacacaaaagaggaagaaagaatcaaaggacctacaaagcagcaggaaaaaaattttaaaaaatggcaatactaagttcttatctatcaataattactttaaattgcaaatgaaactaagttcttcaataaaaagacaaagtgggtgaatcaataataaaacaagacccaactatatgctgccaacaaaagactcattttaactttataaacacacataggctaaaaggggatggaaaaaggcattttgtaaaaatggaaaccaaggagacagatttgagtaattataaaactccaatctcctgcaaaactggctctgtgttaattactctttctctactggaattcacccatcttgataaattggctctgcctaggcagcgggcagggtgaacctgttgggcagttacaaatttggaggctcgtctgggattgcccttgtggctgcctgcctgtggttcagtagccccctctctggtgatggatccaaaggccagcccaagcggccacagttgtcttggactgggggctgattctggcaatctctctactggcagggtgctgccaatccaatgtgcatgaatttaactgcaatagagaaacagtcctggggagacgtcccataactgtagccctaccacagggtgtctgtctgtagctccatggcagggtatatgtctgtagcctggtcatggagtgcttatagctgtagccccactatgaggtatctggtttggtgagtatcctaggtactgcccacacctccttccttctcctgatcagtttggatccttcaggggtgttggtttttctgtagccccatggtggagtatccgtctgtagccccactgcatggtgtctgtcttggtttggctccatcaggggtcttggttttcctgtagccttgtgtggaggtgtctgtagctccactgcagggtgtctgtcttggttcagcccctttgggggtctcagttggctctccctaattagtaggaggagtcttggttcagcagacatctaaatcaggaagatttcagggagatttctcagacggaaaatagaatagtttagaaaggatactctcggagttcttggttagggatctggatttggaaggccttctgcctatcgtgtctttgtgtgtgtgtttgtttatgtgaagggaatctctggaggaattgctggcacaagttcagcaggcctaactcagagaaccctccttatttgtctggtcacattcggtgagccctgaaggaagctcaacaggcctgactcggggagactatccactcttcgtcttacccagcaactacccaatgaattaccattcggaggtcatccctccccgcctggagtgaatcaaaggcaacagggaccaacaggagaaagctgagccttgccagtttaatactgggtgctgaatgagttgactagtgtctgttttgttatatgtattttgctttggctgggatggaaaatgttaactcagttccccacacagtctgttgggcagcatcttgcaaaattgagaatcttttgccaatagttccataaaacagaaaagggtgatttccttttgtaaagtggcttgacccccacagctatgccacagtaagcagggtcatcaaaaaccgctccatttttctggaagctgcagtgaaatggaacccggaaacctggtatgccggcaaaaagggtaagaaattcttaccagtcaaaagtttctggtgtgtctctctctctcgctctgtgtgtgtgtgtgtgtgtgtgtgtgtgtgtgtacatggtaaatgtcaatatttatctcctctgcaagggtttaattaatagaaaaaaaggatttgtgagactagtcttaggctgcagcaaatctggtgcgctttgtgctaagaatgtctttcagtgtcgttctgtaatggagagagaggtatcacaggatagaacatgggtttaggacccctataagcctacctttcaagccagcctggcaggctggtcagttacaaactttgctaggggtccctgaaaccaatactagatgaaactttgtcttgttttatgtccttaagagcttaaccttgtgaccatgtggtgatactctctcttggtttccaccatccagaagacacgtgattttagtaattttctgggaataaagacagttttaaagactactggtaaaattaaaagtcctccaaatttagacatttggtctaaattaaggtcaggtatcagatttgctaaatgctttaaagtcataaactgcttctttgacttttgaaaattgttcagtttacctaatttggagcattagattctagataaggcctgggaacatgtggagttagcctggctccccagctatgctggaaagagtaagacctcatctgcacttctgtctgatgtcttaggctccacacctagtacataattaaaatcacttatttatcagctttttcatcaaaaataaaagttgctaagagttaaacactgtaacatgtaattgagactactggagaaacagcttgacatacaaggttgcaaggtatagaaggaaaaagtagaatatggttttgctgggagatcaaaagaaggcatggggatatggttttcgtgaaagacaatgtaattttgtgtagttcagagggttttaaagattgtctcaacctaaaagagtaatgggacaaaactgaaagtttaagcaggttgaaaagggtgtgtgaagggttgatcctgtaaaaaaagttctgggggtataagcaagttggctaaggtttgaagggtattatttttttctgcaggttgaacattaaaataaaagcacactgatatggggccacagtctgggcccatgtgtctgagtaacagggttttcttagaaaatttatctgctgtttaacagaaaattataaagagatctaaaaagtttatgaaaatcttaccttatggtaaaactaataaaaagtggatggatttataaaattttatttaaaaactagctttagcattaaagatgcactaataaaaacataaaatttttctcttttgaaaaagatttttatgtaatattgagagacaatgaaagatttttgcttgccttttgagtaaactacaaaaaatggggagagagaagaaacagattcagttggcctcagggtgtcttcattgggtctaatatattgtttgaaaagctgagtctcctaacagagtaaacgtttttctttttaaaaatttttgagttatcattttggccaaatgaatgaattatgatgacctgaaattctattttgtgatatccagtgttttaaacctttgatatttgacaaactttccaatatcaaattatgaagtatgcatttttctgacctaattaatcttttagatattatgtcctctaaagaccaaaaacgacacacttggtttatttggtataaaaatcataaaagaaacactatcaaatatgaaatggtgtttggctttctttgtgctatatttgtgtaaatgtgttattggtatatgttgcaaaattatatgaaagtcataattctgatatgacttagtatatggtaccagtaataattatgttaaattattgtgtgccacaaaagtaacaaatttccttgtcaattttgtctttacctgtggctaagactttttgtcatccacagacaattgttgtcttgctttgatcctctttaaatggtgattttataatcagctgtaaaactctaacagatgttcttaaatgcaggtttctgataactttgaagatggcaacagtagaatgaagggaaataacttttaggactctcatggagagctgatatgttcatgaatatcaagcaaaacaggagttaactgaatggactgaactaacagataatgaaggccaggtgcggtggctcatacctataatcccagcactttgggaggccaaggcaaaaggactgcttgagccgagatagctgagaccagcttgggcaacatagtcagacctcattgctccaaaaaaccttttaaaattagccaagcatggtgatgcacacctggagtccaccctactcaggaggcttaggtgaaaggatcacttgtgcccaggaggtggaggttgcagtgagctgaaactgcaccactgtactccatccatctggggcaaaagagtgagaccctgtctcagaaaaaaaaaaaaaaagagagagtgccatttccataaatgtgtgaattttccaattttacttctgctagtgagtctaacttcatcctgttgtggtcagagaagatactttgtatggtatctcttcttaaatttgaggcaaaaatttgtgtcctaaaacacgatctatcctggaaaatgttccatgtgtaactgagaagaatttgaaaacaaaaaagaaaaaggaaacagtaccagccctttaaatcccctggaagtcacttgtcaaaagaagagcagtttgaaacaatggtggaaggtataacaacaatggctgcccacttctttgtctggaaatctgagatcagaagcagcaatcggcaatcagagcacagatccccaatatttggagaacaggctcctaacttccgcaacgtaggtgcaaactgctccaggaatatgtacatggctgcctatcacggggctgggtgtgagagacagggagctggtactgtgctaagagctgaaactgaccaaaacaaactacatttatcatctaagccttttcttggaaactgtaagcattaaacagtctccagagttccaaaatagtcacattagattctaccagtgcaactgttgtctaggtggggagacagattcttattgcttcctactcagcctcttcccataatcctccaatagattttcttaaataagttttcctttatttgctatatgaccttaggaccatttccagagacttaaaatacttgtggagcatctcatgctatcgtttcagaagtcatctttgactatattattttctcttcttcactgagtattaaacaagccttgcattcctggaataaagtccacttggtcacagcatatgatctattttatatattgctagattcaaattgctaatattttgttaaggatatttttatcatcttcactgggaacactggcctttttttccccctgtaatgtgtttgcctgattttaaggtgagaataatgctggccttataattagttggaaagtattcctcctcctctattcactgaaagactttgtgaacgatgggctacagatagattagcgctgtaagggttcaaaagaaaacactgtgtcttgaaaggactgatacagttggtgaaatctgacctgcaaaagccagtcttaggagagaggggtgaagaaataccataactaagggaacaaatatgagaaattttaaaacaaactaaggaaataagcagcctactttgcttaactcagcaacttctggtacattggtaataagctactaaaacatgatgatagaaagaaacatacaaggaatttatatctccaattttcaattacttcgtgaagaataatcacaccactataatcttactaaatagattaagtaaatggattgtaccattcttgtacaatgtaaacatggtatcactacatgctatgtaccttttaaataacagagcagaaggcatttgatattcttttagcctgtgaaaaataaaagctcacttttttatatttagagaatatccagtgtaaggccatttcactaacatatgctgtaaatgtcaaacacttgctctcttagtcttctttgcagccagggaaaggcacatgacctaacctgtatcgatcagccatcagctgaagcatgaatgggtaaccggaagcaatagtcaaatccaattttcaaagcacattctggcagattctatagctatatcaaactctaaaaatacaatctaatgcatagtgacagaaagcatatcagtgatagctgacagagggaggtgcatggagaagagcaggagggagattaccaaggggcaataggaaattattagagttgatgaataattgcattatcttcaaaagtgacttcataggtgtttagatatgtcaaagcttttcaaatgtgtgtagttttattttttattattattactattttagactcaggaggtatatgtgcaggtttgttacatgggtatattgcttgatgctgaggtttgaacttctaatgatcccatcttgcaagtagtgaacatagtacccaataggtagtttttgaacccttaccccacttcctcacttccctctgtagtttttaataggtgtagttcactgtgtgtaaattatatctcattatacctttttgaaataaagaaaataaagaaaagacagggaaaaacctttgctacaggggtaaggcaataatcctttagatacacaccaaaaaacacaactggccgggcacagtggctcatgcctgtaatcccaggactttgggaggccgaggcaggcggctcacctgaggtcaggagttcgagaacagcctggccaacatggcgaaaccccatctctactaaaaatacaaaaaaaatagccggacgtggtggcgtgcacctgtagtcccaggtggcgtatgcctggaggcatgagaatcgcttgaacccgcgcagcagaggttgcagtgagccaaaatcgcaccactgcactccagcctgggtgacagagcaagactccgactcaattaaaaaaaaaaaaaaaaacccacacaattaaaaaactaacgaaattgttaaacctgttttttttgaaatacacttataaagtaataaaaaagccacagattaaaagaaaaatatttgcaaatcatgtatctgaaggacttgtatccagatagattttttaaaatctctaaaccaagtaagaaaaatctaatttaaaataaaaatccaacttaaaaaatgggccaaagaattgaagaagtacttcaccaaatgagatatacagatggaaaatgagctcataaaaatgctcaatattctaattcattagacaaatggaaattaaaaccacgagatgccactacactgtagtccaatggttaaaattaaaccaattgtcccttcctagatgttagtaggatgtggaggcaatggacctcactctacttgaagaaatggtgtacaatatatttgaaaaatactttggcagtttattccaaaagttaactatatacatatacatacttaaataagtccaggccattcagcttctacaaatttacccaagggaaatgaaatcatgtgttcacacaaaaacttgacacaaatattcatagtaacttaatttataatagccaaaaaactaaaacaaccgaacattcatcaacaggtgaacagataaagtgtggcatatacatataaatggaatactattcgtcaataaaagatgaattattaatcaatgcaataacaaagacagatctcaaaataattatactgagttaaagaatctagataaaaaagaatattgtatgactccatttaggtaaaattctatacaatacaaactgatcttgtattagtttcacagggctgctgtgacaaattaccagaatcttggtggttttaaacaacatagatttattctgttgcagttctaaaggccagggtccaaaatcaaagtgttggcaggattggttcattctggaagctctgaaggattatgtattctgtgtctcttgcctagcttctggtagctgccagcaatacttggcattcctttccttctaaatttattattccaatctctgcctccatcacatcacctcctctttatgtctcctcccctctcttctaaggatatttgacattggatttacggcccgtcctaatacaggatgatctcatctgaaaccctcaattacatttgcaaagatggtttttttccaaataaggtaccattcacaggttatggatagacatcttttggggtggggacaccattcaacccactacaaagctctagtgacagaaagcaaatcagtggttatctggagatggggagggattagaggaaagaattgcaaagaggcatgagaaaacttctaaggtgatagatatatccactatcatgattgtggtactggcttcatggatataaatgtatattaaaagttatgaaagtatacgctttgtgacaagaatatgataatttctcatgcctgagtctccggatacagccatcaaatataacctaagtaaccataaattcaaacacgatagaacaaatagttttaaaaagatgtggaattgagaaaggatagcagaacactgagctataaattaataaatgacagaggctaaggaagaatgagttctgctaccccaaaagggaagacaggtaaatcagacagtttacaattagttccctgagcattgtcttctacatagaccctaaacaaatactggtggagtgagtcaatggctcaatgaagcactaattcagagttccctgtgttaactatgaagtggtatttatagatccagggcagtttgggtgcttgttggaacaaagtaaggcacacagaacctcaaagaaggctgcaaaaacaaacagtaatagttaactttttttttttttttttttttttttttgagacggagtctcgctctgtcgcccaggctggagtgcagtggcgcgatctcggctcactgcaagctccgcctcccgggttcatgccattctcctgcctcagcctcccgagtagctgggactacaggcgcccgccaccacgcccggctaattttttgtatttttagtagaggcggggtttcactgtgttagccaggatggtctcgatctcctgacctcgtgatccgcccgcctctgcctcccaaagtgctgggattacaggcgtgagccaccgcgcccggccaatagttaactttttaaggggactgtatgtaccagtacgacaaaccagatttctatagtaacattagcatacataagaccaaataaattaatgttcccacttaactctcatttgccaagaagaaaattttacatggtgcagactaaaggaggaggaaaagttagaagaaagaataagaggaaaagagtaggaacctccaaaggctggccccttccaagcctcttacaatatctacaatttggtgatgcattggaaaatatgctgaacataaaaattcctgccatattatttagaaaccgccaaattaaatacatatgcaaaaggcatttttttctattccacagaaagttcaaaggtatgtgtgtatatatatatatatgcaaatagctctagatttatctatgaataaaccttataatgttattatatggaaaatatattacatgttaaaggaccaaaaaataatccttgagaaagatcaaacatcttctttaatgagggagatttattaagcagcaaccatttgttctagtgtattgagtttaattcacatgactagcagcttgatttggcagtctcaatgcataagacaaataattcataaaagtttgacagtattatttttagctcgcatgcttcttggactcagcccacaaatgctgctgctttatgctaccctagggactccattcaaatacaaatacatttgttagcaactgggaggctgagggaggcactcagtgcacacaacatgatattctgagaatccaaatttatcatctcatttgggtagacacttagaataattaaaaaatgactgttgttgcttctacatggactcaacgaagtaagatggtataatttaggccacataacattatgtactagaagcatgtttctagtaaggattatggttaccaatgatcattacctagtaagtttaacagtttaattgatctctctttcataaaacaatatttgagaatggtcacctaaaacatcttgttaaatgtaaacagtgttttcacataccttgattatattatgaagcacaaaacatttttatttttcatgagggagaaatatatctaaaattagaacttaacacaaacatgtgaatcaattgtttctcaactacttccaaacaaaatatttcaaattccacacaagattctgcaaacccatgagtacaagctctaatcttgacactgaatttggatcatctccatggaggaaatccatgaaccagatgtggatttattcgtccagatgtatttcacatgtatgaggaaaaataaaacatttcttcactgcctttatttgaggccacttaaaaatacactagataaaaatagcaaaaaaggaaatcctacaaatcttgaatcttgagtcttccactattctgaaggaatcatttgttgaattattactaaattaaccaaactacatatcgagtagttttcatattatcaatgcacattaaagttactagtaaatcacaatcaacttaacatcatttttataatcctccatttttctcggtattcagtagccatactaattaaaatagaaaattttaaaacaatttttgctttcacattatttgcaaattaaagagaaaaagtattccttcagttttaactaaaatgtcatgacttcaagatctaaaataaacttctatgcacaaagaaaacatggatctacaatggcaaattaatgatcacaacaaaatttcataaaattagtaatacacctggatctaattgtatggtctcaaaatttcaaattactttaaaataccaatgacacgagttttaaaagctataaatttaatatcacaaaaccaacctccatcatattaagagttcaactaactagaaaaaaacaaaaatggttctgttggcacatatatttcctttgccctctactagagatccttcaaatgcttaacaactctatttaaatgttaaagaaagtcaaatcaggaaaatgggtgatctagttgaaatgtttaattttacccaggaaaagaatgtacacatatactatttagttataataattgtaaacagatataacgatacttattttatatgaaaatgtttaatttactgagacacagtagctagtcatatatcaatgcaaattacagcagtacagatatacacatacgaccacattaaactgaaacagtagctagtcatatatcaatgcaaattacaggagtataaatatacacatacaaccacattaaactgaattaacttttgtacagcttaggttgtcaaggatttaataagaatgttaaaattatatgctgacataaaaatgaatattttaaatttagtaacccattttaatttaataaaatatgattttaaatgatttcacagaaatacttcatgcttgctccaaaaattaaaattctaaacaaacagaagaaaatttccagccaagaaatattttataaataattactttttaatttatggaggagggatggtttcccacatgcatcagaaataaatgcgaagtagtcggcaagaatatatgttttaggcttcagtaaagttgtacaatcactcaaatcatagcaacagtatttcatttccaatactataaagaaccagaagtagatcattttcataaacacatacttaatgcataattttggagtgtgtcaacaacactagagccttaagaatttctctctagaaaaaagtaactgtagttggattttaaatacaaataaagaacaaaaattttacttggctgggtgcagtggctcacgcctgtaatcccagcactttgggagacggaggtgggcagatcacttgagatcaggagttcaagaccagcctggccaacatggcaaaaccgcatctctactaaaaatatgaaaaattagctgggcgcggtggcgcacgcctgtaatcccagctactcaggaggctgagacaggagaatcgcttgaacccgggagacagaaattgcagtgagctgagttcacaccacttcactccagcctgggtgacacagtgagactcagtctcaaaaaaaccaaaaaaaattaacttagagttctgttagagatgttttgtttcactatttaaaaaattctatcaagggcaaaatctcctatttcagaggaaagcagttataagctgtatttagacatcaaatttgaatgacataaattactctgaatcacagaaagatgtagtctctaatttcaagaatcaaagtatgaataagaccagccatgaactaaatgtcacattctacacatgataaagtttgaacccctgatttctaaaacacatctggtctttcctttatctaaactcttgaaagcaaaagaacaagaactgagagtaaagagggcacttaccacctgatatggtttggctatgtccccacccaaatctcaccttgaattgtaactcccacaatttccatgtgttgtggaaggaacccagcaggaggtgactgaattatgggggtgggtctttcctgcaccattctcgtgatagtgactgagtctcacaagatctgatggtttttaaaatgggagtttccttgcacaagctccctctttgcctgccgccatccatgtaagatatgacttgctcctccttgccttccgccatgattgtgaggcctccccagccatgtgaaactgtaagtccattaaacttctttctggtataaattacccagtctcaggtatgtctttatcagcagtgtgaaatggactaatacactaccagacaaggacaatgcaacctttaataagtcagttagcaaacacatctttggggaaaataaaatttgtaaggctcaagaaacagaagacagaagcaaaatgaataaacagaagaggtaagagcagggaaagcaaaatcatgtaaatctgactctgacacagctctttaaattataagtgcattaaagaaaataatatgagaatgttccttattaaaaggaaaacctactgaagtatgctgacaacagaatgaaaaataaataggaaagaagtgcattacatatgtgtacttatcatgaagaacagaaaacaatttttctatcttctcctctcctgaattatttctaaaaagtaacaaaatacaaaacactcttgtatctcatagagatcattctcttattttatttgttgttgttgtttttgagacagggtctcactctgttgcccaggctgtagggcagtggatcaatctcagctcactgcaacctccacctcctgggcttaagcgatcctcccacatcagcctcccaagtagctgggaccagaggtgcacaccaccacatctggctgattttttaattttttatagagacagggtctcactatgttgcccaggctcatctcaaacccctgggctcaagcagtcctccgaaatcaatctcccaaagtgctgggattacaggcgtgagccaccacgcctggctgggactattttctaataacaacatacatgttcaaaaatgacacacattaaaaatcttaagtatttaaacctgaaatatctgcagagaataaataataaaatataaaaatataaacaaacttgtttcatctgatatttttctatagcaattatgatagttcaaataatgagagcaaatataattatcaaagacttctaaatattttaaaaacattaagatattactatatctatttttcagtgaaatatttattgagagcctaacacatgccaggtatttcactataaagactaaagatgtagatggcaaataagcaaaacatgatccgtgcccttataaaggttactttttagtgggaaagtgaaacatacattaggtagagatgtgtggtaaatgtcactcagaaaaattattcaattttatattttctggaaatactaatagaagttttgggaaaattcacaaataaaatgtatgagactggtgtttctcttacatgcagtttaaaaaaaaaaaaaaaactaatgagtcaatgtctttaaaggttagagttccttaagattttctatttgcttttacatttctccagaaaatttgtaattctttgttcaaaattttcataattttagaataaacttgttcaaagctgctattataattttaaaaatctcaacaggtaccctttacattcctaatattgttagtgtgtatttctcttatttattgatcaatgttaggaagattgcacaatttcaaacactggctccaccatttactacttgtgtggctttaggtaggttacttctctgggcctcagtttcctcaattttaaaaaaggaataaaaacagtactttctcccaaagcattactgaaggaattaaattagataatgcatgtatttagaacatgcctgagatataacataataagtgctcaataaatgtgatgtattatttttaagtgtagatttatttgtatatactttatttggaactcagcatccatcttcaatctgagatctcatgtttttctttaattttggaaaatatatgctttatctttctttcagatggcatttcttattctttttattctctggttctaaaactcctattaggcataagttgaagcttctcattctgtcttccatgttcttaacatttctcttcctttcctctttctttatatctacatgctgttttctaggtgacatcctcaaatcttccttcatattatgtaagtctgcctttgcatgattataaaatactatagtaagaactacacagtggcacatagaactcaaaagtttgctgaatgaaaaccgatgacattttaatatcaattattgtatgctttcatttctaagtattgtctgaccgctttcaaatcttcctgttccttttgtattgcacaggttttccattatgatcccattgtcctttttgtctataatcatttcaaacaaatttgtttcacagtctctttgaagtttttctattatcttcagttcttgttgtgtttattatcttacttatgtttgcacattcttctacatgatggtttgttttctcctgtggtttataatgcctgtaaccatcagcaaaggtcagtttatcctgtgggagcctggtgtgcctggagctatggaaacccatctacagggcagttgcatttggacatttgcttcagccaggctccaggagctctcattagttccaaccagggatatgggaaagaggttcatatgcaactcaagtttgtaggaattgtttatttatgcataattttttgcttattttacagtattttttattttgataggaatgactacatcattgttaatgaaattcctggcctcggtgaacaaattaacattcctttagatgtttttctctgaacaatatattcaagtcataccagatatgtatactactatcccaagtactggcagttctaaccttttctataaatcacctttttaataaaggaatgcaatacattgctgtgtatttttagagtaattgtcataaaaataatattaaatacattcaagttgtatgctaagagtttacataatcctttaagtaaattcaaaaaatggtgtcttccatgtattccttgcaaccaccctgggaagaaagggcatggtttactaatcccatttgagacatgaagatctgagatccaaacctactggctcatgtgcacacacagaaatatactacattcccatttactgttcatttggagtacacatatttgatattctcacattggtaactattcttccttgttttctgctaaattctagatactaaatcctgcaactcttcccacctattttacttcttcaattattaacatataacactaattggcactcctaatctacgagacacataatgctataggcattatgaaaacactatataacctcaaacctaaaatatatctttcacactttaatgtttctacaatcaggatgtatctttcaattaatgtcaaaggaaactttctgatgatcaggtagaaaagtaagttataatactactacaaacacaattgtacatataaaatatttgtttatctgggccaggtgcggtggctcatgcctgtaatcctagcactttgggaggccgaggcaggcagatcacgaggtcaggagattgagaccatcctggctaacacggtgaaaccccatctctactaaaaaaatacaaaaaaattagccaggcgtggtgatgggcgcctgtagtcccagctactcgggaggctgaggcaggagaatggtgtgaacctgggaggcggagcttgccgtgagccgagatcacgccactgcactccagcctgggcgacagagcgagactccctctcaaaaagaaaaaaaggaaaaaaaatatttgtttatctgaatattactttggttgaggtatttgcatttgtatgtcattgtgactgaattttaattcatttaattcctggttgtctagttttctaaaaagattatactgtgatactgttctgaaacagaaagtaagacgatacatataaagttgactgtcatataccaggtaaggcatttaattaaatacagtggaaaacatgaaatctttaagaactggttgctgaattacaatgccaggagaggatttatgcatcagaaaaaactcaagatactctcttctaaatttttcaaaaataattgatatattatttttctaaaacattgcttttgtcatattatttccctgttcaagaatctataatggtttcccactgcttcctaattcaaatataaactcctacacaacttgcaaggccctctattacctggcttcattagtttatacaattttaattgtcttttttttttcctccacaattctccatgagctctctgctttagtcagatcagtctctttaagtaagtctccatcttgcttacaactctgccttggtcctcacttcctgtgtcaccctcttactagcaggaaaaaccctgcctagccttcaggcccattcaagtcttaatctacgtcattttgagctcctatttatagctagagacattgttatgtaagttacccatggcatttgtctattcttggtttcaaaactattactttttccaaatttatgttgaatatggaaaacattattgatcatttctctttttcattagaggaaattctattaaaaagaaaagagattgtaaagatagaaaactaaatctcagagtaattaagtgaagtgcccagatcaaagagataaatatttcaagctagtcaaaaaaccaggttagtgatcttttactttcatagtactgatacatgaagtaaggagcaaaacaaaagatatgtatcaggccgggcgtggtggctcacgcctgtaatcccagcacttcaggaggctgaggcaggtgaatcacttgaggttaggagttcgagaccagcctggccaacatggagaaaccccgtgtctactaaaaatacaaaaattagccaggtgtggtagtgcacacctgcaatcccagctactcgggaggctgaggcaggagaactgcttgaacccaggaggtgggggttgcagtgagtcaagatggcaccattgcactccagcctgggcgacagagtgagaatccaactcaaaaaaaaaaaaaaaaaaaaagatatgtatcaaatcctgtgtcctattttgcttttcagctagcttaatataaaaattaaaatcacaaatgggacccattacacatttctgtttattgcatgttgatccactgacattcctctttcctgatcagactgaaagtttatgaactttcaagtgtaagttcacataaatacaaattaggtgtgattattgggagcaggggagatggggaggattaattatggatttgcttagagacacaaagatatatttgaacttgggaaagcagccttaagagtctctcttgggtgctatttccatgttgttgggttttttttttttctggttatacttatgcaatatgactccatttgggatttcaagtaaagctggaatgctgtattctctaaggaattaatactgttcagtttttttgttaaaacaaagaatgtgatacttttggtcaaaagttctttctctggaattcatgataaatgaaaagaatcttggcagtttctatgtcattctgcatctcacaagcaacgtgcaattcttcatgtcactacaacttggttattcactgaaacaactgatcttattacaaaacaagttaaagaaacaaacaaagcctccttcagttcctgccttgattcattattagaattcacctttcctttcacctcacccacaatcccagatatttgaaggccaaatgttgttctctctgaaagacaggacattagacaatttaaacatcagcaaattgagttcagctatccttagtcactgactgatgactctattcctatttgtacatttttaaagtaatacttatgtccttcctggaagttctttttgcattccagattacgacagggactaaagtacaacaaagaaaaaacgcaaaaagtcaagtgtcaggcagaataagatccataagcatacatatatgtaagtctgggtcaaattcaccagggtattaatctttattttaaaattacaagtaatatttatcaaattttgcccaaagtaatttaattctggcttagtatcaaattttaaaatatggtcagaggtatacatttcaaacatatgtaagcagaaaatatttacaaagaatttaaattctataataaataatatttggttgtaccatatatcctctttctaatgtcatgtgataatcagatgtaaaaattgctaccatccattttccatctccaattttagaagatgtaatgtacctgttccccccaaaatcagagatgacataattgaatgagttaaaatttctaaaatttccctagaggaatttcaaagaaaataagcaatttagtaagaacattagaaaatctcaaacatttttaaatggtatacaccctctatctctaaattacctaaggttcatttagcaaataactattgtctttattctgctgatcacctgaagtactggaagaaaaaaaaaaaacaaaactaaacaaacaaacaaacaaaaaaaaaacactcagcatcttcctctgttaaagtcacatctgcaggaaaaaggctactaaaaaaagaacaatctgctgttccaagttcatatcctgccagtagatattttgcaattctcagggtagaacaatgtttgaaaaaaacagttttataggatcaaatatttaaggtggaaattccatactcagaatatttaaatggtagttacattactaattaatatattttactaagtctgccactttgtccaagtctccagtttgtaccatgttttctaaaactttatatgacaaagcttgtcttagtacttcctgttccgcttgtttttcccatggactatatttaccatttatgattctcatgagtaaatactagtataaagaataaagtagagacaatttttctgaaaaaatccagaaaagaattaaagagatatacagataaaaacaataaaggcataagcaacaaacactattccagttgaactgtacttaatctcccaaagcaaaagtttaagttaaataaatgttcatttaactgttcttaggccactgcaaggtcaaaaatagattcaaaagttcttaaccaagtgatatgctgttatcttgtatacactggtcaaagtcattgataagagaacctgacatgtctgttttcacattatttcttcatttattaaagtgattctctgttttaaactctgatggctaaattaataaataattgcttagtaaattggagtccgacagtatgtgaaccaaagaatgtttaatctcctgggataaaattatttatagggtcataaaaaaaccacctacctaatatcttgtggttacaattacttatgtttttatgtttatttcagtgtttctcaactctgtgctgtggaatcaacctgggaggctttttaaattttgcaatatcaagactccatctcaaattgtataaatcagaatatcttggcagtcgggccttagaatcaatattttaaattttctaattatggtaaaaacataaaatttatcatctcatccattggtaaatgtatagttcagtagtgttaactatgtgtacactgttgtgcaacagatctctagaactttttcatcctgcaaaactgaaactctatacccactgaacaactccccattttcccttcccctagcccctggcaatcccattctacttcctgattctatgagtttgactactttagagacctgttataaatgaaattattaagtatgtgtcttctcatgactggcttgtttcacacagcataatgttctcatggtttatccatgttatagcatgtaataggattttcttcttttttaaggctggataatattctattgaatgtatataccacattttctttattctactgacagacatctgggttgcttctacttcttggctgcagtaaataatgctgcaatgaatatgggtgtgcaaatatctttgcaattctccttgaagttcttctggaagtacacccaaaagtggaattgttgaatcattcagtaaatataatttttttaatttttagttttaattttttaaggacccttcatactgtttcccacaatggctgtaccatgttacattcctgctaatagggcaaaagggtctaatttaatccacatcctcagtaacacttgttgttttctgtttgttttttcttctgttttttttgagacagagtctcgctctgtcacccaggctggagtgcagtggcgtgatctcagctcactgcaacctccgcctccgggttcaagcgattctcctgcttcagcctcctgagtagctgggattacaggcgtgtgccaccacgcccagctaatttttgtatttttagtagagatggggtttcaccatgttgattaggctggtctcgaactcctgaccttgtgatccacctgcctcggcctcccaaagtgctgggagctagcaggcgtgagctaccgtgcccagccatgcccggctaattttttatatttttggtagagacgaggttccaccacgttggcaaggctggtctcgaactcctgtcctcaagttatctacctgcctcggcctcccaaagtgctgggattacaggcttgagccatcacgccccgcctgttttttgtttgtttgtttgtttaatagtatccaacctaatgggtgcggtgtgacatctcattgtggttttaatttgcatttctctaatgattagtgatgttaagaaacatccacataataacatccagtcagaaatacgggatcagcactcagaagataatgcatagataggtaatggttgaaatacaattagatgagagacaaaactttcaagtaagactggtttgcttcttccatctaagacagcctgcttctgtctttgaaatctctccaatctctcctttttctatattctttcaatccaattctgctcttaagaaaggatttaatatgacttgaggaacattttttatttctcccagggacatttatgtatgaagtcttaacactgttaaaggaaagatatatccccctcccaccaccacatggtaaggaggatgggataaagccttaagacttagctacaaggcagaggtatgcagggctagtattctcgaaaccaattttacatatgactagcagctgatcccctatttcacctaagactgacaatttttagaaacaaaaacaaccaacattgatataaaaatatgcttttgtacaagccaagcatttacttgggaacctgtagaataaattacagttgtcctcttttacccacagtttcattttctgtgccttcagatctgaaaatattaaacagaaaattctagaaataaataattcataagttttaaatttcataccattctgcatagtgtgatgaaatctgtcaccactccatccagcctcggacagaaatcactcctttgtccagtgaatccacaatgtgtatgctatctgcccacctgttactcacttagtaccatcctggttatgatgactgctgaagtattacagggtttgtgttcaagtaacccttattttacttagtaatgtccccaaagtacaagagtagtgatgctggcaattcagatatgccaaagagaagccataaagtgcttcctttaagtgtaaaagtgaaaattctcaagtgaataaggaaagaaaaaaatcatatgcttaggctgctatgatctatggtaggaataaatcttctacccatgacattgtgaagaaggaaaaagaaattcatgctaatgttgctgtcacacctcaaactgccaaagttacagctacagtgtatatagtaagtgtttagttaagatgaaaaaggcattaaatttgtgggtggaagacaggaataaaaatgtattccaactgatggcaatcaagtgggtactgtccacagtttcagggtgggagtcttcgaacatatactcctcagctaagtggggactaatatatatttatgtattttagagtgcacagctagaactcagaacaggccctaaaaacttgcttaatatttgaattatgagacttttccaacatctcacttgttcaacaccctcaattatgtggcacacagccaaggtcctaaaagtaggccaaacaagcaaactataaaaaactaaaattagatatcacaaatctttattaaaaggcacttgattttcctcataggagaatcatttgacactcactcagttattagatactattagtttacacataattctagcaaattcaactagtcattttccaatttataacaaatgcatttacactgggggtgaagatggagacacgggagtctcagcacgcacagtaggctaggtcagcccttcatacctgcacacttacacattacttgtatgcatcatttactagagtagattacaagaattgaaactctatagaatagccttagtcatcaaaggttaaattatattagtatgtgctctcagaaatatgcatagcttgtacagcatgtagttacacacacacatacacacccataccttgtctccgtttttcttctgctttctgccaaaagctattcaaacctcaaccatttcatgagtcaccacacaggcagctcttactttggctttacctctccctgcttggtttcaccactccaatcacctggctcaactatagaaaacccttctgattttccctactgaaggaaacatcagggttagagtgtcacaaaacactacaaaaccgaaatgaatccatgtatgctcatctttgaaagagaaagtcagggaggaagagttcgacaaacagaaacaggaataagaagggaaacatagggttcagctcacaaatacttgcaatttatttgagtacaaaatattcattcctctaagtagtttatttatgacagacactttgaggtactgtatactctaatcacttgttctactttatctgtctttaacattactaggaaaaactgaaggatttccctgttatctgggtagttttataaatcccgacaataaaaaatctaccaagagaatgtgatatttaagtttttgtattcatatttttaaaattctttttaaaaatacaaaaattaaaatcacttatccctacttgaaaaaagagagagaaatctacttcctaacagtgcctaatggttatagatctccactagttcctgttgtattcagagtcgagtttaatctctctcccctagtcttgactataaagtcttccttacaaaaaaaaaaagaaaaatattttccttacttccactaacataaataagctttattgtctgcattattcagacctaggtataaacatacacatgtaataatagctttttaaaataaaaatgtacatttgtccacatcttgcttttctcacttaacaatgtcattcttttctacacttctcaaacatggtgtatttacctaacaacaagactactgagacggttttcagtattttgctattccaagaaacaccaatgaatatgcttataacaaattagaatctcactattaaagtgtgaatatgaacagcctaacactaatagttagttatagaaacattttatggtttggccaacctgatagccaaaatcttcattcacttttattttagattgcctttaaaaaattatgactgagattgcaggcagcttctcatggtttctggcaatatgtgtttcttcagtgaactgacagtttgtatttttttggttgttgtttagttttactattaagttctaaggtgtttttgatcaaggtaatcaacctttgtatcttttaacttggttgacagtatctaccacagtacactaacattaagaaaatttatccttccaatggcatactagaaaactgttaacctgcctacttactctatctgattagagtctagacactgtgaagttccatgtaacttgtacatttccgtcctagagaaagcagaaacccaaaggttaccgttttataactttttagaaaattaaccaaatttgtatctaatcaatattattctgaaggcatcatttttcaattttcctggaaaggtgaactatataagtccctattattcaaatgctctaatatcaagttttattatcttactggttcctactttaattaaaatgttgaatgagtttttgacacatgttcattctgtattttcatgagagtcatttttctaatgtgtgaaaatttcctgacatttaatttatttgtagatagagctatcacaatgttattcctttaaagcacctgggctttctcattaactgaggaaggtcatctccatctctgcactgtgaaaaaataaaaacaaaaaaatatatatactcatctattttccacagattaaaaaaattttctggctgggcgtggtggttcacgcctgtaatctcagcactttgggaggccgaggcaggcggatcacctgaggtcaggagttggagaccagcctgaccaacatggcaaaaccccgtctctactaaaagtacaaaaattagccgggcgtggtggcaggtgcctgtaatcccagctactcaggaggctgaggcaggaggagaattgcttgaacccgggaggcggaggttgcagtgagccgagatctcgctactgcactccagcctgggtgacaagagagagactgtgtctcaaaaaaaaaaaaaaaaaaattctacttagaattttaccatgaatagtatgattatgcagttttactctttcaatatgtaatgaattatattgatatatttcattataatgaaacatactgtacatctcaaatgaaaactacatagcatattactctctcaacagactacgagattcgattttctaatactttgcttaggatttttgcaaccatattttcccttttttgctatcttcattaagttttttttgtactgaagtaatgccaccttcatataatacagtgagatgctttctatatttttaatatttggaaatagttttaatagtaatttaagaattttcagttacttgttaatgaacgacactagaaagggcagtaagtctataaaactacatagcctcctgccttttatatgtgtgtctgtctgtcatatctttaacaactctagatttaaagaaaattgtaaatatagaatacagtccttatatacccttcactcagcatcctcctatgttaacatcttagagacagggtacagttgtttgaactaagaagttagcattagtataatactatcaactaagctacagactctatccagatttccccagtgtttccactaatgtccttttctgttccaggacactatactgcatttagcatcatgactctttaattgtcctcctctgctctgtgataatttctcagtcttttctttttttcccataaacttggcaattttaaaaagtatgagtcagaaattttgtagaatgttccaaaatttgggtttattttctgtgttctcatgcctagactgtgttacggatttaggggaaggataccacaaaggtgaagtgatcttctcattgcatcatattgggaggtacattctatccacatgacttattactggtgatgtgaatcttggttacttagtttttaacagtccttttcacttcatccatcgttatcagtttgttcaggttttctctctcaagtttcattctgatactttatattttattttaaaatgtaattgtctcatctagatttaataactgtgtatgtttaaaactgcacaaaatgttttatcatttttggtactatctaaatctgtggttatactgcttttctcaaccctaatactgtatattattgttttctttctcttttttcttaggcttctttagggtatacctaatttgttcatttttggagtttcattatcaattatattttggttttctaatttactgtcaccgttgaactctattatgtatcaaaggaatggtatttagatcttgataaatggtcaatgtgttgacagatcaagaaggaaagaggaaggcaaagggaacaagccagatgactacagcaatagaaggctggaaaatatggagcatgtgatctgtaatctggtctagctataatatataatacatgcaggaatgaaaaagaatagatgtaagcaagcaacattaaacaggtgggaataaaatattatatttagtaaataaatactgaaaaattaaacacaaaatttcatacaatccaacaattttacttctgggtatatatccaaaagaactgacaccagaaattcaaacagatatttgtctatccatgcttatggcagtactagtcacaatagccaaaaagtgaaagtaatccaactgtccatcaatggatgaataggttaaacaaaatgtactataatcatacatcaggatattattcatgtttaaaaaggaaagaaattctgatacttgctataccatggatgacccttgaagtcattacactaagtgaaataagtaagacacaagagatcaaataattgcatgattctacttataaagggtacctaaaataggcaaatcatagagacatacaagggaacagagattaccaggaggtaggggcaaagggaaattgagagttttttaaaaaatgaatacagtgtttcagtttcggatgatggaaaagttctggagatgaatagcaacaacagttgcacaacaatgtgaatgtacttaatgcctctgaatggtacacttacaacacttaaaatggtacattttatgtgtatgcatattttatcataatttaaaaaattaaataaatacagattccttactacctggaattaaagattctacataattagtttgaaatgtttttcacatattatgctttactatttactgacaaagtgtctggctctctcaaaagaaagtttaaagaatgaatgggcaaaactgtttcctcttttaggctggtcttaacctcacaatattctaaaagagtcatgctaattcctccaatgcatccttttctattgttgttatctcatcaacatccctccattgcctccacagtccacctccccatctatatctttatcttaaccatcttctaagggtcagttctccatggagtctttcccaataattctacttgatggttctctatctctattttctatccaaaaatccttttgtgtcaaagtatgtcatttgactacactttttagaattttatctattaacatcacctaacagttaaatatattgtctttatctactggaataagaccgaaagcaccttaagagatagggattttggtcatgcttcttttatatccctatatggcctaacacagtgctaaataatacagaacagaatacacaagtggttaagagctcaagatctgctgttactaactcaatataaaaaccacttctaccactaagtaggctacgcaaattatgaggctaagcaagtaacgaggttaggcaagttacttaatctgagtctcttctttctcacttgcaaaatggcaagaataaaagtatctatactttataacattatgtgagcattaaataaaataatgaatgttaaaagaacataagcactcaataaaggttagcattcagtattactattagaagtgtctgatactatttagcctaaatgatgttgagcaaatttctgagaagttgaattataaatgaaactcgattttggtgactctacagcgcactggtgacaaacttgagaaaataatacgattaaacacacacttgtttgtttgccagttctttagctgtcttcctaactacactaccttcacgaagtcaggcattgtatcagttttacctactaccatatagagagcacctaaacacagaagttgggagaagtatactgcgcacaaatttggcattcaaataactactgaataaattaatcaaaaagctaatattttgtaaaattcaaactcagatgcttacattactaacaataacacctcttcctcttttccctgtaagaaaagatgattctgcctccttgaacagtaaaagcagagattatattttttacaaaggtaaccacagaatatcaatctgtttcagtccctgcctattttacaacatgctctaatcccaagaacatatgctagataaagaaaaataatctgtagttgtacattacacactggttaaaaactctgatgactctggcaatagatgaaactacagtactaaacctcaaggtcctaaagaaaatactgctgttcagactgaaaatgagaaacagtatactttggcagttttattaatttataaactcaacttgtagaaaaaagaatgctcaacaaaataaaagttgtgaatttagaaagttgcaaacatttcatctgtttaaaacacgtaggggaaataagtttgttttctttcaaaccacatttgctaataaatacatgtttattttcccgcttcttttcttacctagttctattcagctatcaaaacaggaattcctttccacctgcaccaacgtagatagtatccaaacaattagactacaggctaaaagagtcatgtttcccatgaaatactatttcttactcctttgttaccattttcttggtgataagaagcattgagaaaaatggttttgttatttgcacgcaattttctctctttttttttttttttttttttttttgagacacagtctcgctccatcaggc

SEQ ID NO: 2434 - DNA, 7004 bp, Homo sapiens
ccattatggatatctagtttgattccatggtggtgagagaacatactctatatgtttcaaatttaaaaaaatttttcagatttcttagtggttcagactatggtctgtcttggtgtatttaccatgaacatttgaaaacactgtattctgctatttgtggatagaatgttccttgtctgcgttttccttggaaagtcttcatgcatcccaggataagactgctaatttgcccatcaactggactctttaacaaatgtgactatggaaaaccatgtaagaaactaactcatataataaaaaagtattaatggaaggggagattattcatatcataaactattactacagtaactccagaaaattacatatttaaatttcatttgggaaggagtgtgtattatttttagtttacatgagtattaaaaattacttatttttgggaaaatgttaagattttcatttatttagcccatcaaaaaatattttctaagcactctatcatatacaaaggattgtggttggtccagactctctaggggatcgtaaaccaggcatattgtagagtctccagcagttttttccttgtgttagatcaccgccatccaaaagcattttctgtaatgatggaactgttcttcatctgtgatgtcaaagactgtagtcactagatatatgaggctattgaacacttcaaattagcgtattagaagtgtagcaccagaacataatacaggccccttgcatttattacactttccttgttcaaagctgtgcaagatttgtctgaatttaaagcagataagacaggagtgactgagatacccagttttacattagactgcttcagattttacttttacattttctatcacatgggctaaaattgctcccgtatataagctcctgttcaatcttagctatttgctttatttaatttttgttcaataaaaaggatggtgttaagtaattgtcttcctgccttcattccaaaaatatgactaatcttggccaagtaagttattgtcctcattagtttccctgccaaggaaaaatcaacagaaaatgtcagccttctacatagctccttccatctacattcctgtgtggctactggctagatcattctgctcctacccactgggtgcggattagcagaagtataagtcaactatgatgcagatgctatccggagactcagaagggcaatccttaggtgtggtttccatgaataaaaggcctttggacatataaatataggagattaaacttgtatttcactttgatattgtgatttgtagtaagaaatatacatttggtctttgccaccagttcccggcacagtgcttctaaaacccttgtaatttcctgaatgacaggagtgccaggaccatcttttgttttaatatttggtctgtgactagaaacacagctcctaaaacctctggaatctcagaagtgtctttttttatgctaatgagatacatggtggctaaagtctcctgaagagcctccggttggggaatggcttccaggggaaccaacaatatgattagagcactggaagtttcagctctcctctcctgatgtcttacaaagagggactggcaattgagttaatcactattggccaatgattttaatcaatcatgcctacacaatgaggcctccacaaaaccccaaaggacgaggtttcaagagattctgggttggtgaacacatggaggttctgagaggtggtgtgcctaactggggcagggaagctctgtgtctctcccccttaagtgtcctatgtgtgtcttgcatttggttattcctgagttgtattctatataataaactgacactcataagtaaagtgttaccctcagttttgtcagctgttctagaaaattttcaagcccaaggaggggccatgagaacctcccatttatagctagtcagtcagaagcacaggtgacagtttggacttgagagtggcatttgaagtggggagcagtcttgtgggactgagtccttaacttgtggggtctgtagtaaccccaagtatataccatcagaattgcattgaactgtaatacacccagttggtgtcagaggttggaaattggttgatgtgggaaaaattcccacacatctgttttcagaagataaatattttaagtataggaaaacagtttatttttccttttttattcatataactttctttaaagacaagcaaatcatgattggaggtaaaatatgcccagaaaaaaagaaaaatggaagaaaaataaagacaggtaaatgaaaatgactcggtccagagatgcatatatccttactgtgtggcaaatataaaaatgcttgatctcctcttaccaaaaacacagacttaaatctatacctgtgaataaaagcatagaacccatgtaatagctacagtgtcatgttttgtattcagaaaaggtttataacagtgtttctcgggacccaggaaagaagagaaagctatgttattagaagtcactatgtacactattatctccagctgaatgtaaactgtgctcttgatgggaatagctaaagaaacatcaaatttaaagaaggagtcattagataatttttccatttcaaacagtgctttctgtgcttgctggttttgaccttcttctattccttcagaggccatctccccctctctctggaagagactgtaaataactaattattttagaacaagaaagaggcttgattcccttagctaatgtaatatgcatactagtctgtatgaacgctagaaatcatttctttcaaaagacattacaacttttattatccatcaaactaaatcatcaaaattatagcttccctcaagtttttaataaggtgatgctgcttgataaactaccacacatcttttgtcatcatataaatattttagtttcataactctctcataaatactagtaagtataggattggaaatcctttcagaaagcaaatcatagtgaagcatctatccagttctccaacaagactccccaactgatacattagttcaaaaataatcttaaaagcagtcaccatcaaacttattacaaaacttgcattcatcaagaaactatgccagaaaatttctgagtttaaatgtgttcaaatctgacttcgtagagcatttgatgtaacattcaggatagtaagaacagaagtaaaagctatccatcctctttaagctcttaaccttagagctctgcacctcttcttagaaacatcattcctccaatatttcagcctagatttttctcactgctaatactgcaattctgagaagaaggcaaattaactaaagttatcatcattagcagaggagtaacctgtgtcatagatatgaactgtaccacttctgaatgctttagacatttttcttagcaaagaagtatagatacggataaccagtactataacctgaaatactgcacaaaagcttataatttcttatcttgcatctgtcatttagaggtaaattaatttccttaattgctagagactaaggaatacatttttactctgtatttttcaatatttaagggaactatgttgttaggtcctcctgcaatgtgaaaggactgcaaggtctgactctcacaactaatttaaaaattgggatcattgtagaaagcctcttccatcaaagccacgggttgtaagaataaccttgcttttcaagattagttatactggggcaaaacattttttccttctctctactcaaattcctgaagtcccattatacttttctcaaagaagagtttataatacaaccagcgtgaagtcaccattctctatagaaatggcttctgatatatgaatttaacaaatgataggatataattctataaaacactgatacttagcacttccccacaaaccacataaaacttgtgaagtcaccattctctacagaaatgacttctgatatgtgaatatcataaatgataggctataattctataaaaccactgatacttagcacttccctacaaatcacataaactcgtagactgattttaaccaatacaactatttcacttctgtttgaggaagtattcaaactcagaatttattttgactgttttaagactttgtaacttgagatgtctccaaagagaatggtctaaagaaaggtaccacttggcaatgcaatgatagcatatgtaattgacacactcttagggaatcactctgcaaacccctgaacttataagggtataggtactattaagtagacatctctgctacaaagctaacaggtttgtgaaagtattcctcttcttaaattattgccaattctacccactttggttaatctataaaatattgatacggtgggcccccatccttactcctcccattaatttgacattgtaggctctagtcaattatgattttttttttttgagacagaattttgctcctgttgcccaggcgggagtgcaatggcgcaatctcggctcaccgtaacctctgcctcctgggttcaagcgattctcttacctcggcctcccaaatagctgggactacaggtgtgcgcccactacgcctggctaattttgtatttttagtagaaacggggtttcaccatgttggtcaggctggtctcgaactcctgacctcaggtgatccgcccacatgggcctcccatgaatttttacctataaaatgaaatcaaagaaaggtacagcagggagaaaccagctggctctgtgtgatataatcccatgagaaacaacatacaatgaaagaaaataacactaattactactatacctatactaaaacagtaaatgaagaaaaattctgggttcataaattggtagatcaatatcagtaagatgtcatgtctccctaaattgatctatagatttcagtgcaatcttcatcaaatttgtggcataagtttttttagatattaacaactgggtttttgcttttgttttttttttttagacgaagtctcgctctttcgcccaggccggactgcagtagcgctatcttggctcactgcaagctccgcctcccaggttcacgccattctcctgcctcagcctcccgagtagctgggactacaggcactcgctaccgcgcccggctaattttttttgtatttttagtagagacggggtttcaccgcattagccaggatggtctcgatctcctgacctcgtgatccgcccgtctcggcctcccaaagtgctgggattacaggcgtgagccactgtgcccggcccaacaactgagttttgacaaatgcatagagatatgtatccccactgaataatatttcctgatcttgatttaaccttcaagccttttctattgcatttacgctttgcatattcaataccattacttaatatatgcacgtagccaaaataatttttagcgccctatttagaaataaaaattacataataggtcaggtgtgatggctcatgcctataatcccagcactttgggaggcagaagtgggcagatggcttgagcccaggagtttgagaccagcctgggcaacatggtaaaacactgtctctacaaaaaaacacaaaaattagccaagctggtggtgtgcacctgtagtccccgctacctgggaggttaaggtgggaggactgcttgagcccgaaaggtggaggttacagtgagccaaggctgtgccactgcactccagcctgagtgacagagcaagaccctatctcaaaataaaataaaataaaataaacattaaggctggctttcttattagaaacaatttcatgaagaaaaaaataaatattttcactttacaagaactatgcttctggcagaatgtacatgtttgagaaatgtttgctgagtgaacatatgtaagtataaataaactttaaacacattctaggaagttgagatgatgtaaaagaaagcgagaaagttccatagtcattttctacatgttcttctatgctcaaaaaatctttatggtctcatggtacaagggaagaagtttagacctattaatgaaatattaggaaccataaacaattggcccctaatgcctttccagacttctcttctgttacaacctaacatccttccaaatccaaaataaatactaagcgtcaagcaacttaacatactacttcaggacttttgctgaagcagtgcaaatgccttttctctttagcatgtgttcaagctccacttacattccacttactgttgctacataataaattaatcccaaacatagcttaaattaaggatcaccttatcatggtcaaggagtatggggattaggaattcacgtagcacaaagaggcgatggcttgtctttgctttacaacgtccagggcctcagttaggacaacctggagactgaagatgatgcaacagtttgaggctggaatcatcttaagtcttgtccactcatacgcctggcacctgggctaggagattcaaaggctatgactgccaaacagagtaccaacccttggcctttccaaattgcttgatttcttcaaagaatgaagacctcagagtagtcagacttcttacattgcaggctcagggatctaagtgcaagtattccaagaaaaaggaatacatctggatcattatttatgacccagcctcagaagtgcatattcttttgttccaatcagttatgagaccacccagatttaaggaaagaagaaagaggtatacatcttgatgggaggggtataaaagagctttagggctgtgtttaaaaactaccacagcttttataatcatgacaaatttttacctccaagaaaatgtttacaaactcttcctaggcaaacttaaattctcccaaaatactcttagtattttatagttattatcatcacaggacttaatataaccttccatttaattgggagttcctcgagagatgggcttcataatttgtataccccattacagcacctggtatagtgctctatactaatgtcacaaataca

SEQ ID NO: 2435 - DNA, 10397 bp, Homo sapiens
attgtaccaatttacagtgccaccagcaatgtgtgagagtctagttgctccacattctttttaacacttggttttgaagtctttttaaaattttagctattgcggtgtgtattcaaccttagatttgaaccgctggtattgttctgtcttttacatcaaagtgtcacactggtccttttgtatgtaattggtgggtcctaactatgaccaattcctcaatgtaattcttagactaaactattgcttttttccctttcccagttgtcacaggtagtactgatggaattggaaaatcatatgcagaagaggtaggtgattttcaagatctttccttttaatataaaaaataagaataaatatgggatgatttcttatagtagttttgatttttgaagtaaaaaacacaaatataatgttgcatggtacaatagatgctttttgtttctaccttgttggaaataccatatttgcctaaacagacacaattttttgaaacaaatttcatgtaaaataagtataaaactttctggttgtactgggtagttggaactgggaacaatttagtgtaattttattttatgtcatgtaagtgtgtacagtcttcagatttgaaagtcaattattttgaactattttccaaaaaatgaaaatattataggtggttacatttctaggctagtccatgacatcattttcacaagaaggactgtgattaacagaaaggtattgatagacacaggcaaagggttcagattctctgcaatgaaattaaagaacaggagagcatcatagtttgaagaccactggacaaagcaggagccggggcagtattctttaggcaagtttccctgccttctggtccctgtgaaggcacctacagcctatgatgaagtgatctggaacagtggggtgattctaataaagatcccagcagattcactggatcttctatttatcattctcaaaaggtctttttgttaattttaatttttccagctttttatttggaagaatatcaaaactacagaaaagttgcaagaatataacaaacacctgtatactcttcacctggattcactaattgttaatatttggcacatttaatttactttactattattattaattatttcgctggaccatttgtaagttagttatagacataacagttcacccctaaatatttcaggatgaatcttctaagagctaaaacattcacccttacaaccccaatacattggtcacaataggaagtttaacgtgacacaatactgttgcataacatacagcccttatgcaggtttccggttgccccaatacatccttttaagctcttttttaatcgttgtttttccaagatccaggtaaggattatgcattgcatttggtgtcatgtctcttagtctccattaatctaaaagagtaagttagccttatttttcttttataagaatgccatttttgaaaaatccagtttagttgttttgcagacaaacttggatttgtcccattgttttctcattagattcaggaaaagcattttttcatcaggaaggctacacaggtttatccttctgagttcatcttattaggaggcaaaagaagtctcatttttcccattattgattataaacgtaattaataaggaatatgtggaatgacactttgaggctgtataaatatattatttcccaaaaatcttttatccagtggtgttaggattcattgatagtttttgcctagattggttattaccatggtggttaaaaaatggtgatttttggccaggtgcagtggctcacacctttaatcccagcactttgggaggctgaggtgggtggatcacctgaggtcaggagttcaagaccagcctggccaacatggtgaaaccctatctctactaaaaatacaaaaattagctggacatggtggtgggtgcttgtaatcccagctactcaggaggctgaggcaggagaatcgcttgaacccaggaggtggaggttgcagtgagccgagatcacaccgtggcactccagcctgggtgacagagcaagactctgtctcaaaaaaaaaaataagtgatttgtttctaatgctatatctcctacatttattaagatggtgtttttctataaaagcttttccttatccctcttgccctattaattttttaaaagaaagtatcagtatgggctaatggtttttttagtggtgttataacagattaatttcgcaaatcatcaccaacctttttatttttataaaaaatgttcttccatagcttcatttgcaatatcactcactacttaataaaccctgactttaggatttaagactggaatattagtttgctaaatcacttttagttgatagcacctaatttattgctcatttatattctgtctagaatatttcactaaatagttttgtgcagattagtgctttttttcctctactactatatttatgtgtcctgggatagtaaccacatttgtgtaaatctttttcattatgtacaacacttacatatgctgggtatgtacacagaaggtgttcctcaggaaattctttatttattcaattaacttctttagtttgccatggtccataaagtataatgctcaacttaaaattttaaaaataattatgtttttaggaatttttaaaattttagtagtagtttcctttgccagtcctctgatgtttgttttatatatccattctgcagcaaaaacttttttttttttttttttgagatggagtcttgctctgttgcccaggctggagtgtagtggtgggtgcaatcacggctcactgcagtctaaacttcctgggctcaggtgatcctcccacctcagcctcctgagtagctggaactacaggcatgtgccaccacacccagataattaaaaaaaaaaaaaaaatttttttttttttaattttttgtagagatgggattttactatgttgcccaggatggttttggactcctgggcttaagcaattctcccacttcggcctcctgaattgctgggattacaggcgtgaaccactgtgcttggcataaaacttttttaaagctaatttttaaattatagaagtggtagacacttaaaggtttaaaaaacccaaatagtatagatgatataaaatgaaaaagtaaaagtctccctccttctaaaaccctttcacatttaaatactagcttggcttagaaagataactttttggggcatttttttggtaaaatctctattttggattatgtcttcattacacttgggtttatattttgaactatcatctggacaggttttcttaaaatgggggttatagctcattaatgtttttcagtgacatgcacaggtgtgattcaaatctcctttactgtttcagttagcaaagcatggaatgaaggttgtccttatcagcagatcaaaggataaacttgaccaggtttccagtgaaataagtaagttctcacatcaaacaaaaggaatacatagctaattaatgttttcaagcagttatccgatactgacatagttatttctagttcaggaaacttctttttcaaggagagatatcattaaagagcatgaaaaagcacaggatgctttaaaaatggatcatcaattttaggctgggtgcggtggctcacgcctgtaatcccagcactttgggaggctgaggcgggtggattacctgagatcaggagtttgagactggcctgaccaacatggtgaaaccccgtctctactaaaaattaaaaaaaaattagccgggtatggtggcgggcacctgtaatcccagctactcaggaggctgaggcaggagaatctcttgaacctgggtggtggaagttgcagtgagccaagatagtcccactgcactccagcctgggtgacagagtgagactccatctcagaaaacaaacaaacaaaaaaagttttttaaaaattgttttagggtgattgtaatttgcttaaaatgtcttttactaatttatttttgtcttgtcagtagtcaaattatctgattattttatcgtattctgctgaaatgtctaaacttgtttgctgtgacttcatttcagtattcctgaatgttttttactctttttatctcagtgtttctaaatgtataacacatatgtgttaggaaaaatagaaaagatagcaatacccatgtgacagggaaaatcttttgaactttcttcttaggcaattatacttgagacctgaattacaatatggcaaagactcttaactaacttctactcaatcaaccagatggataaaccaatgctgttcatttgtttggtaaaacatactaactgatgtccccagtttgctgaccatttgtggccaggaagcttctgtgtataatgcttatatacttttatcctcacaaatcaaattgtttacttattaagagtcaatttgtgtttgtttccaaacttatgttgggtatattttttattaaatattctgtaaaatgatgaactattagtgtaaaagctagagttagttctataaaaactaagttgaatgctctaaaaaaagtgagtaaaattacttctttgaaaaattggccgtcaaattagtgttgaacaaagacaaatgtaaaatattggaagaacttacaaaaaagaaatctgctctcctgattgtttcatatgtgttgaagtttgtgctgtactttactagaactgaaattgtaatcataaatgatagaatatgggtgtgatgcatgcaagaaagactggaattcaagtccgcagatccaatctcaaagacaaggtcttggccctacacagaggattggtgaatgaattacatttatacatggtttaagtgaaaataaaatgattaccatgtgtatttatctctatgagtccttgttttaactaacttctcagctaacagatcgtccaaattctttcaatgagaattgatgagagaggatttcttctatattttgttaccaacattaccacctactgctaacatttatatagtgccttattatttattcattctctcacatgtattgtctcctttgattcttccaacatacttatgaggtatattttgttactatttctttccagaccatagctggtcctattggacagatagcttcacttcatctttagataaaaaacagagtgtattcgtctgtttttcatgctgctgataaagacatacctgagactgggtaatttgtaaagaaaaagaagtttaatagatacacatggctgaggaggcctcacaatcatggcggaaggtgaaaggcacgtcttacatggtggcaggcaagagagaaaatgagaaccaagtgaaagaggtttcccctataaaaccatcagatctcatgagacttattcactaccatgagaacagtatggggggaaccgcccccatggttcaattgtctcttaccagatccctctcataacacatgggaattatgggagatgcaattaaagatgagatttggatggggacacagccaaaccattcacagcgccttattggagattcccaatattaaatatgttatatctttttttttttttaattattttaaccttgctgagagtacagatctttacaaagctgagcatgtggtatatagatatacaatatatctttggcatttgaagcttttaacattcaagatttcagctatgtaaatgcaaccccaaagggccaagatatacagtattttacagttttgctgaggtctgaatctgaattaagccatgacactaatgagcctgaggtagttactgagatagtaggtgaatttaacatactgcctggatcttagcactgtttcattcttagcttcttgtagtcttgtatataataactcttaaagtgatttaaaaaatgttgtgtttgtgggtgtgtctagaaattgcctctcaatgaatgcatctactagttgctagaaataaaggtacataggcagaaagtagatgcttttgactaaatggaatgttgcattttgaaatgctatgatatgaatgaatctaccgtctactcgatacagaaacaagaaaagctacctcatgacactttcagcaagtactgcagcctgtacaaagattgctcagtgactcagaagatatgctttaatgatatttgagaatttggttaactcatgatatgaggtggcacgtgactgttggcagaaatgtgattctggagaaagagaggattctgttcaaacattttcatgaaggaacagatggtaaagacactgaattgacctttattaaaaggcatgggtttttatccttgttaaaatttttgaaaaatgtttttctgggcataatatgaatttaataggagaggtgatatcagcagactatgtcttctgttctaagctgaaaaaatacatagaggagatttataagttaagacagatttttaactgagatgtaaatcacctctttgggaggataatgtttgcatgaacatatttattccaggagaaagaaggaccagtatttaatattgtcaaagacagactaactctgcattcctttgattatacctttaacacatctttattgaatgcctgtgtaccaggtactgtgctaggcagtgaagataccatggtgaacaaggtggcatgcagtccctgttctcaaagaacttaagtgcaggagacagtaaaaacaaataggtaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaacaaataggtaaaaaacaaacaaataaaccaaaccaaaaaaagcacacacaaaaaaaacagacaaataaataattgcagcctatattgaatgccacaaaggaaacaaagggctagagagataacaatagagaagttcttactttgttgcagcatggtgagttttgcgattcgcaaggtgataaaagggctagaataacggcctgttgcccatataacagcactccagtaacaaaactggagccttactgaaagacctatcctctgggcccatttgggggtataatggtggagggattgtgtgtgtgcaagttgcataggatacatgcactaacgtttctattttcttaagccttgttatgcaagggaatttatggccccccagtctcattaaactgtagcctattatggagtccaagttccaagtttcagtcagccaaccaagtcaaccaactatatgaactaaacattaaatcctaaatctctggtaagtgaatcataaaaatatttggcccaatctggtattatattgttttctgttgtgggtgtcagtgagggatatttgagttaagtcttgaggagaagaggaattcttttgctaggaaactgcccttactgttgtggtggggttattagaggatcttcaagccagagaacgccaatcttgggagacacaggcaggagaacagactagtactatttccactggaaagggaggttcagagtagcttgggagtccaagattctcagtttcagttgagtctgaccaaatatccccatcccaaatctcagggtcacactttttctcattcagtgctttcaaatgagactaggtgtctgtggaattcaacttaagttgtaattctgcaactggcacatttaaatctgatgttagcaaggtgaactccatggctataaaacataaaactttttactggggctaccacggaagttctctggttctctcatggtaaatgtgagctgacagtttagtgatctgaacttgccgtttttattctataagtgctccagtatattcagaagaagccacagcttagcacagtctttgtactcatcatttctgccaaactcaaatgtagccaccatttggtccctcaaggcacttctccagtgggtacttcattacaattaacagccagggttaatttgatgaactgtcataccacttattgcataatggattgctagtatcccatttcctattgggaaggggcttaacactatgtctaagcccaaggacacaatcaaaccagtgcaaaagtcctttgaagtttgtcttgtgatcctactcctgaaactaattcgtggatcaggcagcgcccagtcaggaaacagaagtcacacaatttagtttaaccaggataacttgtctcttctagtccaacatttaaactcactccaatgggttgaactcatcgttcttacttccctgtgtgactgaaagacaaaaagaggaaatgggggattgatgaggaaattacttgacaagtgaaaaaaatcaaggactttttttttggctgctctcaccttcgaaatctgtcatcatataaacttgggcactttatatcaagaagtaattccttatgaatgtggagggtagcctactcatcagtgtcaaaatttttaagaaaaattttgaatggattatatgtagttagtaggacactaaatgtttcaccaacaatggataagtgctttgtcaggattgactgctttgatgaaattacagttctttgtaaggatacctgtcacccttttaattaagacaagctgaaagccatcacacatgtaataagcttattttattatcattcttagccaggattattcatatattaaatatttttgccaattttgattcatcaaagaaaaaaactagaaatttttttaacactgagctgagtttttatttgcaataaagcataataaaaaggagactagctttcagaacaacctgttggttcacagattgtagagatggtgatatttataattcatattattttacagtcctttcttccttctcttttcgtttcatttcttttctttttttcttttttgagacagagtcttactttgtcacgcaggctggaatgcagtggcccaaatatggctcactgtgacctcaacctcccaggcccgagcagttctcccacttcagcctcccaggtagctgggactacaggcttgtaccaccacacttggctgattttttttttttttaaattgagacaaggtctcactctgtcattcagcctggagttcaatggcacgatcttggctcactgcaacctacgtctcccaggttcaagcaattcttgtgcctcagcctcctgggtaactgggaataagaggcacgtgccaccatgcctggctaatttttgtatttttagtagagatgggggtttcaccatattggctaggctggtcttgaactcctggcttcatgtgatccacccacctcggcctgccaaagtgctgggattacaggcctgagtcactgctcccagcctaatttttttgtttgttttttcttgtatttttcgcagaaacagggtttcgccatgttacccaggctggtctccagctcctgagctcaagcgatcctcccaccttggccccccaaagtgctgggcttatacatgtaagccactgcgcccagcccacggtcagtatttctgattggatgcagtttaataaactttgatttttaaaactgcatatttctttcttggatttaaaaaaatcaaaccatgagatttctcttttttgtaacttatctcagggtgtaaagcttttggatggtcctgtaactccatggctttatctcttgaaatgcaatgcttttttagaaatgtaaatcttactggtctatagtgaacagaagagtaggataaggtaagaaatgtccatttcactttttcaggccttacttggaattaaatttctatagttaagatatgaatttgaccaaataagtttgttccacaattttctgatgcagtaataataccattaatacgatgccttgttatatttagcttgttttgttttcataagtacaacaggaggcattagtaaacacctgtagaccttttcgttttatgtctaataaaactaaaaccacatgatgttaggattagagagttaatctcatatagccccatgagtcatatttttaaaactgcttctttaatgctagaaatatctttgttgctcgtagagtttatatgttacagggccaggaataaaacccatccattttgcctctactggttttgcccatagtacctgtaactgtagagatattctacaattttgtcaatgttcctggccttccagaaagtgacgttctgtactg

SEQ ID NO: 2436 - DNA, 42999 bp, Homo sapiens
tctatgagaagcagacacagtggagcaggtgcataggttcacagggccagctatgggtagagtcgggtgtacatttttagaagccacaattcccaaaaatctcctgactataacatcagtgcacagagccagtcaaatggaggaggagtgggtccaggcaattcaggaagaaggaaagtaaaaaatgagtggtttcaggagaacactttctctgtcgaggtcactagacagaacattgtagcctcaccttaacttcggaaacaagcaatggagggtaaaagtgttgcctgggccctgggagcaaaggcagtagataacttctctgttgtgtcctccagaagggcctagtccagcctcacaggccgagaagtctgttcagttcccaagtactagagatgctgctataagggatccctgaatttcctgcccggaccacaggctccccggccttttcttcctgttttattttttcccaggaagaaacttgcctgtataattacaaggttctatgattctaaattccaacctagccttccacatcgttttgaaggtataatattatttgtcagagtgggatgatagaagatatgtgtgcacataaaattaagttgttgacaaggaaaaaaactaaaataaaaaaataagagagaaaaaatatgtatgtacagtggttagctagaaatatgccttttaaatatttgacatgtggtatgtgggcctcaatgtgtactattgcactagcttcacaaatattaaaggatgtcttttaaaagaaaaacctcttgctaaaaggttaacagtcaaaataacccgagtggcacaggtaccagtcattaagtgaaacctttcatcttcccagtatagtacctgttcccaagccagcttctttgaaaatcacttttctctcttttactatttagtttataaattgcatagtaacaatacagaaaccacaatagcagaaaaaactaataaagaatatttttaaatgaaaactcacatcctaactctaccaaaacatggtaattaaacctgaatgcctccctttcctgatatattttttcacctaaatattcagctctgggattgcattgtctttggattgagtgaaaattattgcctggtctctaaatcttccatagtgtgtgtgtgagtgtgtgtgtgtgttgaatgtatttctttttgttcagagcaaacttttttcaatatgtatatatagatatatatatttaggcagattatgccagtaattttctacaaatgtgcttttttaaaaataatctttaattaaaaaaataattattattcttatccagtggcccataatttttaaaaacactactaatagagctgggtatggagtcacacacctgccatcccagctacttgggagactgaggcaggggtatttgcttgaacctgggaatgtgaaactagcctgggcaacatagtgagacccccatttcaaaaatcaatctgtcatttaaaaataaaataaaataaaacaaaacactactaatagctttttaaaaaatatttcttaaccaattttcctagcaccttcctttcctcagtgaagtatagaaatatgttgtcagggactgtggcttacacctataatcccaatcatttgggaagccaaagcatgagaaacagttgagtccaggagttcaagaccagccaaggcgacataatgagacccagtctctaaaacaaattttttttttttattaccagggcatgatggtgcatgcctgtagcccagctacttggaaggctgaggtaggagaatcgcttgagcccaggaggtcaaggctgcagcgagccatggttgtgccactgcactccatacctaggtgacagagtgagacacagtatcaaaaacaaacaaacaacaaaaaaaagtatttgttttagaaaaaacatttggtgaggtttgggcttaaaaatatattattctaaaatgttcataaatattctctagtaatgataagattaaagtgacaaagacaaattttttcctgtgcagttctatctctcaccttcccataatttgtctgtcccatccagcttcctaaggaaattatttacaaaataatgtctgcatcgtgggtctatatatctgttgcctatgaggagagcatttaagatctgagccatcttcaagtcttatactttgtgtatggctctcatgtttatgcaggttaagtaagtttgtatgccctttctcttattaatctgtgtatggtcagttcatttcgggtaatcgtcagagggtgaaaggggaagcttttcacttcactcctactgtgacggccaactaccttcttacttattcagttttttagtatatatcaacacttttatatacctttaattttaaataaaattttgcatcatttcacttaaaattgtatttaccttttaaaaaggaaattaaaaataaatttaaaaaatataaaattttaaataataaaaataaatgatttatataaaaattaatctgacctgtgaaaaacactatcaagagaataaaatgacaagtcgtagactaggagtaaatatttacaaaagctatatctggtgaagatatatttgttatccaaaatatacaaagaactctcaggactcaatataagaaaacaaatagtccaacacaaatgtaaagatctgaacagacatttcaccatagaagacagatggatgataaataagcacattgaaagatgttcaacatcattcatcattagagaactgcaaattaaaaccacaataagatactgctacatccctattagaatagctaaaatttgaaagactgaccatactaaacattggtgagaacacaaaggaactggaatgctcatacaccgctgctggaaatattaaacagtatagacactttgtcagtttctttaaaagttaaacatatcacaccacctagtcattcaaatcctgcgtatttacccaagacaaatgaaagcgtatgtccaaacggttggacaaacattcatagcaactttatttgaaatagcaaaaacaactggaagcaacccaaatgtccatcaagaggtgaaaagatacactaactgtagaatatccatacaataaaactatctttttttaactacggggcaaaaaacaaaaaaccaaagatagaatctaacttcttggtaaataccttcactattagggttttttataacagagaattcattctttattaatactcttgactatgaaaatattttgacatcagaaatctgcaaaatatgaataaacaagcaaacaaaggacacacagctttttttatttttatttttattttatttttattttttttgagacagtctcgccctgttgcccaggctggagtgcagtggggcgatctccgctcactgcaagctctgcctgccgggttcacgccattctactgcctcagcctcccgagtagctggactacaggcacctgccaccacgcccggctaattttttgtatttttagtagagacggggtttcaccgtgttagccaggatggtcggattgtcttgatctcctgacctcgtgatctgtcgcctcggcctctcaaagtgctgggattacaggcgtgagccaccgcgcccgaccccaggacacacagctttaaaagctctccttggtctcacccagtgccaaccaactaaaacctctcattttcccccaggcatttcttctgcctccaggatggaggtacagaatcttggccttgggccacgcactggggaccatgctgggctgccgtggtcagcgacagactcaggttctcaccaggagccccaggataagcccctgaaaaaaaatgttacccatcagggtgtgctccctgattcttgtctctgctggaaggaggaaatcaagccaggaacattgtcaggagagagatgaaaatggggctcaggtttctgtctcttgtgatgtcagacaaacctttcagctccatctcctcagccctcatggaattgttcggtgtggacgcactgagattctgaactgggtcccctctccctctgcctttctctggggccagatcctgagctctccaatccaatttttcccccaatttgaccttggatttatgtatctcaattactgtctgcctgtcccaaagaataaaagctgtatcgcagcagggacgttgtttaaaaaaataataataacagctatatttttaggatccatgacactgtccagcatatcggtggtatatgataaaaaagtttgttgaatgaatgaacaaatatattattcacaatgtcacattatcctgaactgacaagaaaattaaatatctgatgtcagtattggcaacattatgaagtaaatataattctgatacagtactggtgaaaatctaacaagagatgctcattttagaaaacattttcttgtagatttgaaaatgtttaatctccatgaactagttgtatatctgcaagttgtgtatctttgggttaggcatctgccccccaccaaagacagccacatcccagtcttcagataaggtgaacatgctaccttatatgctaaaaggggctttgcagatgtgattaccattaagggcattgaaatggggaaattaccttgaattatcttggtgagtccaatctaatctcataattccttgagagcagagaatattttctggatgcagagattcagacagatggcagtatgagaaagatgtagcctgctattgctggcttttaaaacagtggaagggggccacaagccaaggaaagccagtgacctttagaagctgggaatgacccaaagtttacaaccaggaagaaaccgaggatctcaatcctacaaccacaaggaactgaattctgccaacaacccagattctctcttagagccttcagaaagaaatgcagcctgccaacatcttgatgttagttcaatgagagccataccagatttctaaccagaacaactctaagataataagtttgtgtgtgtgttttaaaacaggctaacagcttacaaaaatgtgttcttttaagccactaagtttgtagtaaatttttatagcaggaatagaaaactgatacaacccattctaactggtgtgagatggtatctcattgtggttttgatttgcatttctctgatggccagtgatgatgagcattttttcatgtgtcttttggctgcatacatgtcttcttttgagaagtgtctgttcatatccttcgcccacttgttaatggggttgtttgcttttttctcgtaaatttgtttgagttcattttagattctggatattagccctttgtcagatgagtagatcattaaaaagtcaggaaacaacaggtgctggagaggatgtggagaaataggaacatttttacacaaccattgtggaagtcagtgtggcaattcttcagggatctagaactagaaataccatttgacccagccatcccattactgggtatatacccaaaggattataaatcatgctgctataaagacacatgcacacgtatgtttattgcggcactattcacaatagtaaagacttggaaccaacccaaatgtccaataacgatagactggattaagaaaatgtggcatatatacaccatggaatactatgctgccataaaaaatgatgaattcatgtcctttgtagggacatggatgaaactggaaaccatcattctcagcaaactatcacaaggacaaaaaaccaaacaccgcacgttctcactcataggtgggaattgaacaatgagaacacatggacacaggaaggggaacatcacacgctggggcctgttgtggcatggagggaggagggagggatagcattaggagatatacctaatgtgaaatgatgagttactgggtgcagcacaccaacatggtacatgtatacatatgtaagaaacctgcacgttgtgcacatgtaccctaaaacttaaagtataataataaaaaaaaagaaaactgatacaaccctagagaaagtcttgtacatatgccctataaacacacaacagaatttttttaatttttttattgagataaaaatgtatatatatataatttaccatctgtacatttttagaggccagtttagtggtgataaatacatttatgtttgcttttcttcatctcctcttcccactccccttgctggcctctagcaaccaccaatttactttctatcttcatgagatccactttttcaccgcccacatatgagtgacaacatgcgatatttgcctttctgtgcttagctcattccatttaacataatggcctatgttcattacgttaagcgaaatggccagcaccacttatgttgctgcaaatgacagaatttcattcttctttgtgtctgagtagtagtccatgatgtatatatattacttttaaaatctgttcgtttgttgatgaccacttatgttgattccatattttggctattgtgaatagtgctgcaataaacatgggcatgtagagatgtctttgatacattgatttcctttattttggatatatatccagtagtgaaattgctggaccacatggtagctctagttttacttttttgaggaacctccatacagttctccatagtggctttattaatgtaaattcccaccaacagtgtactagtgttcccctttctccacatctttgccagcatctgttattgcctgtctttttgatacaagccatttcaaccaacatgagctgatattgcattgtggttttgatttgcatttgcttgatgattagtgatattgaacattttttcatcttcctattggccttttgaatgtcttcttttgagaagtatctgttcagatcttttgcccatttttttaaaaaattgtatctatttatatatttttaacaatttttttagaagcaaggtcttgctgtgtcacccaagataaagggcagtggcttaatcatagctcactgtaacctcaaactcctgggattaagaaatcctcctacctcagcctcttcagtagcccatttttcaatcagattttttgattattattgagttgtttgagctttttatatattgcagttgttactcctttatcagatggatagtttgaaaatattttgtcccattctgtggttggcacttcactttgttgattatttcctttgcttgaggctttttagcttgatataatcccattgtctatttttgcctttgttgcctgtgcttctgaggtcttacgcaaaaaaatctgcccggaccaatgtcctggagcatttctcctatgctttcttttagtaacttcatagtttcaggtcttagattcaagtctttaatctatttttattcgatttgatttttgtatatggtaagaggggtttaattttatccttcttcatttagttattcagttttcccaggattatttattgaaaagactgttctttgcccagtgtatgttcttgatgcctttgtcagagatgagttgtttgtaaatgtgtagatttatgtctgagatctccattctgctccattgtcctgtgtgtctgtttttatgccagtagaaatatattggcaataattagtacagaaaagctgaaacaatgaaatgacaaaagtgaattatattgatataattcattatgctcactaaatgcaatagcatgcagctaggaaaaacaatgtagtgcacacagtattaaaataaaacacaattcaatatacacagtgctcacagtggccatcattagagtgttgaagaaggggatgtagtcagcaaaagttgtacaggtgacttcaaaagtaatcataagcacttatgattacttttggcttaatttcttaaaccaagactggagacacaagtgttcattgtgtgcttattctatatatatattataaatattttataaatatattgtttctattcagtatttaataaagtaaatcaatagaaaaggttaaaaagcaatgcatacatatttcaaatatttttttgctccaaattatataagcattgcatagttattgccctgggccaggtaaggtggctcacacctgtaatcctagcactttaggaggctgaggcaggaagagagcttcagccccagaggtcaaggctgcagtgagccgtaattgcactactgcactccagcctaggtgacagagcaagacgctgtctcaagataaaaataaaaataagttaataaataaataaatatatgtgtatatattaactgattttattaagtatatatatagttaatatatataactatacatatatgtagttactgtcttggtctatagtcaatcttacagtgcttaagacattgatactgagaacagttctcctaggtatatgctgtgtttctggggtgacatgatgctctcatcaggcctctgtgagcctaattctatcttacatttaccccactcttcaacaacaacttgggaaggtgtccctaaatgttcctaggtgaacccaaacctgtggccctcaacacgtttctaggtaaagcaagctcctgacatatctgtggatatcctctcattagaagaagggggaagagaccatctcaaagaaattcatttaatatagcttttcagcattaattttattttgacaaagagacacaaagtaaataaaatttctaaaaaactataaactttcaagcattttcacactaagtctagccctgctcacatgccagggaattataaaggtgatctgtttctcaacctgaccaagatgctatagtaattaaaaataaactcaatccctggatctctaccaaagggtcttttcatatggatcaaagtgtatctactcatcacattctggaaaaattatttgtctggaaatagacaaattatccaaaatataatagaaataacagcctctggaaagggccaaataagactcttaatgatacaacagctaaatctaggtctgatgcttattctgtgtggacaacaatagcagagctaatggctgatttgtgggaagtaaacattatgtttgcagaatcgtacacgatttcagtagaagggcaaggaaatttcagttgggaacagattgctccatggtaatgtgatcactatgtacccaacaatggctctttcttcctagcgtcaatgcagatgttgttttatccttaactgttatcatttctgtttctaatcacataaaagtgtatccgttacatatctgaagtaaattcatactagtggtgtaacatctccagccatttaagtgtaaaaagagaaaacgtatgatgtgtttactcactgttttatactctgtaacgcatgaagatccttttattcattgcctgtacttttatttttaaactttctgaaacactttatgttatatccagcatagaactgagttttcctttttgatttaatctgacaatatttttttcctctaataagagagtcaagcccacttacttttattggtaaattctgtttggttatattttggttacagcatgttatgctatgatctatatgcacgtatcttcttttgctgccttgtttgtttttattgattttgttttgatgttgtgatatttggaagagttaaatttttattctgatggctaccttatgtaacttcataaaatcatctctttctttagacagtagctaatgtctctaaactaagaacaatggtattaactctttcttgtcttccctatgtgatctttcatctcccaatttgatataataatattaactttgtttcccctgatgccattaagtatgcctacatttctataaacagtatcctttgactcccaggcattacagacgagcagtcagtaaaatcattctgcagaataccttctttttccttttcttctatttttcttagttgtatcatttctatattgccagagcacctacagttgcatttctttctgtcagctttatccagcatttgtttttgtcttttatttgaagttaaatatattccttgctcactacgacactggggagaggaaggtttttgttgtcattgttgtgcttgtacagttgcttatttaaaaacattggcaaaaacaaacaaaaaatgtatgtagatggaatggagataagacagaaaatgagagagattgatgatgagtgtgcttattctagactgggaggggtgctgcactgagtagtgtctcaaggctgcaggaaaggatggttgattgtgagcaggtggagtttccactgaaggagagaagtcctgccttcaacaacctgtgcagaaccaggaactggtaatggttcaaatcaacttacagacctggaggtagaaatttaagaaagctcgtttagcacctagtttcctagaaaatattagctactatttgctgagcatctgtcagtctgtctgcagcatggaagatctgagtacaggggagactggattagtaacagtgggtcagaaaattatataatattcaaccaaaattcctgctttacatagacggcacctggtatttccagaactagaaggtaaagaaattatttgtgcttgaacttgcagaaaactgccttttcccttcttctcttgcatcttaacctggagcttctcttttcttgagcctcagtgtccttcccaactcaatttataattgacttcctgcagtttctccttaggacagggctttgttttgggggtggttaatttgtagggttcataggatacagaccactcacagcactgctttttgccatcctcactctcagctgtgagttgaggcccaggaagccttctgccagcctcagctgctgttctcagattaatctgctaagttctttttgcctagtaggaatctctgaatttaggaacatagatgttagcaattgtatttctagtttttccagttcccagggccattaaagatttttttcctttcctttccttcttccaaaacagttggtgattcccctgggtctctgtggtttaacctcacaaaaggttcatgatgacaccctgttacattgttttgtcatagttaataccttgttatcccagttgctcagtcaatttttgtgagagattcagggatattaataaaactgtgctgctgctactagcatcttgcataaaagccctatgaattaaaatgtttattttacgtgtgatttgaacttgtaatttttattcaaagtttttcaacagagatccagagaagaccctctttatatttgtagttttgtgcattgcaacactttttagtgaaaaaaaaaaaaacatgagaacaacacaagtgattttaaaagaataaacctacaatccattaattataaaatgaaatactgtgcaggtgttaagaatgagggaatcaataagaacttgtgttgggtaactataaactcttaaaaaataaagtatatgctcatgtgaccatattatcgtttaaaaaaatacaagcatacttgcacacaccttcaagcaaaatgggtacatgcatttaaaaatatttaaattaagtaaatggtccaataatttaactttgtaaaattctatgttctctgattattttatacactagaaacaggcattactgttttgtttatttcatttgaaataattgtagtcacatgaggtttaagttataagacagagaggtcacatatgcctattttctaattggataccttatttattactattgagttttgagaattctttacatatgctagatgtaagctctttgtcagatatatagtatgcaaattatttctcccagtctgtaattcatgttttcaacctctttacaggatctttctaagttaaaaaaaaaaaaaggtgtttatttattttaatgaagtccagttttatcactttttccttttgtagattttgtttttgatatcgagcctaaaaattctttgcctagcccaaggtctaaagagttttcttctatttttaaaagtttaatgaatgaatgaatttatttatttatttatttattatttttgacacgaggtttcgcccaagctgtagtgcagtggtgccatcattgctcactgcagccacgaactactggactgaagtgatccttctgcctcagccacttgagtagtagctgagattacaggcacgagctaccatacatgacttaaagttttataatactacattttacatttaagcctgtgatttatgtgagctaaattttatataaagtataaatttaggtcaatcttagtttttgtatctatgaatgtccaattgctctagcaccatttgttgaaaaaggtatccttcctttaaactgtttttgcatccttgttaaaaaaaaatcagttgaatattgtgtggtctgtcaccttttaataagataaaaacattaacactcaccagatatcgaagtttagaaacttttttaaagctaaacttctgaaaatagaatacaaaataaaaaacatgtcaaattagtcaatttgcataagaccagttcatttaaatatattaaaatacaaactaattcaaaccactaaattgataatgcaagactataaatttaaaggctaattattaagtcaaactgctgaattctatgtgttagagtgagttcagaaagatccattgtattattgaataggcaaaagttttaatttcagaggatgaaactgacatattactgccaccttgtggatattctgttattataggctattataaaaagcaatgagggtatgtaatctgttctaacaagaaacatttcctttttttgtcgtttttattattattatcattacattttaagttctgagatacatatacagaacatggaggtttgttacataggtatacacgtgccatggtggtttactgcacccatcaacccatcatctacactaggcatttctcctaatgctatcactcccccagccccccagccccccaccccctgacaggccccggtgtgtgatgttcccctccctgtgtccatgtgttctcattgttcaactcaaaagaaaaaaaaaagatgcattttctgctttcccaattttttaaatacaatgcaactttatgtttaatttaactaatttaattttttgagacaaggtctagctctgttacccaggctggagtggagtggcatgaatatggttcagtaacacctccacctccctggctcaagtgatcctccttcctcagccgcctgaatagctaggaccacaggcatgcgccaccatagccagctaatttcttttttcttttttgtagagatgaggtctcactttgttgtccaagctggtctcaaactactgggctcaaaggatcctcctgccatggcctcccaaagtgcttggatttatgggtgtgtgccatagcaccaggcctaagcaactttagagaagcctttttttctttcataaaaacagttgtagatattttccttatggaatttatttgtgataatatattttaatagatggtttaatttgttaaataatttgtctcagataataataattaattgatattaaaactacaaaacaagcagggtcttctttttctatgaaaaatgaaagttgattctgacatctatgtaaacattttaaatattcaaagtatataaatgtgaagtcctatcaagattaattagacaagagaaagaaataaagggcattcagattggaaaggaggatgtcaaattgttcctgtttgcagttgacatgatcttatatataggaaaacctgaagactctaccagaaaacttttagaacaaacaaattcagtgaagttgcaagacacaaaactaatacacaaaaattggtggcatttatatatatgaacaacaaactagctgaaaaagaaatcaagatggcaaacctatttacaatagttaccaaaaaaaacacctagacataaatgtaaccaaggaggtaaaatgaaaactacaaaacactgatgaaagaaattgaagaagatacaaataaatgaaaagtaaaaagtagaaagtagaacagaggatactgcaggctgaaaagggtagggagaaaggagggatagtaagagatttgttaatggatacaaaattacagctaggtaggagtaataagttccagtgttctatagcactgtagatgacattcatgctcatggatcagaaatactaatgttgttaaagtgacagtacactcaaaagcaacctacagattcaatgcaatctctatcaaaataccaatgaatattcttcacaaaattaaaaaaaaatccaaagagattgtatggaaacaaaagtatcctgaatagccaaagcaatcctaagcaaaaagaacaaagctggatgtatcatgctaccagacctcagaatatactacaaagctgtagtaaccaaaacatcatggtactggcataaaaacagacacatagacctatggaatagaataaagaacacagaaaatccacatatctcagccaattgattttttacaaagatgccaagaacactcattggggaaaggatagtctcttcaataaatggtgcttggaaaactggatatccaaatgcagaaggatgaaactagacccctgcctctcaccctatacaaaaatcaactcaaagtatctcaaataaccaaatataagacccaaaatggtaaagctactagaagaaaacataggggagatccttcaggacattgctctgggaaaagattttatgaataaggcatcaaaagcacaggcaacaaaagaaaagtaaacaaatgggatcacatcaagctaaaaggcttctgcacagcaaaggaaataatgaagtgagtgaaaagacaacctacagaatgggagaaaatataaactactcatctggcaggaaattaatatcaagaatatacaaggaattcaaacatatcaacagcaaagaaacccaacaatctaattaaatataagcaaatgctctgaacagacatttctcaaaagaagacatacaaatgaccaacaaatttatgaaaaaatgttcaacaccactaatcagcagggaaatgctaatcaaagccacaatgaggcatcatctcatcccagttaggatggctattatagaagagacaaaaataaacgctggcaaagatgtgaagaaaagggacttttttttttgacagtctcattctccgtccaggctggagggcagtggtggtgtaacctggctccctctgcttctagagttcaaatagttctcctgcctcagcctcgtgagtagctggggaaaaaggaactcttatacactgttggtaggaatgtaaattagtgcagccagtatggagaacagtattgaaatccctcaagcaatcccactactgggaatttatccaaaggaaagaaaagcattatattggagagacatcggcatccccatgtttattgcaacagtgttcacaatagccaagatatggaatcaacctaggtttccaataacagatgaatggattttaaaaatgtggtatatatacaccaaggaaggctatttagccataaaaaaagaataaataaaatcctgtcattctcagcaacatggatggaactggaggatattatgttaagcaaaataagccaggaatagaaatttcaacaccacgtgttctcactcatgcagaagctaaaaaaaagttgatctcatagaagtaaaaagtagaacagagaatactgcaggctgaaaagtgtagggagaaaggagggatagtaagagatttgttaacggatacaaaattacagttaggtaggagtaataagttctagtgttctatagtactgtagatgactatagttaacaatactatattatgtagtttaaaataccaaggagtagtttgaatgctcccgacacaaagaaataataaatgtttgagatgatagatatgctaattaccctgatctgatcaccatctacatgtattgaaacatccccatatagcaatgaatatgtataatttttgtcaatttaaaaagtaaaaaaaaattaatcttgaagaatgcatttgaagaacttgtactcaagaaatcagcttattttaagaacttgagtctccttggaatttgtgttttctagaccagtacttctccaaattaaagcaaatttaggctgggcatggtggctcatgcctataatctcagcactttggaaggccgaggccagcagctcacttgaggtcaggagttcaagaccagctgacccaacattgtgaaaccctgtctctactaaaaatacaaaaattagccgggcatgatggcatgcgcctgtaatcccagctactttgtaggccgaggcaggataatcgcttaaactgaagagatggaagttgcagtgagccaagattgaaccactgcactccagcctgggcaacagagcaagactctgtctcaaaaaaaaaaaaaaaaaaagcgaatttagttcactttggtattgtgtcaaaatgtagattcttttaaagtaaatccagagaatttagatgtagttgaagcttgtaatctgttcttaattttttttaataaaaataaaatatttagatttagagtaaatctaaagtgaggcctgaagctgctcccaggtgatactgatgctgctcatttttgcccaaattttgagtcacaagattctaaattagtggtttgaagtcctacatgcgtaatcacttggggagctcaattaacacccagcacagactaattattaataaatcagaatcttcagtattaggcttcaatcattggctttttttttttttttttttgagatggattctcccactgctgcccaggctgaagggcactggcacgatcttggctcactgcaagctctgcctcctgggttgacgccattctcctgcctcagcctcccgagtagctgggactacaggcacccgccaccacgcccaactaatttttttgtatttttagtagagacggggttttaccgtgttagccaggatggtctcgatctcctgacctcatgatccgcctgccttggcctcccaaagtgctgcgattacaggcgtgagccatcgcgcccagccaatcattgacatttttaaaggtcccaggtgattctaatgtgaggtctttacagacatcttgtaagttaaaaactataaagtgtaaaattgtctttacctcccttttggaaaccacaaatgtatgtcaaagttagaacagaagtagaaagcatacaaaaatgaacttgacaatacccatctacagatccgtgataggcatttgtgtacaacttgacctacgtgacatttaaggtcagtttgctccgattattattaagaataaagtcaactacaatgatggcaatatgtttcatcgacagcagttcacccattgagtgttgataccgtgggtctgagtgaagctgagggtggaggaaacacagggtgagggagcgggatagtttgccccttcaaggattgacaggatataacacaaaaggcgggaggggggaaagaataaagtctaccttctgagtaaagcaaagcaaagtgttctcagccaatccaagtggcgcctgtaaataccattatctagagaaaatatgattaaagaagtggcttttctgtgtaggaaggtaagaagtttctggatatttgtactgagtaggaatcaagatttctgggtagagaggctggaagaaaatcagcgcctagtccaggaaaaaaaaaaagaaaaagaaaacttctccgaatttttctgcttgaattccatgaactcaaacttgtaatttagtctttaaacataatagtgagtcataatattgcctacgtatacgtggaagaaaatgttgttttacctatcttcccaatgggaaaaaagtggctcataaagaaaccttgacttccaactaaactttcaggttacttagcctcacatccattccactaaaatacaagtgtgtgctctaagtagaaagtagaaggatggttaccagaggctgggttgggagaaggggaggaagggagtgggagcctgttgatcaaagggtacaaagtttcagatatgggaggaacaggttttgagatctattgcacagcagagtgactgtagtcaataataatgtactacatacttcaaaataatggtaaatttcacgtctcaccataaaaaatgatgggtaagtgagatgatggatatgttcattagcttgatttaatcatgccaccttatatatatatatatatatatctcacattgtagcctataaatgtatacaattatggtttgtcaatcaaaaatatttatataaatttttaaaatatctgtacgctaatagagatattacaatcagtgcccatagaggaagaaggaggatgttggatgagtatattttcttctgatccaactgactctgcatgaagcttaaaaaagtcaattacctcctttccttctttctaggtagctttgttgaggtataggtgacctgcaataaactccacatatttaaaactgcacaatttgagaagttttgacatatataaatatacgtgtgtaagaccaccaccataatcaagataataaacatcaatcacctaaaaatttccttgtgccactttctgttttgtttaagatgggatcttgtcatgttgcccaggctgttctcaaactcctgggtgcaagtaatcctcctgcctcagccatccacaatgctgggattacaggcctgagctactgccctcggcctccttatgccactttgtaatcccaccctcctgaccttccctgctgctcctctccaagcaactactgatctgctttctgtcactatagataagtttgcattgtctagattgttatataaatgcgtcatagagtatacatttgttgtttttgcctggcttctttcactcaatatttgtcatgagatttgtccttgttatgtgcatacatttttattgcaaaatagtgtttgattgcttgactatatcagtttgtttaaccttttatagtacttgttaatggaaatctttgttgtttcccgtttgagggggtaattgtttgtttgtttgtttgtttgttttgagatgaagtctcactctgtcacccaggctggagtgcagtggcatgatctcggctcactgcaacctctgcctcccaggttcaagcaattctcctgcctcaggctcccaagtagctgggattacaggtatgcaccaccccaccaggctaatttttgtatttttaatggagacagggtttcatcatgttggccagactggtctcaaatccccggcctcaggttatccaccctcctcggcctctcaaagtgttaggtgacatgagccaccaagcccggcatgagggtataatttttaaaaagcttctgtgaacattcatacacaagtctttatatggacatatgcttttgtttctcttgagtaatacctaggaatgaaatggctggaccatctgcctgttttctgacagcatccaattagagcaaaccccttctttcttagacattcactcatctcccaaccaaagggtaagtcctataataggttccttttaacatcctattactgagacacccattggtttctcttggtatgtgttctccttgtagcaggccaggcatggtggctcataccagtagttccagcactttaggaggccgaggtgggaggacaacttaaggtcaggagttcgagaccagcctggccaacatgatgaaaccccgtctctactaaaaatacaaaaattagcccagtgtggttgtgggcacctgtaatcccagctactaggaaggctgaggcaagagaatacttgaacctaggaggaggaggttacagtgagccgagatcatgctattgcactccagcctgggtgacagagcaagactccgtctcaaaaaaaaaaggaaaaaagaaagttgtagcaaatctaattaattacgagtgtgtttctataggtctttgcctgtaattattgtctagaatttttttccattttacttaaatcatctggtttattggcataaagttcttcaaagtattttcttaccattcttttaatatctataaaatctacagccatatcaccttttttattcctgatattggtaatttgtatcttctcttcatttccttatcagttttactaatggtttatcgagtttattgatcttctcaaagaccaataggttttgggtttattgatctcaattgtttttgttttctgtatcactgaattttgctaagattattacttctgtgattctgcatactttaggttgaatttctattctttttctagttcttatgataaaatatgaagttattgatttttttttcttttctaatatgtaggcttttagtgctaaaaatttccctttcaagtactgctttacttgcattacatacatttttgtatgttgtgttttcactttaaaacacttcctgatttctctttagatatcctctctgagtcataggttatttaaaatatgttatttggtttccaaataattgagaatttttcagatatctttctgttactgatttctaatttaattccattgtgctcagaaaatgtattttgtgtaatttgaaccatttcaaacttggttagttttatgtcccagaatatgaactatcctgttaaatgttttctgtaatgttgaaaaaaaatgcacaatctgctgttgttggttgacagtgttgcaccatcttatatgtttctattgattttatgtctactttttctatcaactgttgacagagaaatttaaaaatccattataattaggaacgtgttcgattcttcttgcagttctatcagtgtctgctttatgtatattgaaagcttgttcataggtgcataaatgtttaggatcattatgtcctctcgatgagttgatcactttatgattctaaaatgacctaattttatcactgctaatattctttgctcttaaatatacttcctctaatgtattaatagctactcttgcttttttcactagtgttatcaagttacatctttttttctgttattttccttttaaccaatttgtttttatagttaaagttcatttcttatatggcatatataactgtgtcttttgtatcttgttcttcttaacctggctttttattggaatgtttacatcatatacctttaatatgattattggtacggtaaagtttaattttatcatcttactatttgttttcttttttctttctttttttatgtgttttttgtttgtttgtttgttttgtttttttgtgctgaccatggaaaggacagctatttgttttctgtttgttacaagtattcttttcctctttttcttcttttggattgaatattttatgattaaattttatctacttttttgcttgttcgctgtatgctttgttattttagtgactgctttagggtatgtatctttaaattatcagtttacctatgggtgatattataccacttcatgtgtagtataagcactttacaataatacacatccatttcttgtctacatgtatattgcaataatatacatctatttcttgtctacattcagtacaataatattcgttcatttcttaaatcatatgggtaagatatttgttgacttaggacagacagcacgaaagactagagaaattcaaagcatgataattgagggtagctgcctctaacagcaaagggtatctcaaagatgtatataaatagactcaagtttcttaattatcattcagtaacattctaaaactttgagactgatatcctccttttccctcacacaaattcttatttcctgcaagtgaaaggctaaggttgttataaacaaatgccaagtttgtttctgtcacttgacaaactgcaaggtcggttgaatccgggttttggaatctcttttatctttttttttttttttttttttttttgagacggtatctcactctgtctcccaggctggagtgcagtggtgccatctccgctcactgcacgctccgcctcctgggttcatgccattcttctgcctcagcctcccaagtagctgggactacaggcacaggccaccacgcccggctattttttttttttttcggtatttttagtagagacgggatttcactgtgttagccaggatggtctcaaactcctgaccttgtgatccgcccacctcggcctcctaaagtgctgggattacaggcgtgagacaccacgcccagcctggaatctcttaactgaaagtctgagcactgattttaaaagagcaagataccaaacactggaatgtgaatatacagaggtacttagaggatttagagtccagctttccagcctgtgtggcccttcctttccctgaggaaaatgagcctcctagactctcactcaaaggaattttcctacttttaaagaaaatatccatagtcttcataactcattgtctcccaaatagtaaccaggttaaaatggaatcaaacccaaaaaggctttttccatagcatatcataaacaatgcttacacattgcaagaattacagattttagcatttcatattggccactatcttgcaaatgcatggattatagattctggtgataaatgacaaaaaagaaaattttagattagggtgaatttaccagtgtaatgtgtttaccagacattgtatgttcaaggtgctagctcaggtacctggaagtagtcttagttaattgatcatcattggtctgtgtatgtacttcttgattcacaaaaatctaaccttatagaacagtggaatgctttttgatgactcagacacagtagcattttctaattcaaaaaaaaaaaacaaatacagagtctcgctctgtcgcccagtctggagtgcaatggcgcaatctcggctctctgcaacctctgcctcctgtgttcaagcgattctcccgcctcagcctcccatgtagctggaattacaggtgcccgccagcacacccagctaatttttgcatttttaacagagatggggtttcaccatcttggccaggctggtctttaactcctgacctcgtgatccacctgcccctgcctcccaaagtgctgggattacaggcataagccactgcgttcagcctacagtagcattttctagacaacattttgtgagtttgaagtgctgtcctgaaggacttcaaactcagctcagttgagctgagccgcaactaatacacatgtagtgccatttctcccacaaccagaaaatatatctcaggaaaccaagcatagagaaaaggtagttcttctcatgattacatttgaagatccactgtagtccccacaattctggactctgatgatttagaggttccagtccctacagagcaaatgtttctgtcaggggaaataatagttacatagatatggctccaacctggctatcttaagcctctcatgccactgaacagaacacaacactgtaggcagaagatgaatttaccgttggctggagtggaaaattcttgtggtaagaaagaattgagattcttgtcataagaagataagagttaccattaaactgagataataatctaaatcacctcctcaaacctacattcagtgcaaaaggttcactgagattactaaactagagggtacagcaagggttcaggtcccttagaaatgaaggtaaataattctgaatagctgagatacttgctgaaagcaaagggaatatgggagaaaagtggtggaaggaagttataagtgactttataatgaaatgctgaaacaaaaattttaatctcatgtgtctcatttcttactgtaacatgtatatattcttacagtttatcttaaatttcttttctctctccctattacatatatattttttatttttttttttttaatggagatggcatctcactctgttgcctaggctggactcaaactccttggctcaagcctcagcctccaaagtagctgggactacaggtatgagccaccatcttggctaaatttttagttttaagagacagggtctcatttgttgcccaggccggagtgcagtcacatgatcatgactcactgcagtctccaactcctgggctcaagcaatcctcctgcctcagcctctcaaatagctggaattacaggcacgagtcactgaacccagcctcctattgcatatagaggtaaacgggatgtgaaagtagcagttagcttttcagttttgttcataggatgagacaactgagttggaatcatgacagaactacaagaagaatgagcatcaactagaaagctagatttgcagctggatgcaataaccacaagactttgggtcgattttttcccatcgtataaaagcaactctaaaagtaatagttatcttcattcttgaagaaaagtttctgattcaatagctctagaattgccctgagactgcacttctaacaagttgccaggtaatattgacgctgttgtctggggatctcactttgcgaaccacttctctaaataatactctaatgcatttttttcctgtctgtttagagaaatgatgagtgtagtcctgtttgctaaatgtgaaaattacaaaacttccactggggatgtgttttttggaagtttattggaagattaatatgtacagatattgggcaggcagaaaaaaagagactatataactgtttgctggtgtatttttgtctgtacagcatttgaacaccctttctatgtttgtggaatgttctgctgtgtgattcttcatggtctcagaatctataaagtctagacatctgtcttccctgaccctggtagagcacaggcacatgatctcactgttctatggtggtggtgatcatggggatcatctctaaaacaaggggtgccatccagtgtcccgctgccgcagccataccagcctcaccagattgttcctctgtcatcatttttgccatagttatgattgactggccactttaatcactgcccacttcaaaaaaaaaaaaaaaaaaaaagattctctaatcttgccagagattctatgagctactatttcttttctgttcaagttagagtaatgtatattgtttgcaaaatagaagctaacagaaaccaaagcataggccaaaaatgatacagattacaggcaatacagtttacaatggagacattttaatgacaggcaaaacaccctttcacttaggtgaaatgtcacttcccaatgcttacagatcaagtatccaaagcattttttaaagtggaaggtaaacaagaatcaccttcctctaaattctgaaattctgtactcaaacatgagtcttaaatttggtttcaccaaaactgatcaaatgggataaaagtataagatgcaggaaagctgattgtctagtagggtagagtctctctttcactgtattttgctgagtgggaggtgggatctcctcaggccaataaattgtaaagacagactcttctctaagcaatatataaaatgcaatgttttgatgttgcaacaccacttttgtagtatacctgctcaccatgccaaagatgacaacaggtagggcaaaaataatggtcctagggtctctgtatccttcactgttgactaaagttaaatgctttttaaatctttttgaagaaaaatttttaacagtgttttcatttgactataattatcctctgattattgcacatttaatactctgctttatatatttagtttgaggggattttatcccatttctcaatatggcagtaaaaaagaattctatgaaatggtccaataaaatgtgtatcatatatatttaaggtgtgcaacatggtgttttgatgtatgtatacataatgaagtggccacaacattccagcaaattaaactatctatgacctaccatgattactggtgtgagtgagtgcatgcgcgtgtgtgtgtgcgtgtgtgtgtgtgtgtggtgagagcacctaaaatctaccctcaacaaatttttatatgcaatacaatgttatcaactacagttctcacgctgtacattagatctctagattaatttatcctataaaagtgcagttttctaccccttgacctactactttccatttcctcctccttcctgctcctgaaaaccaccattcttctctctgtttctacgtgtttgacttgttttagactccacataaaagtaagctcatgcagtattttcctttctgtgtctggcttatttcacctagtgtaatgttttccagattccaggtctttttaatgaaaagagattttaaggagaagtaaaacaaaagtttgtgttggttagagacttagttttgttgtggacagatgacttgtgtgtgtttcaggacttagaataggtagccaggtacagttttggtctttgtgaaggccagagaccattcactgaaccagctattttatgtcttctggggccccaccatgattctcttactctctgtatcttctttaatcttttttacctttgtattagtccattttcttgctgccaataaagacatacccaagactgggaagaaaaagaggtttaattggacttacacttccacatggctggggaggcctcagaatcatggagggaggcagaaggcacttcttacatggtggcagcaagagaaaatgaggaagaaacaaaagtagaaagctgcgataaacccatcggatctcatgagacttattcatatcacaagaatagcacaagaaagaccagcccccatgattcaattacctccttctgggtcccttccacaacagcaggaattctaggagatagaattcaagttgagatttggatggggacacagccaaatcatatcattccacccctggcctctccaaaactcaattcttcacttctgtgcaactgcaggctcaacaccacatggaagctgtcaaggcttgagacttccaccctctgtagccacagcctgagctctatgttgtcctctttcagccacaggtggagtggctgggacacagggcaccaagtccctaggctgcacacagcacggggaccctggtcccagcccacaaaaatcacgttttcctcctgagcctctgggcctgcaatgggaggggctgctgagaagttctctgacatggcctggagacattttccccatggtcttgggaattaacattaggctccttgctacttatgcaaatttctgcagctgacttgaatttgtcccctgaaaattggttttttcttttctatcacattgtcaggcagcaaattttccgaacttttatgctctgcttgccttataaaactgaatgccttttaacaacacctaagtcacctcttgaatgttttgctgcttggaaatttcttccaccaaataccctaaaccatgtctctcaagtttaaagttccacaaatctctagggcaggggcaaaatgccatcagtctctttaataaaacatgacaagagtctcctttgctccagttgccaaccagttcctcatctccatctgagaccacctcagcctggattttattgtccatattgctatcagcattttggacaaagccattcaacaagtctctaggaagttctaaactttcccacatcttcctgtcttcttctgagccctccaaactcttccagtctctgcctgttacccagttccaaagttaattccacgtttttgggtatcttttctgcagtgccccactctactggtaccaatttactgtattagtccgttttcatgctgctgataaagatatacctgagactggaaaaaaaaagaggtttaattggacttacacttccatgtgactggggaggtctcagaatcatggcaagaggtggaaagcacttcttacatggcagcagcaagagaaaatgaggaggaagcaaaagcggaaacccctgataaacccattagatctcatgagacttactatcatcagaatagcatgggaaagactggaccccaggattcaattacctccccctaggtccctcccacaacacgtgggaattctgggagatacaattcaagttgagatttgggtggggatgtggccaaaccatatcaacctgcacaaaccagagtgtgccataacttcatcactagatgatctgaaaaactcccttcactcattcattaatagccttgcttctctgagcctaagaaaaagaattttgtatggaaggtgggatagtagtgagcagggctggcaaatgtttggcagcttttctcagagtggtctgagacttagcaggaaatgaatgctcagtctcaaaaactggcaatataatatagggaactatggggttatggatgtggcttgtagaatagggattatattcctcttgttatgaattagactgtccttggtcaggttagctggccaagaaaagtaaccagttaataaaaataattctcttttaaaataacaaatgaatttcaactcaccacaataaaaatatcaaataattttagtttctccaatggttaactcaaattgtaaaattgttaaacaccctcttcttgctattttactttgttagagatctttgaaaaatactatagaaggctggggctttcttagccatttgccatataacaaagcctcctttatctatagacatatgaatttattacattatcactaggagggcttagtgacacaagccctccctttgggtttgtctgtttctttatgatgttggtgatctttgttgattttgtggttgcctggtctccatgtatttggcttgcctgtatttccttagtgcagttttcctttgaggggaggtgagattcaaaagctagatcatgtgggtttttggtagccactctaatgagtctaaatttgggggaatttggggttgtttatagtttttattttttctcagagatccttgttctgataaattttgtttttaagtttaaagacagggctttggaaaattttaagttataacttgatctgatttttgacttaggaaggacattctattgagtcaaagatggtctgcaaaggtggagaaagagaacccaataaaaatgctttacatgagagattattgtggctaagattagaataatggcggtgaagatggtaagcagctagattcaagatacattttgattgcagagccaatagaacatactaaagaattctatgtgaggtgtgaaagaaaatgaggagtgaagtgccaaagaatggggcacactcaaattctacaatgtagccattaaaaccactggagaaagtaggataatatcttggtggggacaatgatgaaaaaaggaagcaaattatataatcagatggaagtgacttcagaagagaatgtgcagggaataatggtgacaaagcaaagatctgtccttcctctctgaccccatgagtcaatggagaggcaagaaaaggaaatgtccatttaactggttttcagaaaaaagtggtatcaagtgaaaataggtgtcagacaagagggggtagaaaaagatatgttagagagaggattcaaaatataaagggatttatacacaataaaatgatactaaagggatacagggactgcagctgtaaataaggctataggatgagagtttgtgaaggaatagcactggaggtaccctaatcatggcactattagttaaagctattatggaaaatagcttgaaggtgcattttaatgataagggatgagcaatgttaaatcggaaaatctggtttaaaggccaagttgtaaaacttaccagtgtcaaggttccaactagaatgctagcatgataggaggcatatcctacgctgataagaaggtatggatggtctattttacacatttacctggtaggtcttttctaatttctacatttattgttgagtagagtaattatgacatcagaaggaaatcatccaatcatggtttctgctttccttttaaaatttcttctcacttttatcagtctttcacctcttctcactatctagacttcttttgtctcacctctcctctgtgatataagttctggtatattgtttaatgtactaattttctaacatcttattttatgtttgaaactaatttttgccaattttgtggcccagaatcttaaaaatacttaaccacagtggttcatgtctgtaatctcagcactttgagaggccaagttgggagaattgcttgagcccaggagtgcgagaccagccaaagcaacgtagtgagaccccatcctataaaagagaaaagaaacaaatacccaactggaatataattcttgtgctgaatcacagctatcataacatcaacgattcacatttttgaaagtgaacattgctttctggatgaccacaacatcatgtgggcctattcatttccctagtaatgccaccttgtgacatcactaagggcataatgtctgtatctatacagtgagcctctcatatgcagaataaggcaacattttcaagcaaaacctgaaattttgtggcacagcacctggtgagactgtgggtttgacaaatatctcaccactttatcatcaagttaaacattattcttttttattaaagcttaataattaaagcttaattctgcaagtgaaatttatatatactgctttattagtacatatatgacactttgttttcaaacattgccataacctgtttgaaggaacttgagcttcagggttacaaaactgcttctgctatgatggagaagaggaggaaaaaatgcttagataagagcaatttaacttaaatggaggaagtggtgagttttgttatgttagaggctcactgaatcatgagcaggtcaaatgtgtcaaatagcttcattgagagactggttttcaatactcaaagtttttatatactattagctttgatggagaaattgaaaaggattgccctacgtcaacagtgttgctttgttaagtgtgctttgcaaagtacaagtatttgccaagatggtaataattagcaattactttttgatagcagccttctgttacaaacttaattaacatagaattttgaatgcttgcagtgtctatattgacaaaagtccaaagacttgttgagccagctaactgggctttttacaatggcttttcaagattgcagatgccgcctacagagacgacagtcatatttgaggtaacattgctcattcttggaactctttaatctaattttaatttagggagattattcaaactggcaaactgtgttaaataatgcattgatttattctattactcaaacttcaattagcaataaaaaacacaaaatgagcaagaaaaaataaatttaataaatagcttagcaactttattcattagtttctaccttctctttcttcagtaaatcttttcctggagataattttgatctgcctcttgagggctatgtagtcaacagtgaatggtccaatgggtagcaaatagaaaaagccaagagtctaaaaattgacaaattacacaatcaatacccaaaatgtttatatgtacaaaaataacatttgatattgtttgagacctttgtgtgtcacctgttaaacactggagagttattaaaatcccagtattatttcataatgtcacacataaaaataattctgagtgctcttggaaaatgtttcttaagccatatttgaggggtttagttacttcactggatattgaaccttttgaataattctattctaattccctatatttggtgttgtgtgtatgcatataagggggaacaaactcactttgttatgaaaatgttttttgaaagatgtttctctctaaaataaaaaacactggaggagtcagtcaaggaatgtctaacaggctagtagctgaaaaagctgaagttagttgggacttaaattgcatgcaaacatttagaaatcaacagttcattaaggaggtttgcttcaaagttaagtaccaggtatgctacaaaagtttcaagaaataagttattaggcatacctatcaacaattatgttcaattgatagccattgaaatacaaggacaaaaaaaagttatgtcccagaaaaataaatttcactcttccagtcacttgttaggagcaaaggtgcattacctaaagctatcagggctgcagacaatgctgtgaagtttatcctagatatactaccatctttgaaatcaacatagcagttttgctttggctgaaaaaactacttttggttagatacgtgaagccaatcataaattcctaaaatttttctctgagatgagatggttggatgaaggctatttacaatggccactattttgcaaacccatctttaaagagaaatgcttcatgaatgtagcatggtgaggacaggggaatgacagggaccattgctaatgtaggggtcaatggaaagcttccccttcaccctctgaagttttgctggaaaatcaactcacaaaaggcagactattagaaaaaaaaaaggcttacaaatttatgaataacatagcataagggaatcgtagtagaatgattacccaataaccaatgaggtacagatgataatatacccatctttttagaggaaaggaagatgagaatgtgtgtataattttaagagggtagtaaatgaattttagggaaattcaatgggcttgaagaatatgcaatggcctgggacaaagtctgttggccctacagggcagacgagagtttgtaacagaaggctgccagttgtattgacagactgcagtccttcttcctgagatattagttcggttaatgaaaactcaggaaagaaactctttttttttttgtttgtttgtttttgcctttagtagttctggactttaggcagataagggaactttagagaacagctttattctgtgctatgggagagacaaaggattgagagagaggagctggaagagaggggtatggtcagagagaccccctggcttcttcggtttagcatgtcaaagcaccatattttgggaaattggtgtctgagctttagcattaagaacagactctcagtaactactggcagtgcaaggtcctttcagtgattacttttactaatgtgaacctaaaacattccagtgaggtaggtaaaaacctcagttaaatgagtggaaacagaattacagaaatgtggagttttgtttaagtaaaggggaacaaaaaaacgcaatcccatcgattttgatgctgacagtgattgcggtattagtgatgttaacagctttaacagcggagcacccaggaccagaaatcatttccgagtctgacgagtgggaaattacagcagagaatctggaagaagaataaccaatagatcaggaaaagcaatacttaaattcacttctgagccgaaactgggcattttgggggatgggcatggcaaacagcagtagagttctttaggaaaaaattagggacgttttcagcagctcccgccacctactatgtccgggttactgcgggatccacagaatggaagttgcccgccaacaggaagaatgtctcctccctctgcagggcttcctttcccccatcgagggcccctggggaccacaggtccccagcgggtagggcggaggcgtggccttgcgaaggtcagcggaggccacccagagctcacagcctcctgccagcgcgctctctgtttctctgcagccccgaagctcgcgaatgtagcaggcgccccaagctcggtcctcaagaagccatggcggaatccaggggccgtctgtacctttggatgtgcttggctgctgcgctggcatctttcctgatgggatttatggtgggtaagtgaacaaaacactctaccccgactccggggctcgtgattctctgcagagataaagggagaaatcctggagctggaagggattgggctgtgcgctagccctggccggctgggctagatatgataaactctgcacatttcagcaaaactagaaaccagatggaatgtattttgggcttgctaatagataaagtgtgcttgaaattcaaatttattaaatgttcactgagttcactaaagacaacctacagctgtcactgtctgcagggatgaaaaaaaatcgttttatttccaagcaacattagtgagtcaaaactttcaactaatacgggcagcattaaaaacaaagcaaaacgaaacaaagcaaaacaaaaccctgctctatacgtaaataaatatttgtggaatgttccctatgtgtcagggactagagatccagggaagaacaacaaaagccatgccttcatgcataacgtgagaaaatgaaagagcttctcttaaataaaactccttttaagcatctaaaaattatattacatatcagaatttacaggttttctgcatttaatataaacattattttttaaagctcaccatgatctacttgtcagataaaggctttttggggggaaggacagaggggtggcttctagttttaataaagtcaaagtgattttgtgtgtatgtgtgcatgtttgtgtattttttttccttaggctggtttattaagcctctcaaagaaacgaccacttctgtgcgctatcatcaaagtatacggtggaaactggtatccgaaatgaaagctgaaaacatcaaatcatttcttcggtaagtttattttacgtatttgatcttaaaaatcatgtttaaaatatcacagtgagaagcatattatacctggttatatgcatgaggacagtcttctctgtgtgaaattacatattagtcatcaactttttttttttttttaatgtctctttacaccagtcttggggtgaaaaagtaggtctttcttccctaactttatgtaacaaaaagtatctggttggcttattgagagatgtttcaacttcatgtaactttggatctaactgaatgttattctttgttcatcagtgcctgggttttaatcagcaattttcttagataccatattctgtcagggaaagttagatgatggttgactaagtgatttagtggaaaagtgatcaaagtgtctgattctgtctgccaaaagttaaacctttatcccatcttgcaggtataaatttgttttttacaaataagacaaaatgaaaccaaaaagaatcattgccattcctccagcttctaaccatgaaaaacagtggaaattgggggagtgatcataaactccttaagaacaatggccatggtatttatttctgtattcagactctttcaaatgggtgttattttttaaaatcagctttagtgaagtataatttacataaaataaactgcatccctataaagcctacaatttgagagttatgacagacgtatgctatgctgaacaaaccacctcctccatcatgctacaaaaatattccattatgccctttgcagtttattccccatccccctccatctctgtcactgggcaatcactaaccaattttatatcactggagattcatttgcattttctagaatcttatttaaatggaatcatatagtatatgttcttttgtatctagcttcttttactcagaataatgattttgagattcatctagattgttgcatgcattagtagttcattatttttattgcagactagaattccattgtatggatatattgcaatgtataattgatggaaatttgggttgattatagtttttgactattgtgaataaagctgctatgaacagatgtttacaagtctttctgtggatatgtggtttatttctcttgaaatggttgagtttgatgataagcataagtttaactttttaagaaaatgcctaagataagtgaaaagtggttgcatcattttgcatttctacctcaaaataaggaaatcagtattccaaagagatatgtgcactctgatatttaccacagcaatattcacaatagccaagataccaaatcaacctgatgatcaacttccatcaacaaatattatggtgtatatacaggatggattattactcagcataaaaaagaaagaaatcctatcatttgtagcaaaatgaatggaactaaatgtcattatattaagtgaaataagccaggcacagaaagacacatattgcatgatctaactcatatgtgggagctaaaaaaaaattgatctcatggagacagagaatagaatgatggttaccagaaactagaagggtagtgaggagggcagacaatactgaggggttggttcaatgggtacaaaaatacagttagatagaaggaataagatctagtattacatagcacaatagggcaactatagttaacaataatttattgtatatttcaaaataactagagtggatttgaaatgttccaaactcaaagaaatgataaatgtttgaggtgatagatatcctaactactctgatttgatcattacttattgtatgcttgtatcaagatatcacatataccctataaatgtgtacaagtagtaggtagccataaaatttaaaaataaataattttagaagtctattcacggctttggcttattttgtatttagatataagttgttttccccctgtggagttttttgtttgttgttgatgttgttgttttgagacagagtctcactccatcacccaggctggagtacagtggtgcaatctcagctcactgcaacctccatgtcctaggctcaagggattctcccacctcagcctcctgagtagctgggactacagacatgcatcaccacacccagctaatttttttatttttgtttattttatttattttgttgttgttgttgttgttgttggtagagacagggtctcattattttgcccaggctggtctcgaactcatgagctcaagtgacatacccacctcaccctcccacagtgctaggattacaagcataggccaccatccccaaccctcctatggagattttagagttctttatatagagttgactcttgagtaatgtgggcatagggtgctgaccccccatgcagtcaaaaatccacacataacttttaattcccccaaaacttaactattaataccctactagtgaccttagcaataacatagacaattaatatgtattttgtatatgtattatatgctgtattcttacaataaagtaagctagagaaaagaaaatgattttaagaaaatcataagaaagagaaaaagcatttactattcattaagtgagtgtagattttcatgaaggtcttcatccagtcttcacattgagtaggctgaggaggaggaggaagaggaggggttggtcttgctgtctcaaggatggcagaggcagagaaggtagagaagggagtcaggaaaggcagtcacattccatttaattcttagacatcatgtatgttttttgctttttcttttctctaaaaatatttttatacactaccagttcttcttccatcatttgctttagttttagtgcctatatcatagaaaggaccgtgttgtaaaagaagtcaaaagcagtcttgaataatggaaacccttctgccagattgtctaatatcatcttgttttctggcattgcttcttctgtgtcttcttcctcatcacctggtactggtttagaagtattcatctccatcaaatcgtcttctgttaatttttctggtgtctactaacttttgaatttttccaagattactatcatgaaacccttcatccctcaacttttttttttttttttttttttttttttttttttgccatattcacaatctctttcatgattaccttgtttggctctgtcatcaatcctgtgaagtcatgtcaacatctgcacacagttttctttagcaggaatttgttgtgttgggcttgatggctttcacagcattttctataacaatgatggcatcttcaataatgtaatttttttcagaatttcatgaagttctgtcagggttctcttccgtagtattgacagtcctttccatagagtgcagtgagccttaaaattcttattatgaccccttgatctagggggcaaattagagagatgtgtttgggggtaagtagactacttgatctcagggtttctgggtagccagaggtgtcttccaataccaaaagaattttaaaaggcaatcccttcctggcaaggtatttcatgactgcaggaacaaagtatgggtggaatcaatctagaacataggtttctgttgtccaggccttcttgttgtacaaacaaaagactgaaagctggtgtttatcttttccattcaaggcttgggggttaacagcttcatagataagggcagtccttatcataaacccaagtgcatttgcacaaaacagtagaattcgcctatcccttcctgccttaaatctcagtgcttacatctcttccttactcataaataccctttgtagcatccccctctgcccccaggatagggcattttcatttgcattaaaaaaccttttcaggcagatatgctttctcctcagtaattttcttaatgtcatctgaagacttgtctactgcctcttggtgagcagaagctgctcctcctcttatctcgacactttaagttaaacttctttctaaatgtatcaaaccatcttttgcaggcatactattctccacctttaccttccttttgctttaaattatcatagaatgactttgctttttctcaaatcacattaattagagtctatagatatgcctttcttataacaatcctacacccacataaaagctacattttcaatacaagaaaaaaaggtaatttgcaaaagaacaaagttttcacatttgcaggcatagctgccatgacagcttcacaaacttttcctttttttttttttttttaacaatagtccttatgctggatttattttgaaaatggagggcaatcacagctgcatacctcagtctacggtataccaagcaattcaaccttttcttataatgtatcattagtggcactttgtatggatcccacggtgttattcaaggtttacagtattgtactaaacatggtaagaactacatgagaaccatgggagatcattttttaaactgccataagcaatttactggagaaacaaactgttcaggtagtgatgattagggagatgattaatatcacacagtggtttaagcagatagtcacctcacaagctcacggcaagagcaataagctgttgctacaaaagtattactgtagtacacaatgtattacagttaattttacataattatgattttatattgtatctttatgtttgtttacatttctctagactgcaaatggcaccatgtagtctgtaactgtatgcctacgttttgatacattttaactttttataatagattcatgttattttaaaacagtaaatgataaaatacttttacatgtacttcatgcattcgtgacaaacctcttcttttttttttaatatttctaggctatgtggttcatttatgagttttttttaaattgctgcaaatctcaaaaaaattttccaatatatttattgaaaaaaattcatatataagtggacccatgttgttcaaacctatgtttcaagggtcaactctattctagatataagtcttttgttggaaatgcagtgaacaaatattttttcccagtctgtaatttgtctatttgcccaccctcatttgcagatcagaagttaaaaccttattttgatgaggtttaatttatcaatttttctctttttggatcatgcttttgggttcatatctaagaactctttgatctggactttgaccaattttgtcttcttttttcccccagagatttataatttaccttttacattaaagtttctgacctattttgagttattttgtgcataaaggtgtaaggtttaggttgagtttattcttttgcttgagaatggccaactgctctatcaccatttgttaaaatgttatccttctttcatttaattgcttttgcacctttgttaaaaattggttgggcgtatttgtgtgagtctatttctagattctctcttttgtagagacagagtcttattctgtttctgggttttatattctgccctatttatccagtaccatactgtcctgattattaaagtgacatagtagattttaacaaaacatagaatgatttctcttaccttattcttttaaactattattgtagctatactatatcccttaccttttcatttaaaatatataataaacacatatttgtctaaaaaactattggtggagctttgataggaattacattaatcctatagagctatttgggaattcttgacatttttgctatgtccagtcttctattacatgaacgtggtatgtttccaattgtagatcatctttcttttatcagcattttgtaatttgcattaagcagatgctttacatgctttgttagatttgcatctttcattttctttggagcaaatgcaaattatattgtgttttaatttcaatttccacatactctgttgttagcatatagaaatactgttgtgtttgtgtattgatgttgcatcctgtggccttgctgaactctaagaaggttttgtttgtttgtttgttttggttttgggggggttttctgagacagagtcttgccatatttcccaggctggtttcaaactcctggagttaagcgatcctcccacctaggcctcccagagttctgggattacaaatgtgagccactggacttggctggaaggtgggaaagagtttggtttgtttgtttgttttggtttgtttcttgtagattcattgaaattttctatgtagacaataatgtcatcttcaaaaagggaacatttcatttcttttttctttctaacctgtatgccttttacttttttaagaaaaattgcctctttgtgctgactggaaactccattactctgttgaataagagtagtaagagtggacattcttttcttttttctaatcttaaggagaaagatttagtttcaccattaagtatgatgtagctgtcgttattttgttgatgctctttgtcaagttaagaaagctctcctctattccaagactgctgagggtttttatcatgaatgggtgttgaattttgtcaagcgctttttctgtatcaattaatatgatcatatgatttttcttttttagctggtcggtagggtaattcctttatttcttcactaatttgggagggggtcaaatttaatccagaggtatgttatagttttctccacgaatgcgaaattgtctatttgtcccattaacttgctcagtttttactctatgtattctgaggctcattcattaggcatatacacatggacgttgctatgttttcaaaacagaatgaccttttatttttatgaaatgtgcttagttatctttagtaataatctttttaagtctattttatttcatatgaatggagccacgtcagccttctaatacttatgtttatatacgatgtcttcttccatctacttacttttaactatcactttcattagaattaaaatgtaccctctatagagagaacacagttgtcatttgctgttttatccatttttgtaatcttaatttaagtatgccctctgtgggccgcatataatagatatttgcttttttatccactctggtaacctctgccttgtgagtatttagtccattaacatataatatagttattgattgatataattaaacttaagtctgccactttttggtttgttttctgttttctttctgtacctttactcattttctgactttttgatagtggggaaaatatatgaaattttattttatttcaatttatcttttggctatacctctttggctatactttttagtggatactctaaaggttatattatacatctgtaatgtttcactgtattcttaaatttactactgtgtcacttaatacaaaatggagaaactcacatttctttatgtccatttactctctcccccaccatcctttataaagtagctgtcatatgtattatacatacatgaaatataaacctcaaaaaataatgttatattaatgttatattttttctttgaacatgtatatgtattgtaaaccaattaaagttaaaattagtatttcatgtttcttaggtatttatcgtttttgatgcttttcatttgtttctgaagatttaggttgccttgtgctatttctgttgagtctgaataacttccttaagtatttcctgtaatgtggagtctgatggtgacaaattcttagtttttcttcacccataaaattctttacttcaactttattctccaaacatatttttcctggacatagaattctgggttgactccgctaatacacatgaagtttttagaactttaaatgtttcactgtcttctagctgctatgtcatctgatgagaagtttacagtcattaaatcatgtaacgtcttatttttgtctttgattttcagcagttttactatgtgtctaggcatagttttctttaaatttagcctgtttaggctctctgagcttcttgacaatgtaaatttatgtcttctattaatttagaaaggtcttgtttactatttcttaaaatatctttctgtaccattctttctcctcttctcttttaatactccagttaaaccctacagacagatacactgagcgaagtacatacactacagttaacagacaatccctgacttatgatggtttgatttagaatttttcaactttatgatggatttatcagggtattaaatgcattttcaatttagtaatatgtttgactttcaatgcgtttataggaacataacctcaccataagttgagtagtatctctattttctacccatctgtgctgttgatgagatcacaaggttccatgttagtgtctatggatgaactcgagtgagctattgtaatgaggaataaatcagctataatgttcttattaaatttcagcttatgtattatcaaggcacatcagatatcaagagattagttcaaaatgtctgttgtgaggtgcttttttgatgata

SEQ ID NO: 2437 - DNA, 12270 bp, Homo sapiens
tacatgtacatatgttattaaaagtagaagttgatgacaaataatatatagttttattttggcataaatgtagttgcttctacccctaatttccagtatttgatttctctttccagatccccagccctgatgatgggtttgagagtaaatcactgtatgaaagctggttggaaaaagacccttcacctgaaaataaaaatttgcctaggtaagttactgatatgcaccttttctactgtaggataagttatgaattcccctctgcctcttgtttctccaagcatgaaattctcaagcgtctcatcaataatttgagccaagaaaagataatgaagaattcctggccgagcccagtagctcacgcctataatcctagcactttgggaggccgaggcgggtggatcacctgaggtcaggcattggagaccagcctggccaacacggcgaaaccctgtctctactaaaaatacaaaattagccggtcatggtagcgggcacttgtaatcccagttactcaggaggctgaggcaggagaattgcttgaacccgggaggcagaggttgcagtgagccgagatcgtgccattgcattccaacctgggcaacaagagtgaaactccatctcaaaaaaaaaaaaaataagaattcttctatccagttttgttttgctgattagccagcatgtgaagtctttcagtctatgttagagcacaaatagatctagttttgcaaatttttagccaaaatagtttcgctacattattagccattagttggcattcttgcttaaaatttcatttacatatgtattaggtgtattaatatataatataacttcagatgataatgatgaaaagacaaatgctagattatttgcttgtaaatttattaaggaacattatcagtaaccaccaaattgtgtctttacctgtgatttagaatttatataaatattattttattttttatgtcatctcattcatgctacagcagctttcttaaatttattttatatttatttgtttttattttcttttttctaaacattatgtaataaaaagtatatatttgttttctactgtagtgccatttctaatacagactgagcattcctaactcaaaaacctgaaatctgaagtgctccaatatccaaaactttttgagcaccaacatgatgtcacaagtggaaaattccacaccttatagcacttaacacaaactttgtttcatgcacaaaattatttaaaatattatgtaaaattaagtttaggctatgtttataagatacatatgaaacataaatgaattttatgtttagacttgggccccatccccaagatatctcactgcatatatgtaaatattcatagttggaaaaaaatctgaagtccaaaatatttctggtcccaagcatttcatatgggatactcaacttgtacaagcaaataatagtaacagtttatagctttattcctcatttcaaatcagtcttgtgaaagtttgaatgtgggtccattataaaactttcacatgccaattcaacaaaaacagtaaaatacaaaaatgatttctaaaacattgaagaggtcagtctcaaaaacatatctactaacctaatagtttggaaataaacagttatgttattaatgaacatgcaattttatattctgctttcatgacttaccattattttactaaaaattttcatgtcttacattttatttatgtatatgcatatatatgtgatagatcaacagaggtttcctaatcatatgcaaagaaataaattataattagatttatttctaaaatgaggcacatttatattcttcatgattttaaaagtagatttttttatggcagttttcttactagatgatagttctctgagggtagggcccacgtcttcattgttttcccctctaaacaaaaatgtaaatgctgaagatatgatggagagcatcatcacaagatgcagtctttggtggcacagcccaattcttgttataggttggtgcaaaagtatttgcagtttttgccattatttttaattttcagcattacttttaattttacagcaattttcctgcagattatgggaaaatgtcttgatggtggttgaccttttttaaattcttataaatgtaatatataattccttgctattcttggggcaggattccttgtcccatctatttaactttgtatcatttacttgtttatgtgtgtgtgtgtgtgtgtgtgtggattgcattctacatctagaatcaataagctgggatctggaagtgactttgaagcttattttcagagacttggaattgcttcaggcagagcccgttacactaagaataaggtaagccattttatcattttgaatatataacatttcatctacagtcctttggcgaagaatgtcactgagttgtttggcaccagacacctggtggatgtggcctgggaagagttcccagggatagagatagactgcatgtccctttccagatggacaaggaagcaatttgagtaattttgtgaaaatttcattgttagggttaatcaaataaatggtgattcacagagtaatgccagacacttatctggttaatcagtactaagtagttcacatccttttcctgatttgtcagaaaactctcattctctagactagtcttgcaggctctgatgtacttttcatgaggataaatgcagttggagaacatattttggtcaagaggagcattagggtaagattcattattgtcggtagctcctcttcatattgccacttctgcctgtcacctgagtcaagggttcttggttgggaaataaagcaagtttctcttttaacttgatccccttttctgttctgcactgactggtttgcactactgtcacacagacatcctgatgatatgcaggtacttggatataaccaatatataccatgtttgctcatcaatgttataaattatttcataaaccaaattgaagattacagtagcagacacagatttgtcatagattttaatcaatcttcaaatcataattacagtacatctaaatcttgcttgcccattatatgtatatcacttgcaaatttgactgttcagaatacaacaaagaacaaagaaataaaagcaaccccagagtaacccaaaatagataaactcagaatgcttacattcattacaattaatacataaatgatgtgttttaactctttgtcaaggcctgttcacttttatactctgtcttctgtaatttgctcaaagttatctagtttctaagaccactttagattagaagcagataattagatagaaggagaaggactgataaggagattgctttttagtgatactaacagcagtaagaacgatagccatacaaggtggcaaataataaaaactaaaattagaaaaggcagaccgaagaactaaaaagaatatttatacgggatactactatgtaataattcatattcataatggtaccttaattatgtaataaagcttaaatgacatttagatatacactgtttgagaaggaagggaagttacttaaataaatcatccttaagctgtgtacttagctgcccagaaccttttttttttttttaccaatcaattgatagataactttgaactatgctgaggtgcaatttgaatatgtattccctaattttagttatcgaagatacaaggagaaaatgttcaaggtgtagcatcttgaatgaaggttacataaattataaaacaaataatgagaaaatttttaaaaccagtgaatatttggctatagtgttttcgttattagcgttttgcctccttgtggtaaaactcagggtgttatatggttgtattttttctttttcttgttttttttttttttttttttttttttttttttttttttgtatttttagtagagacagggtttctccatgttgcccaggctggtcttgaactcctgagctcaggcaatccacctgccttggcttcccaaagtgctaggattacagatgtgagccaccatgactggctggttgttattttttctatagttatttttatgcttacataaaaatattataacttgaatatttaatgtttatttatacttgcctctccatttttttttcagaaaacagataagtacagcagctacccagtgtaccacacaatttatgagacatttgaattggtagagaaattttatgaccccacatttaaaaaacaactttctgtggctcaattacgaggagcactggtatatgagcttgtggattctaaaatcattccttttaatattcaagactatgcagaagctttgaaaaactatgcagcaagtatctataatctatctaagaaacatgatcaacaattgacagaccatggagtatcatttggtaagaaatagttgggcagatattttacagtctttaagttagagctttaagatattatctcctatgatgatcaatgcatattgtttcatcctagaatacatatttgccttacttattttgacttctacacaaaaacttaaaacaaacacctattaaagaatctgatttaatctggcatgtatagaatgaatccattatggctgagttattaccacaaacattgggatggtaaacatttttcttgtattatggcctttaaaaacatttttactggctgggtgcggtggctcacgcctgtaatcccagcactttgggaggctgaggcgggcagatgatgaggtcaggagatcgagaccattctggctattatggtgaaaccgcgtctctactgaaaatacaaaaaactagctgggcatggtggtgggcgcctgtagtctcagctactcgggaggctgaggcaggagaatggcgtgaacctgggaggcagagcttgcagtgagctgagatcgcgccactgcactccagcctgggcgacagagcaaggctccttctcaaaaaaaaaaaaaaatttactgttatagaaacaatattagaaaaatgtaacattatttgcaaaagattgagaaagccacaaatactattacatacgtatttttaattattgtcaacaaaatgattattactgcatatatcttttagtgtttgtctatatgaaacattttttccatggttataagtatactttccttttattaatgactgtttagtggttgctcttctgcattgtgcatctcctatacagcaaggatgactcataatgcagtgtatgtagtagcattgaggattgagtttggaagtggtttgcctggttcagatactagctttaccagttcttcgttatgtgaccttgggaaagttacttaacttctctatgtgttagctttcatacaattaaaagataaaaaagaacatatcatgtttcaaagatcattgtggagattcagtttggtaatatatagaagctgtggtgggtagcacttagtgctcattaaatattacctattactgttttattacaaacattgtcttttattattctgggggcacctatttttagtatatacccaaattatcaaatatgccctgagtttctactgtgtaccaagtactatgttattacctgggagatataaatgtgtacaaggcatggtcatagtcctaagaaagcttaaagtctcatgtggggaataaagcaatatacagataataggttactatggggctatgtagagagtactataaaaacacagaaaatgggtatggaatagtaatgacttctgaatattattatataaaggattagtaatctttatataatattatatacaggattagtaataatagcaaatactatggtctagaaaaaaaatgaagcaaataaaatgtgtttatatcaatacaattggagtatctctgcagtgatgggggaaataaggagagataaaaccagagaaataagcagagcctacagcaaaatggacattggtagttctgtggctattcagcatccagttgtcttcctaaattccctgatttccttttggtgaatgatcttttatcagtttttataagtcagggtccaattaagagacagaaaccacacagttagagtggaagggctctctttagacaaggttaattcttctacctacttaccttcttagaggcctggtttgatctgttaattcctttccctgtcatactttcaaaaatcaccattactattggtgactatccattagattaattattcttatagcttttctatttcaaaaacatttcttctgcctgatgtgtcccactttcttcacaatcaaaattcttcatttagtgccaggcagaaacagttcctgagaaaatgtgttagtgtaggaatgaaggtataattgatgaatgaatgaatgaatgaatgaatgaatacataatctacactccctgtctatagttttttacctctcactagccaatccactgtgctgtcttatgtcctttctactctagtaaaactgctcttgcaaaagtcgtcattgacatgtgttactaaatcccaggacacgtttcagttatctatcttgacttctgtcctgcatttgaaatttaaaattctgttttcagcattctttcctcatagtttctattctatctcttattacattctttggtttgaacttggcttaaaacaacaattaaaagttaaggaaaatctaggactaaaagactaggactaaaatctaggactaaaatctgggactaagaaggtttttaaaaatactgaatatacttatactgaatgtaccacttactagctaaagcatttagagctcaggatttctattaggtcagacctaatagaaattaggtaatagaaatagaaattctttccattaggtgtgacctaatagaaatcctgagctgtaagtgctttatctataaaatgaatatcgtatctcctgatttgcttgcaccacaggattgatgcaagcaacaaatcaataatgtatgtttaaagtcctgtgtagaaaatatggaaaataataaattgttgtaataaaaatataatatagtcacctctctatattggtgagttctgcatccatgtattcaaccaactgcaagccaaaaatattcagaaaaaaaaacccattaagtttcaaaaaagcaaaacttgaatttgaatttgttgtgctctgagcactacattgaatccacatgaagttatatataggcattgtattaggcattataagtaatctagagatgacttaaagtataggggaggatgtgtgtaggtaacaggcaaatactatgccattttatataagggagttgcttccatggaatatggttatctgcaggggattctggtacccaggcctcactgatactgaggtatgactgtactgagaacctaatcactttcctcagaagcattgtgaattaaagaagagtttgaccagatcaaatctgatcctctttctcagtatctggttatatcagtttgtcacaggttgcctgttgaacaagatcttaaatgcactatttgaaaacaagaattggtatttttttttgccctgtaataattacagaatcatatcctatgcatagctgtatccagtgtctagcatacagttgttgtcccaatgaatgaatgaattaataaaaaaatgaattctgggtttctggtaaactatgggttaaggaattatttgtgtcctagatttttgaaagtcatttcctttaagaaacaatgttaccattttttgttttcaaacaatattactttgttatattttctactaattttcatggatctgcaagaagactcagtagaaaaatggcttcgacatctatgtggtcatatcaatctggaatggggagggtgggaaagcgaacctctgaaatatgagctaatttctcttcttcttttctatttttaaaaaagactccttattttctgctgtgaaaaacttctcagaggctgcttcagattttcataaacgacttatacaagttgatcttaacaagtaagtttcaaatccctttttttttaaaaaaaaaaaaaaaagcaatctggttactagaatgaactgtttcactcatattagcattaacctctaaatcactactattcaaattatagtctgcaaatcagcaatagcagtagtacctgagaacttgttagaaaggcaaaatatcagacaccaaccaagacatgctgaattagaattttgcattttaactaccacccccaccccgcccttcaatgatttatactaacagtaaagtttggggagcactgctctgaatggtagactaaaaactcatcccaaagagacaagggccaaaggtacctgtcattaggagtctgcatgatgaaaattctgactacagctgtaaattcatagctttatgagtttaagtgcgtttgtaatatattttactagttctttgttcagtactcctgtgtaccagtttagaaattcttttttcatggataattttttttgcattttatttaatttcttgccactttcacattgaaaatagtttcaaagtacattcaaagtaaataccatgtaacaagcataaatttatccacagatgtgtccatgtcacatttattttttcagatgtaatcagaataaactttgctacttcccatattggaagaaagctattatcagtagttttaagggacctcattctcctttggattgtaggggagcccagggaacttactcaactccccaaagggatagtctgagtgtgacaagggattccctatccattatgtgcagctatctcttaccctccttacaggcttctgaaaccttcattcactctttgttgtccagcctgttatctgctccttttttcagcagtagaaccgaatgacttatcaggaataacttgatagctcactttgtctgcctttccaggaggcctggctgtcctcctagaagtatagaatgtctttgagtcccttttgattggtgtgtgatgtaaaaaaatataacaaacgattttccaataggtctctctgctgactgtaaatattagaaagatgactctgctgtttgtggctcaccatgtaaagcattactgtgttaatattcattttgttaaaaattgatcaattttagaaatatattttcccaagccttgtttttatttaatattatttttgaagcatgattctgcggtttgcgttataattatgtatatgttcttctcgaagtcccattgcagtgagaatgatgaatgaccaactgatgctcctggaaagagcattcatcgatcctcttggtttaccaggaaagctgttctataggtaaggaaacaacaggcgccaaatacatcactgtgaccaaaaccagcatacctaaagttggctttaaactaatgccattagatgggtgaaaggcaaatatgtacactctagggaatttgggtaagattgtacatttaataataggtataatacatattagaaaaataaatttcatattgtttattgctttgctgtgagggaaaatggtaaaggctagttaaaaaagaactctttctaacaaaatcttcaaactgtagaatcttaaagggaattttagagcttatctagttcaaccttctacataatcctttttatagaatctcagataaatagttatccagtctcagaatcttttagtgatgagaagcttactacttcatgaggaggctcatttcactttatgaaaggtctaattattagaaagttttcttcataaagatttaacatctattttcctgtaatatttttctctttgagtttgttctgttaaagtcaaataaaataagtttagctctatttccatatagtattttaggtttttgagatggttctcaacgatggttagatttcatttttcggcgttatgatggtgcaaaggcaatacacattaagtagaaaccatacttcaagtacccatgcaaccactctggttttcatattcagtgtagtattcaataaattacatgagatattcaacacttcattatagaataggctttgcattagataattttgcccaactgtaggctaatgtaagtgttctgagcacatttaaggtaggctaggccaagctatgattgttggtaggttaggtatattaaatgcatttttgacttgtgatattttcagtttatgatggttttatcagaaaacaactcatctttaagtcacgaagcctctgtatcctattttcctatctgtatctctacatcatgttctctttcagtatcttggctgcatccctttggatgttctccattttctcaaggtccttctaaaactggttctctggtggaaattagaaaggtcctagcattcaaagccagaaaatctatattctagttcacttgcagatgtgtgacttaaagcaagtaacttctagggttttcccatccgaattaagatgatgataattgctactttaaaggctatttatcatcaaataatatgcaaaaaaggtttatatgttacctttcttataaatgttaatgattaatattaacatttagataattacaagcatacgcttttagaacccagctctgccacatacttcacgtgacctggaaaaattatttttctaagcttcagatccctcagctactaagtggagattataattgcttttactcaataggcctgtagatttaaggcctgtagaagatttagctcaagagggatgcactcaataaatggcagctatttttataaataataaaaacacaaatgtttgtttcttcattgatgcaaatgaaatagcaatgatcaattatttatatggatcaaacaaaagccgaaagccgtatctacagtgtttgttagtcctctcaggtgttgttattagtctatctttatatatttattttctatttatttataagaaatctatattttgtcattattttaaaaactcaggctctgtagaagcatataaaataaaaaggagcagtgcttcttcagcattccccccttgccccctacacccagttctttattctcttcagtgaaactcaatgttgagtttggtgtaagttttaatgcacttatatacatgtttatatatgtatatagtcagccctctgtatctgtgagttccacatctgttgattcatcaactgcagatagaatatatttgaaaaaaaaatgaatggttgtgtctgtactgatttacagaccttttttgggtcattattccctaaatacagtaaacaactatttgcatagcatttacattgtattaggtgctgtaagcaatctagagctgatttaaagtatctgggaggacttgtatatgtcatatgcaaatagtaagccattttatataagggagttgagcatccttaaattctggtatccaaaggggattctggaaccaatcccccatggatactgaggaattactgtatatacttacatatacatttatatatacatatattacatttatatactatatatgcaaatatttccataaaagtgtacacacacaatatataaacaatttttatttacataaacatctatatttaacatattataaatttacatatgtaatcatttatatttacatgtataaatatgtaaacccatttatatttacataaataatgtatgggaccatacgttacaattttatttttttccttaagaatgtatcttaggctgggtgaggtggctcacacttgtaatcccagcgctttgggaggctgagaaaggaggatcgcttgaggccaggagctcaagaccagcctgggtaacacagcgagaccctgtttctacaaaaaattttttaaagtagctggtgtagtggtgcatgcaatcctagctacttgggagggtaaggcagggggattgcttgaacacaggagcttgatgttacagtggagctatgatcatgccattgcactccagcttcgacaatctctaagattttttttcatttttttagataaaagatttgactcttgtgaaaatatctacctcttactgaatttcagattaggatttttccacaattatttactattatgaaaagtaatggcattgtatggatgtccttgagtcctatttgaacatttgttaatatctctataatcaggacctgggatttcagggtgaaagggtaaacacttttttttttttttttatatacatttaaaattttatttgttttcacagaaatgagcaacttgtacagccatatttgccttttctggctcattggcttttgatcacatctcatgactttt

SEQ ID NO: 2438 - DNA, 10590 bp, Homo sapiens
tggtggcacacgcctgtaatcccagctacttgggaaactgaggcaggagaatcgcttgaacctgggaggcagaggttgcagtgagccaagattgcgccatcgcactccagcctgggcgacaaagagcgaaactctgtctcaaaaaaaaaaaaaacaaaaaaaagataaagcaaaaaatgcagggatagagaaaccatggcaaaaggtgctaagtgctgaatttaagtgtagaacctagactcaatctgagaggacatcatcccatgtctgcctggtattgtacagaccctcctagtcttttagctagctcttaaaggataaatcagagaagagagcgttgcgcgtattcttagttgataaaatagcagatgaaaagtcacagaggtatgaaatattaatattaatgtgtatttgaggaactataagaaatttagtattgctagagcaaagaatgtttgaggagaattttgaggaaaaggctagaagggctttctatgccatgccactaatttaaattgctattctatagcaaggaagtgatgtgatccaatccatatttcaggaagatcgtgctgaccctgtaatccattacatgaatgcagacagtaacactctcaaaatttattaaacacacttaatgaaataaataccagtatctatgttatctgccttttttgcctgtcactcatgcggtcctcacaactccttccagcccctaaactaatcagtccgggcattagagagctttgaaatgtttattaagaaaacagtcctgttttgacagacaggagttagagcacctggacttaaagcaggctttacagctctactggggatctctcatgtaggcaacatgaggccagcagagccctgtgcaaacaggcatcataagcaaatgaccatttcttttccattatagacttcatccttcaaaagggagtgccattcgtcccaactagtattttccccccttttatctgtgtcactaatgctaaattagttcatgggtcattcaaattctagcagctttggtgttagtctttatatttcagttccagtgctccgctgattattttggcatgaaactatcccatacagtcatcatgctgcttttaattcaaaagattcctatgagctgcaccaggaatatcgtatctagtacaaaaactgtatgtctgttcttccctgaagcagattctcttgtaacttgagtttagttatcttagtattgatattgagttatttttagagagttctgtggtggttagtggctcggtgttttcatcagtcgttcacttaactatcctttcggaacatctgtgccacttacgctgtctcacttctcacccaagtcttagatgctttttcattcttcatattactaggaaagattaaacacatcatataatgccagtgactgcaggactttcctttaaagcttctaaactacctgccagtatgctgaaataaggtatattctgaagcttatcgtttaaattgtagatttcatatgtaaaaacattttttttttttaagacagtcttgctctgtcacccaggctggagtgcagtggcgcgatctccgctcactgtaagctccgcctttcaggttcacaccattctcctgcctcagtgtcccgtgtagctgggactacaggcacccaccactgcacccggctaattttttgtatttttagtagagacggggtttcaccgtgttagccaggatggtctcgatctcctgacctcgtgatccccccacttcggcctcccaaagtgctgggattacaggcgtgagccaccgcgcccagcctgtaaaaacattttcatctttgtttataaataaaacatctgattatacaacaatacttttatgggactcaaagaggggagtcagggttggggtggggtctgtcatttatttacttatttttaaaagatacctggcctggttctgtggcggtggcttttcttcgctaatcatgagctgtactttgagtatgcagtagattccgtcagcatctcagtgggagaaaggggggaaagaggggttttaacacagtgttctctttgcattgagtgaagaagctgttgatctctgaaggaggaaaggagagactggaaccacatgaaggcttgtgctgtgaaaccctgaaaccctgacggtgccttttgatcactgtgttttaacaaagctgacaatcctcagccacacaaatcttgggaactaaaataagtattcatttaactcttgactaaaggttaaaagatacagttaaaaagaaatctaaaacccagagtggtaattccactttttctttctctttctgttgttggaacctgagctctctaggaaaactaacatttgttaagggcctgccatgtgccagattcctgtctgtaagagaggtataattattattttacactatctcaatcttaataacaactccgttaagtttacacatttatatttccatttgacagttaaaatcaaggaagttcaggaagctgcttgtctagggtcatacaactagtaagcggcactgtccagctccagaacacatgctttttcttgtgtattttagtgctccttcagtcacttatatgatttacttatttgttattcttttataaatttaagcagtagtacaaagtagaaagaataaagaaaaaaacagcccccaagtcaattgcctagaaaataatcattatttgtagtaggtaagcaggattcctgtcatattcctatgcacatatagaaaaaaattaacatataacatgccattttaaataaaaattgaatttaattttacttgacattagcagaataaagagaatttcagtagaatatttcttctttttttttttgagacggagtctcactctgtcgcccaggctggagtgcagtggcgtgatctgggctcactgcaagctccacctcctgggttcacgccattctcctgcctcagcctcccgagtagctgggactacaggtgcccaccaccacacccggctaatttttgttctattttttagtagaaatgggatttcaccgtgttagccaggatggtctcaatctcctgatctcgtgatctgcccgcctcggcctcccaaagtgctgggattacaggcgtgagccaccacgcctggccagaatatttctttactataaaggagaattcctaagccatccttccaagtttaagaaaagagatagagattggggttatgttttacaacagcatcttttatttttattttaatcagtattaattcatgccatgctctaaaagatgaagaaattatcacttcttctcaccagtttttaatgatatagttttatatcagctttaccaaggtttataatatttacatcttattttataactcccaggctacttagtctgggagttaaattcagcacttaacaccttttgccacattttccctatccctgaattttttgctgtatcgttttgcttatttaattttatcttcacttgactatttcaggaaagactgatgctgaattctggttttcttgttttatgtttgcatgcttgatagtgtttatttgccattctacttgaagtattacttagctagttacgaaattcttaggtgtgttcttctaatgcagagtggatgaatgttcccggatgctctcttcctgccatcactgcatctgatgttgcccctctgagttagaacagaagggccaggaattgacttcagcctgcttttctataacctgggaaatgtgaggagctaggactattctcagctggatctccactgtctttgtggaaggcctggactcaagtttttgttgtttgtttgtttgtttgtttttcctgaaattttgataaatatcctgtattcatcctggtaagcatgagaaggttcagatcgtctgtgaaattctttagagattgctagaaaacagcatatcctagtaatttttcttgcctttatgaggttgccatagttaaatgttttgtcctgactcatctcttaaaccaccagtccacccttttccatctgtttttctccacatttggggatattactgggaattctcacagttttatcacctcacttctgaattgcttctgggcttagaatagggtaaagagcaacactatttttcaccaaaatttttgttgattttattacctgcagcccaacacaaaaatactgacaaacctttcatttctaggagaacaactgattgaccctaatagaaaaaatagactctatcagtcaggtattccagtgtataggaaacagcgtgttgtgacatttgtttatttaagagatgatggttttcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggtgtgaacccgggaagcggagcttgcagtgagccgagattgcgccactgcagtccgcagtccggcctgggcgacagagcgagactccgtctcaaaaaaaaaaaaagagagagatgatggttttcaggttttttgggttttgtttgttttgatcctttgaggatggtatgttgtagtccagagaaggtatttagaattgtgacaaggtaataaaattgagacaaacacgattatttatctttgtcgagagtcactcctggcaattttcacatggaccttcgttgaaatgcatcattgaaatactagcgtacattttaggtattttactgtttcacggtatgcttattagtcagtgtaaaatgcatcctaatcaaaattaactactttgaaaagggaagttgatcgcttcttggccatttggctaagatcaactgaaaagggaagtagagataatatggtacagcaatttatttttaaaacaattagtttttttaaactgacaaataaaaattgtgtatgtccatcatgtacaacatgatgttttgaaatatgtatattttgtggaattgttaaatcaagctaattaacatatcattatctcacatgcttgtcatttttcatggtgataacacttaaaatctatactcagcaattttcaagatgtagtaatttctatatagagaaaatctgtagaactcaggattgtctattttgaaggttcttaagatgtatttccaagaaaatacagtataaattttgtgattgataccacttttcatgctagccacataaattgtcctttttgctcccaggttaagaattcaaggcttacaaaaatgaacacaaggctgggcacagttgctcaagcctgtaatcccagcacttgggagaccgagacgggcagatcacctgaggtcaggagtttaagaccagcctggccaacatggtgcaaccccgtctctactaaaaatacaaaaattagccaggggtggtggcgcatgcctatagtcccagctactcaggaggctgaagcatgagaattgcttgaagccgggaggcagaggttgcagtgagcagagatggcgccactgcactccaatctggtcaacagagttagactcggtctcaagaaaaaaaaaattataattgaaaatgaacacaggtttcttgtatgtctctccacttagttgattctctagagtgtggtacattttacaatgtgttgtctgcagtgtttatttacattgtctggcatgctacaaaggttggtagcatttgctaataaggaaccactatgtgaccagtgtaaatgatctaccagtgcctcttcctggtttcgatttctttcctagcaaaatacgggtataagaagtgaaccagacgtctttaagaaagagtatgtctgctactcttgtttccaaaagtgtttatatttattcattaaagaacttttgttactgaattctttttaggaaacttagtgaaccatacactgcctgtatggccaatgatgaagaatcagcttaaggggaaaaaatgtataatgtccagccaggcgcagtggctcacgcctgtcatctcagcactttgggaggccgaggcgggcagatcacttgaggtcaggagttcgagaccatcctggccaaaaccaacatggtgaaaccccgtctctaccaaaaatacaaaaattagctgggcgtggtggcaggcgcccatagtcccaattactcgggaggctgaggcaggagatttgcttgaacctcggaggcagagcttgcagcgagccgagattgtgccactgcactccagcccaggcaacagagtgaagactccatctaaaaaaaaaaaaaagtataatgtctcacaatataatgcaacaagatttcctactcaggacttacaaagacctgtgtctcttaaaatacacgggtcaccggaatgtaggttttttggtaagtgctgagcattcctatattcatttccttcctctgttttatgattcactggaaagcttcaagccttgaaatatttctgatttgatttttgcaatatactttttcttcccattgccatgctcgtatttctgcacacctcatgtgcttatacagtccaatcattttgatgacttggggaggtgtgaagaggctgagctagacttcatattttctcctgtcccgtgttcttattgtaaaggaatgtagtaatgcactgtgtcttttttgtgtctgttgttggctacatgtcctcaaaacatattcaacaagtagacgtctattgaaaagaaattttcctaagttgtccccaagaaaacgacgacactggagtcagttccgtgtttataacagagtcccaacacttgtttttctccagggtttctacaagaagaagcataaaacagtgttagtatgtgactgacctttggcttcaaggcttcagtaaatccgtaaagtgagattgattaggattaatagctttttgtcctagctaaaaagtgttcgagatcttggcttaaaaagagttctttttggccgggcacagtggctcacgcctgtaatcccagcactttgggaggccgaggcgggcagatcatgagatcaggagtccaagaccaccagcctgtccaatatggtgaaaccctctctactaaaaaatacaaaaattagccaggcatagtgccatacgtctgtagtcccagctactcgggaggctgaggcaggtgaatcgcttgaacccgggaggcagaggttgcagtgagccgagatcatgccactgcactccaacctggacgacagagtgagaccgtctaaaaaaaaaaaaaaaaaaaagttatttttgataccttggaatgtgttggccgttttaggtgcttccagcattttattcaaagagttgagaacataaaaggatagcttgattatacttagaccttaaaaaacttttaggagttcatcaaacacataacctttacaactggttagacttccagctttcctaaacaagagtatggcactcttgccagtgttggtttaaagtacatgtaatttacataaaatagcactgactgcagcctaggtctctaagcagagaatgctctgacaactttgtctccaggtccactctactgttccttattgaggagggaaaccaggttcacagtgttgtgctttcttcttttggcaccaaaaggggctcctcctggtttatgagttttaaaggatgagggaaaaattcatcatgggggatgttattttcctcagtgggtaagtgaagtcagggaaaaacagaaaacaatggagataagaggatgggatgcgttcagtttattctgttgttctcaccacagtaattgactcagaagggactcattctgaatttagtatctagtgttaaaagaacaggcctggggcaggcggaggccagcactgagacacagtggtgggttgagacctattgtattttttaagttgttccaaggctgtccaggtgtcctgatttaaagcctgcttcttaagtcaggaaattgtatcttgttctgaggtttactgtaataaagtacacagtcctaggggatggtacttctggctccatgaatcactttacaggctggctgtactgacccaagcctcatgatttatttatgccataccacagtaggaatggcaaatatgtaagccacacatggtctatgggatgggcctttaactgggaaactgccataaatccgtgaagtcaggtaggacagagccagcaggagctcatgtcgtgtacaagatttcttcctgttttatagggacttacagttctagagctaattaagttcatcctccttagagtgtatctgtcttagtctgttgtgtgttgttataaaagaatatctgcgcctggataatttataatgtaacaaggtttatttagctcatggttctgtgggctaagaagttcaagggcatggccctggcttctggcaagggctttcatgctgcgtcacaaaacagcagagaaggtcaaaggggaaggggacacatgcaaacaggagaacctgagggtccatcctggctttatcacaacccactctcctgggaactaatctgttccctgcaatacctaatgcagtcttgtcagagtgggaactcactcactaccacaagatcagcaccaagccattcctgaaggattcatgcccctgtgacctgaacacctcccatcaggccccacctcccaacaccatcatactgggaatcaaatttcaacatgagttttcgtggggacagacaaaccatatccacaccatagtgatatccttggactttttgtgtgctgtgtttatccagtctttgatttactgcttacaaatctaaagaatagctctgaaatatagtctagtcctattgtcactgatattttctcttcgatttatttctataaagtgttgcccatgtttttcaaataatttctatgttttgagtaaatactaaggagtgcgatggccagatcttaagagtatgtttagttgtgtacagaactgccaaactgtcttccaaagtgctgtaccattttgcgttcccaccagcggtgaatgagaattcctgttgctcagcattcttgccatcatctggtagtgtgtgttctggattttgtccattgtggtaagtgtgtagtggtatctcattgttctcatatgcatttcctgattacgtatgatgtggagcatctttttgtatgcttatgtgccatctgtatatattccttggtgaggtgtctgttaaggtctctggtgcattttcttccttttatcttgttttatttttgttttttataatattttcaatttttaattgatacaacataattgtacatatttatggggtacatagtgatgttttaatacatgcagtgtatcataaggcccattttttaatcagatcatttattttcttagtgttgaattttaagtatcttttgtattattttggataacagtcctttatcaaatgtatcttttgcaagtattttctcccattctgtgtcttattttctcattctcttaatatttgaatatttaaacacatattatttataaattaatggtacattatttataataatggttaaacggttggtaagtaaatcactgctgagtatatactgctttgaagggcccaaggatccattaggcctccagctttaacccagcacagcattctgaaatacccaattctccccagagtttcaagagtcaccaggccttaaccttcttattgcctcaaggactcttagagctcaccaggctcctcctaccacaagccttcatcatatcaccctgttcctgttgcttagggagctttctcaggatagcatttcaagattgagtacccatcctagttttctcagtgttccttgtgagccgtgtcacatagaaggcatttaataaatgtgtgctgaactgagctgaaccagcaagggcaaaagggatttaagagactgccgttttaattgaaaaggagtaaaaagacactgggaaaggcagcatgtattgggggaatatgagaaatttccaaatcactggaccatcaggctggaaaatttaggttggagccaaactgcaaatggtttgaatgtcatcatgtatagtttatgtatttatatatacttacctttctcatagaagggtgaatttttatattataatagctagaatgttcttagaatttatcttcttaattcagaaaacatcacattgagatctgtcagtaaaccccccacacacacaaataatttcttgtcctcattgaccttcggtctgagctcttaatgcagttttctctactacacttgtccatgcacatagtggtcgcagacatttgagagaatgaaaatcatgtgtttaatgagagattgttatcggagactgtagcacttgttttactttattctttctattgctttttctctttttgtttctttcaaagtacatacaaatacatattcattatatcctatgtaagggaatgtgtatttactctagaataggactactttaagtttgagatggctttttgcttt

SEQ ID NO: 2439 - DNA, 15323 bp, Homo sapiens
ccgcagagggcctctctccatgctcttgttcttctctaagcagtagactgttcttgttactcagtgaagactcagggtcgggcaggagtggcttcttcattttcctgctccagtcttggtcttggtacttctgtcccacccccagtgacagacaacatctcccccctactcagcacaggtctagactgtcggctgatttcctaccccttccccagtagcagcagacttctagtttgaatccattcataatttggggtcctactggactccctgtctccttcctggcaacagtttgcttttgcctaatgtcagcacaagaggtagggtagattttgtaccaattctctagcctaggaatagaggccatgaaggttgctgccctacccccagaagcacacagcttttcccttgttctaaaatgttgagcatggaaaatttggccttatgtcttctcacttccgggctttcttgatgtcaagctccctgtcattctgtgtccatgttgtgattgaagaaagcaatcttaaacatgcatattttaggagtcacaaaaaattatttgcagaggattccagaagaaagtttcctctgtgaaaaccttctcttaccattttttacattatatataatttctatttttgtccccaggcttttttctttattgtgtgtgattgtatcaaattaattttaatgaaatatttcaaacatttggaaaaatatggagattaatataacattacctttatacccagaattaacaaatattactttgtcttatcttcttcagatcctttttaatgctaaatatagtatgatattgtgatataataagaaatacacatttggtctcggtccctagttccttatacacagctcctgaaactcttggaatcccctgagtgatgcgtgtttgtttttttaatgctaatagatgactggtggctgggagctctggatggagactggttaccaagggaaccaaccctgtgatagatggttgggactctccagcccacaccccagcctctagagagaggaggggagctgcaggttgagttgattgcccgtggccaatgatgtaattaatcatgcctacttaatgaatcttccgtaacactctaaaggatagtgtccagatgggttccagatagccagccgaacacacggaggtgctggaggtgcccagagaggtcacggaagctccacacccctctccatgtgccttgccctgtgcatctcttcatctgccggttcatttgtgttatcctttgaaatatcctttgtaataaatgggtaaacatgagtaaagtgtttccccaagtcccataagccattctatcaaattaacctaatccgaggaagagatcctgagaactccggtttatagctggtcagtcagaagcacaggtcacaacctgtgattggcatctgaagctggagggtggatactgtgggactgagcccttaatctgtgaagtccgacactgtctccaggtaactagtgtcagaattaaattctaggacacccggttggcgtctgctggagaatctgggtcaggagagttgtgccgactctgtgagattaggaaaaacactttgttttttcctgcctctaataataattaaagtcttctttgtatctcttctcagctgtatttttcttttttcaactacagtggcacagccaccatcctaaattggtgtgcatttttacagtccatatttttagcgttttaatacatatatgtttccataaacaatgtacaatactgttgagtgtgatataaatttaaaatatatcgtctcatactacttaggctgtcagttcattattacttactgaactcaggccctctagtcatttgataatagaagaaaacatattcttgacatttttcagagagggtgattcttagaccatttttttaggggcctaagccctaaagaagccttctttaaaggaaatagattgaggtaatgtcaaggtggaacacaattatggtacgaagtgtcttgacccagcactaagaaaaaggttttattaaattcaggagttttttaaattgctgcgcaatagaaatacttatttttggagtgtggataatttgatacattcatatgctgtgtaaatataaataagaataattgggatatctgtcaccctaaatactttcctttcttaatgctaggaaccttgaaattctcttctaatcttcatacaatgtacaacagattaacattaactgtagtcaccctattgatctgtggaacactaggtcttacttctatctaactatattttaacccactaatcagcctctcttcagcacgccccaacccccttcctggcctctcaagttcagttttagatttcagcatcttctctgtttactttaggatgctcccgtatctgaccactgttacttagctttcagaatcgccgatcactgaaattccaggtccaggggttctgcactgcgcttagaatttctcctcatgtataagatgtgctggttgcaccgccaagccctgttgccgtctgtgggacaggaagccttgttagtgcctccatgaatccagcactgacattagctcacgtagaactaacatctactcagggagttgcgttagtggctcttaagaaactccatgaaaattgtgagaaaacttcaatgagaacgtttttgacaagtcgcctttcccttgtatataaatgcgaaccgtttttcattttcaaaatttcaaactttttcatagaactcaaggatttgagtcctgcttcctttgagaggggtaacagtgagttttacataaacactgtgtatgattttaaaaggcagtactgaacatgtgctacacattaattccttagtttcgaaagatgcgacggagtgggaaagttcgatatccacaggtgcagatattggaaagaccacactcaggtgtatgatctttctcatagctgcaagtgactgtgttcagctttccaatgaggtgaggaaacatttatgggcctcctatggctctcttattcattcaccactgtgctgtgtaacacaatttccctgcaacaataaacttcaactttgcaatttgtcaccagtgcaatggctcatgtagttataaagtgaacgtggtgaccaatttggggcgtaatattgttctgcagtcaaagtatcctaatttgaagaaattttatgtatcgtgattttacaccaactggccaaagtcagatagtctgattaaatagatttggttttggctaactatatgtagttaattctacacactttaaatattttggtttgcaggtattttttgaaggcttaagtatttggtttctgtttctttgggtttcctgtctgtagattctaccaagcgtatgttgttgaaataatgaattcagggccaccttacccctagctgcaatcttgtcaagttccagcagctgagtaaacttgggtcaggtcagatttgagacaccctatgaccaagaagatattatttctaaatatcttgtatacattgaagaacagccattattttatctcttcaaggtaattttcttatctagttcatgttatgttttttacttcttttgaattatataaaattggaagttatatttataatattgttgtaatgtgaggccaagggggagcacacatcagaagatggaataagcaagcagaagctcggatctgagtctcacagtactccagatgcagtgagtggttctggagctgtacttctcaaagagggtggcagctctcagagagggtggggccctcagaatcaccagaagaactgtgttctcttgcattcccatccccataattctaataatctagagaaaatgaagagagaaaaaataaggtgaagccaggagtgagctcgcaggcattgtcagagatttaattattgtcatgtgctacataacaatatttcagtcgatgacggaccccatgttccacagtgctcccgtaagatgataagaccatatttttactgtaccttgtctatgtttagatatgtttggatccagaaataccactgtgttccagttgcctacagtacgtagtacagtcacatgctgtacaggtttgtagcctaggagcaataggctgtaccagacaccctcggtgtgtagcagctataccacctaggtctgtgtaagtcagtctgtgatgttcccacaacaagacctcctgacgatgcatttctcagaatgtatccccaccattaagtgacatgtctgtagtatgcagtttatagtaccccacgatattaaaacagaaacagaaaaagaaattcctccctcatgggtcctcataaagaatctgatcgtaagcaacatcttcagcatccttccatatgtacagccgtgaggttcagaagacttctttttttaagaaacatctcagcaatataataaggccaaagttcatctcataaaaaccgttttctaggagaccgtaaatattgctactcaaatatctaatatattatttaatattgggaataaattttcaagtctttggaaagatttaggcagtactctctaaatattagttgtctcaaccatttttttatacattaagcagcaatatgtttaggatctagtctttgacagataccagaatgcagctattcagtgttcaagtatagagtcatacactttaaaagttaatcgaaaaaggaaaaaaaaaattagccaagtatggtggtgcatgcctgtggtcctagctacttgggtggctgaagtgggagggtcacttgagcccagcaggttgaggctgcagtgagccaagatagcaccactgccctccagcctgagccacagagcgagaccctgtctcaaaaaaagaaaaagaaaaagaaaaaaaagttagtcaatctgccccttccccttaatggtggctgaggaatcagctggcatggtcagtgaggctggtgccaagtgttcaactgatatagccaaaatgactggcaggacaaaggcactgggtttgaccagcatggttggcatatttggtagtggagctggtcctcaggatcatgccctgggcatttggcaggaccatggattctgctagcatagctggtgtgtttgtcatgctgagaccaagaagccagcccacatggccaacatttttgggaggcgagggctgaggattcagctagcatgagtggaaatagcaggccagggccaagaaagtggcccacatggttgagagactggttacataccaggagatcaagcaaatgagtaaatatattggagctaatatattgaggatagtgtgtttgttattataggagataagagtaccagatatagaaagagtaaagacaaatcctatcgtattggattgtttttagaggtattgatatgaattcatggtttttaacagataaatagatttagatttctctgtgtgtatgtgtgtttatatatgtgtatatgtgtatgtatacacatatacacatgtatgtattttcttttttttttttttttgagatggagtttcgctcttgttgcccaggctgaagtgcaatggcacgatcttggctcaccacaacctccacctcccaggttcaagtgattctcctgcctcagcctcccgagtaactgaatcggattacaggcatgcgccaccatgcccggctaattttgtatttttagtagagacagggttcctccatgttggtcaggctggtcttgagctcctgacctcaggtgacccacccaccttggcttcccaaagcatgtatgtattttctaaccttatctgctgaagggacctggaagcagtgacacccagtaacagagagctcacttactactcaaatgttggtctagatgccttttcccaccagaaggaaccagagctctttggggaaatgactgagtctagggctgtgtgtgggaaagcacgtgataatcccagaacagttttataccagaaagtaaggaagcattccaagagtggtggggatgtatcaaaacaacatggggaaaatcttgaggaattcgagcatcaaaataagtaaagatagtaacagattataacaactaatatagagagagtattgcctaaatctttccaaagacttgaaaatttatttcctatatcaaataatacattaggtttctgagtacttgggcagcaatatttaatttagggtctcctagaaaatggtttctatgaaatgaactttgacattatgatattgctgagattttttttaaaaaagaaatctctgaacctcatggctatatatatgaaaggatgctgaagatgttgcttacaattagactttttatgaggacccagggggagaaatttctttcagatctctggactagaaataatcaatattctattgaataaaatagaaatctttgagtctgtgatggtataaagaagtgaatgaatgaatgaatgaatgaatgaacaagtaaatgggggagaaaggaaaactccaccctgtggttgaatgccagcataatgtagacggaattatggaattagagaatctgcatttggcaccattatagtagtgactgatttaggcaggtatcatcaatgaatgtgaaaacaccaggtgaaggttgactaagaacagactatttgcatagactgaaagtatctcgtcaaacacacaaaaatgtatgtcagttaattagcacaaagtatttatagttaatttacattggaaaaatctgacacataccatctaaaccaagtgattaaggttagcatctccagtagtgggacacgtcaatgtgtgcctcttcatcataggcacagagaagaacacaggtggtactcttgccaaacaatcacctgaatttaacaccaggaaacatacatagagtgatatagatagagatacagataacgatacagatagagacagatgtgtatacacatgtatatttatcaagatagagaattaattaatgaatgatatgacaaatgtaaaatgttagcagttaaggaatccaggtgaaatttataccagaatagacttaaagatttctgttttattcagtgagttataatattttataatcatttatttcaatgctcaaattctccaagatgtttcccgcatccttctaatatatgcccactactcttggaaaacttccttactttctggtataagatgttcttttgaaattattttaaaataaaaagtttttaaaaacttaaatcagtaaactaggattaagattttaatcctcttgtgaaaattgagaggcacaggagtattgaaaatacaagtattagcctaaatagccaaccccaaggtaacacccacaggcagccgcaaaatggtgccgtggcaggtggagctttgtgtgggctgagtcggtgttaccccatgagcagtgctgccagttacaccaagctccacccatcgctgcaccattacaagaggtaaatacgtttgaatgcgacatccatttcattaccattacagtgtttaattgtaaacattacaagaaggcaggtttaagtttaacagaaagtgaaacttcctagatctctccacaaaaagaatgggcagccatatttgaaataagtccttttgactggagagaagctactcagttgggttataaaaaggattcaggattgcaagatgatttgagtcagcttgtttctaaggtggtggtggtggtgtttttctaaccctgattgtctattatctagtataacagggatgtataatagccccctcctcccagttttaggacagtatttgaatgtgacatcctaacttgaactccataaaaaataaattaggtaaaatagttgaaaaggggaagaaaggaggaatgaaaaatgaacaattgttttgaaaaggcagttttcataggataaagacttgcctaaacgatgaggaggccctttttttttttttttttttttttcatttttctagttccacttaggatagaccaagataatatattaaattacaaaagaaatattttagttaaacatagggaacagctgtctgactataaaactaagcaacatggaaaaaattcaaaagaatgttgtagaatttccttctggagagttttaaaaactaaggttgactccccatcacttagtgcccatcccaacctcaccatacttgtcaatattgtacccatttgatacagatcatctcatacaattagccatatggattatatatgaatatgagacatgtataacctgtatgttgaatgattgaatatttttgaaagtgcagctttcgtttttaaaacctttgtcgcccaggaattttagataaagccaacgtttttggctctaaaattgaactttgagccgggcacagtggctcacacttgtaatcccagcactttgggaggctgaggcaggcagatcacctgaggtcaggatttcgagaccagcctggccaatgtgggaaaatcctgtctctactaaaagtacaaaaattaacctggcgtggtggtgggcacctgtaatctcagctacttgggaggctgaggcaggagaatagcttgaacccaggaggcagaggttgcgtgagctgagattgcaccattgcactccagcctgggagacaagagcgaaactctgtctcaaaaaataataataataataaaataaaactgagcctttgtagcaatgggtggttgttttaagccttaataaagaaatgtgttttaattccagatattaaccaaaaggcacctaacatatattgctaaaactacccccaattcagcaggcatagagacataaaacactaaacttaagagaacaaaatggtaaataggactttatcaaactttaaacttctattcatcaacactgggaaaaaatattcactaaatacatacatacacacacaaaaacacatacacacatgacaaagtacttgtattgagaagatattttaaaagtcagtaacaaaagatatttaatagatatttagtatctattagatacttaaaacaacataagtttttaaatgggcagaagacttgaacagactctccaaatatacaaagtaagcacatgaataagtgtttatgcaaatgaaagccacaaagagatagtactacagtatcactaaaatagctaaaattaacaaaactgacagtaccaaatgctcgtgaagatatggagcaactggaactctgatacactgtgatgagagggtaaaatggcataatattttagaaaactgagaagcagtttcttatagatgtacatctatcctgtaacccagggatcctattcttactcaaaagaaatgaaagcatatgtccacaaaaagacttgtacaagagtgttcatagcagctttactggaaaaagtccaaaagtggaaacaacccaaatgtccattaacaggagaataggtatttttaaatgatcatatatcattaatggaatactactcagcaatagaaaagaatgaactactaatacaaacaactgaatcttcagaaacactgtgttaagcaaaagaagccagacacacacaaaaaattatgtactaaatgtattattccatttatatgacattcaggaacagaataaattatggtggtaaaaattagaacagtgattacttataggaattgactgaaagaggataaaacagaaccttctggggtaatgaaaatgtcctatattttgactggggagatggccatgtgggtagataaattcatcaaaattcattcagttgtacacctaaagatctgtacattttgttatatggcaacgtttaaaaaaaatactccgcctccagtctccttttgaactgtttgaagtagtacaactgataggcagattctgctaaaaagctaaaaatataatttttctctagagtacaaatttcttttttttttccaccgtaaatgccagcctcccatcagaggctgaaccacagtggaatcaactttcatcagccagcccctctgtggctcactgagctttggattccaggtccctttcccagcacttagtcccatttttaattttcaggaagtattgttccaaaacttggctcagacttatcctctccttggattcctttctccatttgttttctcggttttgctcacttactctttaacttgcacccctctttttccaaggtggtggattagggggtgttaatgctggggcagtgttaggcacagaacctaggagtcatctccctcactccgggaccgcatcaatcatcagtcacagacatgacagttcatttttccctcctgaacgcgcctgcacagatgggtgtatcgctcaagtagccaaatggatgtagctgttgggggacagggcctgaggggcagcagggagagaaaagaacaaagaaagaaagaagaatggttctttgtggggcagcaaactttcttctggttcccagcctgaatgtttctgatctggttttcttctttttgtgatgtttgaacttgtttcctcaactcagatgctgaactcttgtccaaaaaacctaagggcagcatagtgtgagagactgtgggaggcaagtccagcaatccagcaaaaagaattgcagaactgtgaagataaatgtgtgtccgtatcaggactgcgctggagaacgggaagagaggggttggggtgctaagactgtgtgtgtgtgtgtgtgtgtgtgtgtgtgtgtgtcttgacaaactgatgagaaacactattgagtagttttctcctctctgctctcacacacagtctggcactttcttcttctgtgacagctgccattaactttttaatgcgaagacaagggtatcttgccaattggatgttgaaatctctggcaaggaaaagcttgctttaaaaaaaaaagaggcagggaatatggggaaggttgggcagacataccaaaggtccgggggaagacagggtactaagttggaccttacaatgcagaatggctgccctgcttctgataaaatcccctcaaatgaagttgggaaaagaaagaggaaatgggagtgtgagtgtaagggagataaggaactcttttacgcagttgcaatgacacagatattaagtattatttgcaattcactcccgatggatgtgagaactcctcatggagttttggtgtatatgtgggaccttgtgctaaatgtagaataatcttgtttgtgcagaaagagaaggaaagagaaaatattaggagacctctgtagaccaaaacattatgatacaaaagattgttccagtcatttccttccatagcttatctcagagaaggggagttctggtgttcgtggctcgcctatcaggtcttcccctcacctctaaactacggcagctcttgatccttattactggtacctaccccaaactcaccaggtctaaataaaactgaacataaaaacatcctgttgtgaattcagttctcatgtaccttcagctttgcagcaaagaatgcaaaagccttttttttttttttttttttttttttgagacagagtttcgctccgttgcccaggctggagttcagtggagcgatctcagctcactgcaacctccccctcccgagttcaagcaattctcctgccctcaccctcccgagtagctgggactacaggtgtgcaccatgacgcccagctaatttttgtatttttagtaagagacagggtttcaccgtgttagccagggtggtctcgatctcttgacctcacgatctgcccacctcagcctcccaaagtgctgggattacaggcgtgagccacggtgcatggccacaaaagccttttttaatctagtttttattagcttggcctcacactggactctttaaaaaagagtcctaaaatatgaatatggaatattatatgaaatattttataaaaatattttataaaaagctcagcatttatggagatcttagtgtattttagctgccctaattgcttttttcctttgtgttgaacgtattcccatgggagaagaaagttcaccctcctgagtccctgagctcctgcaggaagaattatttaccatcctggaattttaatgagtcttgacaattactgtaatccaggtcattgaacgcgggtctgtcatcgccagtgtcatcttccagagatgatgctcccccaactaagctgagaagaaaatgagtccttgtgaatgccaaagagacatgaatgtgacctgcaccaatgctgcaaacctaaagccagtgggactagaaactgtggaaatgacagtcttccggtccggtcagagcatctgaaataaattgcccacagttttcttccaaacttttaaattgtttacaaaaggtttggtggtaccaatcttactgagacggcctagaaatacaagtaacgtaaatttcttacagagtgtctacaatgctgcatgccagaggcactcagcacacctgaaggatgtgaagctcctgtaggaacagtagctctgtacaacagtaatctctagacaaccaacgtaaatttaaacaaaaaggtgtgagaccacacacccttcttccagtggggcataactgcccaggtgtaaaatcagacaggaaccctgaaatatgaaccatctccagtttgcagacagacattgctgccattctccacttgactcccctgtgcccatgcctgaaagccccgcttcccctagagaggtgggggcagtgtggccacagcctctctccccgcagtaccacctggtcccaaaagtcccagccctccacggcagcactagtgaggcctccttgctgttgctgctgttactccctgagccttctagagaatctcctgcatgccctgtgagaatgtgctgatgctggggccactgccacagtcgcgggttttctcccagacccccttctggtgccaagtaggaaagatgggaccaggctaattctgttgccactgagacaagtgaagacatatcctgatgtctggagttggatctcagaaggcgccttccagtgtataaactgatatgaaatggtggttaggtcctgtggcactgcacaccaacactgtattaccttgctcgggacaccgtaacaaaataccacagaccgcgtggcttaagcaacgtaaattgatttcctcacagttctggaggctggaagtccgagatcaaggggtcggcagggttggtttctcctgaggccccctctccttggtgtatacatggctgcctgctcgctgtgtcctcacgtggtctatcctctctccctgtgctccccagtgtctttctgtatgtccagatttcctcctgttacaaagataccagtcatactggatttggaaccaccctgcctgcctcattttaacttaatcgcctctttaaaggccctgtctccaaatgcagtcacatcattctgaggttctggtgatttaggcttccacctatgaatttggtggggacacagctcagcccaccacagacattatgggtaaaataggctcatggcaacaacttccgaacctaactactgcttgggtaattgttaagggtttcaaaataactgactgtcaaacaagctctggaaactgcattccaaataaactgtggggctctgcctgttaaaaggtaggaggtcctggcgaatctgttatgtccagtaattactgaatactcccttaggggccattcagggtctgctggttacttcaataaagaatgctgtaagaaaagcactgagtctctggccctttctaaaagagttgtgtaagagacataaagccataaaatatgaagtaggtgcttgtttagcgactgaatgaaatcaggaattttccggagataagattatggtattcttctacactgtataaatgctatcttcctgctttgtttacctctttttatacaaaagaccacctaggcacaaaaggaagtgcccctacctagcatagtctgaacgagtgaaagagagtctttaattttaacactaaagataacagatcttgctgtaaagtgcaatgatgcttaatagccctaaagatcaggttgtgattgatgggatttctcatggtgttcttgttaaagataaatagtagtttttaatgttatcagactggaaacatcttactcttttctaatgtaagctctaaagcaaacttcggacactaacatcttattgccaacttaacagaaaagtgtgatgggatattggataaggctccgacctgcgtgcctgaaatttcagtggttcggtttgttcctttgaatgaggcatctctctgaggcactgcctttctaagtgcaagttttctaggaagggcagtgtgttgtcagtttctccttagcgtgcccagtgtatctaggatgatacaaacaggaagagactgggaaaaggagggttcaaaaaagggagggacccaatggccagattaaaaaccagcttaacctcttcattgtatcccaggcctgatgattgagcatctttattcttaggattctccaactttaggctacctgatacatctagagcagcggtccccaacgttttcggcaccggggactggtttcacagaaggcagtttttccacagacaggggagtggcagggaagggatggtttcaggataattgaagcacattacatttattgtgcactttatttctgttattattccattgtaatatataatgaaataattatacaattcaccataatgtagaatccatgggagcccagagcttgttttcctgcaactagactgtcccatttgggagtgatgggagacagtgatagattatcaggcattagattctcataaggagcacgcggcctagatccctcgcgtgcgtggttcacaatagggtttgcgctcatatgagaatctaatgcctcagctgatctgacaagagacggaactcaggcagtaatgcacgcaatggagagcggctgtaaatatagatgaagctttgcttcctggctagcccttcacctcctgctgtgtggcccagttcctaacagggcctggaccagtacacggacccagtactgggagttggagactcccgatctacagtatgtgagaaatcacatcaaccttttacaaggattgagcctaaatttgaaccaaaaaatacttacttctaaaagtaagtaagccacagatagatgtcagaatacaactagcaagaaggtaaagactcatggaaaagatggagtaatgagttttcttagcactgtatgatacgacagaaaagctgcagggggaaggcttcacgaaagcaaaaaactccaactagaaatagcctgcaggggccaggtgcagcgactcacgcctgtaatcccagca

SEQ ID NO: 2440 - DNA, 12662 bp, Homo sapiens
tagtagctgcgactacaggtgtgtgctgccatcccccattaattaaaaaatattttttgtagagatggggtcttgttatgtttctcagcctggtcttgaactcctggcccttcccatttcagcctccccatgacgtggggaggtttacagacatgacccaggcccattcttctgattttgttttcctcttcatctaaaagaactcctttcaagattttatgagacagaagtaaacatcagcatctcaaacacctcaatgccataaggtggcaggggcaatgagaactttctgcctagtctatactaccacataagctccaaaaagagagagacctcatctggcttattcactactgtattcccaagcctcacaagcaggaggtactccaaaaataaaaaaaggggaggaaattaaacgtggtatgcctataaatgccatgctttctacatgacagggtcaactactactgcttaataataaaaccaatagtcagccaggcgcagtggctcacgcctgtaatcccagcactttgggaggccaaggcgggtggatcatgaggtcaggagttccagaacagcctggccaagatggtgaaaccctgtctctactaaaaatacaaaaattagccaggcacggtggtgggcgcctgtaatcccagctacttgggaggctaagacaggagaatcacttgaacctgggaggcggaggttgcagtaagccgagatcatgccgctgcactccagcctgggcgacaagagacaaactctgtcttaaaataacataacataacataacataacataacataacataacataacataacatcacaccaaaccaaaccaatagtctggccgggcaccacggctcacacctataattccgccactttggaaggtcgaggtaggcggatcacttgagaataggagtttgagaccaggctgaccaacatggtgaaaccccatttctactaaaaatacaaaaattagtcaggcacggtagtgcacgtctgtagtctcaggtacttgggaggctgaatcacctgaacacaggaggcggaggttgcagtgagctaagattgcgccactgcacgccactgtactccaacctgggcaacagagtgagactccatctcataaaaataaaaattaaaccaacagtcacatattcaacaaattattattattattttgagacacagtctcactctgtcacccaggctgaagtacagtggcacgatctctgctcactgcaacctctgcctcccgggttcaagagattctcctgcctcagccttctgagtcactgagactgtagatgagccacgcacaaatggccaatttgtgtatttgtaataaacacagggtaggccaggtgtggtggctcacgcctgtaatcccagaactttgggaggccgaggcgggcggatcacaaagtcaggagttcgagaccatcccagataacacggcgaaaccccatctctactaaaaataaaaaaattagccaggcatggtggcgggctcctgtagtcccagctacttgggaggctgaggcaggagaatggcatgaacctgggagtcggaggttgcagtgagccgagatcacgccactgcactccagcctgggcgacagagcgagactccgtctccaaaaaataaataaataaataaacaaacaaacaaacccagggtttcaccacgttggccacgctggtctcgaactcctgacctcaggtgatctgcccgcctcggcctcccaaagtgctgggattacagtcgtgagccactgcgcctggccacgacaagttaattgataacttactaagcatacaaagttgtacaaaacacttgttcctactgtcaagatgctctaaatctagaaggaagataatgcaaatatttccaaacaagtcagatcgcaaataaacacatgcaccgcatgtttcaattatttatttatttatttatttattttgagacagagtctcgctctgttgcccaggctggagtgcagtggcacgatctcggctcactgcaagctccgcctcccgggttcacgccattctcctgcctcagcctcccgagtagctgggattacaggcgcccgccaccacacccggttaatttttagtatttttagtagagacggggtttcaccgtgttagccaggatggtctcgatctcctgaccttgtgatccacccgcctcggcctcccaaagtgctgggattacaggcatgagccaccgggcccggcccgcatgtttcaattaacaacagacctatatacaatgatcaaccagtaagttaaggtaaatttactcttaaagaaagatatttttgaccaggcgtgatggctcacacctgtaatcccagcactttgggaggtcaaggtgggcagatcacttgaggtcagaggttaaaagtcttaactcctaaccacagtgaactttctgtctgcagaaaagagcattggtcaacagttcacaaaacggctaggcatgatggcgtgcacccacagtcccagctacgtgggaagctgaggtgggaggattgctggagcccaggagttcaacgccctgggcaatacagcaagacctcatctctggccaggtgcggtggctcacatctgtaatcccagcactttgggaggccacggcgggtggatcacctgaggtcaggagttcgagaccagcctggccaacatggtgaaacccccgtctctactaaaaatacaaaaattagccaggtgtggtggcacgcacctgtaatcccagctattcaggaggttgaggcaggagaatcgcttgaacccagaaggcagagactgcagtgagccaacatcacgccactacactccagcctgggcgatagagcgagactccatctcaaaaaacaaaataagaaagatatttatcaatttagtgtatcctaactgttcagtgtttgtctacagtagcatacagtaatgtcctaggcctgcacattcacacaccactgataaatgactcatcccaagcaacttcctgtcctgcaagctccattcatggtaagtgacctattcagatataccacttttatcttttacgctgtatttttactcaccttttctatgtttagatatgtttagattcacaaatacttaacattatgttacatctgccaacagtgttcagtaccgcaacatgctatacagatttgtagcctaagagtaatactctgtacgacagcctatgtgtctagtaggtataccatctaggcttgtgtaagtaaactctatatttgtacaatgataagatcaccgaaaaaatttctcaaaacacatccccatcattaagcaatgcataaacatagtttctcatcaccaaagatggtatgaatgtcaaataaacacatgaaaaaatgctcaatatcactgggcattagggaaatgcaaattaaaaccacaatgaggccaggcacaggggctcatatctataatcccagcactttgggaggctgaggtagatgaatcacttgagcccaggagttcaacaccacccagggcaacatagtgagacctcttctctactaaaaatcaaagcaaactaccaggtgtggtggtacatgcctgtggtcccagccaggaggctgaggcaggaggatcacttgagcccaggaggtcaatgttgcagtcagacaatatcgcaccactgcactccaccctgggtgacagagcaagaccctgcctcaaaaaaaaattcatacactgctagggaaagaaaatatagcagtcactttagcaaacagtttagcaattacttttaaaattaaataaacactcacaggattatatgtaccctggaaaaataaacacttgccacaaaacccagcaatctcatttctatgcattccaaccaagagaaataaaatcatatgttcacacaaaacctgtacataaatattcataccagctttatttatttatttttttgagacggagtttcactcttgatgcccaggctggagtgcaatggtgcaatcttggctcaccacaacctctgcctcccgggttcaagcgattctcctgcctcagcctcctgagtagctaggattacaggcatgcgccaccacgcctggctaattttgtatttttagtagagatggggtttctccatgttggtcaggctggtctcaaactcccaaccttaggtgatccgcctgcctcggccttccaaaatgctgggattacaggcgtgagacatcgcacccggcctccagctttatttttaatagccaaaacctgctaactcaatgtccaccactagatgaacaaactggtacatgcatacaatagactactactcaacaataagcagaaagaaactactaacatgcaatagtacagacgaccttttttttttttttttgagataagagtctcactatgtcacccaggctggagtgcagtggcgtgttcttggttcactgcaacctcctcctcctgggttcaagtgattctcctgtctcagcccccccgagtagctgggattacaggagcgcgccaccgtgcctggctaatttttgtacttttagtagacacagggtctcaccatgttggccaggctggtctcgaactcctgacctcaggtgatccacccacctcagcctcccaaagtgctgggattacaggcgtgagccactgggcccagccagagataaggtcttgctgtgttgcccagggccttgaactcctgggctccagcgatcctcccacctcagctccccaagtagctgggactatgggtgcacgccatcacacctagccattttgtgaactgctgaccaatgctcctctctgcagacagaaagttcggtgtggttaggagttaaatgggaagaaagaggaggctgggtgcagtggctcatgcctgtaatccctcccaacactttgggaggccaaggcaagagtttcacttgagcccaggagtttgacaccagcctgggcaacagagcaagatcctatctccgaaaaattaaaaataagaaaagtaattagccggacatggtggtacacacctgtagccccaggtactcagcaagctgaggtgggatgatgggatgattgcttgagcccaagaattcgaggttacacagttacagtaagctatgatcgtgccactacactccaccctgagcaacagaggaagattctgtctccaaaaaagaaaaaaaaaaaaaagatgacaacggaacgggaggtgggtgtagtcccagctactaaggaggcagaatcatctgggctcaggagttcaaggtcagcctcagcaacataaggagaccctgtctcttaggaacaaaaggggagggggagagagaaggggagggagggggggagagagaaggggagggagggagggagagaggaagggttgggagagacagagaaagaaaaagaaaggaaaaaataaaaaggagagaaaggaaggaaagaagggaagacaggaggaggcagcggggaggggaaaaaaggagaggagggatgaagagaaagaaaggaaacgacaaagaaaggccaggcatggtggctcatgcctataatcccagcactgggaggccgaggcaggtggatcacctgaggtcatgagttcgagaccagcctggccaacatggtgctaccccatctctactaaaatacaaaacctagccggctgtggtggcaggtgcctgtagtcccagctacttgggaggctgagacaggaatagcttgaacccaggaggtggaggttgcaaggagccaagattgccccactgcactctaggctcggcaacagagcgagactccatctcaaaaaaaaaaaaaaaaaaagaaatgtattagaaataaaagtacatcagattctaatgccagttatgcagccaatgatgagatactctggtaaataaccctcttggtctcaatttcttcacccgtaaatagaatgagtactaaaaaaccaccagagccagagaaatccaaactaccagggaaagggaggggcccactgagaaccaccccagcaacccgaccacagctggtcttccctggacaccatgaaccacaatgtccaaacctcttcactcctgccaacatcggccatccccctaactatgagatgctcaaggaggagcaagaggtggctgtgctgggggcaccccacaaccctgctcccccaatgtccaccgtgatccccatccacagcgagaactccgtgcccgaccatgtcgtctggtccctgttcaacacccacttcatgaactcctgctgcctgggcttcatagcattggcctactccgtgaagtctagggacaagaagatggttggcgacctgatcagggcccaggcctatgcctttaccgccaagtgcctgaacatctgggccctgattgtgcgcatcattacgaccattctgctcagcatcatcccagtgttgatctttcaagtctatcaacagatcaggaggcattatctaggccaggagctctgcccgtgatctgattcccatgtactccatccaccctccattcctcgccctgcccccagagccaagttctctatcagccgtttatcctcacacacttttctacaatggcattcaataaactgcacgtgtttctggtttaaaaaaaaaaaaaaaacaccagagccattccaactccaaatgcgtttgactctacattgttgaacatctactatgtgccaagaacagaacataagaagaatttaggctgggtgtgctgcctcatggccttaatttcaatactttgggaggccaaggcaagaggagtacttgagggcagaagttcaaaaccagcccgggtaacagtgagactgtctctacaaaaatttttttaaattgtagggcgcagacactttgggaggcgaaggcgggcagatcacttgagctcaggagtttgagaccaacctgggcaacatggtaagaccctgtcactactaaaaatacaaaaaattaaccaggcatgatggcacacacatgtggtcccaagctactcaggaggctgaggcagaactgcttgaactcgggaggtggaggttagagtgagcagaaattgcaccacgcactgcagcctgggtgacaaagcgagacggtgtctcaaaaaaaaaaaaagaactgcagggtgtgatgttgcatgtgcctgtggtcccagctactcaggaggctgaggtgggaggatcacttgaacccaggagttaaaggctgcaataagccatgatcacaatactgtactccaacctgggcaatacagcaagatcccatctcaaaaaataaatacataaaaacagaaaatattaagactttagtatctcagtttttttgtttgtttgtttgtttgtttgagacggagtctcgctctgtcgcccagcaggctggagtgcagtggcaccatctccgctcactgcaagctctgcctcccgggttcacgccattctcctgcctcagcctcccaagtagctgggattacaggcgcccgccaccacgcctggctaattttttgtatttttagtagagacagggtttccccatgttaggcaggacggtctcgatctcctgacctcgtgatccacccgcctcggccttccaaagtgctgggattacaggcacgagccaccgcgcccggccagtatctcagtttttttttttgtttgttttttttttttttttggagacagagtctcgttctgtcgcccaggctggagtgcagtggcacaatcttggctcactgcaacctccacctcctgggttcaagcgattcccctgcctcagcctctcgagtagctgggactacagatgcgcaccaccatgcccagctaattttttctattttagtagagatgaggtttcacaatgttgcccaggttggtctcgatctcctgacctcgtgatccacccgcctcagcctcccaaagtgctgggattataggcgtgagccaccgcgcccagccaaggaagatattctttctcttttaataggtaaataaactaagcctgagagtggctgagtaacttgcccattcaaacatgtgaccaagcagttaagtgccaaccattcaagaaatagggatacaatcaatagtgaacaaaacaaagttcctgctttcatagagcttaaattttagttactgaagagtgaaccatggccaggcacggtagatcatgcctgtaatcccagcacgttgggaggcccaggtgggcggaccacctgaggtcaggagttcaagaccagcctgaacaacatggcgaaaaccccgtctctactaaaaatataaaaattagctgggcatggtggtgggtgcctgtaatcccaactattcaggaggctgaggcaggagaatcacttgaacacaggaggtggaggttgcagtgagccaagatcgcaccattgcactccagcctgggcaacacagcaagactccgactcaaaaaaaaaaaaaaaaaaaaaaaacagtgaaccatgattccagcttagactggagttgccagataaaatacaagatgctcagttaaatttcaactttagataaataacttttttctatgcaatttaatacacaattatactaaaaaactggtcaatgttcatcaaaaattcaaatttaactgagtgtcctgtatttctatttgccaaatctgacaaccctagcttagatataacctcaaaactctttctcaatccttttactgcgtttctctggctctaaagcagtaacttttttgactatatcaataaaaaattacttaaaaaaaaatttttggctaggcacggtggctcatccctgtaatcccagcatttctggacaccaaggtgggtggatcatctgagctccagagttcaagactagcctgaacaacatggcaaaacctcatctcttcaaaaaatacaaaaattagccaggcatggtagcgtgctcctgtactcccagctactcaggaggctgaggtgggaggatcgcttgagcccaggaaacagaggttgcagtgagccgagactgcaccactacattctagccttggtgacagagaccctgtctcaaaaaaaaaaaaaaaaaaaaaaaaaaaaaaaaaattcattgaactgttgctgctcgtggcagagcaggactagtccataggcaatgtgcccagagttggccaaaaattacattttgaattacaatgcggtatatatacattaactcaaaccaaagcttaaaacaattcttggcagctgggtgcagtggctcacacctgtaatcccagcactttgggagtcgaggtgggcagattacgaggtcaagagatcaagactatcctggccaacatggtgaaaccccatctctactaaaaatacaaaaattaggccgggcacaggggttcatgcctgtatccccagcactttgggaggccgaggcaagtggatcacctgaggtcaggagttcaagaccagcctgaccaacatggagaaaccccatctctactaaaactaaatacaaaattagccaggcatggtggagcatgtctgtaatcccagctactcaggaggctgaggtaggagaatcacttgaacccgggaggcagatcgggccattgcactccagcctcggcaactaagagcgaaactccatctcaaaaacaattatttcaataatgcaatgcatcctaacacttcttattctttttcatttttctaaaaatgcttgtcataatccactaatgtgtttcacaatctactaaggggtcatgatctgcagattgaaaaatacttctttgggagatataaaaaatcatttaacctggtgttatgagtcaccattatgagcacattaactaactacactgtgctataaaacagtaatgcccttagggcctaagatatacagctataaacttacagtcaaaactcccaggccgggagtggtggctcacgcctgtaatcccggcactttgggaggcctaggcaggtggatcatctgaggtcaggagttcaagaccggcctggccaatatggcaaaaccccatctctactaaaaatacaaaaattatccgggtgtggtggcgggcacccgtaatcccagctactcaggagtcagaggcaggaaaatcgctagaagctgggaggcagaggttgcagtgggccaagattgtaccattgcactccagcctgggcaacagaacaagattctatgtcaaaaaaaaaaagccaggtgcggtggctcacgcctgtggtcccggcactttgggaggctgaagcaggcggatcacctgaggtcaggagttcgagaccagcctggccaaaatggggaaaccccgtctctactaaaaatacaaaaattaacccggtgtgtgaccaatatctgtactcccagctactcaggagtcaggcaggagaactgcttgaacctgggaggcggaactacagtgagcagagatggcgccattgcactccagcctgggtgacaagagcaaaactccatctcaaaaaaaaaaaaaaaaaaaaaaaaaaaaacctcccagaatggtatacttgttgagctcttgtgtctgttttttagtagttcccattttagtagttcccaggctctttgctttgtttttttgagataaggtctcattttaacgcccaggctggagtgcagtggtgcaatcatggctcacctcgacatccagacttaagtgaaccacctgcctcagcctcccaagtagctgagactacagaagtgcacgaccatgactggctaaattttttgtattaatattttttgttgagatggggtttccctgtgttgcccaggctggacttgaactcctgggctcaggtaatctgcctgcttcagcctcccaaagtgttgggattacaggtgtgagccaccatgcccagccaccagtcttccaaactttttttttttttttgagacagagtctcactctgctctgtggcccaggctggggcacagtggcacaatctgagctcactgcaaccttcacctcccgggttcaagcgattctcctgcctcagcctcccaagtagctgggattacaggcgcccgcccagccccaagtctggttttttttttttttttttttttttagacggagtctccctctgtcgtcagtgcagtggcccgatctcggctcactgcaacctctgcctcccgggttcaagcaattctcctgcctcagcctcccgagtagctgggactacaggcacacatcaccacgcccatttaatttttttgtatttttagtagagatggggtttcaccctgttggccagaatggtctcaatctcttgaccttgtaatccgccctcctcaacctcccaaagtgctgggattacaggggtgagccaccacgcccggccctttttctgtttttcagtagagacagggtttcaccatgttggccagactggtctcgaactcctgacctcaagtgatccaccctccttggcctcccaaagtgctgggattacaagcgtgagccaccgcacccagctaagtctttcaactttctatcacgctactgttatttctcattgctgttaatatatctgcctctgaaaacattgcttttctacttgctgccaatatgtacatcagaaaagaaagctagatagaatcatgtgtaaagtaaaagttctcaaagaggccataaagaactctccagaccagaggctaaagcaggaggacagtttaagcccagaagttggaggccagcctgggcaacataacaagacccccatttctaccaaaaaaaaaaaaaaaaaaaagaactcccctttctaaaatctgctcaagcttcagtgaaaagacatttagtcttcaattcctgatttcgaaatgtgtttcaggaatgaaaatagttaactgcacaaagtccacagcaaatgtttataaacccgaaaagaaaaatgcagtacttgtttcaaaacccgccctttataaaaaactaaaattataatcaagattaattccacttagaaaaattattaagaatattttaacatgactttaaaaagcaatatgaaaaacgtcaatgaaaaatatttgacctggccagccacggtgcctcacacatgtaattaaagcactttgggaaaactaggtgggtggatcatttgaatttaagagtttgagaccagcctgggcaacatggctaaaccctgtctctacaaaatatacaaaagccaggcatggtggcatacacctgtagttccagctactcgggagactgaggtaggaggactgcttgagcccaggatgttgaggctgcagtgagccatgaccataccactatactccaacctggccaacagggtaagactcagtctcaaaaaaaaggaaatttaaaaaaaaactgatcattggcaacactgttcaataaagcctctcaaggcaatggtttcaggagaccaacattctaaagttctgatacagttaataaaaataaaccacgttcacttatattgccgacaagcctcataccacaactaatgagttttacaaagacttcattatagaatgaaattttattacattcccaaaatgtagttagctattaatcatggcacgaaactgacattttcgggctggacacagtggctcacacctgtaacaccagcatgttaggaggcctaagtggggtgga

SEQ ID NO: 2441 - DNA, 15194 bp, Homo sapiens
tagtagctgcgactacaggtgtgtgctgccatcccccattaattaaaaaatattttttgtagagatggggtcttgttatgtttctcagcctggtcttgaactcctggcccttcccatttcagcctccccatgacgtggggaggtttacagacatgacccaggcccattcttctgattttgttttcctcttcatctaaaagaactcctttcaagattttatgagacagaagtaaacatcagcatctcaaacacctcaatgccataaggtggcaggggcaatgagaactttctgcctagtctatactaccacataagctccaaaaagagagagacctcatctggcttattcactactgtattcccaagcctcacaagcaggaggtactccaaaaataaaaaaaggggaggaaattaaacgtggtatgcctataaatgccatgctttctacatgacagggtcaactactactgcttaataataaaaccaatagtcagccaggcgcagtggctcacgcctgtaatcccagcactttgggaggccaaggcgggtggatcatgaggtcaggagttccagaacagcctggccaagatggtgaaaccctgtctctactaaaaatacaaaaattagccaggcacggtggtgggcgcctgtaatcccagctacttgggaggctaagacaggagaatcacttgaacctgggaggcggaggttgcagtaagccgagatcatgccgctgcactccagcctgggcgacaagagacaaactctgtcttaaaataacataacataacataacataacataacataacataacataacataacatcacaccaaaccaaaccaatagtctggccgggcaccacggctcacacctataattccgccactttggaaggtcgaggtaggcggatcacttgagaataggagtttgagaccaggctgaccaacatggtgaaaccccatttctactaaaaatacaaaaattagtcaggcacggtagtgcacgtctgtagtctcaggtacttgggaggctgaatcacctgaacacaggaggcggaggttgcagtgagctaagattgcgccactgcacgccactgtactccaacctgggcaacagagtgagactccatctcataaaaataaaaattaaaccaacagtcacatattcaacaaattattattattattttgagacacagtctcactctgtcacccaggctgaagtacagtggcacgatctctgctcactgcaacctctgcctcccgggttcaagagattctcctgcctcagccttctgagtcactgagactgtagatgagccacgcacaaatggccaatttgtgtatttgtaataaacacagggtaggccaggtgtggtggctcacgcctgtaatcccagaactttgggaggccgaggcgggcggatcacaaagtcaggagttcgagaccatcccagataacacggcgaaaccccatctctactaaaaataaaaaaattagccaggcatggtggcgggctcctgtagtcccagctacttgggaggctgaggcaggagaatggcatgaacctgggagtcggaggttgcagtgagccgagatcacgccactgcactccagcctgggcgacagagcgagactccgtctccaaaaaataaataaataaataaacaaacaaacaaacccagggtttcaccacgttggccacgctggtctcgaactcctgacctcaggtgatctgcccgcctcggcctcccaaagtgctgggattacagtcgtgagccactgcgcctggccacgacaagttaattgataacttactaagcatacaaagttgtacaaaacacttgttcctactgtcaagatgctctaaatctagaaggaagataatgcaaatatttccaaacaagtcagatcgcaaataaacacatgcaccgcatgtttcaattatttatttatttatttatttattttgagacagagtctcgctctgttgcccaggctggagtgcagtggcacgatctcggctcactgcaagctccgcctcccgggttcacgccattctcctgcctcagcctcccgagtagctgggattacaggcgcccgccaccacacccggttaatttttagtatttttagtagagacggggtttcaccgtgttagccaggatggtctcgatctcctgaccttgtgatccacccgcctcggcctcccaaagtgctgggattacaggcatgagccaccgggcccggcccgcatgtttcaattaacaacagacctatatacaatgatcaaccagtaagttaaggtaaatttactcttaaagaaagatatttttgaccaggcgtgatggctcacacctgtaatcccagcactttgggaggtcaaggtgggcagatcacttgaggtcagaggttaaaagtcttaactcctaaccacagtgaactttctgtctgcagaaaagagcattggtcaacagttcacaaaacggctaggcatgatggcgtgcacccacagtcccagctacgtgggaagctgaggtgggaggattgctggagcccaggagttcaacgccctgggcaatacagcaagacctcatctctggccaggtgcggtggctcacatctgtaatcccagcactttgggaggccacggcgggtggatcacctgaggtcaggagttcgagaccagcctggccaacatggtgaaacccccgtctctactaaaaatacaaaaattagccaggtgtggtggcacgcacctgtaatcccagctattcaggaggttgaggcaggagaatcgcttgaacccagaaggcagagactgcagtgagccaacatcacgccactacactccagcctgggcgatagagcgagactccatctcaaaaaacaaaataagaaagatatttatcaatttagtgtatcctaactgttcagtgtttgtctacagtagcatacagtaatgtcctaggcctgcacattcacacaccactgataaatgactcatcccaagcaacttcctgtcctgcaagctccattcatggtaagtgacctattcagatataccacttttatcttttacgctgtatttttactcaccttttctatgtttagatatgtttagattcacaaatacttaacattatgttacatctgccaacagtgttcagtaccgcaacatgctatacagatttgtagcctaagagtaatactctgtacgacagcctatgtgtctagtaggtataccatctaggcttgtgtaagtaaactctatatttgtacaatgataagatcaccgaaaaaatttctcaaaacacatccccatcattaagcaatgcataaacatagtttctcatcaccaaagatggtatgaatgtcaaataaacacatgaaaaaatgctcaatatcactgggcattagggaaatgcaaattaaaaccacaatgaggccaggcacaggggctcatatctataatcccagcactttgggaggctgaggtagatgaatcacttgagcccaggagttcaacaccacccagggcaacatagtgagacctcttctctactaaaaatcaaagcaaactaccaggtgtggtggtacatgcctgtggtcccagccaggaggctgaggcaggaggatcacttgagcccaggaggtcaatgttgcagtcagacaatatcgcaccactgcactccaccctgggtgacagagcaagaccctgcctcaaaaaaaaattcatacactgctagggaaagaaaatatagcagtcactttagcaaacagtttagcaattacttttaaaattaaataaacactcacaggattatatgtaccctggaaaaataaacacttgccacaaaacccagcaatctcatttctatgcattccaaccaagagaaataaaatcatatgttcacacaaaacctgtacataaatattcataccagctttatttatttatttttttgagacggagtttcactcttgatgcccaggctggagtgcaatggtgcaatcttggctcaccacaacctctgcctcccgggttcaagcgattctcctgcctcagcctcctgagtagctaggattacaggcatgcgccaccacgcctggctaattttgtatttttagtagagatggggtttctccatgttggtcaggctggtctcaaactcccaaccttaggtgatccgcctgcctcggccttccaaaatgctgggattacaggcgtgagacatcgcacccggcctccagctttatttttaatagccaaaacctgctaactcaatgtccaccactagatgaacaaactggtacatgcatacaatagactactactcaacaataagcagaaagaaactactaacatgcaatagtacagacgaccttttttttttttttttgagataagagtctcactatgtcacccaggctggagtgcagtggcgtgttcttggttcactgcaacctcctcctcctgggttcaagtgattctcctgtctcagcccccccgagtagctgggattacaggagcgcgccaccgtgcctggctaatttttgtacttttagtagacacagggtctcaccatgttggccaggctggtctcgaactcctgacctcaggtgatccacccacctcagcctcccaaagtgctgggattacaggcgtgagccactgggcccagccagagataaggtcttgctgtgttgcccagggccttgaactcctgggctccagcgatcctcccacctcagctccccaagtagctgggactatgggtgcacgccatcacacctagccattttgtgaactgctgaccaatgctcctctctgcagacagaaagttcggtgtggttaggagttaaatgggaagaaagaggaggctgggtgcagtggctcatgcctgtaatccctcccaacactttgggaggccaaggcaagagtttcacttgagcccaggagtttgacaccagcctgggcaacagagcaagatcctatctccgaaaaattaaaaataagaaaagtaattagccggacatggtggtacacacctgtagccccaggtactcagcaagctgaggtgggatgatgggatgattgcttgagcccaagaattcgaggttacacagttacagtaagctatgatcgtgccactacactccaccctgagcaacagaggaagattctgtctccaaaaaagaaaaaaaaaaaaaagatgacaacggaacgggaggtgggtgtagtcccagctactaaggaggcagaatcatctgggctcaggagttcaaggtcagcctcagcaacataaggagaccctgtctcttaggaacaaaaggggagggggagagagaaggggagggagggggggagagagaaggggagggagggagggagagaggaagggttgggagagacagagaaagaaaaagaaaggaaaaaataaaaaggagagaaaggaaggaaagaagggaagacaggaggaggcagcggggaggggaaaaaaggagaggagggatgaagagaaagaaaggaaacgacaaagaaaggccaggcatggtggctcatgcctataatcccagcactgggaggccgaggcaggtggatcacctgaggtcatgagttcgagaccagcctggccaacatggtgctaccccatctctactaaaatacaaaacctagccggctgtggtggcaggtgcctgtagtcccagctacttgggaggctgagacaggaatagcttgaacccaggaggtggaggttgcaaggagccaagattgccccactgcactctaggctcggcaacagagcgagactccatctcaaaaaaaaaaaaaaaaaaagaaatgtattagaaataaaagtacatcagattctaatgccagttatgcagccaatgatgagatactctggtaaataaccctcttggtctcaatttcttcacccgtaaatagaatgagtactaaaaaaccaccagagccagagaaatccaaactaccagggaaagggaggggcccactgagaaccaccccagcaacccgaccacagctggtcttccctggacaccatgaaccacaatgtccaaacctcttcactcctgccaacatcggccatccccctaactatgagatgctcaaggaggagcaagaggtggctgtgctgggggcaccccacaaccctgctcccccaatgtccaccgtgatccccatccacagcgagaactccgtgcccgaccatgtcgtctggtccctgttcaacacccacttcatgaactcctgctgcctgggcttcatagcattggcctactccgtgaagtctagggacaagaagatggttggcgacctgatcagggcccaggcctatgcctttaccgccaagtgcctgaacatctgggccctgattgtgcgcatcattacgaccattctgctcagcatcatcccagtgttgatctttcaagtctatcaacagatcaggaggcattatctaggccaggagctctgcccgtgatctgattcccatgtactccatccaccctccattcctcgccctgcccccagagccaagttctctatcagccgtttatcctcacacacttttctacaatggcattcaataaactgcacgtgtttctggtttaaaaaaaaaaaaaaaacaccagagccattccaactccaaatgcgtttgactctacattgttgaacatctactatgtgccaagaacagaacataagaagaatttaggctgggtgtgctgcctcatggccttaatttcaatactttgggaggccaaggcaagaggagtacttgagggcagaagttcaaaaccagcccgggtaacagtgagactgtctctacaaaaatttttttaaattgtagggcgcagacactttgggaggcgaaggcgggcagatcacttgagctcaggagtttgagaccaacctgggcaacatggtaagaccctgtcactactaaaaatacaaaaaattaaccaggcatgatggcacacacatgtggtcccaagctactcaggaggctgaggcagaactgcttgaactcgggaggtggaggttagagtgagcagaaattgcaccacgcactgcagcctgggtgacaaagcgagacggtgtctcaaaaaaaaaaaaagaactgcagggtgtgatgttgcatgtgcctgtggtcccagctactcaggaggctgaggtgggaggatcacttgaacccaggagttaaaggctgcaataagccatgatcacaatactgtactccaacctgggcaatacagcaagatcccatctcaaaaaataaatacataaaaacagaaaatattaagactttagtatctcagtttttttgtttgtttgtttgtttgtttgagacggagtctcgctctgtcgcccagcaggctggagtgcagtggcaccatctccgctcactgcaagctctgcctcccgggttcacgccattctcctgcctcagcctcccaagtagctgggattacaggcgcccgccaccacgcctggctaattttttgtatttttagtagagacagggtttccccatgttaggcaggacggtctcgatctcctgacctcgtgatccacccgcctcggccttccaaagtgctgggattacaggcacgagccaccgcgcccggccagtatctcagtttttttttttgtttgttttttttttttttttggagacagagtctcgttctgtcgcccaggctggagtgcagtggcacaatcttggctcactgcaacctccacctcctgggttcaagcgattcccctgcctcagcctctcgagtagctgggactacagatgcgcaccaccatgcccagctaattttttctattttagtagagatgaggtttcacaatgttgcccaggttggtctcgatctcctgacctcgtgatccacccgcctcagcctcccaaagtgctgggattataggcgtgagccaccgcgcccagccaaggaagatattctttctcttttaataggtaaataaactaagcctgagagtggctgagtaacttgcccattcaaacatgtgaccaagcagttaagtgccaaccattcaagaaatagggatacaatcaatagtgaacaaaacaaagttcctgctttcatagagcttaaattttagttactgaagagtgaaccatggccaggcacggtagatcatgcctgtaatcccagcacgttgggaggcccaggtgggcggaccacctgaggtcaggagttcaagaccagcctgaacaacatggcgaaaaccccgtctctactaaaaatataaaaattagctgggcatggtggtgggtgcctgtaatcccaactattcaggaggctgaggcaggagaatcacttgaacacaggaggtggaggttgcagtgagccaagatcgcaccattgcactccagcctgggcaacacagcaagactccgactcaaaaaaaaaaaaaaaaaaaaaaaacagtgaaccatgattccagcttagactggagttgccagataaaatacaagatgctcagttaaatttcaactttagataaataacttttttctatgcaatttaatacacaattatactaaaaaactggtcaatgttcatcaaaaattcaaatttaactgagtgtcctgtatttctatttgccaaatctgacaaccctagcttagatataacctcaaaactctttctcaatccttttactgcgtttctctggctctaaagcagtaacttttttgactatatcaataaaaaattacttaaaaaaaaatttttggctaggcacggtggctcatccctgtaatcccagcatttctggacaccaaggtgggtggatcatctgagctccagagttcaagactagcctgaacaacatggcaaaacctcatctcttcaaaaaatacaaaaattagccaggcatggtagcgtgctcctgtactcccagctactcaggaggctgaggtgggaggatcgcttgagcccaggaaacagaggttgcagtgagccgagactgcaccactacattctagccttggtgacagagaccctgtctcaaaaaaaaaaaaaaaaaaaaaaaaaaaaaaaaaattcattgaactgttgctgctcgtggcagagcaggactagtccataggcaatgtgcccagagttggccaaaaattacattttgaattacaatgcggtatatatacattaactcaaaccaaagcttaaaacaattcttggcagctgggtgcagtggctcacacctgtaatcccagcactttgggagtcgaggtgggcagattacgaggtcaagagatcaagactatcctggccaacatggtgaaaccccatctctactaaaaatacaaaaattaggccgggcacaggggttcatgcctgtatccccagcactttgggaggccgaggcaagtggatcacctgaggtcaggagttcaagaccagcctgaccaacatggagaaaccccatctctactaaaactaaatacaaaattagccaggcatggtggagcatgtctgtaatcccagctactcaggaggctgaggtaggagaatcacttgaacccgggaggcagatcgggccattgcactccagcctcggcaactaagagcgaaactccatctcaaaaacaattatttcaataatgcaatgcatcctaacacttcttattctttttcatttttctaaaaatgcttgtcataatccactaatgtgtttcacaatctactaaggggtcatgatctgcagattgaaaaatacttctttgggagatataaaaaatcatttaacctggtgttatgagtcaccattatgagcacattaactaactacactgtgctataaaacagtaatgcccttagggcctaagatatacagctataaacttacagtcaaaactcccaggccgggagtggtggctcacgcctgtaatcccggcactttgggaggcctaggcaggtggatcatctgaggtcaggagttcaagaccggcctggccaatatggcaaaaccccatctctactaaaaatacaaaaattatccgggtgtggtggcgggcacccgtaatcccagctactcaggagtcagaggcaggaaaatcgctagaagctgggaggcagaggttgcagtgggccaagattgtaccattgcactccagcctgggcaacagaacaagattctatgtcaaaaaaaaaaagccaggtgcggtggctcacgcctgtggtcccggcactttgggaggctgaagcaggcggatcacctgaggtcaggagttcgagaccagcctggccaaaatggggaaaccccgtctctactaaaaatacaaaaattaacccggtgtgtgaccaatatctgtactcccagctactcaggagtcaggcaggagaactgcttgaacctgggaggcggaactacagtgagcagagatggcgccattgcactccagcctgggtgacaagagcaaaactccatctcaaaaaaaaaaaaaaaaaaaaaaaaaaaaacctcccagaatggtatacttgttgagctcttgtgtctgttttttagtagttcccattttagtagttcccaggctctttgctttgtttttttgagataaggtctcattttaacgcccaggctggagtgcagtggtgcaatcatggctcacctcgacatccagacttaagtgaaccacctgcctcagcctcccaagtagctgagactacagaagtgcacgaccatgactggctaaattttttgtattaatattttttgttgagatggggtttccctgtgttgcccaggctggacttgaactcctgggctcaggtaatctgcctgcttcagcctcccaaagtgttgggattacaggtgtgagccaccatgcccagccaccagtcttccaaactttttttttttttttgagacagagtctcactctgctctgtggcccaggctggggcacagtggcacaatctgagctcactgcaaccttcacctcccgggttcaagcgattctcctgcctcagcctcccaagtagctgggattacaggcgcccgcccagccccaagtctggttttttttttttttttttttttttagacggagtctccctctgtcgtcagtgcagtggcccgatctcggctcactgcaacctctgcctcccgggttcaagcaattctcctgcctcagcctcccgagtagctgggactacaggcacacatcaccacgcccatttaatttttttgtatttttagtagagatggggtttcaccctgttggccagaatggtctcaatctcttgaccttgtaatccgccctcctcaacctcccaaagtgctgggattacaggggtgagccaccacgcccggccctttttctgtttttcagtagagacagggtttcaccatgttggccagactggtctcgaactcctgacctcaagtgatccaccctccttggcctcccaaagtgctgggattacaagcgtgagccaccgcacccagctaagtctttcaactttctatcacgctactgttatttctcattgctgttaatatatctgcctctgaaaacattgcttttctacttgctgccaatatgtacatcagaaaagaaagctagatagaatcatgtgtaaagtaaaagttctcaaagaggccataaagaactctccagaccagaggctaaagcaggaggacagtttaagcccagaagttggaggccagcctgggcaacataacaagacccccatttctaccaaaaaaaaaaaaaaaaaaaagaactcccctttctaaaatctgctcaagcttcagtgaaaagacatttagtcttcaattcctgatttcgaaatgtgtttcaggaatgaaaatagttaactgcacaaagtccacagcaaatgtttataaacccgaaaagaaaaatgcagtacttgtttcaaaacccgccctttataaaaaactaaaattataatcaagattaattccacttagaaaaattattaagaatattttaacatgactttaaaaagcaatatgaaaaacgtcaatgaaaaatatttgacctggccagccacggtgcctcacacatgtaattaaagcactttgggaaaactaggtgggtggatcatttgaatttaagagtttgagaccagcctgggcaacatggctaaaccctgtctctacaaaatatacaaaagccaggcatggtggcatacacctgtagttccagctactcgggagactgaggtaggaggactgcttgagcccaggatgttgaggctgcagtgagccatgaccataccactatactccaacctggccaacagggtaagactcagtctcaaaaaaaaggaaatttaaaaaaaaactgatcattggcaacactgttcaataaagcctctcaaggcaatggtttcaggagaccaacattctaaagttctgatacagttaataaaaataaaccacgttcacttatattgccgacaagcctcataccacaactaatgagttttacaaagacttcattatagaatgaaattttattacattcccaaaatgtagttagctattaatcatggcacgaaactgacattttcgggctggacacagtggctcacacctgtaacaccagcatgttaggaggcctaagtggggtggatcactcgaggccatgagttcaagatcaacatggcaaaactccacatctactgaaaatacaaaaaaactaggcaggcactgtggggcgcaccagtagttccaactacttgggaggctgaggtgggaggatggcttgaacccgggagacagaggttgcagtgagccgtatttgcaacactgcactccagccttagcaacagagccagatcctatcacaaaaataaataaataaataaataaataaataaataaaacaaattgacattgtaaagtcacttgacacaacttcagggttaaaattacaagcaatctatgtaagaatctttaaatgttaatgagaatttcaaattttcacatgaatgcaaacacaaataattaccagcaaataaaaagttaaggttgccaggcatgggaggccaaggcaggtggatcacttgaggccagaagttccagaccagcctggccaatatggtgaaaccccatctctactaaaatacaaaaattagccaggcgagatggtgcgtgcctgcagtcccagctactcaggaggctgaggcagaaaaatcgctttaacctgggaggcagaggttgcaatgagccgagatcgcaccactgcactccagcctaggtgacagagcgagactccgtctcggaaaaaaaagaaaaaaaaaaagttaaggttaacagctgtgacaagttttcataaacaacccagactcataaaaaaaataccaaaccaggccggacgcggtggctcatgcctataatcccagcactttgggaagccgaggcgggcagatcaagaggtcgggagattgagacaatcctggctaacacagtgaaaccccatctctacttaaaatgcataaaaaaaattagccgggcatggtggcgggcgcatgtagtcccagctactcgggaggctgaggcaggagaatggcatgaacctgggaggtggagcttgcagtgagctgagattgtgtcaccgcactctagcctgggcgacagagcgagatttctcaaaaaaaaaaaaaaaaaaaaaaaaaaaaaaaaactaaaccaaactggtcacggtggctcacacctgtaatcccagcactttgggaggacgaggcgggtggatcatctaaggtcaggagttcgagaccagcctggccaacatgatgaaaccccatctctactaaaaatacaaaaattagccaggcatggtggcacacagctgttatcccagctactcaggaggctgaggcaggacaatcacttgaacctaggaggcggaggttgcagtaagccgagatcacatcactgcattccagcctgggtgacagggtaagatcctgcaacacacacacacaaacaataataataatttaaaaaaccagccaggcatagtggctcacacctgtaatcccagcaccttgggaggccaaggagggcaaattgtttgaggtcaggaattcaaggccatcctgggcaacaggtaaaatctctgtccctacaaaataaaaacaaacaaaaaagctaggcgcagtggcttatgcctgtaattccagcacttcaggaggccaaggtatatggatcacctgaggtcgggagttcgagaccagcctggccaacatgataaaaccccatctctaccaataatacaaaaattagccaggtgtagtggcgcatgcctataatcccagctactcgggaggctgaggcatgagaatcatttgaacgcaagaggcagaggttgcactgagccgatatcctgccactgcaccccaccctaggcaacagagtgaaacaaaaattttgctgggcatagtggcgcatgcctgtggtcccagctactcaggaggctgagataggaggatcacttgggcctgagaactcgaggttgcaatgagccatgatggcaccactgcactcccgcctgggtgacagagctagaacctgtctcaaaaaaataaggcgaggcgcagtggctcatgctgtaatcccaaaactttgggaggccaagacaggcagatcacctaaggtcaggagttcaagacgagcctggccaacatggtgaaaccccatctctactaaaaaaaaatacaaaaatttgccaggtgtagtggtgcatgcctgtaatcccagctactcaggaggctgaggcaggagaatcactggaacctgggaagtggaggttacagtgagccgagattatgccactgctttccagactgggtgacagagtgagactctgtctcaaaataaataaataaccaaggatttaacatttatgtagatttcacaccacgtaagtacagaaccacatacattaaaaacaaagaaaagaaaatagacctcctattttagcaagccaaaatcaaggttacaaaaagatatcctgaagggcaagtactgtccgtgactgtattccataaaacaagcctgttagggggccggacgcagcagctcacgcctgtaattccagcactttgggaggctgttgggcggatcacaaggtcaggagatcgacaccatcctggccaacatg

SEQ ID NO: 2442 - DNA, 17543 bp, Homo sapiens
gaagtggaatagtcatcataagaggtacagtgggctgaacatcactgggggaccagaggccagggtcaggatgtaaccaggaaaggcttcctggaagaggtgagaaccgagtgtgatgtgtgcagacagaggtggggaaccacgtggggctggcctaagcagaacctcgggtgtagacgagtgtatgagcatcaacagggaccagtaaggaaaaataactgagcaccaaattctatggggtcacagagatagatgatactgggggtctgccctctaaagctgacaatctagctcggcagaaggttgagaggtgggggtaggaacacagaaataagtaatagctatcactgtgcacacccgcccccacgtgtcaggctttctacctacattgacacatttaagctcacaacatctctggaagatccagttattagccccatttatgaatgaagaaagaaaggctcagagtaaagcagattgctctaggtcttcctagcaggaagggctagggccaaggctcaaacctgggtggctcaaggtctaaatccagtgttctaacctgcacagctacgctattcagcctaccccagctggaccgccccctcccactgcaaggaaaccaaccctgacacccagccttctatgccttctatgcaaacctctaggtgcacttcagtcagaaatctttttttttttttttgagacggagtctggctctgtcgcccaggctggatcttggctcactgcaacctccacctcccaggttcaagtgattcttgtgcttcagcctcccaggtagctgggattataggtgcccgccaccacacctggctaatttttttttaagacggtgtttcactcttgtcgtccaggctggagtgcaatggcgtgatcttggctcactgcaacctctgcctcccaggtcaagagattctcctgcctcagcctcccaagcagttgggattacagatgtctgccaccacgtctggctaatttttttttttttttgtatttttagtagagacggggttttaccatgttggccaggctggtctagaactcctgacctcaggtgatccacccgcctcagcctcccaaagtgctgggattacaggtgtgagtcacagcgcctggcctttttttttttttttttttttttgacagagtctcctctgttgcccaggctggagtgcagtagtgcaatcatgtctcactgcaagctctgcctcctgggttcaagcgattctcatgcctcagcttcccaagtagctgggattacaggtgtgtgtcagcacacccagctaatttttgtatttttagtagagacggggttttgtcatgttggccaggctggtctgaaactcctgacctcaggtgatccgcctgccttggcctcccgaagtgctgggattacagtcatgagccactgcacccagcctctctggtggtatcttttggaaagatatctttctggaaaactctttccatcccagcccaaacttgtctctgactcactcatttatttgagggtaggtgacttagatgtcatatcctacaggagggcagactgactgcccctccaaagccaaatgccattttgatcctcttctattgaccctgtaccacctcgatcaagacaattctttgtttttttttcttttatggtcaaaaaatttaagactagttccaacttgaagtagttttgtttcaacagatcaagataattccttgttttttttttttttgagacagagtttcactcttgtcacccaggctggagtgcaatggcacgatctctgctcactgcaacctccacctcccaggttcaagcgattctcctgcctcagccttccaagtagctgggattacaggtgcccaccatcacgcccggctaatttttgtatttttagtagagacagggtttcaccatattggccaggctggtctcgaactcctgacctcaggtgatccacctgcctcggcctcccaaagtgctgggattacaggcatgagccatcgcacctggactagatcaagacaattctaacagttaacaattattgagcactcattttgtgccaggcactgtgctaagagtgcagtatctcagagtggttaaacatggaggctttggggccagacttctagatttaaattctggctctgggtcaggaacagtggccgacacctgtaattccagaactttgagaggctgaggtgggaggatcgcttaaactcaggagtttgagatcagcctgagcaacatagtaagaccccgtctctaaaaaaaaaaaaattagctggatgaggtggtgtgcacttgtagtcctaactactcaggatgcttgttaggtgcagtggctcatgcttgtaatcccagcactttgggaggccgaggcaggtgaatcacttgaggtcaggagtttgagaccagcctggccaacgtggtgaagccccatctctactaaaaaattcacaaattagccgcgtgtggtggcgcacgcctgtaatcccagctactcgggaggctgaggcaggagaattgcttgaacccaggaggtggaggttgcagtgagccaagattgtgccaccacactccagcttgggtgacagagcaagactccatctcaaaaaaaaaatttgttatacaaaggaatgaataaatgcatattacattattacattcctattgtagagaagaggaagcatagctggtggcaaaccagagatttgaacccaggagttcctgatccctgtcttgaacactttctttttcttttttttttagagatggtgtcttgctatgttgcccaagctggacttgaactcctgggcttaacggatcctctggcctcagcctctcaagtagctaggactacaagcaagcccggctagcttagaccctttgtatggccccagtgtggggcctcatataccctttggctgtgtttgaggacgtgtttgacagatttgatgatcttgattgcaccctgaagtataaaaacttaggctactcgagaaagatttcatgctaaatcaggtagtaaagctctagtaatatgatcctaaggttttgtcttcatgaaactgcatgaccttaaggcatcggtttcagctaacctgcccaaggccacacaggctgtaagggaacaagatgtgagcccagccttctcacactagagtccctgtttgttctcctacccggacttttttgttgctgttgttgttttgagaccagagtctcgctgtgtcgcccaggctggagtgcagtggcatgatctcagttcactgcaaactccacctcctaggttcaagagattctcttgcttcagcctcccatgtagctgggactacaggcttgcgccacgacgccgaataatttttgtatttttagtggagacggcgtttcaccatgttggccaggctggtctcgaactcctgacctcaagtgacccacctgtctccgcctcccaaagtgctgggattacaggcgtgagccacagtgccggccttttttttgttttgttttgagatgggagttcaactcttgttgcccagattggagtgcaatggtgcaatctcagctcactgcaacctctgcctcctgggttcaagcgattctcctgcctcagcctcccaagtagctgggattacaggcatgtaccaccatgcccggctcattttgtatttttagtagagatggggtttcactatgttggtcaggctggtctcgaactcctgaactcaggtgatccactcacctcggactcccaaagtgctaggattacaggcatgagccactacatgcagcccccaggagctcttgatctgaggcataaagatgcttagagggtttccaaatatattttatggtcacctattctcccaacaatgtgtgctatactgtgtgtttacacataggtgtgtctttagaggaaagggttcaaagctttcattagattctttttttttctaataaagaaaaaagctttgttgcccaggctggtctcaaactctcaagctcaagcaatctgtccgcctcggcctctcaaagtgttgggattacagccatgagccaccacgctggtcctcattacattctcaaaggggcctattgaaaaaaaaaaaaaaaaaaaaaaaaaaggccgggcacagtggctcacgcctgtaatcccagcactttgggaggccgaggaaggcggatcacaaggtcaggagatggagaccatcctggccaatatggtgaaaccctgtctctaccaaagtacaaaaaaaaaaattagccaggcatggtggtgcgtgcctgtaatcccagctattcaggaggctgaggcagtagaactgcttgaacctgggatgcagaggttgcagtgagccaagattgcaccgctgcactccagcctaagcaacaagagtcaaactccgtctcaaaaaaaaaaaaaaaaaaaaaaaaaaaaaagatgagactgttgagtcaggattaggatccaggtctgctggcaccaatttcagtgctctttatactttctgttgctattcattcattcatccattcattcagcaaatttatatcaagtatctggtatgtgccaggtatgattccaaattacaccattcccagattattctgagaatgctgcagtgccaaactcttggtatcacagactttatattctagtgggggagacagacaaaataataatataacgacgaaggtgcaatgttatgtgctatgagaaaacgcagtcggaggatggcgaggaaggggaacggaattttagatagggcggtctgggatcagaacctccagatgcccgtccatggactccaacgaagggagcgattccaggtaccagggcaccctgcacaaacctctcttgagcttccgcctcgcccaggtggggacggtagggagaccggagggcacacgcatgcgcacgaaggaaacggtaaagcctgaagggaggtgcagagcgcatgctctctcttgcccgagatgccgaggattttgacaaggactccgtcgtcccggatgatagtgctcaggttaatgccagtgggagggcggcgcccaatagtaacttcctttggaggttgtagtaccgcccccagagccaattttccacttccgcttccggcgctgcggcagtccagatcaaaaatggcggtagttggtgtgtcctcggtttctcggctgctgggtcggtcccgcccacagctggggcggcctatgtcgagtggcgcccatggcgaagagggctcaggtactggggccggggtcgacgggtcgagcctcagccccactcgggcgagacagggagggactgtgaccttggcccgaggccttgcgggagggaaagtgagacccgggcccgccccataccggcgctgaacgtttgtggcttctccgcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaaggtacgcccttgtacatctcttcaagcgtccgttctcttttcgttatgtgtgccttagtgcaagttcttcattctctgaaggcatgggtgccaggcgtgtacagcttgtttatcctcacaaacagaaaatgtattttcttccattttgtggatggacagctgacacttgggattacgtctcaattctcttcttcaaggtcatacaataagtgctcttcagtttcccttttctccgattcatcctacctcctgccttctgagacagttcttttttttttttttttttttttttttacttctgagacagttctgaaacaggtgtccgttgtgtaaagcctggaggtttgggaaatccaattagagtggcaaagtctgaaggtggttcgcgtaagcgaacccagcagctacatgggaggctgaagcaggagaatcccttgaacctaggaggcggagtttgcagggagctgagatcgtgccactgcactccggcctgggcaacagagcgagactctggtctcaaaacaaaacaaaacagcaacaacaaaacatgggcatctggcagctactagttgcataatgaagagactgacagctttctctattccccaccaataccttttctcgactgttttatcattggttgttgatgtagatatattacaatgttgtgtcctctgttgtttgctgtatctttaacaagggcttattctgattcttcaatactggccatgcgcggtggctcacgcctgtaatcccagcactttgggaggccaaggtgggtggatcgccggaggtcaggagttcaagaccagcctcgtcaacatggcgaaacactatctctactaaaagtacaaaaagtagccgggcgtggtggcgggcgcctgtaatcccagctactcgggaggctgcggtgggagaatctaggaggttgaacccaggaggaggaggttgcagtgagccaagatccagccattgcactgcagcctgggcaacaggagtgaaactccgtctcaaaaaaaaatagtaataatatacttgatcttagccaaaaggccgagaagtgatgaaaaaagttattattattattattattattacatcacctagcccatataggactggccttgtagaaacttaacctagactcttgaatttgttgagtctttgagcggcactcccatccttgtacaatgcaattagaagccaaacagtaaaggtttctcagcctcagcactgttgacatttggggctgggtaattcttgttggggggctatcttgtgcattgtgaaatgtttagccatatccttggcctgtacccactaggtggcagtagtacctgcgcaaccccactcccgcttccccctcccccgcccccatcacagtgtctcccgatactacccagtgtgccctgaaggggcaaaatcaccctgggttggagaccgttgccctaaagtaatgcttttcaaaggtaataggcaagataattcagggtgggctgcagtttcccagcccagatattgtttgaagtctgggatggtgccagaaatctgcatttaattaagcatctccctcccctaatactgccaccattttgatataggtgatttgaggattacactttcataaacacagcactggatatactagttactagggagaggatgatgagtaactaacttgagcttgcattttctgccatccatatttgtttctggaattaaaactgtcctgtagccaggataactttaagggctcccctggtagttataagagctccttaaataatgggaaggttgaactacaccagtagataaaggactaatttccattttgtttttatatatgatctgtcaccccgttataagcagttcatgacggtgttctttctaaattattttctggaattatctaactgacatcttcactccacagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaatttagattggtcatgagctgagagttactttctttggttgtgttttttcgcagaaattagcatttgagcttcaagtcagtgtccaagttgaaaagaaattggcattagttatttctgtttccacagtgaaggtctaggctgctgtttagtgttacaggtccaattcagcccattgaataagtgtttataacagcccctcttggtttattgtgcctgatgtggataaagggaccaagtggagtggtgctaattaagcatcaagattagtccttggtcaggtgcggtggctcatgcctgtaatcccagcactttgggaggctgaggctggcagatcacctgaggtcaggagttggagatcagccgggccaacatgatgaaatcctgtctctactaaaaatacaaaaattagttgggtgtggtggcgcactcctatagctgggtgtagaggcttgaacccgggaggtggaggttgcagtgagccaagatcgtgccactgcactccagcctgggcaacagagtgagactctgtctcaaaaaacaaaagattggtccttgacgggcctgagatatcaaagacattgaatggctagcagaatgcctgcaatttacacctgaaagaggtatctgtatttctcaagaggaagtgcttgatctgggtctcatctttttcctgtcccattccactagcatttactgcagaatcttccctgtagtcataattttcttgaacatgtcaagttcttttttttctttttttttgagacggagtctctctctgttgcccaggctagagtgcagtggcacgatctccactcactgcaagctctgcctcccaggttcaagccattctcctgcctcagcctcccgagtagctgggactataggcacccgccaccacacccagctaattttttgtattttcagtagacacagggtttcaccatgttagccaggatggtctcgatctcctgacctcgtgatccacccgcctcagcctcccaaagtgctgggattacaggcgtgagccaccgtgcctggcctcgaatgtgtcaagttcttactttgaggtaatctccttcagggctggtagggtcagaaatcttaagagaaacaaagggagcgtgacacatttctgcttattggcttttctgtggaattaaaactatcctgctttaatggatagtaaatggtagtagtagtagttacaaaaccactctgagagggcaattattattattattattattattatttttttttttttttttttttttttgagatggagtctcgctctgtcgcccaggctggagtgcagtggcgggacctcggctcactgcaagctccacctcccgggttcacgccattctcctgcctcagcctcccaagtagctgggactacaggcgcccgccactacgcccggctacttttttgtatttttagtagagacaaggtttcacatgttggccaggctggtcttgaactcctaacctcaggtgatctgcccacctcagcctcccaaagtgctaggattacaggtctgagccactgtgcctggccagagctggtttattttattttattttattttttgagacagagtttcgcttttgttgcccaggctggagtgcaatggcatgatcttggctcaccacaacctccacctcccaggttcaagcaattctcctgcctcaccctcctgagtagctgtgattacaggcatgtgccaccacacctggctaattttttgtattttaagtagagatggggtttctccatgttggtcaggctagtctcaaactcccaacctcaggtgatctgcccacctcagtctcccaaagtgctgggattactggcgtgagccaccgcgcccagccagctggtttattcttaaggctcaaaggaacactttcgtggtaaggttcaagaggcaacaaggtatttcatattatattacattaaactggtaacgcaaaagtaaggcatatacagtacggaatagagaatctcattgtctttgccattttgtaataattaacggaatagagaatctcattgtctttgccattttgtaatattacagcctgcacttctgagtccctatagagctgttttggttgtggccagtctgagtttaggacagatgcattatacttcagcttgctgcctggcctcccttggctgggttccaaacatcttttataatccttggataatggaccctagccagtcataaaatataaatgaagaatgttttgaaatgacattaaggacaagtcacattaaatatgatgtagcaattggtaaagtggagaaaagacaatagaattagggccttctataaatcaagtttcttggtttatttttcagacagggtcttgctgtgtcacccagcctggagtgcagtggtacaatcacagctcactgcagtctccacctctcaggctcaggtaattctcccacctcagcctttagagtagctgggactacaggcacacaccaccatacccagctaatttttttgtagagacagggtttcgctatgttgcccaggctggtctcaaattcctgagctcaagtgatccgcccatcccagcttcccaaagtgttaagactacaggcatgagccaccatacccggcctgtaattcaagtttcatactactttgggtatctaataaaaccaaattactcaattaattgtggggattacgtgacattctgaggtaagtaagtgctctcctgatccttttttggtaccgtagtgtatttgtatagcctattgtggaaattttagaaatcagtgaggttttggctgggtgcggtggctcatgcctgtaatcccagcacttcgggaggtcaagagttcaagaccagccaacatggtgaaaccccatctctactaaaaatacaaaaactagctgggcatggtgatgcatgcctgtaatcccagctacttgggagactgaggcaggagaatcattggaacccaggaggtggagtttgcagtaagacaagattgcgccactgcactccagcctgggtgacagaaccagactgtctcaaaaaaaaaaaatgtgaggtttctgattgccatactgtaccacctagcttaagacaagtcactttttcttcacctttaagttacaaaacacaaaactctccccactgtatatatgaggtttgtagggtaacagggtaatagttccataaaatgcactgagttccagaggcaaataatgatagaaactaaatgttacaatttattccatcttcaggattacagacattacagggcaggatgagtaaacaaggcaaatgaagcgagcaccttcagcttcccccctaccccgacatttaaccagatgcagcattttgacatttttaggatatgcaggttgacaattcactgacttgggttgagagctggcaatagcagatctttgcaatttaggttcttcctccacagctattccaagtatcttaattcctgaactgcacactgagagctctgaaatggtgttcactgcaacattcttgcagctttcacatcttaatctgacacctcttgtgaaggcagggaactgtgttaaaagctgtcttcctctttgctaatccaggccaccatcaatcttaaccattagttactatataaaaataaaagtgtgctcaaaagcactcactgaaactgttgtgcccagatcccttttcagagcattagttccctgagaggaaaaaaagaggtcctaaccaattgctttcataaatagtgaccccagtacagtgtatatgtcttttgcagcagaaatcaagaggtcaggcagctctgctcatcctgactagtttatcatcgtttgcatacaaggtatatttatgtaaagctgattccacgccaagtattgcaaccataatctcaaaaaaattgttcaattttagcacacagttcctgcaagataccacagcaggtgagaaatcatctcaaagagttcatcttttacaactgagaggaaaacatcgaaggaggaaataaaactcctctctcctaagttcctcatcaaatctgatggctatgttcacagagttagttgacaaaaatccagagtcctcaatttctggacttgcgaaatccttcaaggtgactgtcaaggtcaagaagaattttcaggcttttctttgccatggcccatgaactccagtccttcaataggaatctctttctcctttattgctttctggtaggaggagaaaacacattataaagacctacatgaagcttaagttgcaagctttgtaaataaaatatgacagtacaaaagtaaaatcaagctgattataaagacttataaccatgattcaaaccacatactttttaaaaaacaagtaccggtcaggtgtggtggctcacgcctataatcgcagcattttgggagaccaaggcaggtggatcacttgaggccagaagttagagaccaacctggccaacatggcgagaccctgtttatactaaaaatacaaaaattagctgggcatggtggcgcatgcctgtaagcccagctactcgggtggctgaggcatgagaatagcttgaacctgggaggcggaggttgcagtgagctgagattgtgccattgcactccaggctgggagacagagtgagactctgcctcaaaaataaataaaaaccagaagtaccataatgaataaatcaagtgtaagacctgagggagactggaaaaggagttgtgagggaaccgttaaaattaagtgaaatttgaaaaataatcatcactttgtgttagtgaaagacttaggttcaaatctgggttccaggacttactggctatgtgactaactgtaaatgggatgaagacagcaactacctcggggaattgctgtgaggatgtgttgggttaacttattggaagtgctttgcccggtgctgttcttaacaattcaaagcagttccacatccattgggccagaataaacatttcctggctgcagttgcggggactggtcaagagagagaaacaggctaacgaagggtttataacaacaaaaaaatgtgaccctccagtctgaattctgaagtataatcccgcccagaccccagcagtaatagtggaaaagtgcaccacctgcgaaagaaccaaggaaacctgatgctagtgaactcggattaatcacttcctatttctgggtgttagttttttatgtataaaatatgagtaactatgcccaccttgcgagtttagggtgaacaccaaatgaaccaaaggatgtgactgtgcttcttgaaaagcactgccccaatatttgtcattcggagagacacccaagtggcctcggtggtgatggtaggggagcgagctcctgccactggcctcactgcgacttttctccacccttccagtccagtcccaatccccgtaaaatacgatgagtgtggtgggacacagcgccgagaatgcagggcctgggaacagaggcgggagggctcacctgaacacactgctggtagcgcttgaagaggtcggtgcacgggtccccggagctgtcccccttgagaaatttctcggcgaaccagcgattgaagcactggtcgtactcgcgcttcatgtccgtgcatgcctcccccacactgttcatggcgacagtggtggcggcggcgacgacggcgcactctgatgtcatcactctcaggcgcgtcgctcggcgttacgcgcgggcgcactgcgggggccaaggaaggaagaaatgtggtcgcggttggtgtggctgggccttcgggcccctctgggcgggcgccagggcttcacctccaaggcggatcctcaggtaaaggccagggccatctaggcgggtggcggagcaagccgggaggcacttcggagcgccggtgacccacactccccgcctcatccctcctccagggcagtggccggatcacggctgcggtgatcgagcacctggagcgtctagcgcttgtggacttcggcagccgcgaggcagtggcgcgactggagaaagctatcgccttcgccgaccggctacgcgccgtggacacagacggggtggagcccatggaatcggtcctggaggacaggtaaactcgcggctgcagccccgaagccttgaccgtggcccgttcgcagccgtttaatgtgacgattagcgaacagttttccagggggttaaagagtgttagcaagattcaggaacttgcccacagtcacctcgcgagtcagtggcttcactcttccccttgttcattactgatgctctcgctagtgtaagtggaaacaaaacccgaactgctaatcactgcctttgtttttttttttgtttgtttgttttgtttttttttttttgagacggagtctcgctgtgttgcctaggctggagtgcagtggctcgatctcggctcactgcaacctccgcctcccgtgttcaagcaattctctgcctcagcctcccgagtagctgggattacaggcgactgccaccaggcccggcttattttttttgtatttttagtagagacgtggtttcaccatcttggccaggttggtcttgaactcctgaccgtgatccacccgcctcggcctcccaaagtgctgggattacaggtgtgagccaccgcgcctggcctaatcatcgcctttaaggccctactccatagagtccctacctactcactccaacgtactcttctcagtactctccttggctaccttgactgcttctccagcaagacaagttcttttcctctctagatctctgcactggcccttcgtttttttccttcctctcagtatttgcatggctgcctccctcttggcacaggtctcagcttatcttctcagaaagggctctcctaaccactccaaatcccttctccccttctagttagtaactcatcctattgggttttttccctaacattttaatggacttttgttcatttgttatatctcttttattaaaatgtgagctcattatgtagttactgttttattcctgccttgaatttttattttatttgtttttgagatggagtctcactctatcacccaggttagagtgcagtggcatgatctcagctcattgtaatgtccacctcccagactcaagagagcctcccatctcagcctcccaagtacaggaccacaggcgcgtgccacttggcctggctaattttttgtatttttgatagagacgggattttgccatgttccccaggcttgtctggactcctgagcaaaggtgatccacccatctcagcctcctaaagtactgggattacaggcatgagccacagcacctggccgtgtttgattctttcaaatgtcttctctactttgcaattttctttttcctttgggacggggtctcactatgttgcccaggctggtcgcaaacttctagactcaagagatcctcctgcctcagcctcccaaatagctgggactataggtgtgcaccaccacacctggctaatacttaaaatttttgtagaaacggggtcttgccatgttgccccatatggtctcaaactcctggtctcaagcaatcctcctgcctcagcctcccacttcctcaagaaagtttttttttttttttgaggtggagtcctgccccatcacccaggctggagtgcagtggcatgatcttggctcactgcaacctccaccctccaggttcaagtgatttttgtgcctcagcctccggagtagctgggattacaggcacccgccaccacactcagctagtttttgcatttttagtagagacagggtttcaccatgttgaccaggctggtctcgaacccctggcctcaagtgatccgcccatcttcgcctcccaaagtgctgggattacaggtatgagtcactgcactggccaaaaaagtccattcctttttttttttttttttttttgagacggagtttcactcttccacccaggctggagtacagtggtgcaatctcagctcactgcaacctccaccttccggtttcaagtgattctcttgcctcagcctcccgagtagctgggactacaggcgcccgccaccacgcccagctaatttttgtatttttaatagagacggggtttcaccatgttggccaggctggtctcgaactcatgacctcacagtccacccgcctcggcctcccaaagtgctgggattataggcgtgagccacaagtcttcattcttttatacttaggttctttttttttttttttaattgagacaagagtctcgctctgtcgctgaggctggagtgcagtggcgtgatcttggctcactgcaagttccgcctcctgggttcatgccattctcctgcctcagcctcccaagtagctgggtctacaagtgcccactaccacgcctggctaattttttgtatttttagtagagatgaggtttcaccgtagccaagatggtctcgatctcctgacctcgtgatctgcccacctcagcctcccaaaggtgctgattacaggcgtgagccactgtgcctggctatacttaggttctctacctgtggctctcgtgatatccaaaagggctgatttatacatgcgtttatacatctatttaagggatgtgttgagtctctgcccctctcctgctcacccaccttccacagcatgtctgtttttccttatcatgttctcagtggttggcactgagtattcagtaaatgtgttttgttttgttttgttttgtttttttgagatggagtctcactctgttgcccacgctggaggcagtggcgtgatctcggctcactgcaacctctgcctcctgggtttgagattctcttgcctcagcttcccgagcacccgggattacaggcatgcaccaccatgcctggttaatttttgtatttttagtagagaggggtttcaccatgttggcaaggctcgtcttgaactcctgacctcaggtgatctgcctgcctcagcctcccaaagtgctgggaatacagccttgagctgccgtgcccggccacagtaaatgtttaatgaatttttttttttttagagacagagttttgctcacgttgcccaggctggagtgcaatggcgcgatctcagctcaccacaacctctgcctcccaggttcaagcgattctcctgcctcagcctcccaagtagctgggattacaggtgcacgccaccacgcccagctaattttgtatttttagtagagacagggtttctccatgttggtcaggctggtctcaaactcccgacctcaggtgatctgcccaccttggcctcccaaagtgctgggattacaggcatgagccaccatgcccggtcccagtgttctttattaatatctctaggaaaggagggactagaagcacagagtcatcagaatttccccaagttatctagagggtaaatacaaagaaatataaccatcattaataagggaaaaggtcgtgaaaaaagatgaggaatttggatccagtagctagcatctcaacctcgtattcagtgatctgtactgtttttcataaatttggaaaccagtttgggttaataattcccattaatcattttaatgtgacatctgtaggactttaatgctttgaacacacagaatgtaaagtgaagacaagtattaaaccttttattttttatttttttgtagtttttataacttcatttgatgtatttgatgatcagcagttagttcccatccacactgactgtagatttgtgaaagtggtaacaagtatataaccaaagtatagagcttat

SEQ ID NO: 2443 - DNA, 36180 bp, Homo sapiens
gtcacattatctcaggtgtctcctgggtcctgcaggagcggtcctctttcttcagagggtctgtgggtcctctcgggtttcctgatttattcctgcagtcgttctgtagccaaaattcaccgtgtgaacctccacacgctgctctgttcatcccagtcagagctgccatgtagtcctgcctcccatccaccatgacagccaatctccctgctgcacaaatttgtgaaaaacgtatattcccatgtcatggtgaagagattctgattcattaacataaggatgagacccagaaatagatgtttttaggaaacatcatagataacctgataaataacatattttcagaaattttctatgggtttcaaaaagtgtaatagttgcactatggtggtaataactgatacattcaggtactactagtgaccatgtaaatcataaaactttggaaacaaatttgccattttctaaagagttattaaaatgttatataatttgattcaattatcttattttttattgttttttgtaaggcagtaatctagaaggttattttaatttatacattatttccaagattttgatattaaaagtgacatagaatctaaattattgtttatctgctcaatggatcattatataaccattaaattttataattatgaatactgtagtatcagggaaataaaaggtagataaaaagcataaatctcatttatttgtacagtacattttcaattgtctaaagattgtctaaaaataaagagtaaaggaatatgttcaaatttaaagtagttggttttggccaagtgtggcagctcactcctgtaatcccagcaaaatgagaagctgagatgggcagatcacatgagaccaagagttcgagaccagcctggccaacacggcgaaaccccgtctctactgaaaatacaaaaatttgctgggggtggttgtgcacatctaaaatttcagctacttgggaggctaaggcatgagaatcacttgaacatacttcttgaataaagaagtcacttcctggactctaagccaagagtctaagccaaatatcagaccagtttttccagggggccttattagcattcatttgttaaagtcaaccttagtttcttaaagctgaccatcatatctaattttgcacatcatactcactaatggtttccagattctggaggaatcaagtagagagaaaaagtaattatttcaattttatttataaaaatataatctaggccaggcatggtggcttatgcctgtaatctcagcatttttggagtccaacgcaagtggatagcttgagcctaagagttcaaggctgcagtgagctatgatcacaccgctgcactcttgccttattgatggagagagatgctgtctctttgtaaaaaacagaaaaacataacctaccacattgcggtaaactataaatatcctaagagaaaatgcttttcttaaatctggaagccaaagcacaaaagagccagcaaaattttgaagaaaaggttattaaataattataatcacccttttcagtttatttagtcaaatctaattaagtcttattctgctgtatcttggcttggcaattttatgagctcatcagttgctttattagagttgtggaaattcttacccagtccaatggtatgatcttaaagttatcagaaacctttattctgtagcacttttcagagccttttccattagacactttggcctatatcagattgtaaatgctttcagagaagaatcaaagtaaaacaataaattgagaatgacaaaaggcttaaaatcaccataaagatctgatgagagtttatttgctaaggaaatttatttattgctgtggctaatgatattttaacataataattggaattgtgactggtaacattatgccaaacctatcatgaataacatattgacaaatttctatcaactttatataactcctgaaacacttatattaataacatatatctatatacatataacctaaagaagatatagcatcagttcttatttgacagtacttcctctgtaatttaacaaatcaaactaattaacataacatctctcttttacaaggcaagagacaaatcctttgatattttccaggaaccctctgggaactctcaatgttaatttaaagtcaaagatacgttatgtagaatttgatttgggccgggcacagtgcctcatgcctgtaatctcaacactttggaaggccgaggcaggcgaatcacctgaggtcaggagtttgagaccagtctggccaacatgatgaaacctcgtttctatcaaaaatacaaaaattagctgggcatgttagtgcccgcctgtaatcccagctactcgggaggctgaggcaggagaattgcttgaacctgggaggcggagcttgcagtgagctgagattatgccattgtactccagcctgggcagtaagagcgaaactctgtctcaaaaaaaaaaaaaaaaaaaaggaaaaaaaagaatttgatttaatttgggaaagtttgtcaaaaatgtcagaaggttttaaacactagaatcacacatcattataaaacaatacttatatataagtattgtttattactttattacttataaacaaagtaataaaatattttataagcacatatagaagttacatagttgtaaataaaactgagtacttttaacattgaaaggattccgcttttttaagtaatcaaaataactgataaaggtaacatgaaattgttcaaaataactgataaaggtaacatgaaattgttctaacatacaaaaccttgattttctaggcagattacttaaaaactgggggaaaaccctttcacgatatcgttatcaagagcagacaggtaatccaagaaaagtatgtcattttaacagagaacacagaattctaatatggcatgtgttctattaatactaaggctttgtttgtttgttttttgtttttaagagacaaggtctcactctctgttgtccaggctggagtgcagtgtagctatcatagctcactgcagcctcaaactcctgggctcaagtgatcctcccacctcatccttttgagtagctaggactacaaggatatgccgccatgcacagctaatttgcctaatttttgtggagatggggtctcactgtgttgcccagcctggcttgaactcctggcttcaagtgatccccccacctctaatgctcaaattgctgggattacaggagtgagccaccatgcctggccactaaagcttattaaaaaacaacaacaacaaaatacttttgactaaatctgtccaatcttagccaactctaccacacaaaataagatcctgtttccaagattacttttccacaaacctgtagttttaaaaaatatattcagtttttgtcctgttcttttttctctttctctttggcacaaccagtcattcttactttaggacaaagtgacactctttttcccttaacaaacccacatccttcattcttttcctcatcaaaaaacacattctacttcccttgaatactttgcatatagggttttttcctgattagatttttttgtgtgtgtgacagggtctcactctgtcgcccaggcttgattgcagtggcacaatcgtagatcactgtaactttgcactgctgggcttaagcatacctccacaaccaactaattttttaattttttgtaaagagttctctgttgtaaagactcatctacttgtaaagacgagttataaaaagtttataaccttttatgaatataatttataaaagtttataactttataaatataaacttttataaattatatttataaaaggttataaccttttggttataaaaggttaaccttttggttataaccttttataaatattatttatgaaagtttataagttaacgtgctttcatctatttaattcacttttaataattatgcttggattgctcatgaaaatttcatgagacactgctcaaaggtagatattctcttaaattttgttgttgacaaatcagacaagtatctaaaatatcacagaagcaaaaatcctaataaacaaaaaccttgtttttgcctttttaaagtgtatacatcaattcatttttattgtacatttgattcttaggttgcatttatagttttattctcataaatatctggtagagatagcataagtttgtttgatgagtaaacctaagtggaaaacaattatatgtcgtattatgtttaatgctgacaactctgacaacattcctgtttttattttaccaacaatctttaaaccagttttatttaccaaagattatcccagatcacatgaacctaaaataattaggttagttttcatatttttgagagttttaggaatacctagtttatacaagcactgatttttctttacatcaattaaatggagcccttttgtataattttctatctggagatagaaaaatatcacaaatctatgtcatgcatacatacacacacacacacacacacacacacacacacacaaacagattcaaataaagatcttacaggtttcatttgaaaatttctgcaatgagtcaataaaacatagtaatgtgaactcaactggtttatataaaatcttgtcttttcgccagcttatacttttattcaatttgtgattctggcatatgggacaaatcgaggttagctactcaatatgaggaccagtgcttttcaccaatatttggggagggtttttttttaagattttaattgcccttctgataggtaattttttttatttttctttttccacaacaaattcagatcttccaatcataagtagtataatggcagctgtggacaaaacttcagacaagtgactaaggagacatctagcagctgttcagttttctccaaactctgtctgagaaaatacaatacccaatctatttccaattagcctttcttttttatttttcagcagaccccctgaagcccttgagaactgagattcctaaagttcaagttactgaggggctggagtgggaagggaaaatgtctaacaggggtagatagagggatgcaggaggtaggggcttggagagaggaatatcaaggattcaagggatgtgcctttccttcaggtataggtagggtacctcttacatgagagtcttaaaatctgcttcagaggaatgccattaagtccttcctacacgtgatttctcacatgccttcagcttagaatattcagtataccaactgaatattttgtgatagcatgtactgaactcttcattagttaaaagttgctaaagtttaaggaagagagcatttaattctcaccctatcatattaaaaattgtatttgaataccctgaacgtagagaaaaagctgggcccagaactaaaataatatcagggtacctgatattggaattttgaactgaattgtgtctcctccaaatttatatgttgatgcactgattgccagtgtgactgtgtctggtctttaggaggtaattaaggttacatgagatcataaaagtgtggctcttcttatagggccacagtcttaatgcaataggacggtggccttataacaagaatacagactcacctccttctcttcctcatgacaacactgcaagaagatggctgtctttgagccaggaagaaagccctcatcaaaacctggccatgctggcaccctgatattggacttttgttatgtaatccacccagtgtatgtattttattacagcagccctacctgattaacacatctgccaagctgaaatgttggacacctgtcaagtttaaggtgtatgtaattgctttcttcagtcttgatatagataggtctttatttagttctaatctttttttcccttcatatttgttgccctcactggaaaacagtatgttttatgtagcagtaagagccttgtaaataatgtttttcaagtgaggacaggacagatagtgtttttgtttgtttgtttgttttgtttgttttttgacagtgtcttgctctgttgcccagtctggagtgcagtggcacaatctcggctcactgaaacctccgcctcctgggttcaagcaattctcctgcctcagcctcctgagtagctgggattacaggtgcacgccaccacgcctggctaatttttgtatttttcatagagacagggttttaccatgttggtcaagctggtgacagatagttttagttgcccccttcctatgaaaatacagaatactgaatccagtttttgtgtattcaattaaaattccactaatgcttcagcttttttaacaagaaaatatttctgttttgaatgtttaacacagagtcacaagatagtcatgtatgcatgcctggtattgaaaaaatcagtaaaaaactgataacttactgactatccaaattgttactatactttgatgtttgtattgtaccatgatgataaatctggtccttagcatagtaattgttattttcataatctctaaatcagtttcttctgggttctgagatccaaaaagatgaaacaaagactaattgttgactgaaagaaatataagtaacagctactgctaacacattttaaaattagaatgcataaattaacaaatagtgccaaaaagtaaacacttttttgcaaggcaaatcatatgccttatctactcccgttcaaattaataaaaatacactatttataaacatgtactactgtactttccttttagctttatttcagaaaaatgtggaataatttacacttccacctctcaggatgctgtcagcagtagcataatagcaaaagtagaagcattttgaaatttaaaaaaggcagaaattaattaaatttaaaacaaattaaaattaaaatatggtggcattataaagatgtgttctgataaaagtctagtatattttactattttgagaagcaaatcaactcatttatgaatccttttaatatttttctgtatttaattgcatttgctagagcagtcttcttctagggatgtttaagatccctttactattaatagctggaaaatgaatagtcagagtactgattgatgatatgatgattttagactattattattttgcatttatatagcatattgcctcatatgtattcaaatatttcataaaagcagttatcagaataacaaagtctgtatttgcacacaagtattacaaacaatttaaagatacacagattgaccctccctcatctgaaaatctgaaatctgaaattctctaaaatctgaaatttttgagtgctgccatgatgccacaggtgaaaaattgcacacctgacctcatgcagtgaattgcaatcaaaactttatttcaagcacaaaattattttaaaatattgtataaaaatcatctttatgctacgaatataaggtatatatgaaacataaatgaattttgtgtttagactttagtcttatatgatttggctgtgtcccccctcaaatctcatcttgaattgtaactcccacaattcccacatgtcataggaggaacctggtgagacataattgaatcatggtggctggtctctcccatgctgttctagtgaaagtagataagtctcacaagatctgatggtttttaaaacgggaatttccctgcacaagctcactcttggcctgctgccatcttagtaagacgtgacttgctcctccatgccttctaccatgattgtgaggcctccccagccacgtggaactcttaagtccattaaatctctttcttttgtaaattgcccagtctcaggtatgtctttatcaacagcatgaaaatggactaatgcagtaaattggtaccagtagtgtggggtgctgctgaaaagatacccaaaaatgtggaagtgactttggaactgggtaacaggcagaggttggaacagtttggagggctcagaagaagacaggaaaatgtgggaaagtttggaagtccctagagactcgttgagtggctttcaccaaaatactgataatgatatggacaatgaaatccagactgagttggtctcagatggagatgaagtacttgttgggaactggagaaaaggtgacacttgttatgttttagcaaagagacttgcccctgccctagagatttgtggaactttgaacttgagaaagatgattagggtatctggcacaattgatttctaaacagtaaagcattcaagaggtgacttgggtgctgttaaaggcattcagttttaaaagggaaacagaacataaaagtttggaaaatttatagcctgacaatgcgatagaaaagaaaatcccattttctgaggagaaattcaagctggctgcagatacatgcataagtaataaggagccaaatgttaatccccaatacaatggggaaaatgtcaccagggcatgtaggaggtcttcgaggcagcccctttcatcacaggcccagaggcataggaggaaaaatggtttcacgggctaggcccatggtccctgtattgtgtgcagtctagggacttggtgccctgtgttccaaccactttagccatggctaacaggggccaaggtaaagcttgggatgtggcttcagagggtgcaagccccaagccttggcagcttctacatgatgttgagcctgcgagtgcacagaagtcaagaattggggtttgggaacctctgcctagatttcagaggatggatggaaatgcctggatgtccaagcagaagtttgctgcaggggtggggctctcatggagaatctctgctagggcagtgcagaagagaaatgaggggttggagcccccacacagagtccctactggggcacggcctagtggagctgtgagaagaggatcattgtcctccagacttcagaatagtagatccactgatagcttatactgtgcacctggaaaagcagtgcacactcaatgccagcccatggcagcagccaggagggaggctgtaccctgcaaagccacagggtcggagctacccaagaccataggaacccaccttttgcatcagcattacctgaatgtgagacctggagtcaaaggagatcatttgatttgacgtaagatttgactgccttgctggctttcagacttgcgtgggggctttagcccctttgttttggccaatttctcccatttgtaagggctgtatttacctgtaccctcattgtatctaggaagtaactaaattgcttttgattttactggctcataggtaaaagggacttgccttatctcagatgagactttgggctgtgaacttttgagttaatgctgaagtgagttaagactttgggtgactgttgggaaggcatgattagttttgaaatgtgaggacatgagatttaggaggggtcggggtggaatgatatggtttggctgtgtccccacccagatctcatcttgaattttaactccctcaattcccacatattgtgggaggaacctggtgggaggtaattgaataatggggttgagtctttccaatgctgttcttgtgatagtgaataagtctcagctgatctgatggttttaaaaacaggagtttccctgcacaggctctctcttggcctgctcccatccacatataaaacatggcttgctcctccttgccttccaccatgattgtgaggcctccccagccacatcaaactgtaagtccattaaacctctttattttgtaaattgccctgtctcgggtatgtctttatcagcagcgtgaaaatggactaatacatatccccaggatatctcattatatatgtatgcatatattccaaaatccaaaaaaagttgaaatttggaaaaacttctagtccaaagtatttcagataagggatgttcaccctctgtctgtccaaaaatcatgaacgaagatctagtttgtgtgtagaaagttgcagtttcaccctaaaaagcaaaacaagctggataagtcatataattcaaagattatataatcaaaattttggttatagcgatctacgagtagttgcctgaggtagagggaatttactagaaagggaaatttgagatctttcttggatgatggaaatagtctatatgttgcttgggtggcagtttcacaattacataaaattgtcaaaatccatcaaacataacatcagagatcattattttttgtatatatattaacttgatatgaaaatctgaatgtggtttaatatgattcaatttgcatttaatttaaaatagattaatttagcaacagtagcaacagtgaaggtggaatacgttgaaaataaaggttatgacttttgtgggcactgatagtcaatgggttgtcagaaagaagagtagtaattcccattttttgtgtggaaccatggatactggtagaaaattttttcagttacactagttctgatctgatctcccactatgattgtataaagcagtgaaaactcatttaatattcttccaggactttcatttatcaatgcctaccaggcagtgataatcaggatagccatatgctttgtctactcttggttaaattaatggaaacaacaacaactttatataatatggtaactatactgtattgtggtagtcaaagttagattcatttagcttgctgcaatgcatagggaggctgtgcaaggagctaaggtattttggtacaagaagttactaggaattcatcataggattcagggttgtgcttaaacgtggtttccgtggactcagtgtccttagagtctgctaggctccatgtgggttcttccttttgtgtcagcctccaggaaactcactcaagcctttgaaaatcaggctcacctatttgtttcctgtctctctggaatcactatctttactcttgagtttaatcgtttgaataccaagctgttgatatatatatcttctgacttttttaggtgttttagaaaatagggaaaatccagtatctttattccttcttggtcagaaataaaagttctcatattttttttactaaaatgttggggtagggtgatatgtggatagacaaaaaagttaatatgccagtgcttatttgtaaaacataaagcttaaatgaagaaaagtaatattaaaatagttatacatcgttttttaaacactatgttcaaggcatcttgatctgtggaattatgtattttagctaagttgtactaaatagtactgattcagatatacaaatcataatacttatcagctaattgaaagctccttgagaggaatatttaatggtttaattttgaacatactacatattttaagtatcaaatgttcagtaaatatatatgtggaatacatgttttctgtgtcagacactgatatggtttggctctgtgcccctacctaaatcttacctcaaattgtaatccccatgtgtcaagggaaggacctgtaatcttcatgtgtcaagggatggaggtgattggataatgtgggtggtttcccatgctgttctcgtgatagtgagttctcacgagatctgatggtttgataaggcagttttgcctgctcttgctggctctctcttgcctaccgccatgtaagacatgccagcttccccttctgccatgattttaagtttcttgaggcctccccagccacatggacatgtgagtcaattaaacctcttttctttataaattacccagtcttgggtagttctttatagcagtgtgagaacagactaatacagtaaactggtaaagtggtgagtgaggtactgctatagagatacccaaaaaggtggttgtgactttggaactgggtaacaggcagggattggaatagtttgtagggctcaaaagaagacaggaaaatgtgggaaagtttggaacttcccggagacttgctgaatggtttttactaaaatgctgacaatgaggtggccaatgaagtccaggctgaggtgatctcagatggagatgaggaacttcttggtaactggagcaaaggtcactcctgccttgctttagcaaagagactagtggcattttgcccctgccctagaaatctgtggaactttgaacttgagggagatgatctgaaattggaacttatgtttaaaagggaagcagagcataaaagtttggaaaatttgcagcctgacaatgtgatagaaaagaaaaatcaattttatggggagaaattgaagcccattgtagaaattttcataagtaatgaggagtggaatgtgaatagccaagacagtggggaaaaatgtcaccagggcatgtcagagatcttggtggccacccctcccatcacaggcccagtggcctaggaagaaaaaatggtttcgtgggctgggccctgagcccctctgctctgtgcagccttgggacatggtgccttgtgttccagctgcttcagctccagccatggctaaaaggggccaaggtacagtttggtccattgcttcagagggtgcaagccccaagccttagtggcttccatgtggtgttgggcctgagggtgcacagaagtcaagaattgagttttaggaacctccacctagatttcagaggatgtatggaaacacctggatgtccaggcagaagtcgggtttaggggcagagccctcacagagaacttgtacaagggcagtgcagaagggaaatgtggctttggagcccccacacagagtccccactggggcactgcctagtggagctatgtgagaagaggaccaccaccctccagaccccagaatggtagaacactgacaaccagtaccatgagcctagaaaagccacaggtactcaatgccagcccattcaccaaagctgcccaaggctgtgggagcccacccattgcatcagcgtaccctggatatgagacttggagtcagaggagataagctttcaaattgagtgactgccccaatggatttagaacttgcatggggcctgtagcccctttgttttggccagtttctcccatttagaatcggtgtagttaccaaatgcctgtgccaccattgtaacttaaaagtaactagcttgggtcctttttgagatgcagtgttgctctttcgcccaggctggagtgcaatggcacaatctcgactcactgcaacctccgcctccccggttcaagcgattcttctgcctcagcctcccatgtagctggtactacaggcacgcactaccacacctggctaatttttgtatttttagtagagacggggattcaccacattggccaggctgctcttgaactcctgacctcgtgatccacccccctcggcctcccaaattgctggggttacaggaatgagccaccgcatctggccttgttttttattttacctgcttataggcagaagggacttgcctgtctcagatgacactttggactgtagacttttgaattaatgctgaaatgagttaagactttgggggactgttgggaaggcatgattggttttgaaatgtgaaaagagatgagatttgggtgaggccaggggtggaatgatacagttcggctctgggtccccacccatatcacatcttgaattgtgatccccatgagtcaagggagggagctgtaatctccatgtgtccagggaaggagatgattggatcatgggggcagttttcctcatgctattcagtaataatcagtgagttctcatgagatctgatggtttaaggcagttttccctgcttgtgctaggtctctcttgcttgtcgccacataagacatgcctgcctccccctccaccatgattgtaagtttcctgaggcttccccaaccatgcggaaatgtgagttaattaaacctctttttttttttttgtaaattaccctgtctcaagtatatctttataacagtctgaaaacagactaatacagacacctagcatttcttattagaattcataatatttattccttccctgagcttaagagccattttcaggtaagatgagaactaacatctatttatataaatccaataaaatatatgaattttgattacaaatgctaattttcactcagttttaagcttctatttcttatgctagtttctcttcattatgttgctatagatctactgattatccactttatgtctttctaaatattcctttatttactgatatattaaaatttttgaacaattaactttatttatcaaagactaacataattcctgatctcttggtagttaagtggggaaggcacatatctatcaaataagcactctaatttgtatataattaaggctgaaataactataccagaattaaggataaagttttgtaaagactgaaataatctattaagtctcatgcacagaagagacatagttcaggaggtattttggatgaaaattgccaaagatattgtagctgaatcccaaacctgagaaatattcttggttttttagtatttttccttcatcaccaccgccattgccaccatccctcttcagtctagtccattaccaaatcccattagctccttctccaaaataacatcaaatccaactatattatctattctaccatcaccctggtttaagccaacatcatctctaacttgaacttgcagtatttctaaatatctgtttccattcctgtcatcctttaatccattctctatatagcagccagagaaaccttttattaaccgtaaatcagaccatgacatttttcttcttaaaaccttggtggctctctataacattcagaatgaagtccagtttattcaggataggctactagaccctggttcctgaccttctctccaatctcatctcatcaccattttattatttatttatttttctcctcactctcttcctacaagctatgctggctgccttttcattgcaagaataaaccaagctccatactattttggtgcctttcagtttttgctgtcctgtacctagaatgtttttctccagttttttacttatttggctcatcgatgttaaaatcagatcacctcttcagataggccttctccaataaccttgtctaaagtgacctcaagttattgtattaacttattttctccctcatttaattttatctccttaagttctgtgaaagctatgaattcattccatttatctttgttgtagctatctttgttggcacttaggtgctcagtaaaaatactttttatgtggatatttccccagtcttcttagtaaagtctgaactataatgaaggatcataatcatagcaaacatttatgtagtctccatataaattaataattgacagttgatgatttctgaaaaccataatccgtattcactcagtaagtgagtattttatattatagctgaaaatagcttacttttaaaggtataaagtaaaggataaggactcatacacacttataaagtctaaagttgttaattcagttcaacagataatttacatttaatactgaaattcactatttactatgttcagtgttgtgttaggcaagctgtctagcttaaaggacactaatgttcaacatgaattctaaatggagtaagtaattggagatctggtatagaaattgagtgaaatgcattattaaaatccatgaaaaccaacaagtcttagtagttattctttacaaaagccataattaagacccacacctcccaaactgtgcaccagggtaccccagactgccatagaaaactcttagggataccataggctttttttaaattttgagggaaaccagcaacatctgtcagatactatgtaaagtactatctcaaggtagttcgcagtttcagtgttagattgtacctttgatgatgtcacatctttatgaagctgggttttgcacagttaactgtgagaaaaagcaagtactacaggaaaattattgtggaagaggaaaggagggcaacagtatccaatatgattcaaaggtttaggatatgtacagggcccaatagttgtacccatcccattagtaagtaattgtagttactattaataattatttaaaattaatatgtttttactttcaatttgtatctattatttaacagctactaatttgttaggatataaaacttaagttgtttggaccttactacttaataaacagaactattagatacttcttttactgggtgccatgaaaacattattgagacacccagagcaccttgaactgagaaagtttgagaacttctgatatagccaaattttattttattttatttttatgattcaaatatcattttattgttaatagcatctttctggagatctggtcttcaacagactctctagaagaaatttatgtttatgataagtgggagactatactatagaagcatagagaaagagaaataatatttactgggtacctactatgttatagacattatttttatttcttgtttaatacttatagcaatcttaagatatataatgatgatcttcccattttatagacagggaaccaaaggtcaaaaaaattagatattttgctaggttacacagctaactggatggtgcctgaagaagctaaaggctttttatggcaatgactaatgtattattttcaacttaagaaagttagttggatggagtgacaaaggaacaaagatctactatattgtggattttattactgtaaataaacactgaaggttacttttttttttaaattcttagtccctattattcatgcaagtttttcatgtcatttgctggatcattaaatttgagtatatttggtagtcttatttccataatagagaatcagtgaagattgttttagtgtttcacatagttaaaattgtattttggtcacctacaacttgataatctatagaagttaagtactaccgagttagattttcattgaattttttattttaactgttttctttcttttttttttctttttttttttttgagatggagttttgctcttgttgcccgggctggagtgcagtggtgcaatctcggctcactgcagcttccgcctcctgggttcaagtgattctcctgcctcagcctcctgagtagctgggattacaggtgagcaccaccacacccagctaattttttgtatttttagtacagacggggtttcatcatgttgtacaggctgatgataacctgaactcctgacctcaggttatccacccgcctcggcctcctaaagtgcagggattacatacgtgagccactgtgcctggcctattttgactgttttcttgcctgtgtgccttgtaattataaagaaatttctggaacccatacaaagatattttctatttgcacttcattttctgttagcctcttctgaaacttctgcagtgttttgaattatctcaaccattctccacatctcttaacctctgtttcttattttctttctttttatctctctttgctgaattctatatcacttcttgagacctgtcttccagtttatgaattttcctttcatctgtatctgatctcctacagtcttctgagtttgtttctccagtcctaaaattattatatgtttcattcatgggaaccctggttggttattttcaaatctgcctagtaagttttcttacattttgtacttttctaggcatattaaacatattaatgttttctaataattctaatatttacagtatttttaggtctggttctgtagttcgtcgtttctacatatactttttgtggtagtatcccctttcccttccccttcctcttcctgttctcccttcctctttctttttccccttccctttcccctctttcgggcttttgagtgaatggagttcattccttcatggagaaatttgattctcccatgcacatgggatactgtcaatgtgaaaccactttcaattttggggtggtgtggattcaggccataaccctgcacaaatgtggatttgtggttattaattctcagggaagcccctttttctttttttttcttttcatattctacccaatccaaggtagacaggcatgtatctctttcaactccctttttggagttttggttgtttttcttagtttatccttttgggtgttactgactgcatctgaattttatgtgatatgacttcacatccatattgaactctgaaagcctggcttttaagcactgggctctttaataccaaggctgtaggccacacatcagcagataccaccagagtccagcaaatactggccccagaactctttccttttctggatttatgattcttttttgcttacagcctttatgaattcttttagtttccaaccagccaaccgtgtgcttaaataagtctttaaaaatgtgtattatattcacactttttagatgtggtatgctagaagtgaccttaactgaatatgttggtctgctatagtacaaaaaaaagcaattcattaaatattttgaatgacagcacaggattctgtgctgactcaagttagagcaagttacacactttagaactcttctctgaatttgctgtcactttacccaaaagtagaattagaactctttggctgccctcaccatagccaagtgactcctaatcctccagggaacatgtaaaatggtaaaatttgcctgaaaaatacagctgactttcataagactacagcaaattttgaaaggtacattggagcagtagtagtgataggaaaccaattgttaggctttctatattcattcttgaacggttaccccaaaagagtatcctaaaattcaagttaaaaattaaaacactgttaatttaaaactgtcttttctgtttcagtttaaaatgttaaatcaaaacagactttcttcttaccctaaaatagttacataagaacagtctgttgtcacagaagtcattctattataaagttactttattataaagggtatagtctctatttaaaatgttaagctacaaatatttatccttttgagccatctgtactgctaaatacccataagtattttagactaagatctgaaaaatggaaatactttaaaacctttgcattgttgattcttgattttttttatggcgtgtgtcttgctttgagcagaaatagattgatgcagacagcttacttgtaaaacattatgttactgtcatttaaaaaaatagttttaaaccctctgatggaaaggggcatctttagatgaagtaatttcattaaaatatccaattcagaatctaagtaaataaacttaaatatataaaaattcttcacttaatgtatttattcccataataaatatgttaatttcataaatttagagctctgttaggtgaatttattttattattttaaatcattaccttagctaacccagaaagtttctattgagaatgtttgttccccactttctcctcatgaaatcattttaatactgtataataccaggaaattgattaatgtcattaatcaactattattatggatatatattttattggatgcttatttcatatttcctttttgggtggcgttctattgaaacatgtgagaaaatattagtaacttgtctactctgcttacccccatcttatataaaccccatttccagaggactggaaactggaaagaagaatacctcagggctgaacatgacaggggcttaagaaaagtatctgagaaattataaccaaaaactgagcctagaatgaatttgcaattcaaattcatattgtctgcactgtataaaaaaatttacattttttcttacagcttttttttttttttttgagacagagtctcgctctgtcacccaggctggagtgcagtggcacaatctcggcgtactgcaagctctgcctcccaggttcatgccattctcctgcctcagcctcccgagtagctaggacaacaggcacccgccaccacgcccggctaattttttgtatttttagtaaagatggggtttcactgtgttagccagaatggtctcgatctcctgacctcgtgatctgcccgcctcagcctcccaaagtgctgggattacaggcgtgagccaccacccccggcccctgcttttttttttttttttttaaacaaaaccatcaatggaaggaaaaacactttaagtgtatgaatttagtttaaagtagtctatgatggatagtgcgttcggacaactgaccaaaacaaatgcagattctctggtgaattcactttgtcctaaaattcaaagaaataccatacattatttaccactgaacacgaaaagctacaaggaaatgaagtactatgaataagaatcatcagaaacactaagcagctgaatcaaccctacatagacattaaatattggaatgattggatatagagtaaaaaacaactatgcttacttaatatgttaaacaaaataaaactaaaaagcaaaagcctaaaaaaaatcaatagggaacagcaaactgtaaaaatgtcctagcaaatttggaaaataatcaattagaaattctagaattggaaacaaataatctaaatttaaaatcacatggagtataacagcagaacagatacaattgaagagagaaatagcaaagtgaataataggctaaaagaaattattgagaatttatcacaaagagcaaaaattcaaaaacaagaaagaggttcaaaactacactgtttcatgcacactggtgtatttatgatatatctcacaaaaatgtctaaaatataatcaaatatatggtcaaatatgctcattcatctttagagctttctataagaagaaaacaaaaggaaaaacattatgtgcaacagtaggggaaggatcagagagttaatagttcatccattacaaattatgttactataaatacttaacgtcatgagggaaatatttaccttaagagtattacatttatacattgatctcaaattcaaagaatagtaagatatgttatttatttaacgatacatataaaaagaaagaatatcttatttaatagtagagcttacttctgaatactagggatacaggtactttaaaattttctttgtaggctctttgtatttcccagttgttttaaactgaacatttagtacttaaaaaaaaaaaaagccagaaagctgctaataagtattaaaaagtggtacttagtgatgtattctagaacttttctgtgctatatctgtgcttttcctgtggtaagtgcttatcatatttttaaaatgactgatatttggctcttatagattcttaatgtatatttaaatgaagtggatgaataataaaagttagtggaaaatttataaagagtaaggccttgaatatttgcaacacactgaactgttgattactggggatttaagctgagagtcttcatttaggtgcaatttagtaagtgtcttagttccttttgtgctgttataacagaataccagagattaggtaatttataaagaaaaaatttatttcttacagttctggaaagccgggaagtccagtatcaaggtgctagcatctggtgagggccttcttgtggcatctcatggcagaaggaagaagggcaagagagcatgtgtgtgagagaggaagaaattaaacttgcagcttcaagcccttttataattgacattaatccattcatgagggtggagtcctcatgtcctaaacacatcccatcaggtcccagctcccaacattagggattcagtttccaacacatgctttttggggaacacattcaaactatagcagtaagcaactttgaagacgttcttgatttgcttattcaatatgtgtaagatctagcaatatttatgagataaatataatatgcaaataattttgttttaatttattcatatgataaatatttattgaatgtcttttgtgtgctacacgttgcactagattttggagatgacttgtgaaaccatatacagtctttgatgagatttagagcatagtagaggatatatatgtatgtatgttacatgcatatatgatttattcaggagtataaggcaattcaatattaggaagtccattaatataaaaggttgggggaaatgtggagagtaataccagagacaaacaactataaaagacatgtaagttgttgtctttgggcagaatcactatgaaatgatggttggataggtggcagctgttgttacatcatatatattttatcactgtcttatgttttcaagtttgtacatatgttactttactaaaaataaaagttaattttctagctgacatcaaattatttcttcctctcaagtcctttgtagctactgtcaccagcagaatatcccatagcctccttctaatatctcctcaccctggcagcctctgatacagggataaagtcctttgagttggctttggctcagttaccttcagtattgtccaattgattcatgataaaaacccgttgtctttatcatgctaaatgaccaaagtgtaaacttccaccttactgtcctttctccttgccttgctatcttcattggttccagtgagtctttcttttttagtcctcttgagcaaaaacaagcttttccacaattccaagggatacatgtcaaacgctcagaatgctttattgaacgctcttccttgacaccatctccctaaaaatgtcaaaacactctaacaacacttttccaaaaggaactcttttgccttgttagatttcaacattcttatatcccccagggtggtgtcacaagtgtcaaaaacagttttgagtctcattgtttacagttccttcatagacaatataataaatacctcactttggccttaacattctgatacatgttaattgttacactattttatccattataaagcataccacaaaattagaaactaaagagaattagattttttatgtatatatatatgatatcttcttttaatggataattatgcacattcctagtatgtgtgcagtttgatttggagaccattatattgaagattccgtcctgtttgggcaggattgcatatgcccctgagcctatatagctcttgttatagaaatttattgtgttgatttttttcactgttcaatatcccacccccatagtagaattgatttttagaagaaacggtgacagtttttagcagccatgatggtggcctagggttgaagaaatatgtgatgtattgttagagtccaagccatgctgttctattaaaatactatttttcttcctgctctttttgaagttgattttatttctgcttattttctaagcctgaatttctggccttcatttgtttttgttcttcttgtttttgtttttgttttgttttgtttttgagacggagtctcgctctgtcacccaggctggagtgcagtggcgcgatctctgcttactgcaagcccggccttctgggttcacgccattctcctgcctcagcctcccgagtagttgggaccacaggcgcacaccgccatgcttggctaatttttttttgtatttttagtagagacggggtttcaccatgttagccaggatgcatttctttttttttaatacttaagtttctttttcttgtttaagaaagttggagttaggactgttgttcattcacaacaaattgacaccactgccttaatatcataaagactctgtattgtttcagttgtttgctcattgggaaaatactccagggtgaggcctcccttacatctgagggacctgattccctgtgtagagagttctttttttttttaattgttccagtttatacttctggtagacttttaatcttcccccccactttaaagtcccagtatgccccactataaattgaaacattgtgttctagtctttatctacaaacttagagaaaattaattacttttcaaggtaacatattcaattttattttcttttttcttagatcactccagtatatccagcaaactcccttaaactaagcccaaactggtgttgttgcctgttgcaatttccttcactagagcatccagaaaagcttacttgcctttgcatataaaatctcttactttgggaggccgaggcgggcggatcacgaggtgaggagatcgagaccatcctggctaacacggtgaagccccttctctagtaaaaaaaaatacaaaaaaaattagccaggcgtggtggctggtgcctgcagtcccagctacttgggaggctgaggcgggagaatggcgtggaaacgggaggcggtgcttgcagtgagcggagatcgcgccactgcactccagcctggacgacagagcgagactccatctcaaaaaacaacaacaacaacaaaaaaactctttaattgctttaaaacagctaaccaagtcttatttcctttatcttcttgtatttttcttatattaccttggcaaaatgaaaaatttggggatttagtgtttgccaagtcaccatatggataaatcaccactagtgaagaataaactatatccatattatgttactttaaatgaaacgattacatttcatcattaccctcagaattaaacctgttatttacactactacttctcatcctttcttctaataggctccaagctttctcctttttcatctttcatctatcccaataaaaacataacttccaattttaattagaatagctatatataataggttgaccaactgtgtatcttctgtagccttctgcctataacctgattataaaattgctttaactaaagtaagttactgcctattctgagttactctattacacaaaatttaattttattacgctactttcttttccatattattttcctcctagcctcttccaattctttgtcttcttgatctcccttattaatccttttctcagggaaggaagatctgatcagccaattcactccaagatttaagtgactagtggttggaaatctgttcctcttcagcattacctgtaatttaaacaaggaattaagttgtattggctttggtgaggcacaacgtgtgtttgtatatgagaatgagttctttatagcacccattcagtcacacaaggctacctacttgtaagtctaatgtttagagtaaacagtgaattatctaatacattttgcatttcttacaccttgaaagaatgttgataaatttccttatacaagtagtctgatctgatgttagacaaatagtgaatactcagttttattgattaattgagtgcattttcagaatactgaaagattaggaattgtggttgactgagcattttgttaagatgttattagagacaaatacaaaaaaattctggctctctggattggactctgtgtagattgattccatctgtaaaaggtgcctcatctttgacagtagatattttagtcactgttacttgttagagattcaatatagcaatgcaatttttttttatttacttataaggatttatgataccaagttgtatttgacatttggattaaatcctgaggggtaaggaagattcgtccctgtggtagaagtttctaaagtcttaagtcaaatgaattctacttacactttagttagaaggccatttaagacaaacgtgccttaaaagatcaagtttttcagtgttaaaattctacatctcaatataggttatgaatactacattaagttcatttggttatgaattcattattttcaccttttgctgctattgttatacttcaactctcttatttttacaactttttattttgaaaactttcaaactttaaaaaaatgttgggacaacagtataatgaacagctgcactctgcacacctagattctcatgattgagaatacatgctgtatctatttatatctctgtcttgccttctctctatatataacttaaaaactgtttcagacatagtgacactttacccctgaatacttcagcatgtttccctaaaattaaggacattgttcaccgtactcttatcatatgctggaaatgttaacattgagacaataatatcataaaatataacatacaaacctatttttagatttctccaattatctcaaaatattatttatagattttttgattcagtattctgtgagggattataaatgataatttgatagtgatatgtcttcaccattttgttatatattgtcagaaatttgatgtagaataattcatatgttagcaactgtggaaagtgttgccaattatgaaaaaaatgtaaatttagataatttagaaatagtccactaagacttttattatatagttgattatattaattaaagtaacttgaattccttgacagtttacttatgtataatgagtgttcatgatgccctaattgaatttttatttttttaaaatttaatttttaaaaataataataatacagtaaaaaaccctttgtgatctttcttaatagtcacatcatcactctaccctgcctatcacagatctgttttacatcactatagtttgtgtttttaagaatgtcaaataaatagaatcagaaagtatgaccagcttctctcagagtagagtctctgagatatatccaagttgtgtatgtcaataatttattcatttttatggtagatagtattccattgtacatatataccatagtttgtttatctactaacccattgaaagacatttgggttgcttccagcttttggctgtcacaaataaatctactgttaatatttgtatataagttttggtatgaacataagttttcatttctctataaatacccagatgtacaattgctggctcatatgataaatgtatacttaacattataaaaacccgccaaactgttttccaacatctgcatcatttcagtattaggctcaatcaattgtcttatcccatgtgaatttgtatcctgtattactttataagactctgagtcttatttagatcctgtggaaaatattgatatttttgttttggccttctgtggattgtgtggttctaaccttggctctattttacaagactttggtgtgcaatttggatctgtcatgaatgtgtaccctctagtggtcactctgggaccagcttgtagatctgttcttagctaaggcctttaaatatttgatatgctaattagtatcaaatccataaatgggcagatccagggtgagtaaaagttcaaaacaactttatgtagttgctttcctggtctcccttccctaagtactttctacttcccttggggctgttttttttgttattgttgttcttcaaaaaagaaattgtttctttctgcagttttacgacatcctcacaccatttagcactggtgataagatgccaccaaggctacatggtgggaagacagggacatagggaaaaaattctacagggtttggtgctgcccttttggcattgctgcttctctgaaaggtaggtcgacctccctcagagttttgactcctgcagtctctcatttctgtcttcttttattttagctgccatgggactgttcagggtttggggcatagaaaaatgaggaagaggagagggggaaacaaaataacctggagatttctcctactctttctctgtctgcactgtaagtgttcagaaaatttctcctggacctcactcacaccacatagtgctcagttctgggtttctggcttcagaggtagtggaggaaaataaatgttaaactcaacattggtattcttccctcatctgtctactagtgttaacttttcagagttttcagataagtctctagccaggttttttagttgaattagcatgagataaagagagtctggtcttatttcatcttactggaatcaggacccctaattgatttttaaatggtattgttgatacaattgtcaggccatttatttcagtatttcactaagtaacttctaaactgtgaaaaaagtaattataaaataaacatcaggtatttttgttcttatttgtatctttgacatgagataaagtttgtggaagatttaacaagaacatcataagaagttgactataaattagatgttaattcattaatttattcactccacagaaattaaacgagtactgactcttggcctgggattgcagatattataatgaacaagataggcagagctccttctcaggacgggttaatagatttgagacagtcatttatagtacattgtaaaaaaaaaaaacaaaactgccccagagttaatgttaaaaattgttttattattttttctttaagataaaacttttaaggggtcaggactctggtaatgttgaatgtacattaatgcatttatgtatggacatagctgaggattttgttaaaatgtgccttaaatgattacataaattaaataagcaatttgttcagcaggttaaaaggaagatatttcatatttttgtaaatgaacacatgaaattttttcctttaagattttaaatgccaaattatttacttaggtagtgaactatagtgttaacattaaataaaaagagatctacatatctactcctatttctgtattaataaactgtgatgatgtatcaataagtaggatcatgtgccattaggacttgaaataatggaatatggtacgtcctaaagcttattttgtcattcatctagccaataatattaattacttaatatcactgctcaagctatcatctttgagaaatactgatttaacaatagtttacactaaatatgtaaaaaataattttaaagtcaagcaaaccataggttaattaccccattacttgagaatgcaaaaaaaatacttttactatagtacttattaataaactcatttttaaatttaaattgcaaaagttatcacaggctttctatggtatatggaattataataacatacttttaattgatgtttgttggaattcacagcatttatagactttttaaatagactttattttttggcagttttaggttcatagcaaaattgagcagacagctcagagattttcccatataccccctgcacccttacatgcatagcctcccccattatcaacattctttaccagagtggtatatttgttgccattgaagctacattgacgtatcattattacccgatccatactttatagtaggattcactgttggtgttgtatattccatgggtgtggacaaatgtattatggcaccattatacaggttgaatatcccttatccaaaatgtttgagaccaaattgtttctgattttggattttggaatatgtgtatatatgtagtgagagatattagagatgggacccaaatctaaacattaaatttatttatgtttcatctacacatggcctcaaggtaattttatccaatattttaaataattttaggcatgaagcaaagtttgcctaaaacgaactataagaaagcaaagatgtcaagtgtggaattttccacttgtagtgtcatgttggtgcttaaagtttttcaggttttggagcatttcagatttcagattttcagcttcagaatactcaaactgtagtataatctagagtagttccactgccctaaaaatcctctgtattctacctattcatccctttctcctcacaagccaccagcaaccatggatatttttaatgtctctatagttttgctttttccaaaatgtcatatagttggattcttatagtgtgtgtccttttcagataggcttcttttagttagtaatatgtgtttaagtttcctccatgtcttttcatggtttgatagcttatttctttttaccattgagcaaaaagaaatgagttgtttatcatccactcacctactgaaggacatcttcgttgtttacaagttttggccattatgaataaagtctgtataaatatccacatacaggcttttgtgtggacatagttttcaattcctttgagtaaataccatggattatgattgctgcatcatgtggtacagtgtgtttagttttgtaagaaaccaccagactgtcttccaaagtagctataccattttgcattctcaccagcaataaatgagacttcttgttgtttcacattcttgccagcctttggtattatcagtgttctgaatattgaacattctaataggcttatagtcatatctccttgttttattaatttgcattttactgatgatatatgatgtggagtatcttttcacattattatttgtcatctgtgtatcttctttggtgatgtgtttgttaaggtccttggctcatttttcaatagagttgttcattttcttattgttgagttttaaaatctctttgtatattttgtataacaattcattatcagatttgccatttgaaaatattttcttccagtctgtggcttgtcttttcgttcccttcacagtgccttttacaaagcagggttttttttttaatttttaatttttgtgagcatatagtaggtctgtgtatttgtaggattcatgagatatttagatataggcatacaatgcgtaattgtcacatcagggtaaatggagtatccatcacctcatgcatttatcctttctttgtgttacaaacaatccatttatactcttttagttatttttatatgtacaataaattactgttgactatagtcacccagttttgctgtcaacagagttgttaattttaatgaaatctaacctactgtttctttcttccaaggatgttgcctttgctgtcatatctaaaaagttattaccaacccaaggtcatctaaatattcttctattctaggagttttatatttttatgttttacatttaggtctgattcattttgaattaatttttgtgaaggctgtcaggtctgtgtttagattcattttttttgcacatcatgtcttttaagattctgagttctttcggaagacattccttggctgggattccaattttggctctgcaaggacatatcactactctcatactaaaaatcagacttataattgtagtctctgttttccaagtcaggaaataaggaaaggaccaggacaccagtagtagccatggtcttaaggctccaaaaagatgtagagaggaaaatacataaatacattaacttagtggaggtgagggaggaggatgaccttggtgccccctcacttttttaagcacaggtaaagttgattcataataatgtcaacatgtacttctttaattttttggtagcaggaaaaaggtaaattaaagcttaccaatgttttgtaaaattctaagtatcactggccctcttgtattttatcaatgctgaaaatgtgatgcttgaatccaaaaacaaatgaaatcaaggtttgattaaaccggttctaagacttcattactttgctacttctgacttactgccacatattactattactcctaattgtactaggttgctttggtttggattccagcaaacgaggtaagttggcacaagtgacctaaaaataaagtttttgtactgctgggatatcatttggctggttttctaattttgttgggcttggatcagaattaattatgtgttattttcatatcaatgtcaagtctgtatttatagcattctttttttttagaagtcacagaatttttaaaagtagcagaaaaacaataaatgatattgaaaaaattttagtacttacattttcgtcatgatcttctaaagcctcctaaaagaaacattgctcttgtgaatggtgctgcagtgaacctacacattcacgtgtctttataatagaatgatttatattactttggatatatacccaataatgggattgctgggttgaatggtatttctgtctccacgtctttgtggaatcaccacactgtctttcagaatggttgaaccaattatattcccactaacagtctataagcattctgttttctctgcaacctcaccagcatctgttatttttggactttttaatagccattctgatggctatgagatgatatttcattgtggtttttatttgcatttctccaatgatcagtgatgttgagcttttgtttatatgcttgttggctgcatgtatgtcttcttttgagaagtgtctgttcatgtcgtttgcccacttattaatggggttgtttggatttttcttttaaatttgtttaagttccttatagatgctggatactagacttttgtcagatgcatagtttgcaaaaattttctcccgttctgtaggttgtctgtttattctgttgatagtttcttttgctgtgcagaaactctccatttgtagagccctgcaggatagatttagcataattcttgaagaccctagtattttcagaatggtcaatgagcattggcttcaacttaaagtcactagctgcactagtccctaccaagagagtcaacctgtcctgtgaagctttgaagccaggcattgacttttcctctctctatgtgaaagtcctagatggtatcttcttccagtatttaaggttgtcttatctacattgaaattctgttatatagaatagccaccttcatcaatgatcttagctagatcttctggataacttactgcagcttctacactagcacttgctgctttacctcgtatgtttttgttacagatatagcttcttaaacctcatgaagcaacttctgctagcttccaacttttcttctgcagtttcctcacctctctcagccttcatagaatcgaagagaattagggccttgttctgaattaggctttggcttaaggaaatgttgtggcttctatcaagaccactcagactttctccatattagcaataaggctttctctctcttgtcatttgtgtattcactggagtagcacttttaatttttttcaaaaactttccctttgtatgcactacttggctttttgccataagagaaggttatctcagcttttgacatgctttcttctctagcttattcatttctagcttttgatttaaagtgagagatatgtgactcttcctttcacttgaatagaaaccactgtagggttattaattggcctaacgatgttgtttctcaaggaataaggagacccaagaagagggagagagacaggaaaatggccagctggtcgagcagtcagaacacacacatttactgattaagtcccctgtcttatatgggctcaattgatgttgactccaaacaattacaagagtaatatcaaaggttaattattacagtttacaatagcagacatgatattaatgaaaaagttttaaatactacgagaattactaaaacgtgacacagacgtgaagtgagcacatgcacttggaaaaatggccccagcagacttccttgacatgggttgccagaaaccttcaggttgtgaaaagcacaataaagcgaagcacaataaaaaaatgtgtttcttaaacaacaagactataatggacaagaaagagctgagactagagacaggagaccaacatgttaatcttaagtcaggaatcctaaagtgaagcaataggagtggttaaaaaaaaaaaaaaaagagaagagagattgatttaataaataattgtaatatagaattagtagcattgaatcctgatacacccacagaaaatatatacaaacgtgtttaaataatgaaaatttatggtagattctgttattggccctgattttcaaccatgtccgtcaaagccctttgccatataattttttaggaacccactgttgggggtggagtggacttccttgccttatgaatttgtatttgaccacttaacttgttgttaccaatggatagagcccctgggtatatacttactctcttgtacatccaccatgcaataagaatatgtgtgacagtattttggtgtcaggagaaggatgagagatacatgggggagagctactcccaggcctggaccagataattcttcagttagccatgtactcatgaatgaacccagctgagcccagcctggagcagccattttttaagcagtgcacagatttaggataaataataagttatgattgttttaagcccctgagttttagggtggcagtcatagctaactgatataaagtttctattctgccaaaaaaaaaaaattttaaagaaagttatattctattctattttcacacatcaattgatgtgaaaacaaaatataatctactgatccaacaggaaaactgcttgcattattggttttatttattagactgccttaatgcagcaatcacgcagctagaaagggaaaaataaaacgaatataatttataaaaatagctttattgagatataccttatatatcataaaatttacttattttaagtgcacaattcagtgatttttagtatacttatttttgccactgtcaccacaatgtaatttcaaacatttccatcatcccaaaagaaatctctgtgcccattaccagtcactttttttctctcccacctccagcttaagactatgtaaccacaaatctacttcctatcactatagatttgcctattctagacttttcatagcaatagaattatacaacatatagggatttttgtgtttagcttttttcactgagcattttttaaggtgcttctatattgaagcatgttttagtagttcttttttatttctggatagtaatccattatctgagtttatcacattttgtttatttattcatcagttaatggatatttgagttttccactttttgtctattatcaataatggtatgaacattcatttacaagtgtttgtacaaacattatgtttttatttctcttagataagtacttagttgtagtagaatttctgggtcatatggtgactctgtcttcagcattctgagaaacttaaagttttccaaagtgactgtgccattttacactcccaccagaaatttatgagggaaaactgatagtaatttaattatactgaatattcaatttatactactagtgactttcatatcataatacagaatgataactatatataaaagataataatcagataatctgaaaataataaaactgtgaaatgtacttctctctatagtgagtcatatgtgtaagttatgcagcaggtgaagaaatgtgtaagataggccttttaaaacacaatcttaaatcttattaaggttttctagagtaatataaataatgcgataatagaaataagatctacttattttctactattctgtaaaattattaaataattaaattttctttctatagtaatcttgttacaccaagctcactttgtactattgtgcctatacagaaattacactaatttttcctccattaaaacattaaaatagccttttgacttttatagacttcagagaagttgtcattatatctcaagtgctatgaatgtgaactgtgggaatgtgaactttactaagaatcaattatatagcctaagttggtgttttatatttgtttttcctgcactgttatggaaacctgtaaaatatgttaacattgaactatttggtcttatttagacagtattttatcttacaatgctgtatgatgaaatcctgcactcaaataaaacattaatcagcagaacttaaataaaaatatatgactgttaattttgtagtcttcctacttgcttagaaattaaatttctaataaatctttgtctctgattttgtgcaaaacaatgctattggctggtgacttcactgtctaagaatatggatttataaaggtatagagagtatcggttatatagaggtatcaggtaaagttcatgcaagccaaatatttttaagcattcaatggtgttttcttgtaggaattaaatgtatttattagcttgactttactgactatgtttgcttaatattaatctattagagcataactgcataacatgggttttaaatgaagcttgctgttactctaaatttatgtcacaaatgtggctctgggaaatttttcaagtttgtctcagtgctttaagccttataaaaatgagcaagtaactcataaataatagacagttcctcagaagtcatttaaagtgcactccttttattggcaaaatttccatatgttctttggctctttgagatgtagactctgtagagctatttaactaccattattttctggtgatttttttcaggtacctttctttatgatttatggttctgtaaaatcttacctcagtgtgtagctagaattatttagtcacatattttta

SEQ ID NO: 2444 - DNA, 14061 bp, Homo sapiens
gtgctaagtgcattacctacattattgtttcttaatcctcatggacatggctaataaatgacagggctctaattcaaaaccaggtctttctgacatcaatgcctgtccttgtaaactacactgtatatgaatttggctcagacacatatctcacattttgccctagtgaaacaaagtgtattttctccttttgaccttgggtgaagagagttgaatacaagtctttccatttgtaacacactgtcatcagtagcacaaggcctccctggttttatttatttttcccttcatccctaattatatcttcaatggcctttccctagagatacccattacaatagcttttatatatatctttaaaaatgcatatacccttgtaagatatgtaacatgcttttcttgttatttatttaaaatttattttactggcagcatgctgtatatcttaatgcatttttttaccttttccattcaacactgtttataagatctttcatgttgctatgttttcatttagttggttttctgtaactgctgcatagcatttctctgtatgcatccaccacatctttgcatctgttcctctagtgctaaaactctgcttcaattccacaattaccaatagtgtggtgtgtggccctgagcaaaaattgcttggggatatattcccaaaagtggtgttcctgagttatagggcaaataatgcttaatcacaccaaatactttcagattgctttccagaagggctgtaccagttcagattaccaccagccatgcacaagaaaaatttctaaactgtctctattcttgacaatacttggcattatcacctttgtactcattgccatttgacacgtataaaattgtatttcataagtaaagttcttctgcaagtttggaaaaagttgatttggacttgaacatgccactaaggctgcttaaaatgtcttagatgggatgctgattgagtgaatgcagaggcagaggaggagcaggctctcatttgagccctccttgcaattggtttatgtgtctcttatgacaactaacattgttttgcaatatgcagtgattatttgtgtacttgtctgcagcgagcaccttttggattgtaaattgcatctttcttccttacctgtgtatgccctcaatgctttgcttgttgcaagactccagtaagtgttttctgaaataaattgtctgatctctcgaaggtcctgcctgacaataaggggccattggctatgaaagggtggtaggatctaggagtggaaagtcacagatgattattttctattctaatagggtgatcggtttatttttttcttttcttgactgttttcctccctactttaaccagaggtgcttgcattaggatagatgaactatatgaaactgctctggtaaaaccaaacttttgaacatactggatttttccccctaaattgacaactaaaaatcatgccatgctattgactcattgtcctcttcagtaatcttctggttgggattgggaagggaaatttccagaactacaaacacttctcttagggactcaggtcccaaccttgctgggcagagtgcatgatgtgtttcataatgcatgagtgtttatttaacaaacagcaacactttttaattaaactgttgttgaagatacagactgtataacctttctccaaggcctggatgctcactggcccttccaagatgctgacccctcgctagctgcaggcctctggggcagtacatgctgtgagagttattacaagccagctggattagagggccacctctcttgaatcattcagaagctgaagtgcaggctctgggatggagagtttctcaatatgccaaagctattggaatgcaggcaggtctggagacacttagctggaacctgggggaaaagagtgttcaagataacttcatagaggaaattccctaccgcttttggctttaaaggataatcattggttcttgctggtcttgtactactatttcctgagctactctgaaatagaattgcttttaggtttcaggtcttcatttatagagctatatccctaaaagattagatacgtctcagggatgtttttcaggatgctttttcgcatcatggtgattgtattagtcaggttagacttgattatgctgcagtaatacattacttcccaaattttagtgacttagaacagcatagctttacttcttattcatattacatgtttaacactgggtaacagtggggctatgcttatcttggacgttcagggacctatacgctcagaagcttggctgctttttgatgtgaccatctcgacatgagtctttagggttttctacagcagagaaagaacaagaaataaattgtctcttaaatgttcttaccattttcattggccaaagcaggtcacatgatcatgcttacctataactttgtagagaactgtaatttttctgtcttctcagagagaaaagaggactggaaatgacagagaatatgaataacatataccacagtttcattgggcatgagaaaatggtgatactttgatagatctcagaaaattacatacactcagcaccatatacatgcccttgaagagaagagaccatagactcttaaaaatgtaagtatctcagaggagattttggccagtgaatccaaattatacagcttggaagtctacaggtttatgccataggggacacagaggggaaaatgaggaactaagatgggaatcttgcccacacatctccttcaaacagggcagtataggaaagcatatacttccaaaatgatatgattttcagtcctactctacctcgaacactcttcctggaacatactccaatttgtcatcggctcctcttaaattcagcactcagtcatgaaaatgttctttcatacctggtctcatcagtgtagaggccagaagacctgttggttttccttgctttggatttgttattttggcaattaacgtttctgacaatcatactatacctttgactcattataagcctcatgtgggtttctctactccaaggaggcataggagtttaaaataggaaaacagtagtacgttgtgatggattgtatttttcaaagaaagtcacaataatatttcccatcccatgcactcttctgcaatgtatccttgacattctgtcatcaagattaagaggtagactctctctctaccctcttgaatgtggataggccctatgatggcttcgatcaataaaatatggtggtttaacgctgaggcaggtggggcacgatgtctcacgcctgtaatcccagcactttgggaggccgaggtgggtggatcatgaggtcaggagattgagaacatcctggccaacatgatgaaacccagtctttactaaaaatacaaaaattagtcaggtgtggtggcacacccctgtagtcccggctactcaggaggctgaggcagaggaatcgcttgaacccagaaggcggaggtttcagtgacccaagatcgcgccactgcactccagcctggtgacagagtgagacttatatctcaaaaaaaaaaaaaaaaaaaaaaaaagtgctgaggcagtgaggcagctctggaaatagcccttaactggcttggcagcttctgttttctgactcttagaagccagttgccatgtaagtaatgtgactaccaaaaaatgaccacactgtgagaagcccaagtgtggtggagaggccttggggaaagagataacccatgaggcaagaaagaggcccaggaggtcccaggcatgggaatgaagaaaccagcttgcacatcctgcccaggctacaatggactgtaaccacatgagaggttccaagattaaaccactcaattgaccccagccaactcatagcaccatgagaaataacattgttttaagccactatattttggaatagttttcttaaaaatataaagtgatagataaccataatagaaatttgtgctagaggaaaatccttaagactcttgaaagccattttgtctaacaaagagtgtaaataagatatggccttaacgatcctaagtaatttttctagttaagaaataactgtaatcagttgagtgtttttccactttatgtgacttcagttgaggctgcaatcatttggtgtctggatgagatgggacatccaaggtacctcattcacataaatagctggcagttgatgagataactcagccagagagaacctatgcatgatctctccatgtgaccaaggcttctcacaggatggcaactgggttccaagaagggctatctgaagaaaaactattcttagaaaaccaggcagaaaaaataaaatttcttatgacctagcttcaggagtcattcattgtcacttttgctatattttgttgatcaaaagcaaggcaaagggctctccaatattcatcgattaggggactacacaaagggaaatattaggagtcatggtttattggggggctatctttggagacaagctaccttgatggatagagaaatgataacggaaataggtttgatgaaaaacgtggttaatctgaattgcagtaggtctgatggttggttggcaagttgtccttattctggtgtatgggtgaagggaataagcagtgagttagctcttacctagatccatcccctagaaagtaactgtgtccagttatcaatgggcagggcttgctgggcgttaagcacaggtaacctctagtcttttactatgtttctgcgacagtggcataaaacagctttttaatgagacctactgagatgcactgacagatctcttcctttccttttgtgtctagcccatccaccttcatgtaaatgatttatcaagaaataagacctaggattttgagatgggtacataagagcaaaagagaactaggatgagatcattctcttttgcctgcccttcagcattctcaatgcaagcaggttggggttctaaaggaagagcagggatgactggaaccctatagcagtgagtctgaggaatgggatcatgggggacccagaaggaggaagcagaactggaagatgtttccattctgtgaaagtggcttttggctttgaggcagcaacagtaatatttcatgtcttccgtggtgtctcctacctttaaatgtcagtctctgcagctgccttatctcctgtagcacatttcaattaggtattccaaattatactcttttcttccaggacaaatatgccagaggtgatatttactgttacagcagcatttaaaatacttagggggaaaaaatcctagtgaatagcaatttctcccttataataataataaagcacaataataatggagagaggaggtgaattctggctttgatgccaataactggctgacttaaagtgaacatcttttgtctccgccctcttttgtccccctcctcctattcccgcctcagtgtgaaggttatagtgtttggctctgtcaagagcaacctcacacatcttcttcactggaggctcacaaatgctcctcagaatgtctatttaactatctctaggtaggactgggctctgactgggctcctacttcacccattacctgtttcttcctttgtcctgagaatgtttgcatgaagccagaatctctgtttgtttagaaatttaccaggcaccactgcttactcctcacctatgggacattgtaggtcctgatggaacaccccggcctcctctctaggaggtatatgggttagaaacttatgtattgtacctttccttcttggaatcaagtccttggcctggtaatgaaggtccttcgatctggtctgcattttccagctccatctcctactaatctttatatccttatctactgtttccctaggctgttgtcttcacggccgccatggtaggttttgcctatcatcccaaaccttgtgcaggcctaccacagtacttgacatatggtgggggtctcagtcagtattctcccctatatttagaacccttccactagatcttgtcttcatatttttgattcctgctcagggatcagattatgttccatgtcctccactgagccttttctgacctcctcagcgcactcagtgccgttccctctctgaatttctaaagtgctcagcagcagcagcactcatttggcacttggtatatactatcttatgctattttgtatgaccatatgttgtctatacaactacattataagcacctgatagggataactgtgccctgtgtgtttttcctatccctttgattctaagatagttccttgaacattgaagatgctcagttaatattcatttattaagtagatagatcaaggagtaaatgaaagcaaggatcctaagaagcctgccttttggtgccaatctattcaatttggaattcacaaacttacctaaaacaaggcctttcaatttcctgtttcccctgtaaacagagctctaccaccaggatttctcagaagctctttctccacactgaaccctaaaactgaaggttcaggtagagagcttttccagtgtgagagaatttttaaagcatctggggtttggcacatccagtgctttgaaaatcaaggtgtcttgatcattgggtgaaggggattagaacagcaggctgtgttttcaagttcaagtccataagcagacaggaatagaatcccacaagagtttgttctgtctctgccatttactagttaatctctctatgcctcaatttccccatttgtaaaatggatttaataatggctgtctaccttataaggttgctatgaggtgccagtgtgataataaacgtaaaagtactttgaatattgcaaaacactgtatgaatgtcaggaattaggcaggcaacaactatttcttgggggtttgttctgcatgtagccctgcactatgtgtagatagaggcctctgtacattacagaagactggcagaggcattggggattcatcatggctggaattctggttctcagatagatgaaagctggaaaaagtattatagcctagcaatcacatctgaaaggttggcagcaacaattgagtcagagaagacgggaggtgaagtattggcaaaaatttgaccctggtcattctttgaacacttcagatttccacagattctatccctttaacatttctgaacgttatgattttgcttcctccccacactggcagctctgcctcaatgaaaccgtgttgcttttttggttgatcaattgtgcccaacttcctgatcatacttgtcctgagagcctgtgttaagctcatgccggctctcccaccccgcccccaacgccggccaaaaaaaagactctctaaaaacaggtgcccccgatgatctcacactgctgctggcattggcagcagcccagaagggccaaatggtgacttcaggtccagggaggctactgtcctcagctctgttttcatgtaaatgtcgctcctgctgaaaggaagtggatgcaaaaaaatatctgctatggaagcagaactaccccagactaaaatgttggtttttttttttttctctcccccttttcttttccttcaagttttccatgtggcatcagcagctgagtaagggaaagctaagaggtttaagtgtgctggggctgggtgggctagattaataacccaaagccttccaagctggcggtgctgggtgagacaggccaaccagaaagcgttaggttatggggagccctggccacagagccagaccctaccagggtggaaggtgaaggagcagcgagctctgcgtgcttgccccgagcccccaccttccttccttcctcctccctctggtttctttcctcccattttatcgagtccctctgagatggctgcgcaccagtggctccagcctctgaccgttgctgccctctgctgggaagaaagctttactcggtgtggaaagtgctaagctctaccagggaccagcttaatgcagaccaagtccacagtctgtggctagtgtgtgatttggcccagaggaaggaaggacaattcagaaaacccttgcaccacagtgtttccctagtggtttcaggtgggggcaggactttggaatctattagggaaggattgcttgaatcctcagagttctctgttcaagaggaacatccctgggagaggagcctcctggctcctctttacctgggtcagacatgatgtatggagactccaccatggatgacccttaaatatgatggatggctttagttacaggacacaattctttctcaagggaaggtgaccaaaagaagttgggtcttgaaggggctgcaggatgggcctggaagtctcttggctctaaaggaaccatcatagaatggggattctgagcaaccaggaagcagcagaaaaatatgcaaagccagatgggagtggggaatattgcccattaatgggcaagagtacatagaaaggtagataataaactggcttcaccacttctcaactttccccagagctggctgtgccagtaaactgtgctcagctggctttggatgagagaaggacaagagggtgcctatctccagcatggctgtggggtcgccctgctccatctctggatcttcagcctagagtgcagcccagccaaacaagagcgatgacctcactgaccacatgtaattctgcttgagggatttattttcttccatgagctcctgccaagactcttggttaaagctaatggggctcccccagccagtgagtgtctcctagttatatgtgtaaacaacgccaggcaggaaataggtttcctgttcttaatgggcttgttaaacctcttatcgagtggggtttaaatggctttattatgaataataataatagtaaataaacattattattattagtagtagaaaaattatgatgtcagccctgactaccccttctcattttaatcttgccaacgtggaggtctttggcctctaagtgcacaggaatatggtgagtgacactgggacttataactggagaagatggcagaattcatcttcgttgcctgcagctttccaatcctgagcccttttccactttcatcgtgtttccatctccatcattcctttcattcagggttttcatgatcttattctatcagagaagatagaactacacatccctctccttctcagttttatttagcattgaaagccatggacagaggttctgaggttaaattgaggtatcgggtagaggggattttggagagagcagtggatgctggtaggggagctcagttggaagtggggctcatgttctgatcttcagtgccgaatgtctgtgtccctccctcagatttacatgttgaaacgtaatcaccaatgtgatggtattaggaggggggccttttgggaggttagtaagtcatgagtgctttgggattagtgctcttataaaataggcccaagggagcttgttcaccccttccaccatggaaagacagaagaagaactagaagccaccatctatgaaccaggaggtagccctcacctgatgccaaatcttccagcaccttaatcttggacttccaagcccccagaattgtcagatacaaatttttgttgtttataagctacccagtttatggcattttgttgtagccacctgaacagattgagatatccagtttatagctggaactggaggtataccaggtatcccagactttggtaatttatgtatcaggttcactattttcaccataactccctacaacagtattgattttctttacaccgattatcttgtttgacttaagtagatttggcatcatcttacaagcaatatgtctttgaaatcctgggttcaatgtgttagccaggttttttactgactgcatattgaaatgaatatctaagagctaaatattttttcctaaagttcatcatgtggcaaatgtgtcacaccctccagggaaaacataccacaacatctggagacactgctatagggtagtggttcttaaactttagtgggcatgagaaacactggcagagcttctaccagaaacactggtagatagctgtgctcttccccagagaatctgattcagcaggtctgtggtgggaaatatgactttgcaggttttttttttttttttttttttttgagacagggtctcattctgtcacccaggctggagtgcagtggcgcggtcttggctcactgccagctctgcctcccaggttcacaccattcttctgcctcagcctcctgagtagctgggactacaggcgccagccaccacgcctggctaattttttgtatttttagtagagatggggtttcaccgtgttagccaggatggtctcgatctcctgatctcaggtgatcttcccgcctcggcctcccaaagtgctgggattgcaggcatgagccactgtgcccggccttttctttattttttgagacagagtctcattctgtcacccaggctggagtgcagcagcgtggtctcggctcactgcaagctccgcctcccgggttcacgccattctcctgcctcagccttctgagtagctgggactacaggtgcccactaccacgcccagctaattttttgtatttttagtagagacggggtttcaccatgttagcaagggtggtctcaatctcctgacctcgtgatccacccatctcggcctcccaaagtgctgggattacaggggtgagccaccgcgtccggccgccttttatttttttttgagatggagtctccctctgtcacccaggctggagtgcagtggcacaatctcagctcactgcaacctccaccttctgggttcaagcaattctgcttcagccttcaagtagctgagactacaggcacccgcccccacacccagctaatttttgtatttttagtagagatggggtttgaccatgctggccaggctggtctcaaactcctgatctcaagtgatctacccgcctcggcctcccaaagtgtccagaactcctagactcaagcgatcctcctgcctcagcctcctgagtagctgcgactacgggcttgcacccggaaactgcagttctaacagttgctcaagagatgttgatatccaggggccacactggcagtggcactggcctggagaataagggcctgttctccatttccacatgtgaaaatttcctcatttgaaaatggggataatgtgtgctgtataaaatgaaataattttttcttggtgccaatctgtctatgcaatggaatgtttgtgtctccccaaaattcacatgtggaagccctaactgccaatgtgatattaggagatagagcctttgggaggtaattagatcataagggtgaggtccttagaatgaaatccatgcccttagaaaaaggaccccagagagttccctcaccctctttctgccatgtcaggatacaatgagaagtaagaagtctgcagtacagaagagggctatcaccagaagctgaccatgctggcaccataatcttagacttccagaatgcagtactgtgagaaataaatttctattgtttataagccacccagtctatggtacttagttatagaagcccagatggagtaagccaacctgtttggagtgtttttgagctgtcatgcttttcaggttcagcttaaagctcagatgggaaatacaggaacttctgcaggttaattctggttctaagttcaagtcctaagaataagcccattatgcaattctgggtggccaagcagttctccagcagcccccaggaagtattctatctcacagaatcctggcaaaaggagacagtcttctcagtctggtcaagggctatgttgagtgtgagggaacagaggtgaatgtcccttgctgtgctcaccatgttctgagagacaggcagacaaagcgtaatttacaatttgattaagtgattgcattggtgactttttaaagccgcccagtagttgagccccctttctgcatttggaagtttacccgtatgagtctaaaagggagacagggccctcattccatgactgaggcccccaaagtctagtctcactttcctcagtctcagtgagccacagaagccaggctcagtgtctgggaggagaaatcctctctgatggtggcaggggtggggacagcagccccgctgggccctgtggggacagtcccagcagcagacagtcccagttgggcttatcctgtgatgttggcctcactgtcttggcagcctctggcatttctgttctctgttcatcttccacatatggttctcaggttcactcatcaaatcccttcccatttcacccaatcaataatgctgaactaataatggtttttagagcagggaagtggcacaatcacaacttattttaaagataactgaccactctctggagcatggattggaggatgagtgactcaaggtggggtgactagtgaggaggtgatgaaggagatgagaggaaagaggaagaaacactcacagagtaaacctggccatatctaatgactggaagcctgagtttctcttcaaactcagaagagaaaaatgaatttatggttttgggcgcagctttagttttgtctttggggatgagtatgtattttgttgggaaggtggatgccctgaagcagggttgggaaacaagattagaggtttttgaataagactgtgtttgaatacagcttggctatggtcttctccatttcaagtctgttcaacttaacaaatattgagcccttactaggtgtcagacattcttgggtatttagaatacagtatattttgattttggtgttgaaaaaggtgtggaggtatgcagggaaaaatctcacatgcttttacctacacacacacacattcacgcaacacaaagtgcacgcacatattggtcttgaaattccccaaggaccaaaatggacccatgtgatgagtctgtgttataacagggaatctaccgtaggttcttggctaccttttgtgaaccttctgtcttctttcctctcacttacaagtaatcccctgagtttttacctcctgaaccctgtgatttcaagggttcacaactaaatgcttcttatgctgagcaaatgtatacactgctaaaaccatatactcactccttgtggtgtgtttgttaggaagctgccacttctgtcttctccattctttggaaaaggctgtgagtaaacacagagcactggctatttacatacctagctcctgcttgctttttcaaagctctttgttcaagtgtcagtgctggtttgtaaaacatgaacagagttggggtaaaaaaagtaattacagttcaaatctggtgtttctactgacatgatactgagctgcctgactgctcttctttcttatcccttctctagttctgtcttttcagttgcaagttcactctgtctctgtctcccctctctctcccttgctctcactctcattctcttgcttgctcttctgtgtgtcagaaagctacacacatgaaaggtagctggcctcatagccactgggtagcccatccttgagagcctggccaccttcagtgtgtcgagatgccagggccctctatggctttttgcacagggaagttctagtgttttcagtttccagagcccacaatgagctgtcctccaaatccagatctaaaaccaaaccttctcttggatcagaccaatccagaagcactctatagtttcaggggtgtccaatcttttgacttccctgggccacagtggaagaagaagaattgtcttaggccacacatataatacactaacactgagatatagagtaagctcagttgttgacatagcaagtttgaaattacagcagaacttccagaaaacatcacaccagagttttctatccttccaactatattttacattttttgctttcagaggctatgcttcttcttctttgttcttctcttaattcagcccatgagcacatggtagattatgaatggatgctttaggaaccatgtagatggaggtttgtgaaaatttccacggaacatggcagttgagaattggtgactgatat

SEQ ID NO: 2445 - DNA, 289711 bp, Homo sapiens
tgttcagttttttttttttcctgaatgcacttgaggattctttggtaatgtcttctgatttaccacttgtttttgtttttaatatcaaggaagaatatagattgaagcaattgtcttggtagcaactttagtggtgatggctgtggagttattaaaatttatagtcatgctgtttttgcagctacactttgcatttcttagagaggcttataatatctggttacaaagaatgtagagagatagcaactaccaaattgggataggaaatcaaccctgcataaattgttttaatatatattctgtttgctaaaatttacatttattttcacaatatgtcttgatgacagtgcccaccaagccaactagcccttagctcatgacactactttcagttacactaatgaggagaaagaagggagaaagaagactgacattttgtgggtccaaaattatccacagtgaatgccaggtgcttcacatgtctgtgctctcctataaccctcacagcaagcttcagaggtaacaactggcccctctttccctccacacatctctttatgaaagagaaatcagaagtaaaataaccagaccagggtcatacagctttaagagccatcgctgttatttgaaccatgctaggctaaaacccacatttattctattgaaacagtttctccaaaaatcagagtgttttatatctgatcaaatgatgggtggttccttctcctgatctgttttatctcatatatttatgtaatgttttattacttataaagtaccatcatgttcatcatattatatcatccttacaacagccctatgaagtacgaaatgctgatatcctgtccttatagtgtattatcaagaagtggcttcagaaaaatcaagtaatttgcccaaggtcagtcaggtctgacaccaaagccaatgcttttgttccctcacatcttctcttttctagacacatgagccagcggagttgatttgcatggcagctgtgcatgatagtttcaagcctgggcaactctatgggtattcgccacaaggcttccgtgacttctaatgaactgaaacaaagcagttagccatggattataatgccaccgtggtcccatgacaaatgacaaggaggttgcagtaatgaaattttattactgcaaatagagaccacatctgagatctagcacggccacatttaccattgtgggaaacaaaatgaaacacctgggaaaggatctccactgactttagcagtgagctaacaggattaagaagatctcccagaaacactgattacaatggcaaatgtgtggcacctaagataaggaccaaatatttattctggcagagattaaatcttttcttttcctgaatcaaatatggatcttgcagaaaatctgcccaagaatatatcttgctgatcagcgaactcactgagccagaaccgtacttggccactgctgtcactgaaaagctacagaatgctgctttaaaggtctccatgcttcccctaaaactgttttccatccatgattaattagtgacttaggggtgaattgaatcaccagctgtcctttccatgcatccaggatttatgtactggtttctcattgaagaacagtggtgcaataaacagccctcatttgtggggtgggcagaggagtaatggtgtctgcagtcatggtttcttaactcctctagtacttccattctgctaagcaggttatggctcacattattacagcctagcttatttaggcatgagggtcgtgggcagtgacacacacacacccttagaaatgaataccagttctttaagagaaagcagaaaagtcatattaccatttctgaattccttgagaaataagaagaataaaatggacaataatattagctatgggcatgaaaagtacaaaaagaacccataatcaggttcatttatatatgcatgcatattttaaagctaggtgcttttcctagtgcagagatgtagatagcggtttcaacaaacagatttacgaaatcatgagtgtgtttagtcacaattttgggaggtacctggaactcttttcccagagaacagaacatggggattgcagacatcattttatattgcatattatgtaatcagggcacaaaggaaatactgaggtccaccctgtatctctgcatccttgaatgctcacagcctgctttggttgatcattctatattcctcgcttctaagatcaagacttctgcatgacttgtccattcttttattggatacaagatgaactgacatactaagtgataaatggaaacttgaggaaagccttcattttgggaaaagaagtgaagtgtaccaaactatatatagaaaccagtgtccctccctccagaactcttaatttgttgactttaggtgtagtaggtgcttaataaattttgtatttgtgtatttaatgaatacatgaatgaataaaacaaatgactaaatctgagatttagaaaaactcttttctatatcttgatttatatggattctggacttttctcacattcttctttttcttttcctccttctggttttcctccttctcttccttttacttcttcttgaataaaaaaataatagaagataacaaaggatcgtgaactagtactgtgactcagtcttgtagaatgtcagaattactactgatatggtttggctgtgttcccacgcaaatctcatcttgaattatagttcccataatcccaacgtgttgtgggagggagccagtgggaggtaattggctcatgtgagcagttacctccatgttgttctcatgatagtgagtgagttctcatgatatctgatggttttatgagggggttttcctcttttgcctggcacttctccttcctgctgccacgtgaagaaggatgtgtttgctttccaggcccccacagccatgctgaactgtgagtcaattaaacctcttttgttcataaattacccagtctcaggtgtgtctttactcacagaatggaaaggactaatacaactactaaattttattatccttgaatgcccaacatattgccagtaatttggaaaactaaagaaattgagcaagatgtctcccttctgtccttacacatgcctccaacaccctgcaatgctatgtctttccaagagcttaagagaggctgattatatttgaatagtaaggttacatttatttcatgtctcattgtgactactagttccaacttttagtcataaccaattattagagaagagtcagagttttaatagcattattatgtatgctttgtgttttagtgcacttcccaggaggttggtgatatcaccaccagcatcaccatttgcatcattattatctgtattagtccatcctcacattgctataaagaaatacctgagaatgagtgatttataaagaaaagagtttttaattggctcacagttctgcaggatgtataggaagcatagcagcatctgcttctggggagccctcaggaagcttccaatcatggcaaataggggaggaagagtctcacatgacaggagcaggaacaagagagacacagggaagatgccacacactttaaacaaccagatctcataagaactcactcactatcacgagaacaggaccaagggaatggtactaaaacgttcatgagaaattgtccccatgatccaatcacctcccaccaggccccatctccaacactggagattacaactgaacaggagatttgggtggggacacatccacaccatatcaccgtcttcactgccatagtgttactcttatctaattcattgcaatttcccttctgacaagtctttgatggccacagaggttctcttctgctgtgttgcataagctctggtcttgaatatatctctctttggattaatctgaggagtagggctacaagttgggaagcatggcagccatctaatcatgaaaattctaggtgagtttcattggcctctactggggttaccttttctatgtggtttggaactgcagaaccattatgtgcatgtgtgtgtgtgtacgcgtgtgtgtgtgtgtgtgtatatttatatacacacacacatatatccagcccctctgacattggctcctaaccattctgtacacctctgctttgccttgatcgcatgaaaatatgctgagaagctcatatttccactttaattgtaaatctgaattgataaatgatttaaggtccagtgtcttggtgtactctcttagtaaacaggcctaattcatctcacagaaataaactttgcattgtcattgcatagctactaggtagttccaggcctgatttgccttgaggggaattgaatgatgtaacctgtgcggtgcagcctgtgagagcaatttgggtggtttttatgccattggtttttatgctcaggatgaaagctcatggagaaatgtagaatgctattattatcttatcttcatgctgacagctccctctgggcacctacaggtttattgctggttggaggatcaagtttaaagggagagaacttcgtggttggtgataactatgccttttgtgtttctttattataggaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggtacatgttgttcgctcaatggtcctactctttttgactctcccattctcacttttcagtggtgatttttctcatgactgtcaccaaattccagaacactgagtgaagtacacattcatgatttttttgtatgagaagataagtcatctctttaggacttgatccagtatagggagcttctggagactttaccaactatgcactggacactttttgtcaacctttgactgatacagcctgactggctcataccaaagacaattacggtagattttgcagggcctgtagatgaggagcagtgaagggaaggatcatctctatcatgagctagtgtcgataatcataagatgctccatttgagacccagactttgtggtgccatttagtcggatgcagttgaaggtgcagatgccagagagagactctaaaaggacaattactgaacttgaagacacagatcaagtcatggtaacaatgagagaaaaactaaggtggaattttattcgtttggtggactttgctagtttttattttctcacttaccctaagcctgcctggatattcaaaggttggtcctagtagtcattttaatagcaagcatgctggtgtggcaggaaaaggggttaatcatctgtttaaattttacagtcaagaaacattcagcaacaaattcccagagccagatggctgaatcaagcacaacgggagaaaaggttgccttccttaaaagagatcattcaaataatccctcagctttccctcttgcctctcacttctcccaggaaaagtcctgaatgctgatcgtaaaagtgccaggaatggaagggacaacccttcagcaaagggccattgttccacaattgcactgtcatctgatggatgcaagagaatagtgagaatattgcacttctcactaatgtgggcatgaagtgatgtgctactctctatcctacacaccaaactcctcacaattttctcaccacttttctctaacttcctttacagtgaggtgggcacaataacaaagaagcttgaagcacattttcacatgtctaagagccattagctaataatggttatgcttgtgagaaagatacaaagtgaatttgcctatttgtaggccaagactttgaatggcttgaaggctgttgtatctccacacctaactcagcattaattttctttaaaagcctatcagaagtatctgcgctgttgggttgttccctaactgctagagtcccgctatatctgtttaagaattgtaagagcatctggaaacagcatgcaagacccccaaggtattgaggcaaaaagctccacccactattgatttgccatctcggtttccataaaacagccagctcagccattgctaggggtctcagaatttcttagattaaggcacataaatgcccttatgaggttatctttgagtatttgaagaaagccaaagctattaacagcttctaggaatttttatcattcaaattcactacacactaatagacttaatttttaaatgcttcctgcttaatccctgatggatgggggagagggtgaaaggaataaaagcagtccagtatcttaaaagctgttcataggctcatagaaaaaaatcaatctctctctccatatgtgttatcattggccttgctagtgttgctgaagggtttgttgtgtttctgttaggaatttcaaagatttctaaattgatgttaaccacttgccttgagccaatatagaatctacaagtttgctgccagcaatgagcaggctctttaatggtcatttttaaagccacagctatgtaaccaaaccggagattcttgctgtgcgcctatcttttggtgtctttctttagttccaaattatgggttgcttcctatatgttttcaaaacagattaagcctttctttaatagcattgctccctcctgaaaactattattatcattggaaactgttatttagtaacgatatgtgttattatttcaggacagggtacagtatagcatttataagtatgggccttggagtcaactggctagagttgggatcttggtttcatcacctgtgagtctaaagaccttgaaatgtcctaagcattgaaatatttggtgcctctccccacatgtaattcaaaatacagtaacactgaaccataaaataagtgtaagaatttctaagagtttttatttttctcctctgatgatttctgtaatgctttcaaaatatattagattctttcttcccaaattctcattttgtactttctctgttttgttgttctttaagaagatgttcattcttctccctgagactgtttcctagtctagacaaccagggtaatgataatacctggttaatgtgaagattaagtgagttgaccacatgtataatgctgggacaattaagtcaatcctcaataaatgttagctgtgaggattaccaatcatttggctagcattttaaattaggacatatttttgagtacagatttcttcattttgaagatgaaataccctatcaattagacaaggtagatattttttattctccatttcaaataaaaacagagacccaaggaggtgctatgcccttcctaaggtcacatagcaagtgaaggaagacctaggacaagatttttctgtttccaattgggcagttttcactattgctcccccagagaattgggggatgttctgaaaaatgcatagctagaaatgagtatttttcttcttgtgtcatcttagatttctttctttaaagaagtgtcatatctcaaaggtcactttccaatgatcacacaaaagtggttattgtgaggtgttgagttcaaaatcctcatttaaaagttttattggcaccagtgaccccaagctgctctccttacaacaatggcaatgtgctcccatgaagcagctgaaagaatagtgagtatttaaaggagctatatccccttaccttgctgcctcaattaaaaagttgttgtgtgatatactagatcgaggtttatgttccactctgccaagacttcctaggagcggttcactttttgagccttggataccttattttctctcctctctgcttccctgtgctattaaaaggatcaatttaactattaataatttaaagtatcatgagaaaaatctggcaatgtttattttaaatcataagatcaaaattccccgtgtctgggccatcaaacaaagccatcaacctggcaaggcagtcttgacagtttctacaaaaatgtgtccttttgttttctaaagtcattctattttattattttatcaataacagtaggtttagaaatcatcaagggtttagtctcactactcacttattactaatgtttaaacagtaaagacatacagagtagctcctatagaagatttatgttaagttatctcacttggagaacatgctctcggggaattgttcctgcctacaaggtctgaatgagtcagctgtgcaccgggatgaatgggtcatctccacagtcttctcatgggcatttatggggctctactgaaacatcccaccgtgaaatatttagaacccagctgggcacagggcatgtagcactggctctttctttgtgaatcagggaagaaacagaatgaaaatagttctatagcaatcggaatcttatatcactaaattctgggaggtagaactgaaaagcaacttctttctttgaacctgaaaatagaaaagctaagaaacaggagagggaaataaaagaagaatcagcccagagctatcatccaggcactgacaaatgttccttataaagtctctgattgttgtccctatacaatgcggtggtaggaacaagggagggggggtgaaaggtgacttgagtatgaggaattaattttagccacagctctaggccccctggaaggctgagctgactgggtttgttccatatcttctctctgctgtgagtgggtggccggtgatactgtcactgctgtaagatccctgagcatggtccagtaaaggcttttcaggtcctatctaggcttcctgggacatgcagactgatacacagcttcaatctttgtatgtcagggggtgctgaggagagcagggcataccaactcagttcaagtgctcttcacagaattcctcttcttcagtctttaaaatgcacacggatgacctacatttaaatcctatttgaccacccaacttagaacgtgaaaaagaggtaaaagtagctccctttcaaggatgctacattagaaaactctctttatatttgagtttgtcaaattccacagaaacttgtctttataggggttggaagagaaaacattgctatggtacttataaaacattgctatagtacttattgatgaccaaaataccttcatatcggttattacatttgagcctcactccatcctgtgaaggacagggtttggtattattactcctgccatacccattttaaggttacgttatcaaggctctgaaaggctaaataactttcccagtgtcacacagcttaaggagcagagccaacacttttctatcctgatcctcagactgcacagcctcaaactttctgctcactttcctatttctcagagccacgattttattaataatgacagtatttctttttgtaaaaacatattctcaaatggaaatctctgcctggagtagtctagttagtaaggtttttcaacctattgacatttggggctggacacatctttgctgttggtgtgtaaggaagggggcggggtactgttttgcacattgcaggatgtttagcagcatccatgacttttaccccctggatgccactctcatgtttccacaagtgccaaataccctctggtcagcaaaatcacccccatataagagccgctgacttagagaaagtttccaacatattttgtttaaatgttcatcatgtttttgtaatttagacagtatacatcggtataagaaagattttttttttgtccacatctcttcctcaattattgagactttaaaggattaaaaacaagtctatgtacttgacatgatgctgaaatttctcaggccttgggttttcattaattcctagccaggaggtttactttccttttctttatgtcttttcctgcgaacatttgagaccttgccagatttgaagcatgcattaaaacaagccccatctacctgctcattcatccgttcaggactagcgttgctttcagttcaacagggggaaaaacagagagagcagagtcctgcagagggaataagaagtataaatacaatcaagaaggaaagccatatttgaacaaggtttcaggactacagacatataagggcaaccagagaaagcctcacttaatgaatgtgtttgaacattgtgaggaacattttaaaaccatcttataaagaaggtgctccaacattcagtcacaaaatgtatcaattaatcactcaaactagtgtatcttgaatattcacactgctaactagtcatcctttccaatttgtcagaaatgaattaggattcacatgtttgtgagtttctatttccaagggaattatttccacattatgcagtttgtcttcggttaacaaaaatgttttaaaagaatgttttcaataggcacttatatatacatatttgtgtaaagcaatggtctgcaacctggctgaaattgagaatcccctgggaagtttaataaattgccagtgctcgggcactggtctcagggcatctaatttaactgaactggggtgtggtccatggatcagcagcatcagcttcccctgggagcttgttaaaaatgcagactctcaggcaccaccccgtacctgcaaaatcagatcccccagtgctatgggtacattgtaaattgagaaacactggcccaggcatttttttgtttgttttttgttgtttttaaaaaaagctcctaaggtgattctctgtgtagctaagtttgacattcactgatatgtagaagctaaaaaatgtgtctttctttcagactgactaccggtactgttcaatgtggtagccgccaaccatatgttgctattgagcagtgtggctggtatgacggagattctgaaatttttgttttattatgtacttatgtcctaggcactgaaggctttaaatacatttctcattcagtcctcactccaacactatgaggctataggttagaggctagtattagccagtgcaggactacaatatgccatcttttatttccttttatgtgttttctaccatgtaaacgatgggcatttgccttcatgtaccttctgaactcatctaatgagttttgatattatacaatcacagggataataactccaccctatccaagcagctgttggagagtcattaaagggtgatgattaagcatgagggttttggagtcagactttctaggtgtaaccaagggcccctggccctgtcacttgccagcttgcccacaaccttgagaaggttcccgctgtcgagaagtttctctatgctttgatctccatgatcatatatatgcattttctcgcattaaaaccaagtgaatgctcagattgacattactataggacacttcacaaaaaaagaaagtactggctagaggtatgtttcctaaacacacatggcaaactaccctttcttaagctatatttgtatgctctgacagcatggctatggtgcaaatctatcaacaaacttgaccctaagaagccagttacatgacctataaaatggggattgtgttcattgttctgtcttagaaagtggaaagttctttgaataccttaaagcattgcatgaataataattgtacctgcaggtgtattgtctggattatctaccacccgtatacattttaggaccattttttatcttgactttctacaatgaagtttacttatgaaaggtgagaataggggactaagagattttccatcttgctttctcatccttcatggagaattccacaatagtagaaacggttccaaagtgagggacatgtgcactgaataaacactttctcccagaggtgtaggaagtggcagatggtgccattcaccgtctctcagccaaactcacccaggtggtgatggctgccatttgccgaacatttatgacatactccccacttcatgggcagcatcctacttagtcttgaaaccacccattaggacagcgttggtcttattcccatttttttagattaggaacagtctatgggagtgtagcttagtttgggaaatgctggtattcaacccagaaccatctgacttaagagtcttaatgtttaatcacactctgctccttccttagattctcgtaaacaccctagaacagttgcatatcctagaaattctgggtttaactcaaatcttgacaatttagaatttttctctcaagttaaattatagaattcccccctcaggttaaatctctgatttctgcccagtctagaagtcagcatttccttgggcatctatacatatttggctttatctatatcatcggtgtggcctctggaagccttgtcagcctctttctttttgcgatcttgttttaccttctagtgccatatctatgcaaaaagaaagaacttttaaatgaaggtttgttttgccatttaatagtcttgcttggggagtgacagagtggcaagaaggtgcttagtatttttttaatttaatttttgttttatcaaggaaacttcctttcttctctgtgaattcccagccacagataaacaggcttgtatcttataagttaaatacaattactgctatcaaacctagagcctttttctctctcccataaatgtctctaagaagctgataagcatttcaaggcaaactggagcttggactaatgctaaaattaaacataaccacccagaagacaaagagaccagatagaaatacataaaacatttgaggtggtgggaacacatggacacagggcacatagaaacttgcccccaaaacattaggttaatacatagctcaaggttatttataaaggaattaacatacacaaaggagctttttataattataaggatttacatcagataataacaattgtagtagccaaagatattatttatctagaattcacttgtgaacagggcatgcttttggtctacagggctgttgagcaaaagaataattttgctgcaaccctctgtaggactttataggatgcacatttacattttccccatttttagtagactatcttgggatttaaagaagaagttggaattttaaaaattagaaagcacatcatatttatttagccatatgttaaatgttataaatattatagtttagggactcagtaaaatgaataattaaaaatttgagggtcacttctaggtacaatgtaaccagggatgtaagataaagaatttcttgatttccaaccataatgcatctattttaattaaataatatctttcaagattagaaatacagtgtagtcacactttatgggatttttaaaattatacttatctgaaatagtgtgacataaataaaaatattaataacatctccctctatgtgaggcatcagtaataacatacattcttctgaattaaaacaatcatcaaatattgcataatttcaaagctggttagtgaattacaagttttgttttccctattgtcacatggaagctctagtttaagtagttaatacaaattctggcctgcagaagttgtctctaattacgaaaacttagaattattatcccagccataaaatacaattaccctgtaccgtttttcctctgccccagagctgcctgaacaccaagtgtcctaccacccatacaagagcatagttttatttatgggaaaagtttccaagttccagtctcttcaatttaaattttgcacaaggttgcagagtctctctagttatttaaagtctaaaaagaacactgagcttctttgagaaaggtggtacataaatatccaataataataatatatattcacatacagtatgtcatttatacttctataaagcagagaaggtaatgaaaggtgctctatactgtaaatcactcaatcgattgtaatcatattgcagctcatctcaaagagataaagaccttccactcctctaaaatccctgtcaatatcctagcaggctgaagagaggggaaagggggtcagaagaggaaggagggaatgagtcaaggacaaagcggcactttgagtcttcagttcatggagttaacatgaatttgattggattcccagtgatatttacagttttctccataagatgcatttcttttccacacggtacttttacagcctttcagtaagtccctgatgctctgtgttggccttgatggcatagtttactaagtgccaatggtagatatatagcacagcataagaagacttagggactaagtttataagtagcaaatgtcaattcgacagaacttaaatgctgaagtgtatatcaaacaatagaagtcgattgatcatgggctagcaaaaaatttatattgcactttcaaacagcagaaacactgtaaaaacctttttactaactgctgttgcctttaatgtaatagaagtattcccctatcctcatcaccggggtagctctgagtggagccatttctttatgcacttattcattcaccttcattcactattcaacaaacatttgttccacatctactttatatgtgaattcatactaggtgatgggtatatggtgaaaaatgaaacacagctcctgacctcaaggatcctcaagtgtagttgaagagaaatacaagtacacaaggaagacatttttattgagcagttattaattgccaggtagggtactgggttcttgtatcaagtctttgcagtagccccaaggggtagatattactgttatcatttcacaaatgagaatctggagcttctcctagggtcaagctagcacatgaatacctggaactgaagcctgtatgtcttagaaggcaaacccaaagctcccgtacgctgccctatcttgaacctacaattccacaaagtgaaagaaggtgctactattgaggtgagatccaagttcagtagcgggtacacataaatgcctaatggagcctgaagatcagacaggggcgagcatggaatacaatttgggatgtgaccttgaattatctggaacaatgccaataagctctgctcccctacctagtgtgaaagatgacatgacaacttatacctttctcattgaggaaattaatgaccatggaattctttcttttacttaaattttttttttacagttttattgagggatgattgataggcaaaaaaatcctgcgcatactttgatgagtttagacatgtgcgtacacctgtgataccttcaacacagtcaaaataaacacattcatcgtaccttattttacttagtgtcatctccccagtggttccaaggtagaagtattaatctccctcatttacagatgagtaaaccaaggttcagggaggttgagcacatttgctgtggtcactgtccaccaagggtcaactctgagattccacacagatatgtttgccctcatttgccctcacaacctaatacccaggttgcccactccacttttccaatgtcttccaagagcactccagtttgcatcatctacagagctcaaattcacatggttgacagatacaaattcacatgcaaatgtactattatttcctacatcccagtgcatgcagaacactgtaatcccattattaaacatttactagaaatgtgcttctgcctgatgcacaattgccagcctcaatgtttaattaaactagatttgttttcattttaatcacattagagaaatgtgtttttctcagagttcagtggtgaaatcttcattccaaatgcctccaagtgactgaaaactgtatatcccagaggaagggatgagggtattacaacctatccttgcataaaatattttaggggaaaaatattaattaataacaggtaagactgggatacactatttgtttttgaatcatcatagcatcctggaaaggggtcctattattattattaccattttagagatgaggaaacgaagtctgagtggttaagtaacacactccagtgttgcacagctagtaggtggcagaaccaacatttggatgtagacagggaaaccctgatatctttatttagattagggatcaccaaaccttttcccccaaaggccaaataacaagtagcataggctttagaaaccaacctatcttataaatataaatatatttagatattaacttcaatattttattaatataaatatgatatgatttgcatgatctttgttgcagttattccagtctgctgttataatgcaaaatctactatagacaatacataaatgaataggcacagctgtattctaataaaacttgctttacaaaaacaagctgtgatgaaccacgtttccccattaggtttagctgggggaaccctgatttaaatcacggatagttggaagcctacagcttttactaatccatcagctttattttttgaattgtcttatctgtttggaataaagagagcaagagtatctctaagtggatgggttaaatccctagagagacagagaatagtactaccgtgtagggtgacatagacctactggtgaggttaattcaggataaagaaataaagagatacaatatgtaagaaggacaggcactccatttacgtatagttaaaaatgacaaacaacaaaatagctaaataccatttttttaattcaacaccaaagacagacacagattccattctagagcaagatttgaagatgatggacagaaagcattgtttctttacttctgttacttctacttaataagccgtggtgatttaaatacacccctctctcctaaaaaaatagtgcttacttttcttttaaattcaagaattttgattagccaccctagcctatttctcatagcccttatgcataaaggtgccagttgatgccttgcattgatctttcttttctcctacccgcaccctgattgatatgtctgtcttctaagtcttagagagcatgcccttcattatctcagcattggttgtccctgtcttgctgctgagagcttcctgcttgagcttcagttccattttcaagccattgatctgatgttctgaggatggactagcccactttagaggtggctcagcccacttcatgctattgagttttagagattttagaatcagatcccctatttattaaagcagcaagaccaggctatcagtttttatagatgtgcatatgcctaaaaccatgtagtatttaaaataaattttgacctacatcctctattccccaccacgcctggtacccaccattttactttctctttctatgtatttccttcacttttattttttgctttttggattccaaaaagtgagattgtatagtattttttttctgtgcaaagttataagggatgaataagtctagagatctaatgtacaacataaggactatatttaataatattgtattattatatattgataatttgccaagagagtagattttaggtattcatacgacaaagaagaaagaaaggaaagggagagaaacaatcactgtatgagatgatgggcatgttactttgcttgactacagtcatttcagtgtttatatgtatatcaagattacatatataccttatatgtatatataccttaaatatatactttttttaaaagccaaactaaagcacactgggtttttatttacaaaatagggacccccttcacagtttgctgacctcaattttgactccaattaagttatcaaagttctaactaccagaatagaaagcatatactgccagatttggccctatagtgcaagaaaagtggtcacagttttcttaatcctcttttaaaaaggaaagaaacaaacatagtaggtaatcagtaaatattaaactgtacaactgaggtttttggagctttctgacttcaatgactgcatatacacaacaaaaatataagttgttatacagcatccttgacaagcattaactataaatacttttataacaaaagaaaaatatcatttactacaaaacttttaagcttttgctttagaaatgtttctttattgaaacaaatatgattttattgaaatattttttatattagtacgatgactctttattggtctcaaagggtggattgccaagtataattaaacaaaatgataaataggaggaagatttcagtatccttgacagaaaaatacatataaatctaatatagatatatatgtaaaaagtaaatctaaaatcttagccaaggtttagaaatcttattacttcatttttatacctttataaaactgttgcgaggtgctgtttcaaataaaataaaaatttatgtaagtaaaatacaagctaaaatagaactgaaatgtctttaggtttacaaaatgaatagctggattagtttactgaatttttttctgtggtatgggtggcactggatctctagaatcggtaaaaataaaggcaatatattgttctcagggagcaattgagctctcctagaggaggcaaaccaagtgaaatctaatagttttgcttcattctgtgactttcccccgctatgacctcagaattttgagctacaagtaggtctataaagggaattttggaatactcttaatagatctgttcttgaaataagtcagctaaactgagtgaggtgctttgccaacacattaactgaaagtcctgaccaaccctgatcccagaccttcatggacaattctcttgttttatttccatttccagtagttgtatgtaattcttctaagagacttgttccaagccaaccttcctagtggtcttgttgaaatgagatagtggttgtaggtatcattgatgaacacataggccaaaacattattgaactattcagaaagtaaatctagcttattctgtggctgcataattatataactgtagctttctgtcaggttacagtggctttaattttctgatcaaataaaacaatcaatataattgtactttgttcctccctcttctggcttcgattctttgatttgtgccactcaccactctcattcttccaacctccccctactccactggcccctgcagctacttagaatagctagctgttgattaaagggaccaagagtttgagcagttactgtatactttcaaaccccactgccatttggaagtgaagtcccaactgacatagccaaactgtaaggacaaaagcaactctaatacctgctttcctttgtttatagcaactgctcaaattctcctctaaaagtattcattaagcatccttctctataaatctctgtggtagaaactgaataataggacttgaaccattattcaatcagaccaagtttaaacccaggttaaggaaagaggaagtctacacgtctttgctgctcactgtgtttagtatatatcctctataattcacaatcaaaagtaaatctttggacagcattcttgtttgggttagaagaaaaatttcaatccttgttcagaagtctaagcacttgtgaggattccaatatgatttttaaaggccaccatccctgatagtcagaaataaaaacattaaaccaagaagactgcaggctttcttctcacctgtccatctcttgtcctaattacaccttatacttactaatgttgtaagtgctttttgacaagacagcaatggtacatcaatagatactgcatgaacttgagtaggcaaatcaagtcactcagaggccttcttttaatctcttggatcattattgcaaagataaaagcaggtttctgaaggagtgaaattcaaaggaacctagtaattagaatggtgaaaataccaggtcacccggtccgtttccctgcttggttcagatatttctaacaatatgtactagtttaattttattcatctaatttaaaatgagagactttatctttcttccaccaagataatatatctgatttctcctctttggcttaaattttttttttcattcacatcttttattattagggttgtcagttgaaattattttgaataatttctttaaatcatggatttttttcttacatctcatatctaggagctatttcttgttgcaaggtgcaaggttctatggcacatacaaaagcatgctttcatttgggatatttataaaatctctctatacacacacacccatcaatgggcaaatataaaaagtattgcctttgtgctagcatgtagttaatattcaatgaatatctttacacgtaaaatcacctataatctttagacatgttcctcagatagccaagatttaatattacatataaagtcatatgaaatagcttaaagaaggaagaggcattgttattttatgtatatgtctcaaatgttataaaggttataagaacctttctgaacatcgaaaacttcaaagctaatagtttaatagtttgttggatacctgccatcttttgaggtggccaatagttgtcaactttttgagtatccttgagcactgaaggtatgtcaatgtttggtttcattgtgtgttaaggagggaattatagaagtagaatggagtaaaaagcttaaaaaagaaaaagcactgcttctaaggtgattctaatttcataggaaaaaaatactttaaggactaatattcaatacagagtagcggaatctgggtgccagataaatatttaacatttgtggataattttacataatcattggccactttcttaaaagtgttttttaaagccctaattttaaaaaatgctattctggccatcacatttacaatgtgaataatatttgagtcatgacgtaactataagttacttctaatgattgactgtcacttgagttgtaaatcacagcatttagcagtgctagttgtccttacttttggtaaccccttagtccctggatcttgatcattttggggtctttactctagagtctatctttgctctagagtctagctgccattcacatgctaaagaaatgccccttaaatagtacctataacatcctaaggaaatgatttctaaactcttctcaatgagtttaaaaaggctgctttttgctaatccataaactttaacaggggctgaagaggcagtgcctgctttttaaaaaccaatgttgcaggctgggcgcagtggctcacacctacagatgcatgcctatagtcgcagctatttgggcggctgaggcaggggaaggcgggaaaattgcttgagcccaggaggtgaaggttgcagggagctaagatcctgccattgtactccagcctgggcgatgagagtgaaaccctgtctcaaaacaaaacagaacaacagaaaaaaaggtaaaaccaaggttgcaaggtaggactgtttgtgtgtgtgtgtgtgtatgtgtgtgtgtgtgtctagttttgatctttaatgagagttttggtttgtttctattgttgtgtgttagtagggaatgtggtggaggagtgcctttctagtctaagtatacgtaagtgtattcatgaccagtattcaaagggtattcataccctgcagggacataaatggttttgttttggaatgttagggttaagaatgaaagtgatggccctgtttgctcagaaaaaaaagaaggtaatccttcagtgctctctgtgaaatcatgtatggaatgaaaaaattcattgatggggtgagaggtctcagtgccagcaagtcttactagtaaattcagaattcagcctgctgttcctagagatcttcctctccactcctcatccaaagagtgatagaaggaggtcagataagtaggtccttgtccctttagggagctacttaactctactcattatcgtcttggagtcaatccccacctcattccctgctcttcccctagtctgtgtctagaatcaaggatcagagaagcatcaacacatgcatcaacctttctccaattttccttccctttcccaactccctcagccttaccctctcctctcaggaactgcattattgcatctcttcttttggatttggtaattctttccttagaaagaggaacagggctaaggataggcaacaggggcccagctgtccatgtctccatccttggacccctaagacttttgccacacaaactcctttgaatctggagactgcaacggagctgcttccctcctcctgctgagccttcatggaaatcctcataggagatagtgtttcctttacccactctcggacccctgttcttcctggatctcctgaattcctggctatatcatttaggttcgctgcattgcaaaccactccaaaatttccgtggctcatgtgagtgtttttttctcttctgggttggcttggatggagctagatgatcttgatggcctcatgtacccctctggggtctcagttcagatagccgagtaggttcacatggctgggtttcttttctcatggaagttcacatggcaatctcaggtgtaggcagcaggcaagggcaagcattcatacacagatggctcttcaagcttctgcttatatcacatttgctagtgcccatatgcccaagcaagtctcacggcccacccagaaccccaagggtgaaaagatagattcaaactgttatgagaggagtaagagtctcactgccaagagacagattttgaaatgggattgtagctattttttttttttttccaatttaacacactggaaaagaagaaaggctctggttctactaatcatatttccctcgtaaattttctccttccaaccctgattcaggtctcaagctgtggttggaaatcagtgactttcactaagggattgtcctttcttttctttaggacatggctttttgaaattaatcttgattctttctgccatatcccaagccttacatttttttcctttttttctctatgtctgatcattttgctttaagtcaaattgattttttaaaaattaaatgcccattaagaaaattatccacattcatgttcccttggatgctttcaaatattttattttcctttgcttttggcagttacaatctatcagtgttatttgtaaaatgtcttatatttgtatagggtatgttctccctttcctcttttcttcttttctttttaaactaagatagatgtgttataaaacagcccccatgctgatccatacttttctctagacatttctgtgagctcagtactttgttgtttatcattatcctttgtttgtagccagatttgaggccatgttgcagttctcacaaacaaatcaatttgaattaatttgccaagtagaattaacgaggcattgtatgaattcaagacatactacaactacggcatcccctgaggttatttcttctctgggaaaattttgattcttgtaccacattttaatagtgtatatctgacctttgaatcttgcactaaatgatacatggctgccagctggtttaatttttgagaagccttaaaaattctatgcagccaaacaaataggagtgtagacaattctttaattattaactttacggggagaaagttgtcttcaagatcgatactctctgatgcttgcttgttgctaggagttctttttctaatgatgttctaagcagaagtttgagaaacatcaaaatagagaatatatatttcttagatggtctttgaggtctccacaacctaaaaatgatgggctccttctctcaaattataagctataaatcccagcaaactctactcccagaaactgtttttatttaattataaaatgggaaagcatttactctaaagagggaccatggtgattacctgaaattccttcactccctaaatggacatctacatctgtcactaatatattatttagcaaaagaatttccttcagactatgatgaccaatgcaaacaaaataaataagaaaatccagtcccctcccacccctcacacggtgaggaaatggtaatagagttcttcaaagaaactctaatttctgggtcttagatgaataacattagaagtgcttaaggaacttgaattctaagcccctttaatgttcgctcagaaataattaacaggagccagtcagaatagaaaactagtctgggaaaagtgtcctaaattttacactgtataataggatggatctcttaaactcgggactgatatataaaacttctccagtgtttcatttgaccaaaaattggcacacatttagctagatttaaaaaagaatatggtgatggctgagaactaacctgggctcattaaaaaacaaacaaacaaaaactcacgcatgctagtgtaactttctcttggatagcaatagcaaattggcaggtgaggaggatattataaataccatgcacagtgtatcttcatttccctaaagcagtatactgtaatgtacagagaactatgaagggatcttaaagagacctgcctgtgttccatcatttgaagctttctggttacactgtaaagtttgaggtaaactaaaataataaaagtaaaatttattatctcacagtttctataggtcagaatttgatagcagcttagttgagtgattctggcttaaggtgtctgatgagttgcagttggtatgaactacggctgcagtcatctcagtgctatctagacctgggagatctgattacctggaaatctttcactcacatggatgttgactggaagcatcagttactctctggctcagttccttgccttatgtatgtttccatagaacttcttaagtgtcttcatgacatgagtctagcttgctcgaaatgagtggtccgagagagagcaccttttatgactcagtctctaagtccacacactgttccttctaccgtgttttactctgtagaatcaagtcactaagtccagcccacaatcaaggttgaagaatcaaacctcacctcttacacagaggagtttcaaagtatttttagatattttatagctccatcataatcttcctattcagggactagaatgaatgcacaaaaaatatgcttattaaatttgcagataacacaaagctaagagaggtatctcctaccagaaacaaaaaatcctagagttaaacattttcttaccatgtttggatgctgttatgaaacaaaaagaatacatttaatgagatataaatacctgttggacgttcataaagtatgttgtatgaatgcaacgtggaacaatttctttgggaagccattcaactagaaactggcttgagttttagttagaaacaagcctaatatgcggtcctgttatgatgtggttgttgaagcaacggttgcaaatcagtatactagtcaggcctcctgtgggtggtgactagaacagtgattgttacttttagatattttgggaataataaattcattcttaggcaagggggttcaaggatggtctaaaatgtctacaattttataaacactggcaattctataggatgtatacagaaggattactatgtcataagtttcttgagcatcggagatattaataatagcatgactttcctgttgtcgggatgacaatgttcctgtgttgtgcagcggaattgtcctcccaaacctcctccctgtcctctgagctgtgtggggacaccacatatgtatgtttaaatgaacagaattttaaaaaatcaaatattctggcattctggcttcaaaaaccttgcgtttgatgttctctacttagaaataaataaccaaacatgagaggaatgagaggagatggggatggggagtgggaggaagagggtagatagaaataaaaggaagaacaacattacagagaagcagagatgacacagagggtggacacgtgggaaggcctggatcacaggggaaagagtgagccccaaaataacactgtggcttttgcagcaaggaggaaataagtgataagaggaaaggcacctggggaaatcttgaagggatcatatgtcaaacggctgaagagcaaacattaaagctttattttgaaaaggatatttgaaaatatttgacaccaaaaattctgtagggaagtaattcttgtggagtttgccttctttttagtttaactcttctgaatcaggtacttgttataacaaatcatatattgagggattattttgtgccacagatttgcaacatgctttatatacatttccttttaattctcaccgcaatcccatgttgcaattattattacgatccccttttaaatatgaagaaactaaaacttaaaatgcactaagacatggctaaaactaagcatggttaccagaaaggaacaagacaaaattcagacattgaaatcaactactgtagcttcagtgcatatttcagaataattgtggaaggaaaaaaaaagtgacatttgaggaaagaaagcaaattttacagtcagtttatgttttgttaatttataacatggcctttttgagaggggctcttaaataaagaattggtgccaggttaacctggcatactgaagaaagtttcatttgaagttgcttgaaaatattctcttaaattataggaatgaataaagaggttgcagtcgcctgggcctagttttattaacctaactgggattgaaagtatccttgatagaggaggagaaatgagcttcaggaagtgagttacaaatggcctcaaagtactgagaaaggataatgattggtaaaatatgttgtaattattgcatcaaagtaaatcattttagtacataatacctcagcagaaatggatttttgatttgtttaggatatgaaagagaagtctaatattaacatgtatgcacaaaacatgtatgttcaaccagcaacagacagcaaggaataggggcatgaacattcggatagctggacgtaatacaccagggttacatctccggcatggttccattcccattccatagcctataagatatttggacatgataggccaggtgtggtggctcttgcctgtaatcccagcactttgggaggtcgaggcgggtggatcacgaggtcaggagttggagaccagcctggccaacacagtgaaaccccatctctcctaaaaattagctgggcatgatggtgcatgcccatagtcccagctactcgggaggctgaggctgcagtgagccaagatcacaccactgcactccagcctgcctgtctcagagaagaaaaaaaaaaagatagttggacatgataactacatgtctacaggctcatcagagagagagcacaggcagaggctagagctcaatgcaaatatcgagactgaaaaaggttttggaaggctctcaaggcaaggatttaccctgactcccatccccctgctgttcaaggctccttactgggagaaagaactttcttttctaagccttaggtgagtgttagggaaggatcctaagaattaaaacaaatcacaggctctctcaactcccaacctcttttgattccccacaagctaagcccttgcctgagttattgcatttaatttggataaaaccatgcaatatagatattaccttttttaaaaaaacaaaaaacagatgaagacaccaagagtcatctagattaaataaattgcccaagttcacagaactgataaatgtctggacttgattcaaagtttgtctgactccatatccaatattcttttcactcatgtttgggccatctttgcttaaacagatcaactagcacagcctagagttggtaaacccatactacaactttaatttaggaaggaaatgatactgtctgctcgtatatatttgccattatcagaacatatccagaagacatgtagaggtgagctttatcagccaacttggtgtacgacagggtgatttgcacttctttccagggtctccctggctcaaggagccacttaaaaagctcccttacttaataatgcccttgtgctctgggtctattaatttacttcccacaagctgatcaattttctgttccaagacattaatttctttaccttggcacattaaaggatcaaagctcacaacatataaatagttctttttccttctgccccaaaggtgtgtagtgaggattaatgagatgatgcttataattgcattttgagctccttggtcgaaaggcactttataaatacaagatattagttttttgctgagatccatctatcacttacaagtggccaaacattctagatggcctttgggtgtgcaacacctccctctctgactctgagttggtctgggacaatgccagaaatgtggctcaagccaagttcagagtttctggagttcccttcctttagtgtcatatactttctctgaaacttaacttagaaagtgttctttgggggaagagacatggcaataacctctaaactgccctagtacttgagggcagcagtaccactacattgattttcttttgcctctgactttaatacatagcatttattctttgactgttcattagacccacagtctgattttttagtgtcaacaaagcaataaagaaaatttgttcctcctttatttcagggctcaagacaaaattcaaaaatgcctttggcattcattttgcacagacgaatgttgttaggatattcctattagcatgtccacgtgcttgacaacatttcaggtggtattaatagtctacctgcaagaaagtgctttctgccagcctggtgcaaattggcagaacctttaagccactctttctcagcttagcagcagtatatcatcattacctgtggctggaccaagaaatcacatttgtcaatgcctgaattgctcttttactttcagtggttttagaaatccactttgttttggaaatgggcttagctgagtatgttagaagatacagaaacatataaagtgatagataagggatttaagggaatattaaggatgttacattttctatggtcagttgatctttggaagatgacttttgtgggaccaaatagaatatggtcatcttttgaatgaaggactggtaagtgggaccaaatagaatatggtcatcttttgaatgaaggactgataaggtagtgagacaagggaagcataccgtggaactaatgagcttccttctgatcactagaaaagagtcgagtcatattaataatgatagtttaaatatgctgtactccctattattctatactaagtcctatggtaaattgagaaatggggaaactgaggccaagtgacttgcccacgatcacacagctaataagtgataaagttagaactcaggaccagatttgtctccagagcccatggtcttaactcctatgctgtattgattatggctttaagagtattagtataccttctaattaaataggacccatgtttggaccaataaagtgtaagcgcagtgttgtaaaagttattttccatgttatacaagagttctatttttcagttttttcacttgaaataattgtattccttggagactgttaataaatttcgagtctcaccttaaagaggaattgatgtatattgaggcctactcaagggtcagtttgctttccgtttctttcccttttacttttatcctaagtggattcacccaaagtggaaaatgtgaggttggagtgtaaaggttggaactatgaaccagttgggcttcaatactttcacctcaaagtattctgttcttcacaatattataattccacagtgcatgtgcttgttgcacacgtctccaggagttgaaatacttgatattagagccagtggtccaaatgaaaatgaccagaagaggccaaatgtataatgttctcaatcccttatcaaaaatagatgggaataaacacacatatatttaagtacaataaaatgtgactaatatgtttttttctaaaacccagtcccatataggtgtcggatccacagaagtaatttaagaatggtttatttgaagatctctttgtataatttatagatttctcagtgtgattaagaaatgaagttattacatttttttctctaattagtaatgcacgtatgcctccttttaatgatattatgatgtttactactcatagggccattctttcttgagtatagccatcactttctgttgaagaattgatttcactctttgtttaaatgtacatacttgttgctatatgaaatatatgactgaatatcattaaagatttagcaagaatgtaggtgaatttggtgaggtttgttcagcttttagagtagccctgtataagaatacttatatttagaaggttgtttgcgcttcagtcaaactagcaaatgaggcatggggcaaataactcattctcatgcacatgtttctaaaacagttcttactaatgtttgagataaattaaaataaacaccaacaagaacatgaaaagagactaagaacaatgttaatgcggcaacttaaacaaatttggttttccaaatgaccttccatctttcacaacttttaacagcatgcaagattgctatccttagtgccagatactatcaatctggtgtggaaaacttaaaacttttttctaaatgtctttaaagctgaggtggagaagaatgactctctgtcactttcagaagggtctaaggttgaatcatgaccatgctgtccttccccatgtcacttactgtttatctaacatagttatctctttttctagcctgtatcatgcccccagattattttctatggtgctttacgtttgaaagagagtagatgatgagggtggggatgcttaggagggacaagggccctgtgtatttggaggaagtaaattaatacagcttcttaattaatttggtgtatattaaattctagaaatttggaattttagttacttctgattttgccctgcattttgctaagaatatttagctttatacttgctatcgactacaccaatctattccgtagtgagtagaatgaaggtcattaatatatttaatgtgtagccaacaatggcagatacagaaaacccaaagtaatagaatacattcaaggcagatctggcgcaagccaattaccttttctcagtatagtattctgttgtgtctaaaaccctagaggatgaatgacatcctttatgatatctgtcacctgtagggtaggattatgagttatagatgtatattcgtttcaaaaaggtacacgttctttttctatgaaaacgtctaaaaagtttactcaactttattttgaatgaatagaatgttgtaccaagatctaccaaggtagaccattataatgatctctaatcgatagctatattctttcgccatgggctattgaaacaccaagaaattaacttgcctgtctctttttcctctttgcctgccctctccatttttttctatgagaaatgattccttgaggaaaattttaaattatccactgcagttcgaaactgttaattgttcctattgcattttatttttcaatacattaatatgttataccctgtaccaaccagatacagtcccaaaacataggctagaagcagattcatagttgcctcttttatgagttcttattttaaaaattcctggtagtaaagatatgagtcagcttgttagaataatttgtctgtatgagaagtgaatggggaaccttgtgaacatcctccaatattgctacccgtttcctatcctatacccccaccctcacaacacagaaggtaggtaccagtttattcccaggtggaatctcctcagccaataatgactcctatatggagatggccctgcaattgaaatgctttagcatgcccctattcatttggtctgatgctatatgcaattctaatattctttatggcttttagaattctttgtaaattgtttccaagccacctggtttgagatttttctttcatttttaatattggtagtttggaatggagttccccaagttgcaatataggcctatgaatcaaaagtaatgaattacaattcactaatttctgccagatcaatgtgaggttggttgatgagatagaacagttcccaaggcatggcttcatcattttgttatttgaagcatattcattaagggtgtatctccacagcaccactctccaagtctgtcctaattatggaaaccattcagcagtgttaataacagttacgaaggaagagggggggcatactggcagttaaaaccactatgtttgagccttgaaactaattagatatttcatgcttggaagaagtattcctaacaggctttatgaatggatgcttgttcagaaaggtcctcttacagtaaggtaagagaaagagaaagcaggagggagagaggaaaggagggaagtggagggaggctaaatatacaaaatcagtgtctattataaaatatcggtgctcaaaagtctacaaatgttgtaccactatattataattacctctatttcctttgacatttgagtttccttatttttaaaaatgtggaacaaatctggaaagatagtgatataaaagcttatctgtactgatctacctctttgacaaagataatgagatgcaaggacatcctttatgtaataagaagtctcccttggccatcaaggcttaaattgtcctctcctcctttcccctgtcggaacataaagctgttgcaaacacttgagaggagaagaaaagaaggacatggccctatgtttctgatgggaatacggtagattaatagtgcagcttgcgtgactgtggagcgagggtcccgtctcacatgtgaaactgatctggcaggtgaattagtcatgggtcaaggagatccttgtgtctcaactggcccaattaaggtgtggttgagatgagacagagagagagtgaaggtaaatccatttccgtaaacggccagacctcttaaggattcccattccatgccacttttccaaaacatgatggagtactgcatggctaagactaacctgacctttaaacctatcgaccaagggcagagtgacttcaactccacctctactaaagataaattgatatctatctctaaaaacttcataaaacaaaccaaaaaacctaggatgttttttaatgacttattgacttttcagattgttctttaagctgttttttaaactttaaaggcaacactgataatgaacgcttccaaatggtaaaacagaaaatccccttcaaatataatcggcctgtagaggagtggctgcaggaaaaaggtaaccgtcattaaaactttcattttaaaatcatttgatcctaaaccctcatttttaaagcctgcaaataaatgttccttaaatgataatcgcctgctgcataaatgactgttttaattttcattataatttgtgtcagcttccacctgccatatgttgataaatcatgctataatacattgccattaaaatacagttaaagggactaacttctagcctgctatcagcatgacaaacacaaacaagaaattccaggaacttctaaaacagaaatgtattatggcaatttaaccactgcatgacattatttattaatttgttttaaattaccttttacaccaaagctttctaaagaaattccaaaagggctttttaaacttacacctggaggctgttttggcttgtagcatgcttaacaaaacaaaaaacaaacaaaaaaacaaacaaacaaaaaaccatagattgactcttgtaacttaaactacttaaatattgtaaggggagcatttttttttaacatttgttcttaaagaaaaaaatgaaaaagatgaattttgcctttaaaacctacagaggcaaaattattttctaagagattaaggttgtgtcctagttgctgactgaaactaaaaacaaaaacaaacttattttacacttcggttgtgtgcatacacttgtgtatttgatgttttatgcaacaaaagtgtaagaagttaacataatgagttggaaaagaaaaggttcatgaaaggcaaaacagcagtctctgatttgctggagacaacaaccactgttaataaaagagggcagcggttataactgatgttagaattttcctgtatagcttctagctgttagaaaataaaccattgtttttcaatgaaaaacagtctctaagaagatacgtattctttgttgttgttgttgttgagccagtgtaagctactcttgtctcaacacctaaagggagctcttaacatttgtagagatttcattgagttatatagaagaagtaaccaggtatattacttagtatacaacttaaagagcaaaggactactacagttttaagttggaggaagacattcagacctttaaacgtggaaaatcctcacggagtgttaactgtttgccctgtttttaatgtatgtggtctaattaaaaataagaataactctaaaaagcaaataattttgtttagtaatcatcagctcataaagtccctttaacattaaagacaatgattgcctcactttaaacaggaaaagcaaactagatgcatgtctgagtctcatgtgcctgagaaacctttttgtttctttcaattttatgttaataatttttattttactccattgccttttaagtctaagtttaatagcatgccaggcattttcatttgtataaaccattataaagttattagtaggcttttagtttttcttacaatagaattgttacccgttggctttcacataaaaggtgctttcaaatatacaagttgaggggttgggatggggggaggggtggctgaggtgggactggggaagatatcctagtttcttaaatatatgtatgattatatatgcatataaatctgaaaagaattatttgcaaaccgtgagtttctcttctacattttgttctctgaaaaaaaatttttgttgtaatttgggtgagtaacatctatgcattctattgtcttacctcttcctctgcctagctaaccttcccttcaaaaggaataaaatataccaaagacttgtaaagacaatgaatataaaggataaagatagatggatgattagacagatgcatttggaagtatttggaatgcctctttggagttatttctgtcactggggtggagagctgggtcatagcattcccaagtctcttttctggctctgtctactattgactaactttctgaccttagacaatccacttaacctctctatatctcagatttcccatctgaggacgggcaaaataatactgcctattccccaagggtgttctgaggtttaattaattagtctttgtgcaacactgactggagacatgcaaagatttaatttaagcagtatgtgaacttgatgtccaaatgaggtaataattaatgacttccaagaggatgggtatctaaaacaaaaagtaacctgctacaattcctctaccagtgtttgttataaccaaattttgcattaagaaagataaaatagttctcagattaggatatatatgcataaatatgcacatatatatatatgtttttatgtacatataatggtcagttattataaaaatctgatcataagccatgagtgaaaataatgagaataatgagatctggcattgatttggggaaatcttgggcaaatgataaaaagaaactggtcagttcttcacattcttcatagggaatgaatagtgatggttttttctgttattcactaacccctgtttatctgagagataaattaatcagagtaagggatggcaggacacgaagagtgctctactgttcctttactgattgctagctttgccattaaccacctaatccaaggtacagggagctaggagagggttttactacagcagaagagcagatctagccagaaacagaccatgaaacaaacaagcaaacagaaaagcaaacactccctatggcaagatgaaaaactgaaacatagacaaccccctttactgtctcactccatcagtgtcttattctcaagaattgattagtcagatctctctgggaaagtagctgtagtcaggagtagaggggtagtttaaatcttgtagcccaggaaacctgccttgcctttcctgatgcttgggtcagtcttgaacaggcaaagagcactttgtggagtgaatgatggcaactggaatgaaggagactcatcatctctagccagtgtaattcagctttgcattttcagttttctctgatcctctttttatttgtaagcactggcataataacaccactggagagataagatgagaactattatagaggttatcattgtgaagtattttcaaggatattagaatgtaagattttctacctgtaatcaagtataactgttaacttatcaccagtgctgaactatacacaaaataaagagatggataaatattatgattcgccagcagttgtgtgcatggaaagtatctcttggcattaggctgtctaatgtaagatactgaattttttcctagaaatctcctgctaggcagctgcttctaatttctaattcattatgttaagctgcttcaaatgcctctgtggggttgagggagaatttattttccccttccatcatttcatgtcttttgtagtaagctcagggcttccagaaaaaaaaaaaaaaaaaactgtcatcaacaataaacagtaaagaggtatgaactccagcatattacttagtattattatgcattgaactttctgctgtgtcttgtgtgaagaggacagaggacaaaatacagacagtgatgcatatgcacaacacactaaatgaattgctgagaaaatgatgaaaatctatgagatctgttttgattgcatccttgggatctgggtaattctgtagtcattaaggccagcagatcccatattcaggttctggagatttttataaagtatagatcattttcactataacaaagttctctggccaattcaccatactgcagtgttgaaagcttccaaagggctattatttgtaaatcattcttgattaatgggcactatgagttgcctagtgtgcagaattaactcttgtctaaggagtatcctctgatcggatgagcattctcttctctgccacttccatttctttcattgttatacattgagaaggtatttcacattatacaccaggaattcaaggacagatcaacattgtgtagccttgaagaccatgtaatagtggtagatttttaaagcccaaacgtgacaatatccctctattcatattggaaattataaagcaaaaagctttataattttgttaaaaaccctctttttattaagtagtcataaataacaaaattgtttctagttatttctagctaaggtaattcaggtgattagattaagaatgagtggagcgttgtttgatcactaagtagagaaaacttcagaaggcgtatatttaattccattaataagtctttcttttttcctttcttcatatggaaaagcaaaatgaagtaatctggagacataacagtaaagaaggccttagcatattgctgttctgataaattgcaataaattttaaaaagctcttactttgagtttgcttgggaaaaaaatctcatacttgagagttttataagtagaaagagttgggaggaattttagttgggtttcattcttctaaactctatactggtatgttttttcattttgatacttttcagagcagtataaatggtgtcaaagtgggaactcgaaataaagtgaactattgatattcttcaactcattaacacacctctatgtcattttaaggagttttatatgttgctttcttcattaatatccatccattttaaaaaatttattaaatctgaaggacaacttccccaggactggagcattaccaatatgcttatatttcatactgagggaataatttagttgtgggaccataatccatcctcctaaaaacaaattaatagagataggaatttatctctcatgattttgttaaccagaaaatagaatattatgcccaatgaagatttataggaaatgatacgtttggtgactagaaatgatacgtttggtgactagtagttcatttttacaagtatgcaatgaatccaagtctcttaactgaaatttaatttcagctaatttaattatcagacctggtttttaaatttagttttctgagtcacctcactgagtttttttggccatatttaattcttttcattctcattattttacttcgtagctttaaacattaatgcagtaggtatccgtaatttattctggtcatcacctgatttgagtgtttctttctgtcatcctcaattatatacccaagaagaccataatacttcttatcattgaaccaagatttcttcttcctcactatgaaggaatagagacttgattgttcaagttatcaaagattttcagctagacagtggaagagataaccataatgaaatgttacttgctaacgtcagtactgaggttttgttgtctattttttcctccccttcaattgctcaaggaagcctgttatgatgcctggtccattcagaccaggtaaggcaaacaaggaaaacgtatgagaataataatgtttcctccacccaacccactaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcaggtaggcctttttccaagtattaattgcgtctgtatttttatctttgcaacattgttatcatggtcattgctttatgtagctaaagagtttgaattactatgtaagaaggatgctggcagatactcatagtaatgagacccaggagaagagaaaggtgaagtcattgctaaagaagtcataaaagtctgtggcactcctgggttgttattcttattgtatttatcactgaaatggtaaagctgttattcaaaacgagcaatggactacactttcagtatgaaatactctctcctttaattttattaccttttcaaataacagaaagggcaagggagggaaggaaaatctgttatcatatgaaaagctatatcctagttcaatttcattcacattctccagatggctttgctataacatgaatctttcattattgaggtcaatgggtaccattaaatcaagggcagttaaagttagaagtgcaactactccttgtaaaatgcagtctttatgtttgttatcaaatcctgattaatcatgtgtcaggtttgtgcccattttgttttctttatatttgatcaagatactaattacagtagaaaatttgaaggtttgagtttggctataccggaagtccttgtttttgtggcagtttttttccacttgaaagtaattatatccaaactaagcttaatactttgctgactcccttggcatttcataaatctagttagtagggggtaggaggttaactgaattattagccttaaatgctctggcataccatgagacattccaattgctgctgcgacaacaattacttacccctatcctagttagtgtttatagaaaaatcagtagattagcacttgtcctgtttgcttctttgttttaagacattatccaggagctcagttgtgtctttaacatcacctttacactgactccaatggacgtggttaacttaaagtcaataatcaattataccacctatgtgttcccatttttcagaattaaatgtatgtgagctaggtaatggtaagtgtattatctgttgccttcctttttccttttccttgagcagaagtatccagacagctctttgcatggctccacagtaacaatttggagttatatatgctgacagtgtcataagggcaattttatcgttttcaaaaggcttctaaaaacctggttagcatagtactgttaccgtcacacatgctattacctgcatacctacacacatgctcacgagaaaaaaaatagctcttctctactgatattaaaccaataactcctgacaccttgctctactcactgaaaagaagataaaaggcaatatatatttctattatgactctctctagctcaagagcagatctgtttattgttggtgaaaggatagttctgtctgcacaggtcttggcagacttgttttgtttctgtcagaatgtattctgctaactctgtgggaagcagagaagcaaatggctttttcttcataggaatggctggtcctgtagttctttttaaggccaaattttcactgaccttgagatgatttaatgttacacggggattcgggaaccaagctgtagtaattattggttttttggctttccctcctgtagcacatacataaatgggaataaactgggtgagttcctgaactctttccgcaaattaagaaagtcagaactttggaagaaaagtagggtacaagatacaaaatcttgctagtgattataactctaaacgttatagaacctatggccattttagaggagatgaacaactgggaatgccttctccaatagcctctctctggcatgtgtttctttaagtccagtaattatcgaactacatctacatgcttttccttttacttccaccaagtctacaaaaatgagttataaacctgttgagactctttggttttaagggtaagtacatcctcttggaggaaagccaatagcctacaagaattgattagactgcgatgagggattttaaaagccctggattttttggaagactaactagaggaaataactttctgccaagggttttggaaatcttttttgttcttgaccactagtcatcagaactctgccctgtgctccattaaaaacttaaaagcctcatcttcaagcctagtctggtcttaaacacattctgttgatcacatcaaacctatgttaggactggggacccaacaactattggattctattcaaagtttaggacaattcccagactctagagactgcaggtaaggaaggtcagtcccagaagcattaatatgcctatgtgaccccactacttttcttagatgaggaggattcataaagttctgatctctgggagatacttcagaagtgagtggggaaaaaaaggtagggaagactggatttcatattcaccgggcccattattcacttttttatctatatgtgaaatcatacatagaacattttccaaatgataccactgttctgtcctcttttgctaaatttaataacattgtcaaagcaaagttttcctaaaatgagactcctctaggagaaagaaaataagcatgtcagtccaccagtataaaaacctgtctgttcaaaaatcctctagttctttcttaaagcataagcaaagaaaacatcctttcaagagttctttcctggtcaacctgaggtagtgttgatttcagatcaaaggaaaactgtaaggtgctttcagtgctgcttttaaccgtgtgtgaatgtgaacaagtagtttttgagttggtatgtctgtctagtgttatagcctcttagaagtaattggtgctttgatctttctgattccattttgttacaggtaagagtgtagaactatctgtgaataacctggctgatgttaatttactcatagcaatcatgcccaagcatcaggtcttgatcctacattgagaaggatagctctaggtactctattgaattttaaaaaatttaagatgtgcattgagaaagcaggtgtgtgagtgataattctcaagtaaaggcctggcacttcataggtgctcagtaaatatttactgaatacatctgaaaacaagacaggctttattacctactttagagtcatttcacaatggaaggtagcatagcttgaggaaagtgtttcctccacagtgatcagggtgctttggccaaatttgttgtatttttcagtagtaaggctatagcatagtgattcagtgcatgcacttggagctagattagctgggtttaaaactttgttcatcctcatattagcttacatgaccccagacaagtcatgtaagttctagttaactatttatatgaaacaaattttcccataacttggtggtttaaaacaattatgtcattagatttcaaaattctgtgagacagaaatttgggcacagttcagcaaggcaattcttctgtgccatctagagagatgattgtgttcactcagtggctgactttgcctggagggtctggctttatttacataccttgtgctttgctgggttaactgggaagatgggactcagcagggcccttttccctctctatgtattctctgggattctccttgtggtttctccagcaaagcagatgggctgtgtttatagaggctcagggcttccagagagagtacttccaggggcaggaagtagagggtgccagttttatatagcctgggctgggtaactggcagtgtcacttgtacaatatgctattagtctaaacagtcacagagctttcccagtttcagaggaggagacataaatatcacttctcaataggaggaggagtagcaataatttgcaaccaacctaagtctaccacattactaaggctaccatattataaagtagggagggtggtgtacttctagtggctatgttatatgattgtcataaggataactgagttgatataagtaaaatgcttaaaataagtgtaccattcaaagtaagactgcatgcgttttaaccattattattatattctgtttcccacaattggtgtattaaatcaagatcctctcaggcaaatatctgcctcagaaaatggggctgtgactaccgacagtagtggctatagtttagagtaagggctaggaagtttgggggaaatagagatttgaaggtggatccaagcagaatttaggggctgaaattagtcctggcaaatcaaaatttctatgatctcaggaacagacttctctgacacctcactacccatctttaaagttctgttttattttaaaccaacttagagttctatgagtctttgaaaatatgttctgtctatccacatgtcttttagggttgcaaagaagacaaatccagattccttaccatcgtggaatttacaatctaaatagggcaagagggtttgacatgagctatccatatgaagtagtgactcatgaatggctctttgtgctggggatggcaagtgttgcatggtgtggcttgactggatctcatgcactcattctactaggccttgttgtaaaaagagcacaattggacaggtggtgagaggaacatattcctggttggtcaaatgtcagccagaagctaagttgttaaaagcagagattataatctctgggagagatagccaagtccaagtagaacagagaatgcataagagggagtttgtgagtagcaaggggtccagaatcaaaatcttggcctgaaactttgccaagtgggagagggcccagaggggtaaactgaattgggttccctgtgtaccttactaccaggaatgccccaataattgcacaaacacttcctctacaactgactccaatattggtgggtaattattatggtgctgataggtcagcttctaaaatagaaaagttcaactcagtctacactcaaattcgttggtcttccttcaggatagaaggaaaaagtgagaaacaagtcttttaccttatgtctccatcctgagttatcagcagaaaaaaaaaaaagctcagtgtgttctgtgcaaatcaccatttggaatcatttataaactatttgcaggatactgatcatgacatactttttctgtgttgggcattggtaaagtcaccttgacattggcaactgctgcctgaaaattgccagaaaatcacaatgctcagcatggattggaactatccttataactagtcaaaatgaaagacttaagaggtttgtgagatttcattctcaagcttcacaaacttggtggttgaatgtgaaccacttttgcaaattccagaaggaagccacaatttctcatgttttgtaaaaattcttataggcaaagtactcttagcttttcagtgtcagactggagacagtaagaagcatgcttcagccttgatactgatgattacaaaacaaagaaaaaactttggattaaaatgttcatcctgcgcaacgtctgttctgggtagagtctcagtgtgttgaagagcgtgggcttttgcgtcagagtttctgagttggactccaggtttttccagttgcttagctgtatgtataagtctgttctcacactgctataaaaaactacccgagactaagtaatttataaagaaaagaggtttaattgactcacagttccgtatgcctggagaggcctcaggaaacttacaatcatgatggccggagagagaaaggagagtggggaaactgcccccctgatcccccctcccaccaggtccctccctctacatgtgcggattataatttgagatgagatttgcctagggacacagagccaaaccatattgctgtatatctctgggcaggtgattagcctctctaagcctcagttttactgtctgtaaaagtggccttacagtacctttcccgtaggctccttgtaaatagtaaagtgcaatcatgtgtgaaaagcaccccataacttttcagtaaaaattttcacataaggaaaccacttcaacctaagggactctcccagaactcacagatctccctagagcttagccttcctgtggggctggataagcccaggaacaattttgtttatactcatacaaactcacaagggcctggattgtgagttcttctaagggccccagattgaatcagagccccaagctcatcaatcaggagagattgctacggcaggctctttcatattctggagtgggaattggctttgctgaacagttacaacacatagactattctattaggttgaagtgtatgaaaccactatttttgtagatcaaaatggttaaatattagcaatatcacatggttctacgatgacacacagatttacagcatgttgttatcaatggcacttcgaggcccagactagaacctcagatattctccaggtcttcaaataatcaaactgccttgcactgggagacaagatagatccaccttatccccaaatactgtgctatagcaggatgtagatcacactgtatcaaaactggttatatttacccaaagaattatcccctctgggtccttccaccttttccctgctgccaccagcttgagagaaatgagataaggaatctacacagttttcatctccttgcttttaccactagacaacagagcctccgggggaagtttatttttaggatcagggctcaactaatattgattaacagccttacataatgtgaggctccagggtttgttcttttcctgccaagcctcataactggagaaggcgctgaagatttgtcagtctaatcagactttagctgccagccaagaaatatcttctgtcttctccttacccttacgcaggtactttctttttccctcttagagaataatttggggggagagaaattgcactctaatttacttgttgcctggtaagattctctggtgacatttactctctggaactgcacagttctaacaacaacagaaaagggagcttgatgggtttaccttcctcttaaagacttagatgttggcagtacaaataggcaagtgaaaagagtgcagtgtagtttgttttcatccttcctttaatacgtaattttggtggatggaacaggtgctttccaaaactaggtctagtcgatgaaagggtcctgagggcagacgaagtgtgaaagctcccaggagaattcatagagatgcccttccaattaggatgtaatatttacaggatggaatttccaccagaactactaataaagtgctggctcttatttctaggcatctgaacagctgggagggaagtggggtcagttcttggctacccacgggtggaggtccctgagtgtttttaaacctcagggtggtttttctaattacctaacagactctttagccgaatctaaagccaaaatccttgctgcgtggcatatggttctcctccttcctattgctctgaccatattttccaccacgttgctccaatcacacaggtcttcttgatccttcttgaacacagagcaagaagaagggtgaaaccggtgaggcaggattatgcaattgcaagcttagattttcatcttaaaattgatatttgactttttgcttttgcagatttttttcctgcattaatattgattttaaaatatttcagcaaatgaaaacaaagttttagcaaacccccgttaaatcttacaccttaagcgagtgtctcattcaatcttctcagccctgcctgaatgtgccaagcgtgcctgtgccttttcacctgccatttcctctgcctgcagcagcccttccctgctattcacagtactcactccctcacttcacccaggtttccgcttatattgcaccttccagaaaggaccttcttgaccgtctgtaaaatacaacactctatcgccttttcctgttttgttacctctcatagcacttatcactgcctgacattatagctcacatttatttgtttattgtccctatttagtagattgtgagttctaggatggcaagatctttattttaggcactaaaatagcacagtgcctagaacagtagcgagcacagagtaatacgcagtcaatgttggttgaaaggtataaatagtcaaccatccaccagtaccttctcagggagtccacaggccacacaatatttacaggctgaatccaagcccctgtttcccaggacccactccctcatgaggctcaccagtgagggtgggcaccactgggtttgctgctcttggatctttgctctaggaataaggagtcccagagatatctccttgtctctggtatgtaagattatttttgttagcttccagtcttgttgctcagccaaaagcaagggctaattctagcacgtatagttttcaaatcacttttggaaatgtaatatcacccacctttccctttccagtttcttcttcttcctttccaaataacttaatccttaattctcctaaaacccactttcaaatatatgcaaataaaaattacttggtaaggatggaaaattaacttgaggcttttttacttttttttttttttttttttggtctgttgagaaaagggcttgtagggtggtgcctgcataaactggccataaaaatatgggacaataagttgttgaaagccacaagaggcctctgaggaggaaagcctcctaaatgccatcatgttcccaggctcagagcgagatctgctctcttatctgtaaacactgtgttcaaaggagaaagactctgctttgaagcattgaaatgtggccagatatgctggctcctagtgaggcccactccccccagctgctctccgataaattaaagaataaatcagtagttaattttatgctgcttcagcacaaagaaaatttacctaaactgccattgctatagattaggtgtatgacacaccgcccccctttcaccgtttcacccctgaacatctgcttcttagagctaagtgattgtactcaacaaatagtgtggagaccagagcttggcgcctttgcagcctccattttacacttggccccctggcactccactctttatgcactcttaacctgtctattctcattcgtttgtcgccaccggacttcgggtaccctacgggtggtgctgaggctggtccccaacattggtctaatggctgagtatattgtgtgagcaccatttattcatgtctgaaaccctataatttgactagccccatatttacccatttttagtgataatttgaaaaaacattgatgattgagagaaggaacaatagctatgttgctcatcattggacatttagagcctagaatggtgcctgccacaaagcagggctcaaaaatatcagttgaagaaaaataaatgtgttaaacgaatgaaagtaagttaagcaaatgcttatcatcagagtgaagaggcagtgggggccaatataatttatttacaaagtaggcaaagggagttaggaggaagcagcctggtacggaggaaagtgcattgaagcaggcatcaggagacttagctcatgactggagaagttcttaaaaccatgactctaggcagaccttcatttctagctgtagaattttggccagggtcctttgtggagctatgtttttttattatctgaaatatggggatgatttccaacttcaagggtaggttaagataatataagtcaagggcttaaatgggtgcggctcaaagattattattgctgctgtcttaaatgggattataatctggtctcagctgataaaccagtattgcaactatattttcttttttattctgttgctagtttgtggtctctgatatggcaattagcttccttgggcctatgctctttcctcagaaaagaaagttttattttaacattatctagcatagtgtcttgggcacacacacacagggacagttaaatgtaggaaacaatgaattagaagaagtaaaagaaaggagaagaagtaaaagaaaggaaaaattgagaaggagagaaagacagcagcgatgctctgtaattattgctataagaattacgtgcccatttcatggatttgtatggcttaggttgagagagatgaataaaatatctttgatataattaaaatcataatataaataatattttttctatatctcccctctttgctgaaagctgttgggtgagacatcacaatgaccacttctatgtaaaaggtagattatagatggccctctgcatatgtgggattgcatctgcattcaaccaactaactgtgaatcaaaaatatttttaaaaaattgtgtctgtactgaacatgtacagacttttttcttactattattccctaaacaatacagtataacaactatttacctagcacttacattgtactagacattgtaagtaacctagagatgatttaaaatgcacaggaagatgtgtataggttacatgcaaatactatgccattttatattgaggacttgaggattttgccatccatgggaggtcctggaaccaatcaatcccccacagatgctgaggaatgactgtacttgataaatgtctcttgaatcatccaaaaaaaagaaaaagccaatggtttcaatttaaactgaggtaagaattgttttttttttttctgaaaatatatgatgttctatttatatataataggaaaacgacttcaagcagcaatcgtcacttgccaggcatcaaggcggatatttccattatgtctatgacaaggtggtgggaggggtgggatgtggtttcatacctttctggtgcatgtttgaatgattgtaaaaattagaaacacactgaggctgttatgacagccttgccttttgaaaccttctaattaatgccttgggttgtctagagagcttgttctgttagctaaatggtgatttgtaaggttctccttgatttcctcatcattcatggatgaaataattggggaaataaaatgattggggaaataaatgcacaccacgtctgtggtggctagcagtcactgagagaattacttgatgggaatttgattgacttgtgtgtataatgcaacctcttatatctctggccccatcttattatgtgtgtgtgtgtgtgagagagagagagagagacagggagagagggaggatgctcgtgtttgcttgcactatggagaacagtgcttcttaaactttaatgtgtgtatacagatcacctgggtaatcttattaagcacagattttaatgcacgtccggggtggtatctcagatcgtgcacttctaacaagctcccagatgatctcatgctgcagatatgtgtacctcactatagagtatagagcaaggctctaggaaatatttacggttccttgctgagtaatcatggtatctgtttacctatctcttccaaatggtcttcccaaacttagctcagttctcttcaagacaggaaattttgttaacccaaagtattaatgtaagtgaaagggtggataccccaactaaggattagaagagaaaactgtatcccatcagacaatgctgctccgggtttcagatgccccttcttcctgtcccttactttactgcatacccccaaggcagatggaaaaaaacataggtaaaatttaacttgtcataatatttatccccctttctgagaggtgacctccaatggaagcagaaggatgtgaatgattttaatccacggtaacaatggggagccagtcctgaccatcttaagcagtataaatgtataaaatgacagatttttctgctctgcctctccactttctcctcccggatactgagagagacacatattcatgcacccacaactcacactataatgcacaatgaaatttcacccagcctttatctcggggctgctgttctcatgattaatgccctactggctgggaagctattccactgaagacagacaaggagagaggaagatgcatgaaatatatctctgaggccatttctcattattattattatcattattagttccttactaccctatctatctatcctgttagaggatgcttgatctattggcaagggggaggggatgacatttgaaagcaggttttatgagggagaaatgaacaaggacaaagagagaaatagacagtttttatgaaagagaattaacctggatggggtttttgttatgattgttgtcctttatttgggggtttgtttgttttattgttgctgttgttttccatttaaagtcaaaaataatagatgcctccatctgcggcttctgatttttttccctagggatttatttttgcatgtgttcttttgtctttattgagtctctgtctgctagaatcaatatgatataacttatgcaaattatatccctgaccacttatgcaaaaaacagaataatttcgttgctctgtaacactcttaatataattacctccatatcctggttgatttcaagcttttgaaagggctactttaaaaaaaaataataaaaatctatttatgtgttgtataaaccacagtgtctgattctctcctgtttctcattcaaagaaagggtgactgctaaatgatttctggctctgtcatttaagaagactgcacagcagtggtcttagttgggaagttgggaccacaataagagtgctattgtaacacgtgtctactgataaaatggcaaattcattagcctagacaaggagtactatgatctggtttcaaaaatgctgtatacttccacagtccagtttatgagggcatgagatatataactgaggtgcccccatgttacttcaattttagtttgactttgaatttcattaaaaaatatttgagttatttgagtgcctagtatgggctaagtactgtcctgggcacttgaacaacatcagtaaacagacaaaaaccctcttttcttatggagaacattttctattccacaaacattgggtgtctcataagtgcaagactttggagaaataaagaatgaaatagaaatttttctgctttagaggaacacacagtctggtactgttcttaaatattttcagactacaagcggactcacttgcagcccagttttttacaaaaactttagcatgctgattggctagtacagttgcaaaggcagcagccatctatatttacagaggtctattccaagaatagggtctttaatttctattcaaaaaagaccaaatttcaaatgtaaacaatatatgttttgactaaaaaagacagaaaccgtaaagcaagttacaataaagtgattgaaacatatttcggtcctggagactaaatttgcaatgtttatggcaaatatcttcttgtgttggtttgagattatagttttatggaatgtttatattggaagaatctcagagattgagccccacacaaccagatgagcttcagagatgggccattctggtttcaagtactagtttcattgctcaaagctctacgtccaggggcaaattgctcaaccactttataaaaaatgtaaacaacaggtaatttcacattttaatttatttttatctaaacaatatattcacatagtttatttttagtgtatatatgtatatatatttatttcttatttatttcttatttatatatttatttatagagatgaggtcttactttatttcccaggttggtctcaaactcctgggctcaagtgatcctcctgcgttggagtgctgggattagaggtgtgagccactgtggttggcctaagtaatacagccacacaatttaaaaccttgaactgtgcctagatatcccctttggggaaaaggcatcaccttagttgctagagtgctggctgatggctgttggctaaatccttcacgaagaactgcctttgactattgaagccaccttgcccaaccaaggtcaagccccttcctgaagggtggcccatatccaattaatgatggtgaagggtggcccatatccaattaatgatggatgatggagctggggggatctatcaagactcagcccattgtctcaagactggataactgggaagggccttttagctagagagtttcctaaggccagctgaggtctctattgcatgaatgttcacctcccccttctgcccagactctgatgtcactctccccaaacttcccaaacacgataccgggcctcagactttgttttctgaaaacgcagctgaagatagatagatagcatcgtgagacttaaaataagaaaacaacaataacaaaagaaaaacagtagtatctttctaaccttgccctaaagtcctgctctatactggtaacccttttatatccttttcagacatttcccttcatagttctagcaatatgcttgcatttctatttcttgactttttcagtttgacatattaactaatgacttctgcttctggaagtaaaagttgagctttctcatgctctccctgccctacaacccacacacacttttttaccttccagtttcccagtaaaattctatcgcatttcgattaaataaatgttcagagtttgttattatgactttgtaatatcgcctattgaaaacaatgtaagatcatacatgaactgacttgttccacaactattcaccagctgcatagaatgtgccagacactgttctagagactgaggatacagcagtgaaaaacaacagactatatttctacctctgacaaaacattatactgttatgacaatttctgttttcctgtaactctttgtttgttaatgaataccctcgttatctcgttagcttatttttctagccacccatcagtgccacagccaacagctacaaaagacctcacaagataaaccgacaggactccattatttctttttctgtcttggaggtctcccttctggagtcgtctgacctcctgctttagtctgggctgggcgctcgctgagcctgcctcacagctatcatcctgcgtcttccttgctcgtcatgctggaaaatccctgggccctgctcctgtattaaatcctagtttcagctctatttatttcctcattttcaaggtgcacattgtcctgtagcctcctgagaaaggatagctaaaaagtaaaatcattgagacattgctcatctgaagaatgttttattccattctcacccttgacgataatttgcctgggaaggacttgtatcttggaaattatcttcactaataaatttaaaagcatccgtccaatgtttttgggcatccaatgttgcagctgttgacatcacagtttggtgtctaattccttgactgcactgatttttacttttttttttttttttttttttttttaccctctctctgaaatatccttatcagtggacctcaaagtagcacttacaactcaggtctcttgaaccacatgctgctgccccctatagttcttgcttttgtaaagttgtggttatttgccgattagctgccctgtgttggcatcctgactttggtatgatttgatgagctaagctattactaaactataacacacacacatacacacaaaaaatgaatagctataattaattagcataaagttttgagggtaaccaactttagtagagatctgagatatatataatgtatatatatatatatatatttgaacattttgccttgggttagagagggaattggtggtacagtaattcttactggaattgtgtagtgatagctagtttatatatacatatatatatacatacatatacatatacatatgtatgtatatataaactagctatcactacacaattccactaagaattactgtaccaccaattccctctctaacccaaggcaaaatgttcaactcttttttgtattcccttaagagcccttattttttttttcagtttcaccaatcatgttcatttcttagccacctcagaaagaatgagaattaaataatatgtataaaccctttgaattttttacatccagaaatgagcataagctcattcctctgcttcacaccagatgcttatatttttgagaggagcaaggattagaattgtcactctggaatttttatgctacaaaatgtcaatcaatatgtttgcatgtcactgggttccatcctacagtgtttggtgataaagtcttttcatttggctcccagctttatcaccataatatatttatttactttaccttacatgtgctagttggtagaagctgtagaaaaagaattactcccacatatttctttcccctaaagagaaacaatatattgtaagaacacagatggggctccacacaaaaagaatgccgaattaatgttggatggatgtacatatacaagaacttgctatcagtacacaattccaataggaattatatatacacacactgaaaatagaatttgattaaataattacactaggtacaagctacattttacttccattgaaggagagctaagtggaaactagtgtgagacaatcatgaatagaaaagtgcagaaggaatttgatgaggatgttcccagggctatttctagccagaaaacgaagctggaggctttgaagtaaatcaaaatatttgaagaagtaagaggataaatagcaaaactcacttccaacatcatactaaaagcaccatgcaaccatatagaaaacatgcataatttattttgactcaaataactatagggagattcttgttttttttaattaggagatttgaggtaactgtctagactacctatttttatgttgcattcagcaatatgtctgctaataattagagggaaataaattacataaaacaatgccagtcatgtcattgataaaaaggaaattaaagtgtgattgtgtttctctttctctctctccctcattttcagtgagctacatcctcttgttgtcctcctcacctgattaggcatttttgtaagggagtttgcctccgtcctctgttgtaaacattttccttacctcagcatcctttttaaattcaaaagacactttcctttgcaatgcactatgaaaggcgattgtgttagagaatatcagagatggctttgtcatgtctggtgctcttaaatccttttcttttttttcttttcttttcttgagacggtgtctcactccgtcacccaggctggagggcagtggcgtgatcggggctcactgcaacctctgcctcccaggttcacgccattctcctgcctcagcctcctgagtagctgggactacaggtgcccaccaccgcacctggccaattttttgtatttttagtagagatggggtttcaccgtgttagccaggatggtctcgatctcctgacctcgtgatccacccacctcagcctcccaaagagctgggattacaggcgtgagccactgtgcccagcctcttaaatcctgttgtgtcctaaagagtccactaaacgaggttgagggtatgatttgacaattgaacaaggcctcagccagctctcctagactgccccaaaactccctgagcagagagacccaggtggtgatggaagtatttttcctctaaaagactgtggagattctggcaaacctatattttgggtttagctttcaaggaagaggtggcatttgaaaagccaggggcctttgtagccattttattcactacctaatgtgaaggtggtggcagggaatggaaaagggaagattatttagtcgataaacacttaatggccactgcctgctgtgtggacagatctggatagagttaaaaagataataaagcaagtgtaggatgcctgtcttcatggtacttatatcatgggaagaaggcatgaacaaaccaattttacacataattattcaatcacaatcatgacacagtgtgataaaggaggacaggcttctaagacagcagaaaaggacctgaggtagtgttgtcatctggggaagctttcttgtagaagcagtatagaagctgtcctgtgcaggatgagatattagattgcaaaagaggacaagggccagtgttcccgccaaaggaaatagcctatgctgaggccctgctgtagggatcatactgtatcgcgttcctctggctttggactacgcattgatgctaaagtctggaagcataccatattcgaccaagtaaagtgaccagttaaggtccccacttaatgggctaaagataggtcattccaagagtgagcctcccattattatgactcatgacaaaggggtgtgggactggttggaaaagagtttccaaagctggactgcatcacatggtcatgtggaatgggctgcctgctctcccagtctgaaccctacctctgtgctatgccaaaggtgcagatccccttagtgaaaattggagacatgaatcatttaaggcaatgcctcacagacccatgtgcaaggttccatggaatgtgttaatatatcacactcatctcaattttgcacggtacatgaaactatgcttgctgatgagggaccatacacattgaacagatcatataatggttatggatgtaatgtcaataatgtcatggaacctatcatatgttgtaatatcaagaaaccttttagcatgtacatttgtctaggtttctggactttacagccttctggtatttcacttgcttgtgtctttcattgaacactaataaccagaaatcagcaacgtgaaaatttgattcttcttcctatttttctcatgccttactttggtctttctttctgcttggtggaaactgcggagttcagtggaagttttcctgcagtctaattagcccctctgtttaattttgtaataaaaacgctgaaccagaagctggagataatgtgcccaattcaattcacagatgtcaatttctttttaattgtaatccttttcttgagttcttcccactcttacttccctggcacagctgaggcttgggtgattacaaaactttcatgcctacgctggagattatgcctcctgctttaggattaaattcattcgttatcattgttgtaattattagtagtaacaatgggcatttccacccaaacctgatgaatagtagttttcacagtctttgcctccaaacttagcttatttcagttctttgcccagataagttcttcactctttaatggcagggagcattccgttttctgttgcatttaaatgctattttgagatcattcagaagacaaggctctttttcctttttagcaggttctcctgggtgtggagagatggcttctttccccagagtaggagtcaccacttagtgaatgctaatggggtcttttcttcgtgatgcgactgctgctttgaagatgcatttgaactggcaaggggcacctcttagctgcaatctcttccttagaagggtgccagctccaggccctaaaaagcacacatagctttgacttccatgctgactccaaaagaaccttttctctgcctttttgatggagtagtccctaccactaacagaacagcagtgtggcccaaccaacttgaaaatggaactggctcctcagcaacatgctaattctttcaaacttccttgtcagactcaaacctcgatgtgtcttttgttcttaaactgcatttgtagtaagatcttcaggaaaagcaatcagtgagagactgggtcaggcttttatttaattactttgcactttttttccccctctgaaccttctccaaatcaaaagaaagcaatgcagtttaattctgaatatatgaaatgtttgcactttaaattataaatgtctctcaacgataacaccttctgaaaataatgctccgtgggctctttagaagaatatttaggacagttcatctcaggtttaaggtgcccaagctactatagtgccctttcttatcttggttttatgtttttccactatggcttactgatataatttcctaatccttcttatctcaaatgtctcttagaccgttaaacctttgcctataaaatgaaggggtttgactttgaatctaaaggagtggaccatccctcaagcaccctagtctctcagcgcattcattccacaaacatttttttgggagagcagggtgattcctgctatggacccatcacccttgtagactctgaggctgcaatgaaaatacaataaaatcagtaattctagttcttatggaacatacattctgggagtgggggcagagactaccgataaataaattagcaagagaatataatatgcagggacaagtgctatcaagaaaataaacctgcgcaatgtcacacagaatgcctgatgggtgggtaggtagtttaggggaagttactctaaggaagaaacatttaacctgagattggaatgataaaacatgtcaggtctgtgaagtctgggggaagaacatttacagcagagggaacggttagtgtaaaggcctttaggctggaacatgttgagcagtgtttgaaagatgatgaatatggctgtagcagaagaaatctggtgtgaggtaagatctgagaagtggcagggactgaaacagacagggcctgtttggctgtggaaagcagtttaggttttataaaagtgcaatggcaaactattagaacgtactaagtaaaggagtgacatgatgtgacttatgttttttaaagattactctgccatgttgagaaaatattgtaaagcagcaagagaggaggcagagagacctaatacatggctattgctttaattctgatgaagtttgattgtggtttgaactagtatagcagccaggcccccactacaggcccacccagcttgatggcctcaccctgcatcttgtcctgtctctgaactgctaaatctcaaaactttaaagccctaatatcttgctgattaaccataatttccaaatcttatgcttaagtccaggcagtttttaatttttttttattttttggcttcagcaaatttttcatttgtctatatctataaagtacttctcatcatcaacccagattcctttttctctctgttgtgttcattctagatcattccaaatggtctctgttccttctgccttcaacctggtcttagaagacttctctgttttttatctctcccccattccacctccaactcttgatcagcacctatttcaaactctcaacttggtctcctttttcactttttacacacttggattttaaatgttaccttcttttagaaaacaatgctgaccagtcatgagtttctttgaattcctccatgcttatccacatcagtccttactttaggggaatcccttcgtccctttgtttgaaatcttatgctaattatctcttcactcgggtctcttcccaaggtttggacatcatttagtgttctcattttccactggtgccattaatatcatcccgtcatcatagacatatatgtgtgtgtgtgtgtgtgtgtgtgtacatatatatgtatgtatgtgtatatgtatgtgtatgtatacacgcgtgtgtatatatatgtatatatacacatatatgtgtattgtgtgtatgtgtatatatatgtgtgtgtatatatatgtgtgtatatatatatatatatacctttcccatttcaaaaacaaaatcaaaacaaaaaaggcaattatctatgaacctgatttctgtcccttctattagcacttactgtccccagatgaggacactctttcacttccccatatgctcaaatatcctgaattttatactctcactgattttactttctaaacaaggaatatatacgtattgtagaaaaaaatcactgtgaagtaaattccacccgtgatccaaccctccagagaaaatcgtgcataaaaggtcccgcagattcccacctgtctttctttccttccttatctaccaatattttttcacatgcatgcaacattctagtcataccttgttatactttcagacatgttctttctacttgagcacatacaacatacaacttgagcatgcttgtttatctataaaatgaagataatatgatcatttctgtaggagttttgagtcaaaaataaatttatgtatttcaaatgcttagaatagtgtctgttgcatagtgacctttcaataaaaattattattattattgctcttttgtccactttatctacctggaaaagtaataatccctcaagactaagttgaaatataacatccctggggagtgtattagtctgttctcacactgctaataaagacatacctgagactgggtaatttataaaggaaagaggtttaatagactcagagttccacatggctagggaggcctcacaatcatggtggaaggcaaaggggaagaaagacacgttttacatgtcagcaggcaagagtgtgtgtgcaggcgagctcccatttataaaaccatcagatctcttgagacttattcactactgtaagaacaatatgggggaaactgtccccatgattcagttatctcctccttaataatccccttgatgcatggggattattacaattccaggtgagatttgggcggggacacaaccaaaccatatcagggagttatccttctcctctgccatcctgtttcactctgccaggctccttttctcagtgcctccacaagtggtttacttgttgtgatgaacactatgcacagcagagagtttaaggaccttagtcatgtttcctaccaatcagcggttggcttcctattaaacctttctcgatgttctggacctctagagagccattctgtgctgctatgcaatctataatgactcttcaactaggtttctattcatttccaagtcttccctaccactgagatacttcaaggagatatgagtggatcatgaataaatatcctaaaactaaagacagttaagtcaattgcactctcaatattatcagactattttaactaatatgctatagacaaataattcttcagaatggtgtttgctttgtgtgtgtcataagagattcttgtctttagagaattagggaataatattaaaatgaataaatagtaaaggtgggaatatttttaatattattaaaataaataaatgattaaagtagggagcatgtttgaaggtccattttaaaaaatatatgtagacagaggaaacctaagagttaaaatactgagtgagttttgctctgcatcagtggaggctataaaatgcagtatttatctgtatatgagttctataccaatgtgatctatctctctaattagatagtcaactatttttaaagagctgcaaataagccttacaagaatgtcataaatgcattccatttagaaacatcttgcagataaattgtatttttattcttcctgcagcctcctgtagccttaaaagaataacaaaaaataaattcttactacctaattccagacacagatcattactaccagtagtatgttaatcatgcttgccattccttctccttcgatatcattatgctttaggatagaaaaggtgggtggtatgtgagcctccttggataaacaaaacgttggagtgcacaggcttctcaagaggtacaatgttattttcatgcaaaaaaatcccaagtattacaaaggggcttgaaaatgttgaaaacacattgtgaataagtagaattactaacaagagcactgtatcttttgcttcgataggctctttcaagatgtagacaaattggaggtaggccagacagaatctacgggaatgattaggggaattgaaggaatgacttcggaaaaaagattaaaagagctaaatacgtataggttggctaagtgccaactcagagaaaatgacattatgggctatagatatttgaaagtggctggctataagcaaagcaagggattacttaggtaattggattaaatcaagggggtaaacattttaaactcaatatctggatttattttgttgactataagaattattagattttagaactatcccataacctactgcttggattaaagcaagaggtagggtgtggtagcatgaagtctctaatagtttacccagttctgagcatcttgttgccaggaagcagatcttactcacttttaatccctaggatttagcacattaaaagaactccatagagagctaagtcatgtttagttcagcgagaagaaaatggtctgtggagtcagacattacagattttatatctctgctgttttattgttctataacagtcagcaagttacttaacctaagccttatccataaggtgcgtattaatatcaactttataggattgatgtgaagtttacatgagttgtcttgatctcttcttttacctatttaacagcggttaaatacacccctcctctccatcatcactgccattgtgttccttctgactttagtaatgtcttcaatggtttcctggattccaattttgcctatcttcaagtttccacaatatagtcaggaataactttttgcagcgcatgtatgagtaagcaagccctagcttaaaaactccaatggatcccattgcctgcaggataaaatcgaatatccttaggatgacaaacttcatgccatcatgcctgtctttctaattccaactcatattaccctacccttctcacataatgctctaactacattcacttgcttgagtttttcttttgtaccttgtacaaatgtataaacatgctggttcctctgctgagaacccactttccactccaatttgccatttctttgccactctttgtcttctgccttgcttcacactctttctaaaatgccaatctcagattttacctcttttgagattccaggtgcctctcccatgtgtttccacagtaaatggagcttatcattatcctgctattaattctactgtgttctaagtgtcttttcactctgcctctcctaatagatgttaggattcatttgggcagatacttagattagtgcctaccatttagtaggcattcaacatatttttagattcaaagaatgataaatggtagatggatagatggatggatgggtaggtaaaaagatatatggagtgtaacaaagtacctacaacataagaaattatcaattaatttcagttttctttccttggagttttgagattaagaaatgcacttcgttgtcccgaataagcatagtcttgagtgggctttagtcagagttatttgtgtgcatttatgtcgatactacccactccattctatcatattgggaaaataatgcaatctcgaaggaataggagtctaggaaacctaggatataagtgagcacataccggagaaaaatatgccaacatagtagcttggaggaaatacttggaaatatcttgcctttatagctagatatagaacttcattttttacaactagaagctttgtgacttctgagaccatgactgaagaaaaatggaaatgaagacaaaggggactgaaatgggagtggaagtaggaaaaggggatccatagacacaaaacaaacttttccttttacacactccatttccctctctggtgcttgcccatggcccagctatttaaccttaagacacatggccagcccccttgtctagagtttgccctaattgttgggcgcattgtagcgtcttagatgatcaattgctcatgccaaaagcagagtgttaagattcatgaaattcgagtctgtgctattaataacctgagcagggttttcatgcctccttcccctttgttttctcctttgccaagtctccattctcactcttttgtggatgtgtgtgttatggagacgaatgaaatttcagacacagcaatgaattgccacctaaaaggatacaccccagggtcttctgtgttcctttgcagctgtgtgataaattgccatctccaaaattaattgttaccttttcaggaagtgtttactcattttcatctcctcactggcatcagtgaacctctgagctagaaaaaccaactttcctttcccttctcaagcccttgatatgcagctagaacggcaatcagtggagctgacaagggcgagcagtggtacctccgtgttgttctctagcccatgaattcaatgaacatccaggctatgcctttcatctcaactgccttttaatagactaacccatttctctttacttttggctccacattaaaatgtctataaaattttactccaagctaggtcttccaggtttacggaagaaggaacatacattcagcaaaacagttttctctttttgttagatttctgctgttctcaagagctgaaaaaaagtgtgatacttcacatgtactctttaaaaaacttactaagcctgctcagcttttacacagggtacgccggcacacaagtgtgacctggtccttactccatcctcaaagataagttgtccccacagtctgccaaaaagatgtccctgatgcaatgagaatgagctggagtcctgactgtgctacatttttagtggtatcctaactctctattccacagacatcagaaaatgtcacaacatactctttgtaactagtccctttattatgtccatgaatgtaatatatacaatgattttcaaagagggtgatttttcacccctcttctctccctgccccacatacaaaggagactttgcctatgtctggaaacatttttggttgtcacaattgaaaaggaatgtatggaggtgttgctgttatccagtgagcagaggccacagatgctgctatacattttataatgcacatgaactctggaatatataaatcaagtaaatctcagtattctgccatgtactctgggagatacttaaaattataagccatgacttctattttccaagcattttggagaaaaacaaccaattttgtttttgatttctgactatatggtagagttcagctacacagtatatggtactttaacaaagctatacggtagctgcaagacaacaccatggctgggcccttcagagcctcataagtgtattggggacactgagaatctagtaatagactaacacatatgtaccaccattgagtggcatcaaacatgctttcatttagtgctgaaattgatgatataatggaggctagaaagatctaataatgaaaaaaagaggaatttaaccagtcttgaggtgatcaaatgaggaagcagaaaggtaggattgattgtaatgtgtgcacagaggagtgaagcctgattacctgtactactcattgccagaccttcaagaatcgcgtgccaagtgccaggtgcagaagttgcaaaactgtttgggagatcaaagagaaaatatcaacctggctttcaagtcttttcagggtgctttcttagaaaaactgtttttggtcttgaaacatgggcaaacattggctgcgggccaagaaatttatagttcctgaggaactttagattgatacatgtctgacaatttccattttgcaaaacaagagaaggcaaaagtgggcttggaaggcattcaatctttgatgttgtctttgcttcagctgagcagaagtgagaatttagacacactgagccattaccagagtttaagaaaacttaccatcagtgtggtttccccctttctctcagtcaagcacatgggtgtgtgtcattgtaaaaggactataggattggaagtggacacgtgaattccatttcttactctccactaactacctgagtgacattaggcaaacttgcaaatgtggaagttgggccgggctaggttatgttccgctctaaccttaaacactgatttccccattgactttcttgttccattcaaagagattaggaggaaaaaaaagtggtatatcccaggcacgttttgtgatatttcagtgaaatattgaaataagcaatgtcagcagcctcatgttctcgctaatggtctggtatactttatgaataaacaacactagctttatattactggatctcatttccagcagatttataaaattgtaactctacagtgttttctgacagagcttctggaaggggaaaaatgacagtgcagttgtttgctaacatctgggtgtactttttgcaacatggggagaattgttccaaggcagggagctaatctgattcatatctctacctagaagcacttaaagaagctgtcagatgattcccacagtgacaaatttgagtcccaaggagatgatggagtgaaatcagacacattttgggaagaaattcctactatcttttcaaaggataaactcccacagtatttgtgccaatctcttttacagcattcctatctcaaaaaccagagacttaggctaattttttttgtttctgttattctctaatatatttgtttaaaaaggaagttttaatgaaaagtcagtcatgtgacttagagaattaaatgtagggctctagcaaggatttgctttaaaatgtttctctccgatttagttgctgcacctgggtaataactaccttggaagtattagtgttgtttctctgtcataaaattgacatgcttggtgtggataagaatatttgattgtagaactgcttctacctaactgcattctgttatactaacaatttggctagcagaatttttttttaaaatcctccatttgcagctttttgtactctgatcacaatatattaaatcccccagaagaactactaccttgaatacaaagcacatagcggtgctcttttaattgatttgtaaaggttagttgctcagtactagtggaaagtttcatgattacttaattgaattacctgcttcccccagtagagtgcttactgggcaccatacagtaagctgagagttttacatgcctggtactattatttccccagtttacagattaggaaagcaagatgtagcttacaaaatatgctgaaagaccactggcataaaagccttttaattccttgctgaaaaactccctgggttttgaaatatgataaactacatttttgttgttctctgaagattcaggttcatatagtatgacagttttatttttgtgactctcaatcatatatgagataaatgatgggggaaagagaccgctttgaggtcaagcagacctatgtccaattctaacatcaaggagaagccacgtgctttggcaaagtttgtgtatttacactgttgggaaaactaaaagtaatttatataaagtacctagcatagtatctggcagggtaggtgttcagtaaatgttgctggtattatttttgctagtgataacattattcagccatataaacacatagcactaaggttaagcaaaatatgtattgacattacagcatgcctaggtatttattgcctaaaatatatttccgataagcttttcttagcatttgctgctttctactaagagttgagtgaaactacgatgaccacaatttagtctacttatttaaacctttaattggttggcttccggtaaattgcagtttgaatgactagcccaatcatgtatgagtagccgggaatattcgataggtatagaattcttcctgcctaatcaagtcagggataccgatgttaatttctgaaataaatactttctcctctcaagatctacccagtggttcgttgccccttgggatcacttctacttttcaacaaagagcaagggacagtaattgcaacttcagggtagaaggagagtttgcatgcctggcccagaatgaaataaatgtggaggaacagagcccaaatgacttgtatgtttcaggtacagctccatgtatgctgcagatgatttgggttaaaaaaaaaaattggccagcctaaactttgaggcaaagaaattgcatttcccaatgtctcatttctctttccttttactttacttcatctactgtgaatgacccttatttttttgttgttgctttatggcaataaataaacgaacccccattgtgcaaatattatgctcttctcattggcctggagggaaattgctacgagagaaatcctggacttttttcccctttttagaaggaaataccaggttacgaatggcccttctcagtctctagattgagactaggattcttctgtcacctcctcagagccctggatgcagaaagcaattcatttcacatgtgtgcaaatcagacacagaaattctgcaaggcacctcttggcagtaaaagtggactattaactctcaaattgctggcctctactgagaggcaacttctccctgaagccaggtgggagtgtccctttgaagccttacacaacccgacttctgttgctagggtagagtactttagagcaagagtagtcctgcggtatgttaactgagtaggtgtttcccagaaaattaaaagcaaaagtaactacctggaacagtctgatttttaaagcaaagcaggatctttgtacgtttaaaatttagtccagctacttgatagcctatagagcccccaactccttcttccagcccagggagagtctgcagtgagcaaggtaagaggtagctccagcattttcagcatggggttaggttggaagtcccagttgacagggacagtccttcctgctctcacctgccaaaatctctctcctcccaggagatagctcccttttctccctgattgcttcctctcatgaggagaaggtcattggcgctcaccacttccagggcaaccctttatgcaagcagtgggtgcctttgaaaggcaaaccgcagcaggaagactttgaaggcaagaagagactttttcatctttgcaggccccagccagaacattggttctcagtgcagtacaagcagtttcaaagttatctcccttgctgatatggatgtgataacatggagcggagaggtgccataatgatttcctttcaaatggctgcctcaccatttatctttgcacactgtcaaagactgatattgtcgggagttagcagtggcatggaataattaatctcgtacgggggaagtaagttcttcatttgtctcctgagaaattagcactgcattgacagcaaaagtagatgatatcatcggaaagggaaagggaggtgatctttgtaactccagatgccaaattgtaacattgattcagttctgtgaagttttgattgaacacctactatgtgccaggtgctagagatacagatacagattcctgtgctacagtagatcataatcccttgagggtcacagcttatttcaaaatccttgtcaccttgacaaaatgctcaagaccaccatggtgacatgtgtgccaccatcattattattatctaaagagttttaccaagtgtctgtatcattaatatttattgtaaaggctcaacttttataagaaagaatccttgtctcccacaccaccagtgcaaagtagattaacaaagttggcatttatttattttattttttctttaggggaaaatcaagaagttagtgatctagggctaatggggatattgtgttactcccaatatgtggttcccatatttggattcaagtttttcctattttccaatcagtgggaggagaaaaagaaaagcatgcctgcttatatcctattaaggccacacctgtctgcaaaacaggtgggatccatgtgaaccagaagcaagctattaaggatgcaagaaaatgtagtgactagttggatggccatataccttgcttaaaaccagttagggtcttttatttctgaaagaaagaagggaaactagatatttggggatgataagcaatctccccacagagattctgggtgaaatcctttttgcttctctgaatttccaataactcacctcttaaatgagagaattgaaggaggtgtgctgtgtagtccttttcaatttcaaagtcaaaataacaactctaggctcctcctccttcctcagcttctcccaggcagtaggcacagtgatgggctctgtgctgggaattttgttttgagcctgtttcttttatttggaaacatcaggtgctgaacctatcctggattcgagtgagtgcagggcatggctctaagaagcattttgtggaaagagtcaagcttgtcatcctcctcctttgaggcactaattgggctgactgggccaagcaaaacaatggtatgatccatgtgaaccaaaagcaaattattaggcttggagagtggtgggtagtcagagaagcacttctgttgtagacagaaaaacagcatcatgcttctcagaaagaaagggggctgctatctgggtggaaagcttagaatcaagggagaattatacatgtttttaatggaccgaggaagaagccagatttgtgtatgcggagtttgatagggaagggcttctcttctttttcctactaaaggaatagtgtttttgacaaggtgccaaaaatctaggccacagcatcccactttgtgccacagcatcccactttggtgagccataccaggttgcaggaaattaattgctttagactttgggctggctgagtggggcctgaagccaccgtagtccctgggcaagccccctcccactacacaggcctcctccatctccctcattttctctgtgtgctgtgatttggaaaaaattgacaagcacttgatagaggctaccaaccaattagaattggttcacacgagacacttgggaatgaactcagctggtcactatggtgatttaactaaattgtgttatccagacacattagtgaatcaagtctggcatttcaattttctctataagatgaattgtggaaagaagttcattataataattaaggaagatttatgcagtgagtacatttttatctctgtagcctgttataatgctggtattttgtgaccaaaaaaattgagttgtagatattaactatgtaattccacaaactgtgctcccgaacgagttatttatatagttagaatttaataaatggaaactttttgaatgcacctgcttaggaaaatattgaaagaaaacttactgtaagtttttcagcacagtgaacaatcatcccccagtgaacaaaatgctagccttaacccggtcagtaaattatttggccataggcagatatctcatctccctgtaaaggaaagccagtttcctccactgtaaaatgagtcttagtaggaaagggggcattagcaaagtaatccctgtgcctacccaatcgttctaatgtgatgtttcctttggaaaaaacctacaactcagaaatatattgaatgaaaatctccctattacaggaagacactgcgggttgctaaggagtgtggtttctgtggttggagtagagaaaaatagtggtgttttctgagatctcaactcaactgtgcagggtagatcgaatgaacacagcacaagccacagccactgttctgcttctgcctgatttgcttctccagaaatttcccagattacaacaatgccgaagtgcccattggctaccacggagataacttcataaattgttaaacaggcagagctcaggtttaaagaactgcctttattttgagctgtgattttacttgtgtttcagacattccctcagatattttatttaaaagatttcacaggagcatcatgcaaaatggtaaataataaaacattctataaaccacacatcccatctaggactaatcattatattttccaatttaacattcattccttccagatatgttcttactcgttctttaaaactatcataaatggaaagctaccatttaagcacaaataaaactcttaagaaagctaagaaaatctgaactcattaaatatttctaactagtgaactccttggttctccaaatgacctattttttcccttccttcttttttttttttttgtatttttagtagaaacagggtttcaacatgttagccagcctggtcttgaacacctgacctcgtgatccacctgcctcagcctctcaaagtgctgggattacaggcgtgagccactgagcccaccctccttccttccttttttaaattagaattttttattttttatttttttttttaattttttttttggttgcttttagccacctcagttaccttgaccatccgatttcacttactgtagccagatttctaaagtatgtgtttctgtggcttttccatagtttttttccccaatattttggcagtggttgaatagaatccttttattcctccctccctcacccctcccaatcagctccacctatagatatagaaatacaaagtgaacaaatgtgccatgcaacttctatttttgtgcccgttcttcctctttgtctctatttttgcctctagcacatagtatcctggtaaactggatttttttttaagagacatggagaacacagtgcagtgctcattctctctcagcctctctgtttttactgtaatgaatctattctacataccatgttctcaggatcccactgtatgtctgataaactaagtcaagctaaggtcattattaccaataagtaatcaataaactcaatgtttaccctaagtttgatacggtaacttagttattttaagaggaaattttaagttcttgtgtgtgtgagtaagaaggagcatgagaatagggaaagggccgtttcacagaagcggtcctatctggttggcctcaattgtgcctctcaggcttgtatctcatctgcttagctgtaaggccagtcctgttaggcaagaaaaaatttaatttgcaacctagtttatgaaaggataaattaagggaccttgtgggaatttaaatcatctaaggtaatagaacatgaaacttgcctagattaaaaactgggtcttttgtgaggtttcattcattatggccccataataatagctacatgtctatgcacttttgagcttgggtctgtttaaaatacttatttgttatttcacttaattcccacaataactgtacaaatatggttctcttgcctccatcttatatatgagaaaaattaggaacaaaaaaacttaagaaatttctttcactttctatagctgataaactttggagatcagtttgaacccatatactcttaaacactatttatacagtattaatgtgatttgacaaaagtggcataaagagcaatgactctttaagactcaaaagaagatgttcagatttatattttgatattaatattaatatcagcaagataagctgttaaataagcattacatgtaagaatcctgaccttggataaaattaaatctttgtcataaatctactactgtgacaaaactgcaaaatatgcagtgaataattaaatccagatgtctcttccggcaacagcagcagcaaaaactggaggtgggggtgaagggaagatggaagtgacagactccatattcataaaagctctgatgataaatttttttaaaaaaatgtgtttgttttaaataccagtcttccatgaatcctaagaattgcacagtaaaaaataaaatctgcctaccatttaacagcccgcaatacaaaaatcttactgtgtcaaatgtaatatgcatacctggcttcccaatttggttttcttaaggaggagtaatttagttgtcattaaactctttgggaaaccgttttaataatgttctttggttatcaggggtatcctttttttccttaaggcaaagaagagaaaacgtgccgctaaaacctttactgtgtgtggtaatgaagttggtccatttctgtgcaggattgcaacaattctttatcacttaacacgatcggaggtgtgagagcagacagtttctcaaactgcaggaaaatgctgaattcaccgattgctatcttgacacaatgaagggaccatacattatatgaagcccacatttggtttgctgttgttgttttttttttttttataactgtgattattttttgatggaataataatcacagaaaaaagaaaaacctgtaagagaagacaccactgtatcatctttttatggcaatatgcaagagggtagaaaaaatgagagtgtctaaatttatcttattttcctgtgggattttcagcacagacatattcctaccactacaaggaccaaggacattcacttgcctgcttgctctgataatggccagtagctggtcccaatgttgatacaattaattaaaatgataaacatgactctagctagcttcagcacagtaagagtaccacagcattttctggatcatttattcaagattcactgacttggagtcactgatggtaccaatcattttatgaaataccttccactagagacagaaaaacgttgttttgacaaattcatggtctgcacctcccccaaaccagtgcatttctaaacagacttgtttttcctctaaatagctttgccaatccggccaacaccccaatatttctttatattttgaaaagtaggtctttcacctgctgataatggaggatccaattctgtgtaaactctggaattctatttaaaattgcagattttaaatgtagggaccaagacaggatgtaggttgtgtcaacttgggaatgctgaatgactgaactgtcatgacatttacaatccagatgtcatggcaagctgggagacaagacagcttggttgataattagatggcagatgtccatgcagtctcacgtgatacacgttactttttgtatattcaagatttgggactttagccctgaaagataggtgatacatcatcttctctatacaataaaaaatagtttcaataattgtatattattttgttttgctttttttctcatttatttggaagtagcaaatacaagaaacaaaaattactcataacccctatttttggtgtatctctatgcaggcaaatatactgatgatgattattttcattttttgaaaatttagattctcacactcaattaaaaaaagaaagcctgaggaaattaaatgatttctaaaatcacccagctaattagtggcagaaatgagaccagattccagtctcttgctttcccgaataccttattctggaattcaattataagtacaaggcatcccactcttggcttcctttctgaataaatgcttgcaccaaatccccagtggcttcttgagaaagctggctacaaatcttcaaagcctcagttgaagaattcttattaagcctactaggtaccaaagcaatagcctgaagtttggaaaaattctagttggtgaagctagaattttattcaatttaaagaatacttggtaggggggaatgtaatgaattcactccctagcctttcttgaactctacctatttaacaccctatttctaatacagcagcttctcactatagaatgttaggtttatcaaatctctcttccaccctgttatacggcattttccatcccttggatgtttcaagtccaggaccttgggcttaaaggcaaaagtaaaatctattacacatttgtagctttgtacaccaatcagggaaaagtagtaaagtgggctattatgtacattattttacaatgcagtatgttagttgtcaattgttacgcaagactaattttttccacagcaaaaaataaagctattttaaaatattttggaagcaagtcatggttgaagagaagcatcccttgaaaaattagacttaaagctgcaaacttcccggggttgacattagcttgaacttgatgaaaaaggaaaaattttaggaggatttgttcagctgtcttctgagttatgaaagcaggaagaaatgagttttacatattgcctggaggtaatttgtgtacatataagtcaaaaacaattaaacttcaaacttcacacacagccactgtcctgtaaagggtggtagtgtataagcagaagaaaaatgactagaagagaacagggttataaagcatccagacatttcccatgtgaggatcttgaaaaacttctgcagccctgtgactggattctttctcctgatctaatagggctgtttggaggaagtatttctactgctcttgagttgttgctagttttcctttgaatatcctgctcagttccctgccccagttcaagcttccttccaaaatgtgtttaaaataattagctcttcctgttggtataggaaaaaattagtcacacataattggtaattcacatattgtattataaaataatgtacaaaattaccacccttacttctttttggagggcctgtggcttgtaccaatggatttatcttgttccagggcattgagaaattttgccttactgatggcatcaccacttacatttctcaacatctttgcctcccatcagaccaggatttcagttactaggtatcctaccttgttccattgatctgagaccctcattaataccctagctgacagtcttaactcagcactgtcttctattttctaccaaatagaatacaataatcagatacattttactctctcttctgaataaagatattaacaaaatttccatgagtacttataagggtgagtttccagaccaacctagatgagttaccaggatatatagtttgaaatattaactttaaacatttcttgatttttctgaccccatcaggtattttttggaaactggtattaggcttgtagaaatggacaaggagctctaccatgcttgaagatggtttaagccttcagcaaaataattgagagcttcctcttctgaatattccgaatacacaggtctatcagttagtgtatcatgttatgtgtagatgtgtgttggggtgatcagatccaacaccaggtcgtgggggtgacaaaggccggcaattcaaaggaatgagaaaaagacagtttgagagagaaagtgggaccagggggccatcgcgagtgtggaggctgtgaaggccccaagttctgggagcccatgttatttatgggtgctcaaacaggtggtgaggatgtcgagtgaatgagaaacatatggctgtttgacataatgggagtactagaagcaagaagccagcaagtctagcagacatgcaagccctgcctcagcttctctcccaacactcagcttttctccaacagatgtgtatgaataaggcttattaataacaaagcctggctccacaggtgagagggaagatgtaacttaatctactggaagtcaccaacatagccctctaaaatgagtcattattttgactcaaaaatgaacagattaaaaaatgtttcagctaatcctcttagctatttgatgtacatcaagcatccagatgttcacaacatccaagctgcaattttttgtgtgttatttaaaagttttacacttgcatatattattcctttcctcaaagacaaagtatagaacccaaactggactttttaaattcactccttaaaagtgtggtaacttaccattccagagctggtgggtccccgattattggcccatgggttgtccactttgtggttttgctgttaggaaatgttggctgatggcttccttaaccactcagcagttaaccaacaataacttggaatgtgtctaataagtgcagcctaatcttaattttattgggagttatctcagctaaataatggaaaatttgacaaacctaattaatgaattatccactgttaaatcttctgtgccactgagtcctctttttagtaaaatgattaaaaacattaactatagtggtatataattactattaacaactattatgccaatatatattgttattcctgcctaagatactatgtctcagcacggagtttatattaggtattttattttaacagttttctaattgctgccactttttcgtcagattgcatattttgacccacaacattgatttcaccttaatgtcaccagtgggaattaattatctgaagcttggcataatattaattaaatccatatgtcacatcatggtgtggcattcttttctttctttcttttttttttttaagtcagggtctccctatattgccatgctggtctcaaactcctgagctcaagcagtcctccctggttggcctctcaaagtgctgggattacaggtgtgagccaccatgcccagcccattgtgcagtgttcttacaaaagtattctaacaatccaaaatcaagactacttccaaaagtggcaggcttcatatagaatccaacattctgttgcaatgagattgggatgagtgggtttagaccaacattgatatcaaaggccagtttccctttaaatcaaaatcacctgtaaactagcatcttgacattcaagatcccaccagggggatctagctgggaatgtcaccatgcatgtcttgagagagtgcattagcccacctgcagtaggttgaaaaatatcttccaaggataatttcttaagctgtatattttaccttatttagaaaaagggtctttgtgagtgtgattaagttaaggaccttgagatgaggaaataatcctggattatctgagtgggccctaaatatcctcaaaagtgtccttataagagtgaggcagagggggcatttcccccgccacacacacacacacacacacacacacacacacacacacagaggagaaggtgatggaggcagatactggagtgaagcagccacaagccaaggaatgctgacagctgccagaacagtcaagaaacagattctcttttagggtcttcagagagaatgtggccctgctgatgtcttggtttcagctcaatgatactaatttcaaatttctggcctccagaactatgagaaaataaatgtgtttttgttttgttttgtttttttgagacagagtttcactcttgtcacccaggctggagtgcagtggtgcgatcttggctcactgcaacctccgcctcccgtcttcaagtgtttctcctgcctcagcctcccaagtagctgggattacaggtgctcaccaccacgcccagctaatttttgtatttttaatagagacagggtttcaccatgttggtcaggctgatctagaactcctgaccccaagtgatccatctgcctcggcctccccaagtgctgggattacagacatgagccactgcgcccagccaaatgtgttcattttaagtcactcactttgtgccaatttgttatagcagccacaggaaactaatacaatacttgtgccaacttaagtaacagcaccagccaaagtacataaagtggaaataaaggtatttttagaaagtctcattactataaaatatggtgtaaataaaaacagatctgaatatgcaaattgaagtttcaaaataagtctcctgccatcccatttcaaagacactggaaatcttaagctcttttctttacaaattctgaaactatcattgcctgtgggttgggttgaaatgaaggcacgtgggtgtttcaagggtatgttctgtgacaaagagacagaatagaaaaatccaaagtcatagcctggagctaatacagtaatatgaatacataaaacaggaaggacaagaatataaaagtgaatttggggacctgagaaagtcaagaaaatgattggagaaatacaatttgggagaccactttagaacccagccctcactgggcatggtggctcacgcctgtaatctcagcattttgggaggctgaggcaggtggatcacctgaggtcaggagtttgagaccagcctggccaacatggtgaaacccgtctctactaaaagtacaaaaattagccaggcatggtggtgggcatctgtaacgccagctactcaggaggctgaggcaggagaatcactggaacccaggaggcggaggttgcagtgagctgagatcatgccactgcactgcactgcagcctgggtgacagaacgagactctgcctcaaaaaaaaaaaaaaaaaaaaaaaaaaaaagaacccaggcctccaatggtgcgatcaggtgccaggtactcttgtctactgtgctgaccatatgctgttgaggtcatcaccagctacgggaaagggcattctcataggggcaagcccaactctatgtatcttacgttatttaccactatttcccaaataaacctgtttcaaagaataccatctttaatgtctttcacaggtacctatcctccactctgcatccttttccatgctatcacttgcagtgaaggtctgttcaccccttttttaacctgtcttccatcttgagttccaatttccagctgccctctgaatatgtccagaggatgctggctgctgcctcagactcactggatgaaacagtttcctgttttctttactaaaactgccaaccttccttttccttgtttgagttagtgtatcactgtcctctagcccctgagctgaaaccttggaatcatctttcactcctccctccccctttatattcagtcaactgacagtaccaatatttcttctcttctccttttatttcttttgccactgtcctactttgggcactaatctctcttctgaagtataacaatagcctcccaactggccactctgctttagctgctccatggtccaatctcccttgtcacatgtgttatctttcccaaacactgtcacaacttgtcagtctactgcaaaactttccgtgactcctggggggcctgcaggagagagtttcagatttctgagtctgccttcctggctcttcacaatgcagcctgagtccatcttttcaaccgtctctctggatacataccaacacttgccctttgtctcaatgaatgtgcctgccacttttgtatctccttacctttactcatattgtggtttaactatgtggttgtcttctccaccctgacaatagatacatctattgtccatcagcccaatttacaacttttgcatctcttctgatttctatcctctgctaatgacacttattaactactgcctttccactggactttgcatttagttttttatatatatatatatatatatatatatatatatatatatatatatatatatatataaccttacttctgcttttaaacatagatcattatttccatgtctaccttccactttctccaacactagattgcaaatttctacagggtgaagcttatgttttcatcccttaacacccagcttaaatgtcacctcacatactgactaatgctttttatctcagttctaaaacattattaatgtacatcacataatttaactccattttgaaaattagttcttgttccagtatcttatctcttaaaatagactggaaccatctcaaggttagagaggatccactatattaaattcttatatatccctcagtagatggcactttgttggatgatttaattgacgtatcttcttaaaaaataaaaatatctggctcttcaaataattagctttgtgacctgaggcaaatcatttatcctctaggacatttagtttactacatggtgaaataaatgataccttcattccttaaatatatagatccagtgacatgttgctttgaatcacagaatttggtttcgtgctaaatctaagaccaaaaacagagcacaaacaattcagaatcaacagcatgctttctggaagcaatatgaaaggtgttattaatagaattcagcattattctaatttcctcttaaaatttcaagaaatatatctgacatttgtcctgtcattgtaagttgaaatatgtgtgtgtgtgtgtgtgtgtgcatgtatatataattttttgttgttgtttttgagacagtcttgctctgtcacccaggctggagtgcagtggcatgatcttggcttactgcaacctccgtcccccaggttcaagtgactctcatgcctcagcttcccgagtagctgggattacaggtgtgcatcaccacactcagctaagtttttgtatttttagtagagatggggttttgctatgttggccaggctggtctcaaactcctggcctcaagtgatctgcccacctcagcctcccacagtgctggtattacaggtgtgagccaccatacctggccaaaatgtgtatacattacacacacacacacacacacacacacacagagtatgtatacgtatatatctgtatataggtaagtgtgcttatatgtatatacacagacatatacacacacaacatatacatatagatttgttgtctagatattataagagtattgcactaatgtttctataaaacaccagttcacaggcttctgtcttctaacaatatccttatacatatttgtcagccactatttaccttaaaatgaaacagaggggagcctgatatataattacggtcactgtgctttgttctattttgtttatccctttgcaatatagtgtggcagacagaaaaatgtatgaaattaattcttttggtttagaatgacattcctatcattgttagaacaagggattacattatacactacctctaaactcaaattttctgagcactttaactattaaatagcaataacagaaagcattgtaaatcttttggagttttgcatgataatgtacctcttgttaattgaattgagagatgattgccctatgattacctcgattcatttgctgcataatttaccataatgataattaactccttgtactgaatgaggtaagatgtgtgttagttagacaccccctccctcccttcttgcctttccttctttccctccctattttagtgtttaaccattttacacacaatttgagacttgtttcagaatctctccacctatattatcatgtcaatccaagtatttctaaataaaagtagaagttgggccatgtttttaaaatttctagctaattgcctgctacttggcttattgttgtgatctaattatgttctggtttttgaaaaaaggactattgcctggcccactgtatgacatttgatttatgtagtctcacctctccctaaatagcccatagttcacaatgcagcagagcctatattaccgcaatttcttctgcactgaaattagacaattatgaagttagtagattattaaactaacgtatgctttataaatacttcttcattctaggataagggagaaggaagtatactgtaattcccaatatgtaaatgccctcacacatttgatagttgatggttccattttttagatgaaaaaactaaagcacaaagaagataaacaatattttgttctgccctataataaaataagcaggcaaatatttatggatatgattctgggttgcctcaaaactttcagggtcagggtaggcaggcagttggagatatgagataatgttagccatgaattgtggctatttttgtggcacctgggtgatgagtccacggaggttcatcacatgattttatttacttttgtatgtttcatattttctataataaaggtattttaaaggaatatatttaggtatccacagtgtgtgacacctgtcaaggagcacatgctagaggcctggctctgccagtgacataggctacgtgactgtcggtgggtcacaacttcctagacttcatttttccctcattaaaatcaaagtattagaagagatcagtggttcccaaggaggtggagttgcttagggaactgtctaaaatttcactgacaactcagaaatctatttggatttagaagctggaggggaatgtatatttcaaaataacttctcaagtgactgtactgtgaccattccttacacacaaacttgggctaacaatgagaatgacttaaccccccaccccacaacactttaataggtttaggatgggttctgagaaataaagatttttaaaacattccccaagtgattctaataggtggtcgacatgccatactttgagaaacacttttttagctcatctcagggtcccttccaactctgacacctcatgatattacttgagcattcttggttctctgcttctatgatgtactattccatgagcaactggagatttagttacaggtgtatacaagtgtacaggagtcaagaaaatgatgctaagtttcttgcactgactgaggaagcaaggtagaagcagactctggcttaattggaattcatgtttgaggcctctgggccctcactaggaaaaatattcaatttatatgtaagcatatgtataatacacatatctcaccagcattctttttgggaaaagagaatttccaaattaaatttaacctatcaattttatactgactaagatgaacacattattttaatatattgtttcctcttgcttcctaatacttacattgtatagagtttcattctttatgctaatcctaatgcatagattggtaaattgagattaatgagattcttcctttactaccacctgtttttaaccaaatgcctacatgctgcatgagcaggaaatgaggtgactactgttgttggccacagagcttcaatatgtcgtgaacaagggttagatgtgaatgtcagaaaaaatgttatgatcaatttctgcctccaacaaggaactacaaatatgggtcacaaaagttctactagtagccccaaatacattttttgaaaggagacaatataaataaagctgaaaagcagtcacaacgctttaatgtgtcattctcttcttcacctttctatccacttagatgtttcctaccccccaaaaatgaacttatgtcacatcacacttgtgactcccactgacatctaaagtagtgtgagccacacagatagaagcacaggtaaatgcctcaaaacctagttattatatttgaaggaatttctgattcagtagtgtttctgtaattgttactaacatcaacgcttcgcttgcttctaggaagacaggatggtaaattcctaacaatggaattgcaaagttcacagtgtgctttaaggagtccctttctccataaacacagctcttgtgatggctttgcagattttgtttctgcatttagtgtagataagttgaacaatcctaattcctgagttctaactagtgatagagcacattatattgttaagaataatggatgttggagaaagtcaggacaaaagtaggtatgaggtgtccctggtatgtggccaataggaaccacggtcctgaagtatccggagcagtccggacatcctcaagtagacccaaatcagccctatcaggagccaacagaaaagcttgctagggcaaggtcagaagataaatttattagccaggaccagtttaagtcaaaagttgaatataagtcatatctttagaaaaaaaaaaaaaaagcaggtagaaaggcacattgtttttagctaactctacaaaaagttcagagcgaaaagaaaaacagtgatgcagaactaggggagaaattaaggagcaaacattccaaaaatagaatgagttgtacacttggttaatttcattgctcagtgatgcctccatagaccagattcttctctctgccatcctcagaaataggctctagggatgctcttagataggctattctgtatgcaagaccttctgtagctgttctagatgccagatcctgaaatgacaacattcagtgaacaataatagctcttcttctacgtcatttccttagatgtgaagaaaccatttccagcaaactcccctcatgtccacaacacctcattaatcaggattaaatcatatgttcatttctaaaccaataagagaaaaagaagtatcgtggctatattatactgaaatgcaattgattttggagagttaaaaacaaatccaaaccagcagcagagcctggggagaatccacgtctccttctcaatccacaagacatgatgggtctgctgcagtgtggtactaaatttggggttacaagaaatttttggcttattagtttcctagggcttctgtaattaagtaccacacactgagtgccttaaaacaactgaaatgtattatctcatagttacaaagtctagaagtctcaaaacaaggtgtcagcagagccatgctcccccctgcaatctgcaggggaataatttcctcttcctagtgtctggtggtttgcccagcaatctttggccttttttggcttgtagttgcttaactccaacctctttcttcctcatcacatggtgttctccctgtgtgcccctttcttcatatggctatcttcttgtaagacactagttatattggcttagggtctcactcaactccagtatgatctcatctaacttaacaaattacatctgcaaccttcctatattcaaataacttcacattctgaggtagcggggattagaacttcaacatatgtatttttgggtggaacaaaattcaagccataacaggcttctatagacctctctagttttactcagtctagatcccaatccatggagtttgaccaaatgagttagggtgctattccctaaacttgctgaaacataataattgctagaggcccttagtaaaatacagattcctggccctcacaacagatgtactgaatcagtctctctaggggacatgcctagaaatctgctttttgacaactgcccagttcaattttatgatgaagcaagtttggaaagcatagagtcagggtgctgagcactttttgagcatctttgagcactttttgaccatgttattcctggctgtgaaagaattctttttgtatgaaatctcatctacccataacaagtcttggaagctgctcttgtcatcctcatcacagacctgcagaaatggaggttaggtaagagtggggctggaaatggagctaggtccaatctcaaaatacatactttttcaatcatactaactcatcatgttagtagtaagttaaagaatcttgaatcatatggtccactgtagtttacttttcttgccttattcccaggagttttgtttttatttgttcttgtccttggagggaacaaaagacagctggtagctgttccctgtttggttttgcatgtattcaaaaggcatcatcttctactgctctcttactcctttactttgtggtcatttgttttgcagctatttagacagttacttcttaaagaacccctaaaactatttagacagttacttcttaaagaacccctaaaactatttagacagttacttcttaaagaactcctaaaactaccatttgttcctctagaaaggattaaagatttgctgaagcaaagttctcctgacactttacctagagcaaggctgaaacaaaagctacctacacctgtattttccttctcttatccctcaagtacacaatagggcatttggctctcagcagttgatgccaagttctgctagggaagaaatgagacttcagagctccctacaagttgaaatggagtcagaaaagctacatatataaatgtcagaaaagctacatatataagctacatacataagctacttataaagtttctgcaaaactacctcaaagggcaggtagttttgcagaaactggagggacactgttttctggagcactctgccactaggattttacttttagtgtaatgaaggatcactgaagacttttaaaccagacggtgacatgataaaatttcatttcagaaatttcatttctgaaaattatgatggctgttggaaaaaagtagattggaagaagcaagaaaatgctaggttacttcacaacttctccaggaaaatagtgcagtgggagaaccctgaactcaggaaatatggcccatttcctgcactatgtttcccaattcaaaatatcctattgtggaattctacagctcaagtcaagagccccttctgaactacaaaggacaaggactgatctactaaagccgtgtagtaaatgtgaggaatttgcctaactcagccaattgatgtgtcaaaatctaaccaatgtgtctaataatctaacatatattgttattgatttcaggttttaagaaccagttttctaaaaatgaaaaacaaaatcaaagcactctagaggaagtaatcatatgtttaatgtcataagtcactgattgtatacttaatagtaaatggtggatatgaacttgggccctggagtcaaacttaggtggctcggtcatgcccttgatgtgtgtctttgggtgggctactgaaactctgtcttagtttcatctataaaatagaatgctaacatcgactttatagggttattgtgaactctaaataagacaacaaatggaaacccaacacatgttctcactcaaaagtgggagctgaacacgtagacatggggaggggaataacacacattggggcctgtcggggagggggagggagagcatcaggataaacagctaatgcatgtggggcttaatacctaggtgatgggttgatagctgcaacaaatcaccatggcacttgtttacctacgtaacaaaccttcacgtcctgcacatgtagcctggaacttaaaattaaattaagtcaaaaaaagctaaaagcaagctttatgccaaaaaaaattttaaaaacttaaaaaaaagcgcctcttaaagttataagggagggtacacagtaagcacttagtgagtgagtgttgtggttgctgtttttcttaataaacatatttttatccaaattattaagcagaaatattggactggaaaagggtaaagtgtggattattaacggttgacattggaagagcaaagagatagagatgttccatgtggttcctttgccaagccatccagatactcacctccatccttttggtcatttcccctaatacacagtatatttatgatccccttctgacaaccccttgaagagttgcttgcctcctgcacagtgctgagttatggacgatgcatttgaagccatatattcactctgtcttccccacatgtgcctagtaactatggcagagctcaataaagaagaggccagtggcgggtttactcatttttaaaaaaatttccttgttgttcttttctgtgattgtaatggctagcactggtactctttccctctctctccccttcttttgccatagagctattgtcaaatgtacaaatacatagtgaattgcgatggtttctgggactgacagagagaaggaacctgttttccccataaatgctgtagaatgaagggtttgcaaacattgtgattgtggcagattaaaaaaaaaaagtcaagcaggctaaattgaaagggaggcatgagaaaagctggtgcaacctgtcagctcctggtccgaaagaagctgatggtattttttttaatattgtgaagagaaggaaaattttttatagtaagtctatggatctgctttaggaggcttttctcttgatctaattgagctgtttgaagtgtgcttgaaagttctcacccagcctgtgtcagccacctgcctgctacaagctgtgagaagttaatcgtcttgggcattgttaggaggagactgtctggtatctgatggctttccattctgaacaagggtgtacggatatggaaaatgtgtgtgctcacatttgtctttggggtgtggggctgcttcactatgcatgagagcacatccacacctccatccagatggtgcctgctcatagtggcagtgctagataaattcatgtcaaacaggcagataatccaaaaaagcaactgtaagtatccacattgctgttttctgcttccaagcttcagtgttgtttttttttttgtagtgacagggtattactatgttgcccaggcttgtctcaaactcctgggttcaagtgatcctccagccttggcctcccaaaaatctgggattataggagtgagccaccgtgcagtgcctggttttttaacatgctattcccttgcctgaaacaaccttgccatttgccatcaacactggcttcatcttccaatctctttgcctgttgcctcacattggatgtcaccaatctgggaagcctttgtcacccctcaccacattgaggtgaggggtacctcatattctctccctgttccttgatttcccattcaaagcacttaatgcaccaaacatttttttttattgcatgtctgaatacattccttagtagttcaacattctttgaggttatatcatgttcatcacagaatttaaagcaatctcctgtgtatagcagattgacaataaattagctatgaaaacaaatgaataactatggtttgggaagaaagacattgtctgagcacacagaattctaactcatgacttgtgcactgtcaagaatcacttgctttcagataattttgatgagtctgattttacgcttttcagtttgtatgtctcatgatttgtccttaatagactgaagaagtcctagcccttataattgaccagtgcctggtaggggaagggcagcagagaaggactggattagaaccatctcaaatgcttctattctgattagtacttagggttggttggagagtaagaatagggactcagcctagttgaaggaaagcctgtatagtggtgagtctgagtgacaaaccagggagaagtaataagacaatttatttctatttttttatcctacacctgaaatgtaaacaaggacacattaaatttttactggttagcattttttaagtaattatgtgctcaactatgtccttatatttgcattcttaccaatgtagactctgttatggaagtaacccatgctgctgctgcctttggacctgaatctctttttgcccttgtcccatttgtgaatttagactttcagcaagttgtctttatgattctctattctatgacatactttgtgaattcatctgtaatcaaatctgtttgatgaaggtcacaaaagctaagtcaacatgagacctgaaagtagaacctgggggtactgattttcctacccattaggaaacagcctccccacccaatcagggcaggttatagtattcaatgccatcttgtcttattgactgagtcatacatctctcattccgcaaagtcagggtcctaaaatacttctgtggagtcgcaaggactcttcctcattagccatctttgactttgtcattgatactattttctacctgtttctgataattaaaaccccccaaaaagtaaaatgtcagggtgaccagagagaaccttagataggacagctaatctcttgcttctagagaaaggtatgaaaatatactgtgcttattatggggatgatggtatgctctctgaattgaaccttaccttttaacatgaaatttctaattgaaacaaagctgtgatgcctccagctttgttcttttggcttaggattgacttggcgatgcaggctcttttttggttccatatgaactttaaagtagttttttccaattctgtgaagaaagtcattggtagcttgatggggatggcattgaatctgtaaattaccttgggcagtgtggccattttcacgatattgattcttcctacccatgagcatggaatgttcttccatttgtttgtatcctcttttatttcattgagcagtggtttgtagttctccttgaagaggtccttcacatcccttgtaagttggattcctaagtattttattctctttgaagcaattgtgactgggagttcactcatgatttggctctctgtttgtctgttgttggtgtataagaatgcttgtgatttttgtacattgattttgtatcctgagactttgctgaagttgcttatcagctgaaggagattttgggctgagacaatggggttttctagatatacaatcatgtcatctgcaaacagggacaatttgacttcctcttttcctaattgaataccctttatttccttctcctgcctaattgccctggctagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgtggtttttgtctttggttctgtttatatgctggattacattgattgatttgcatatattgaaccagccttgcatcccagggatgaagcccactcgatcatggtggataagctttttgatgcgctgctggattcggtttgccagtattttattgaggatttttgcatcaatgttcatcaaggatattggtctaaaattctcttttttggttgtgtctctgtccagctttggtatcaggatgatgctggcctcataaaacgagttagggaggatttcctctttttctattgattggaatagtttcagaaggaatggtaccagttccgccttgtacctctggtagaattcggctgtgaatccatctggtcctggactctttttgcttggtaagctattgattattgccacaatttcagatcctgttattggtctattcagagattcaaattcttcctggtttagtctgttttggttactgcagcctatactacaaggctacagtaaccaaaacagcatggtactggtaccaaaacagagatatagatcaatggaacagaacagagccctcagaaataacgctgcatatctacaactatctgatctttgacaaacctgagaaagacaagcaatggggaaaggattccctatttaataaatggtgctgggaaaactggctagccatatgcagaaagcagaaactggatcccttccttacaccttatacaaaaattaattcaagatggattaaagacttaaatgttagacctaaaaccataaaaaccctagaagaaaaccaaggcattaccattcaggacataggcatgggcaaggacttcatgtctaaaacaccaaaagcaatggcaacaaaagccaaaattgacaaatgggatctaattaaactaaagagcttctgcacagcagaagaaactaccatcagagtgaacaggcaacctacaaaatgggagaaaattttcacaacctactcatctgacaaagggctaatatccagaatctacaatgaactcaaacaaatttacaggaaaaaaaacaaacaaccccatggaaaagtgggcaaaggatatgaacagacacttctcaaaagaagacatttatgcaaccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggaccaagaactagaaataccatttgacccagccatcccattactgggtatatacccaaaggactataaatcatgctgctataaagacacatgcacacgtatgtttattgcggcactattcacaatagcaaagacttggaactaacccaaatgtccaacaatgatagacaggattaagaaaatgtggcacatatataccatggaatactatgcagccataaaaaatgatgagttcatgtcctttgtagggacatggatgaaattggaaatcatctttctcagcaaactatcgcaaggacaaaaaacaaaacaccgcatgttctcactcatagatgggaattgaacaatgaaaacacatggacacaggaaggggaacatcacactctggggactgttgtggggtggggggaggggggagggatagcattaggaaatataactaatgctaaatgacgagttaatgggtgcagcacaccagcatggcacatgtatacatatataactaacctgcacattgtgcatatgtaccctaaaacttaaagtataataataataataataataaaaagaaatttctaattgagttgcctaagcctgcccacctgtcattctcatatgcctaacacgatgtgagattttatatatacagtcctctgtatatatattcacaggttccccatccacagattcaaccacccatggattcaaaaagcaaagcaaacaaacaaaataacaacaacaaaaatacaaattttaaaacacagtataacagccatttacacagcagttatattgttttaggtattatacctaatttagagatgatttaaagtacatgggagagtactttaaaaaaaaagtacacaggcatgggggcagtggctcatgcctgtaatcccagcactttgggaggccgaggcaggtggatcacgtaaggttgggagttcaagaccagcctggccaacatggtgaaacccctgtctctactaaaagaagaaaaaacaaaaacaaaaacaaaaattattcaggtgtggtggcacatggctgtaatcccagctgctcgggaggctgaggcataagaatcacttaaaccagggagaggcagaatttgcagtgagttgagattgcatcacttcactctggcctggacgacagagcgagactccatctcaaaaacataaataaataaagtacagggaggatgtgtatagattatatgcaaatactgtgccattagggacttgaacatctccagattttgtatccacaggggtcctggaatcaatccccttgatggatacagagggaagactcactctcactctctcttgatatatatatatatatatatatatatatatatatatatatatatatatatatatatatatgcacacatacacacacacacacacacatatatatacacacacatacacacacacgtatgtatatttacatgtatttataaactgatattttattcaaatgtttcaactggcccctaggaagaaagatccactctgatgtgttctggctctgtgtgcccacccaaatctcatcttgaattatcatctgaattgtaatccctgtttgttgtgggagggacctctcgggaggtgattggattatggaacggtttccgcatgctgttcttgtggtagtgggtgagttctcacaagatctgatggtttcataagaggctcttcccccttcgctctgctcttcccttctttaagctgccatgcgaagaaggtctttgctttcccttcatcttctgccataattgtaagtttcctgaggccttcccagccatgcagaactgtgagtcaattatgcctttttcctttataaattactcagtctcaggtatatctttatagaagtgtgagaatggtttaatacactctgtaaaagcaaaataatcactcttcagaagcagaaaaaaactttttataagtgactcaaagtcaagatgacccatttctcatttatatgatataaacctatacatatcctctcacgtactttaaatcatctctagattagttataatacctaaaacaatgtaaatgctatgtaaatgcctgttatactatgttttaaaatttgtatattttgttgtattatttatatttttgttttttgaatctacggtttatatgaatatcattctctctccctctgcatctatctgtatctacatatgtatatttgtttttttcttagaacataacctagattcctctacagtgtaaatcccttgctttctggttttctgcctaataaaaggctctcatttctatcttggtctggaaatacccccacttccattttttatgaagtaaaaataccgaagatttttttttttttttgctagaagtagtttactgtctttctctacaactcattctaatatttttcttttcaactccctaccattcttattgtcttccagcaatgtctctatgatcatagagagacaaactgcagccacacttagccaggatcatttacatttacttgcatggctctgtgtagcttgctttttatgctaggcaggttcctgaatagtcagataggaattgaattcttggaaatcatgccattgtttaaggatgaggaagaacttactattttaatgaactttattataaaccttttttctaagcaaataatcaccccttactttatcttatctcctatgcaaatcctgattttcacatttaagctttacttaacagtgtcaatttgtatagttatctttaaacaatggtcagtccccactcttataattgaaaagtaagtaattttcatttactttctggcttctacctccagaaaatctcttacctctatctttattttggtaattctcttgtagggactttaatagcccctggaaaatcatcatagctctgcttcaatctgaaaacataactggcaggcatgagtctggaacacatacgagggaacgaagtacccagagccaagttaaatgaactgttgatgacttttctgaaaatcatagtaaaccatgatttcctcacaaaatatagaagtgtctgatttttggcatttaattctcaaacatactcagatacactttccttcttcctctcccactctgggttcatatcatcatataaatcagaaatgggtcatcttgcctttgagtcatttataaaaagtttttcttttctagctctgaagcgtgattattttgcttttagagaggatctttctttctggggccagttgaaacatctgaacaaaataaaaatcaattgaatatggatatgaaacttaacttgtctttttaccattaaatatatatttgaaaaatgtgctcttcttttatagcttttgtcacatcagcatgtaccaattccaaccagagaacgaaatattaatattctgccccaaagtgctgttttccagcctgtgccaaagcagataatgccagtaacagggagttttccaatctaactttcttataccagtcaaattatccatttcaaaaaagcatccagtcaaagtgctcccaataagtgaatattttgcctagagaattttgggcttgagttatccatccctctgaccaaaatctataagcccactcacccaggagatctgagaatgaaactaaatataaaaactggctttactactgggaacccgaaagttcagctagtgagggaaggaaaacaaagaatagaatgttttccgacaatccttgcttttgtgagtggtcagcagatgttttgtgcctctgctgtattccttagctaagggttcacatgaaatgtaccctctgaaggctgtggccttgttggaacgccaaattagtagttattcctcatgctctgaggtctagcttcaccttcagaaccaggtgagcttggtccccacaaagccctactggtacttaagcttcccatttcaagaggacatttgggttcactacacctctccaagccgtctgattaattgcagctgtgtgcaaattagttttcttcaggggctctctcctgctctcagattagcaacaacgtattcagatggaaagcaaataaagatagttgtaaaatgaggacacaaaagagatgcaacatgtttgctcttgatgggtgcattgatgtcagaacaactagggggaaataagaccaccttggtactgttatcatcgtcctgatgatggtcccgtcttgcagaaaagcccaaacagaagcagggcgttgtctaatcactgatgggtttcctgatattattgagaagaccaagcaaaattaatggtgatattatatctggtgaaattattataaattctccctgcagttttaattagctctgctctttttctcctcctgttttaatccaaagcatatgtgtatgtttgtatcagcaatttcaaaattctgtgaagcatttggtgtcatccatctagtttcaaaataggtacagcatgatgcagtgggaagaatgctagcctagaagttaggactcctgagttcctgcctaggtctgccgctaagctgtagtatgaccttggacatgacctttcaggaccttgatttcttcttatgtgagatgaaggattaaaatccaacagtttgttaaatcactctcaactttttagatactattaagtttaggatcccgtggagaggcctatcatccgagagaccatcctatcatcaaaaggtgaatatcaggtcaaagcaaaagaaaccacattaatttttttctgttgtcagctcacaaagctattttaagcctttggacaataagaaatatactttttttcccctccaataaatatacattatccattaaagtagagtgtgttgtgaactgaccttaagggaatttgctagtttttttgtttatttttgttttttacaggaaactaagtcctgtggaacaaaatagaattaccttcatggagcaagtttaacaaattgtcttcatttttggtcagcaggttgatttctaattccctcttattccctttatatgtatttttggcttcctgtctttgttttgcgttgctataaagaaacatgtgagactgagtaatttacaaagaaaagaggtttattagggctcatagttttgcagcctgtgcaagaagcatggcaccagcatctccttctggtgctgcccctaggaagctttcactcatggcagaaggggaaggagagctatgtgtagagatctcatggagagagagggagagcaagagagaggataggaggttcaggcagtttttaacaatcagatttcatgaaaataaaagaactcactcattacctcgaggaaggcaccaagccattcatgcgggatctgccccatgaccaaacacctcctactaggccctacctccaacattggggatcacatttcaacatgggatctggaggggacaaatatccaaactattaaattcctaaaggacataaaagggtgaactgcacaaggatactatatctccaaacaaatgcccagttaggtccaggacgtgttcaacagtgtccaaaatccaaagagaaccagagatagtgtggcttagtagaaggtaaactgattatacacactcagcattgcaagaaaccttaacgggactgttgtccaaccacacaagcattattcaaaaacctttttacctctcaaggtttggttttctagcatgggttgccaagctacaactgcccagagaagtcatttaaactgcaagagactcagctttctcatccttggaagagagaaattggacaaaattatctttaattttttgtttgccttaatatcctcttattctactaaacattttcagtattacagaaatcagctcttggaggaaaagacattgcagggggtgggagacaaagttggtgataccatgtaataagatttttttagatagtggcaagataaaatgttttgaggtttggcaaaaccatctagtagtttcagttctccctgacagtaagaagttaaggaggccaatttctctttcaagtcagaacttcttgttataactgggtagtaaacatactttttaataagaagtggctaaggcttaagaagaccaactgctgatacccagaaatagccaaagaatacttcattactgacagtgcacactttgatagacctgtcttttactattgacagtattctttctctgctgtttttacaagaaaaaaagcccaatgaaatgtaaaccttgttttcttcagttattggtcctaggagtattcagagtaaataaaaaaaaaataccttacgtatacttctataaaatcttttatttgagcaattaaaaaaagctatcttctttcagtcttatcaaggagagcaaattcctcctagaagtcttatttctacttctaatgacaattgctttattatgtgacattcaaaggaaaaacttgaagtcatatttctagtaaagtatttaatttcagaaataatttaaactgttacttcaaagcaaatatctgctattcctgacataaagtttttacccaagcttggtaataaagttatcataagaataatatggattattctcaggatggaatagaatgtcttgattaggaagaaacacacataagaaattcatttttttggaagaaagaaaatctgtgctgtttatctggcaatggaagtcagatcaaaatatatctatatgacatttgaatggggtcacgtgggaagacaagatctgtctgtatgaatatttttagcttctgaatttgacataagaataggatcaggaaaatgaattctgtgttacatgactaagatgcatattagaactcaggcaagatgattcctgtagttggtctactgggaaattaccctctgcctacagctttcaaatacatatatatactatgtgtgtgcatgtgtgtaaatttccaactgagtacatcagcacataaaatacacttgtccaaggtaaaaaagacaaacagttattaatagggcaaaaataaaatggggttatatccaaccatggcataatacttctcattagaaaaaagtgtggcgagctaattaagacccagtgatagttagaaagtctgagaacatttatctttaaaaatggagtggtaactaactaaaagaaggacccagaacctcctaatacaaatatcagttatattccctgagatttaaaaatataataattcttatttctaattcaaaggcctagagtgtaagtagggataacttaacctttttttttttttttaagcctctgtgagaaataacgcagctgtttggcccgtggtattctctttaaaggaaagaagttacaaagacaagaagaaaaaagtggaagagaaaaataaggagaaaaaatattcaaacagtacataactaaaaaaaaaatttttcacaaacagcaaggggaatcttgaaacaaaatagatttgttttaaaatgcaaagaaagagccttacccgggatgaattgctcagttctcttttgttggttgagttcacttccttccatttctgctaactttgaccagctgctaacaagcaaaagagcttcatagaggccatctacacgtgttctcttctgggttatcgcgatgctgacaaagtgcacctaccgcaaattagaagagcacaaagatttctgtgggtatgcctgcaaaactctggctgcgaggcatcacctcagctcagtagccttggatttacatgtgcctgcccccctgcccatggttactgagggtggcctgaggatggattcacttcataacccttttccataattatgtgaataacaaatgagctctatccaatagagaaaaagaacacattttaatactttgtgaagtgatcatgaggaaggggacagaggagttgagatggccaagagagatcccgccctctggagatgtaatagaacagtgacagataatgcaaaaaaagatttaatatatttttatatatttaatatttgtcttctgttgttgaccttagcttttgagtcaacagtaactaagaagcattttgtcatccgacggctcctcttcctttggccttctgtattgtattatctgataaggaagcagcgaacttaaagctcagttcaacgcaatgatccttcatcatagctgggtgtgaagaatgttgttccctcaaatatgacacaaattgtttggtcaatagagaagagaactgcattctatttttttccaaacatctgttatactccaaaacctttctccttaggccatggctgtctgaccaacagtaggtggatttctttgaaatcttatcttctgtagaactggatctcatcctggccaacatggtgaacccagtatctactaaaaatacaaaaattagctgggcgtggtggcaggcgcctgtagtctcagctactcgggaggctgaggcaggagaatggcgtgaacccgggaggcggagcttgccaagatggcaccactgcactccagcctggcaacaaagcgagactctgtctcaaaaaaaaaaaaaaaaaaaaaaaaatagatctcactagaagtattctcaattcagcagtagtgtccagttttgaatcaaataatttatattttgattatgtgtattaagaagctaaatctactcatatacaaaaggaaaatctttagcttttcatgtgttctggctaaaggccagaattaaaaggaagaggatgtcttatctatcagacatttttgtgcctttgaagccataaacttgagagaaacattagcttgttcctgaccctgcactcagcataagcatttgcttgtagcagtcactcttgggtgactataaattcacaaagtcaagaatttgcatcctgaattgatttgtgtaagatgtctaggggaatgctgattttatattggaaacaaggttagggggaagcctcaaaactgcctttatggagttctgtatctcagcatattataattcttacttctaccatactccagaggaatcagtctgggtgacttcataaaacagtattagaaaaattgctagcactacgaaatcaagcaggttatggcagtatattccttgtaagaaaattagtgcattaactctttccaataagtgattgaattagttttgcacataatctgatttatgaaatgctgcactcgcatgctcaagtagttagaaagtgtgtcgaagcagatgttgaactgaagaaagaaggttgcttgaaatgtaaaggtattataaaatggctaatctgtgggtatgacccaaagctttcagagatttcctggcttcactttttttttttcaatttaataaattttttttcttaaaaggtaaaattgccaatgagttaaatgttgatgctctgatgttagcaagactgagttcatatgtccatcgcttattaactccattttcttatcaatatgtttggcttctgtaagtcttattttcttgtttgtgaaaggaagatctaataatagaactggccttatagaattgttgtgaggattaaatgtggcaacccatggttattggtttcgtgcgatgcctgtcacaaagaaaaaacccaataagttgtagtggctatttttcatcttctcattatcaccattacttaagagagaggcaaagtgatagtatcatacaaacattttcatggagagttaaatgaacatctgttttttcttttcttcaattttttaaaaattatactttaagtcctgggggacatgtgcagaatatgcaggtttgttacataggtatacacgtgccatggtagtttgctgcactcaccaacctgtcatctacattaggtatttttcctaatgctatccctcccctagcctcccaccccctgacaggccctggtatgtgatgttcccccctccctgtgtccatgcgttctcattgttcaactcccacttatgagtgagaacatacggtgtttggttttctgttcctgtgttagtttgctgaaaatgatggtttccagcttcatccatgtccctgcaaaggatatgaactcatccttttttatggttgcatagtattccatggtgtatacgtgccacattttctttatccagtctatcactgattggcatttggattggttccaagtctttgctgttgtgaatagtgctgcaatagacatacatgtgcatgtgtctttatagcagaatgatttatacatacgtgtgcatgtgtctttatagtagaatgatttataatcctttgggtatacacccagtaatgggattgctggatcaattgtttttaaggacaggttgcataaaactgactaatgccattcatgacagtgagtttcaaaggcagatagctatcttagtccatttagggtgctctaacaaaatgccacaaagttaggtacattataaacaacagaaatgtatttgtcacggatctggaggctggggagtctgagatcaagaccctggcagatgtgatgtctggtgagagcttcttcctggttcatagatggcgacttccagttatgtccttacatggtggaaaggacaaggggtctttctgcgaccagtttttcaagagaattaatcccacttatgaggtctctgccatcatgacctaatcacttccccaaaactccacctcctgataccattacactggtgattagctttcaatatataaatttgggtggcggggtggggcacacacattcagatcatagcaatggcagctaggaggaagtaaattttgaatcctcatttccatgtaaagacttcatttgctttaaacaatttatttaacttttattgtgctttttctgaaaatgaaataacatttagctacacacagggagggtatgttgtttctaaagtaaaaattaactcttttgtaaatgtggcattgtttaataatagttcaccctgtccaatgatacttagcttttttatatatgtaaataaattattaggttactggtttttctttttcttttggtgggtggggggggtgttaagatcttattctcagtcctcaaaactctgttgaacagggaacatctgccctcattttcaaccttatttctttagtaccaattgcagccatgttataatctttgttttcatccaggtaaagctgagggaagggaaggagaatccactgagaaaaagattttccccaaagagtgactcagcctttgaaaagaaaatcagctatatgaaaagggaagagtatttaatcattcggagcaataattgcattgtaaatattagctcagctgataaggagtagagaaccaagagaatgagggagccgttacattgttttatcttgtttgatgcctttactcagtgctctagcatgggggccatgtctagggagggaatccactgcagctacatttaaggtcacctaataaaccgtgctgttttctttcttttcttctagactctattccttcattttttttttctgaactttaagcaaggaaactgccagtcatagagcatttccttatacacttccatgttactgttatgcagagaaatctgactggcaggctgatggccaggctgctctggaggaaagtaattagctatgtgactttatctaggccaaaaaaatgggataaaaaacatgcaaaaccattcacctatacagacctgttctcaaggcagtgtttaccctagtgcatctgctaattcctttcaagtctggaaaactgttttgtttgacatttttggaatgctgtgatctgaaccattagactatttttttctcctttaaggtactaatattctgatttttaaacaattaaatatgctctaaatttgtctcgcccacttctacatcttcttccaacatttacatagacatccatgcacattcatgcacaccacacaactacaagtcatttcagacaaatggtcttatctaattctttttagtgtttccattttattatttgtcaaattgaatggaacttccatgttttgccctgctgacatttaggcagacttgcataaaatacaagattatttctagctggataagaagctcagctatcagatagtgttgctgatttatacagtaggaggaaggagaaaagaccaatgggtgagtataataaatagaaacgtcctgaagcaattcacttgtagcctatccaaatcttgcaaactctgcataaaacatcctcccagttctctttcaatggaacaatttttcttttctttttctactcttcactgaacatttcctgtattctacatgcaacagtgcaccttttacattcgtttggcttatgtgctcttgcaataaccctttgctgtgtggtaatatctcatttgtgggaacttctgtgacactattaggggacagatacaatggctatgtgcctagcaatgccttcaccgtgctctatttaaatagattgctcatttatttgctactttgctcatcaccctgtctctcattcactataatatctttagcaaatcacatagtgccaggtaaataaatggtactcattcaatattgaccatatggatgaatctctgcttatgaaatatgagagccccgtgcagggtcattctgtccaggaactcatcttctctggcggtgtgagaccatatgtttaacatgaccagtaaggaagtagaaggaatcttccactactttttacattcttttttctttcaaaaagttttgtaaacttcaagtatgtaaaaaaacagttcttatatgttcatacagtttgctttcaacaataactccacacatgtgcattgacatgtaaagatgtttccagtataaagtagaaaaaaatgggttttaaacatcatatataaaattaatcaattttttaacatatagcatacctgtattcaggaacatgttctttggttattctcatttaaacagtcccctattgttgaatacttgatctgtttctattgtttcattttatatataatatatcctataccaaatatcctaatataacttctctgtgtgcttgtctaattattttgtttagataaaaggtttcatatggtgtccacttcatgccattatgtgatatgatttgcctctcagcctctaggaatgggtttttctctaaggatagtggctgccactctatctagtggctgaagtaatatggcttcatgtcatgtggctaacgattcatgccaaaggttgtccgcatcttatgtatcagtgagttatctgacacccctaatagacgcttatttcttttttcaaaaagcttgttcctgagctgaatttccatgatcagatggtggcaagagccaagtcttctcacataaagagaaatcacattgaatctgctacctacgaccactggccaaggggtcttgtcatcattgcattctggggaattggattcaatttaaaaagttgaagctgcttgctggcttccttcctggtagttttgaatgtgtaatctcacaaagatcttcttagctctggcaaagctgagcctgtctaaaacatttatgttagaatttacatgagttcatttgtgctggcgtcaaacatttcttgagtatttaccatgttattggctgatcttaaagccaagctacaaaggactagtaggggttagcaggcaggcaggaagaagaagggcatggttggcagagattgccacatgcacagaatatagtggtgaacctacatggtgcatttggaattgcaagtagtctggctttgctggaagtgggtttgcaagctgaggagtaacaagaaataaggccgaatagcataccaggaagtggtagatggcagagacccctggatcaccgtgatacttatgacactacttgctcacttgttttttggtttatttcctgataagctttgagccagaacattaatgcaaattcttgttcttgtgtaaaaattactgcaatgacttcccattgctcttggagaagacaaaatccttaatatggcctacaaggtccagtacaatctgtctcctgcctctgtagtcttattcttcactaggtctgccttcttcctcccagccctactggggcccattctctgggcttcaatattacagaccttactttaatttcactaatgggaaatgttgctgccttccaacaaagggcttttgcatgtgctgtttatatgaaatcctcttttcttcctgccactcttgcctattaatgttcttatttctcagcactcacgttatttttttactcagagaaatcttccctgagttccctgaccatgtcagatttttcacttatatgctgtcataacctcatgcatttctcttttacagtgctataaattgtcagtgacacatttgtgtaattaagtgatgaatgttcctttcttcctaataagtaacatcatctataccatcattattaaatcagccagcatcagctggggtacttatcatatgtcctatactgttctaaacacattatatgtattaattcacttaattctcataacagtccctattaaatggataacactgaggaataaaaaaagtaagtcacccaaagttacacagctgataggtgatgaagttagaattagaaatcaggggggaggagccaagatggctgaacaggaacagctctggtctacagctcccagcgggagcaacgcagaagatgggtgatttctgcatttccatctgaggtaccgagttcatctcactagggagtgcaagacagtgggcgcaggtcactgggtgcatgcaccgtgcgcgagccaaagcagggtgaggaattgcctcactcgggaagcgcaaggggtcagggagttccctttcctagtcaaagaaagtggtgacagacggcacctggaaaattgggtcactcccacctgaatactgtgcttttccgacgggcttaaaaaatggcgcaccaggagattatatccctcacctggctcggagggtcctacgcccacggagtctccctgattgctagcacagcagtctgagatcaaactgcaaggcagcagccagactgggggaggggcgcctgccattgcccaggcttgcttaggtaaacaaagcagccaggaagctccaactgggtggagcccaccacagctcaaggaggcctgcctgcctctgtaggctccacctctgggggcagggcacacacaaacaaaaagacagcagtaacctctgcagacttaagtatccctgtctgacagctttgaagagagcagtggttctcccagcacgcagctggagatctgagaacgggcagactgcctcctcaagtgggtccctgacccctgacccccgagcagcctaactgggaggcaccccccagcaggggcagactgacacctcacatggcagggtactccaacggacctgccgctgagggtcctgtctgttagatggaaaactaacaaacagaaaggacatccacaccaaaaacccatctgtacatcaccatcatcaaagaccaaaagtagataaaaccacaaagatggggaaaatacagagcagaaaaactggaaactcttaaaagcagagcgcctctcctcctccaaaggaatgcagttcctcaccagcaacggaacaaagctggacagagaatgactttgacgagctgagagaagaaagcttcagacaatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaacgcagaagcctcaggagccgatgcgatcaactggaagaaagggtatcagcaatggaagatgaaatgaatgaaatgaagtgagaagggaagtttagagaaaaaagaataaaaggaaacgagcaaagcctccaagaaatatgggactatgtgaaaagaccaaatctacgtctgattggtgtacctgaaagtgaccgggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcagatctctcagcagaaactctacaagccagaagagagtgggggccaatattcaacattcttaaagaaaagaactttcaacccagaatctcatatccagccaaactaagcttcataagtgaattagaaataaaatactttacagacaagcaaatgctgagagattttgtcaccaccaggcctgccctataagagctcctgaaggaagcgcttaacatggaaaggaacaaccgataccagccgctgcaaaatcatgccaaaaggtaaagaccatcgagactaggaagaaactgcatcaactaacgagcaaaataaccagctaacatcataacgacaggatcacattcacacataacaatattaactttaaatgtaaatggattaaattctccaattaaaagacacagactggcaaattggttaaagagtcaagacccatcagtgtgctgtattcaggaaacccatctcacatgcagagacacacataggctcaaaataaaaggatggaggaagatctaccaagcaaatggaaaacaaaaaaaggcaagggttgcaatcctagtctctgataaaagagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagattttaacaccccactgttaacattagacagatcaatgagacagaaagtcaacaaggatacccaggaattgaactcagctctgcaccaagcggacctaatagacatctccagaactctccaccccaaatcaacagactatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacatactagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctaccagaaggcaagaaataactaaaatcagagcagaactgaaggaaatagagacacaaaaaacccttcaaaaaattaatgaatccaggagctggttttttgaaaggatcaacaaaattgatagaccactagcaagactaataaagagaaaaagagagaagaatcaaatagatgcaataaaaaatgataaagaagatatcaccaccgatcccacagaaatacaaactaccatcagagaatactacaaacacctctactcaaataaactagaaaatctagaagaaatggataaattccttgaaacatacactctcccaagactaaaccaggaagaaattgagtctctgaatagacgaataagaggagctgaaattgtggcaataatcaatagcttgccaaccaaaaagagtccaggaccagatggattcacagccgaattctaccagaggtacaaggaggaactggtaccattccttctgaaactattccaatcaatagaaaaagagggaatcctccctaactcattatatgaggacagcatcatcctgataccaaagccgggcagagacacaaccaaaaaagagaattttagaccagtatccttgatgaacattgatgcaagaatcctcagtaaaatactggcaaaccgactccagcagcacatcaaaaagcttatccaccatgatcaagtgggcttcatccctgggatgcaaggctggttcaatatacgcaaatcaatcaatgtaatccagcatataaacagaaccaaagacaaaaaccacatgattatctcaatagatgcagaaaaggcctttgacaaaattcaacagcccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttcagctgataagcaacttcagcaaagtctcaggatacaaaatcaatgtacaaaaatcacaagcattcttatacaccaacaacagacaaacagagagccaaatcatgagtgaactcccagtcacaattgcttcaaagagaataaaatacctaggaatccaccttacaagggatgtgaaggacctcttcaaggagaactacaaaccactgctcaagggaataaaagaggatacaaacaaatggaagaacattccatgctcatgggtaggaagaatcaatatcatgaaaatggccatactgcccaaggtaatttacagattcaatgccatccccatcaagttaccaatgactttcttcacagaattggaaaaaactactttaaagttcatatggaaccaaaaaagagcccgcatcaccaagtcaatcctaagccaaaagaacaaagctggaggcatcacactacctgacttcaaactatactacaaggctacagtaagcaaaacagcatggtactggtaccaaaacagagatatagatcaatggaacagaacagagccctcagaaataatgccgcatatctacaactacctgatctttgacaaacctgagaaaaacaagtaatggggaaaggattccctatttaataaatggtgctgggaaaactggctagccatatgtagaaagctcaaactggatcccttccttacaccttatacaaaaatcaattcaatatggattagagtcttaaacgttagacctaaaaccataaaaaccctggaagaaaacctaggcattaccattcaggacataggcatgggcaaggacttcatgtctaaaacaccaaaagcaatggcaaccaaagccaaaattgacaaatgggatctaattaaactaaagagcttctgcacagcagaagaaactaccatcagagtgaacaggcaacctacaaaatgggagaaaattttcacaacctacttatctgacaaagggctaatatccagaatctacaatgaactcaaacaaatttacaagaaaaaaacatacaaccccatcaaaaagtgggcaaaggatatgaacagacacttctcaaaagaagacatttatgcagccaaaaaacacatgaaaaaatgctcaccatcactggccatcagagaaatgcaaatcaaaaccacaatgagataccatctcataccagttagaatggcaatcattaaaaagtcaggaaacaacaggtgctggagaagatgtggagaaataggaacacttttacactgttggtgggactgtaaactagttcaaccattgtggaagtcagtgtggcgattcctcagggatcaagaactagaaataccatttgacccagccatcccattactgggtatatacccaaaggactataaatcatgctgctataaagacacatgcacacgtatgtttattgcggcattattcacaacagcaaagacttggaaccaacccaaatgtccaccaatgatcgaccagattaagaaaatgtggcacatatacaccatggaatactatgcagccataaaaaaggatgagttcatgtcctttgtaggcacatggatgaaattggaaatcatcattctcagtaaactatcgcaagaacaaacaaccaaacaccgcatattctcactcataggtgggaattgaacaatgagaacacatggacacaggaaggggaacatcacactctggggactgttttggggtggggggaggggggagggatagcattgggatatatacctaatgctagacgatgagttagtgggcacagcacaccagcatggcacatgtatacatacgtaactaacctgcacaatgtgcacatgtaccctaaaacttagagtataataatgataaataaaataaaaataaataaaaataaaaaataaaaataaaaatacaaaaaaaaaaaaagaaatcaggcagactggatctggaatctgttctcttaacctctctctctgctcaccggtaggttatagacctaacataaagtagttgctcaataaatatttgttgaaagtataaatgaataaactaattaataaatactttatatgtgtcccactcttaactggggaaaattgggtgggtagatacaaaagaaccctagtagactgttcgctggcaggaatgtgttctagaggattggggaaagagaaacccccgaataactgtacgtgatttatgatgaaaatctttcaagtagtggaaagttataaaatgctaaccaaaagattagttatttggtttatatgttgatcactgtgatctttcccaatattgactggggtttgttgagtgtctgtaatcccacaggtggatgttcatgatctgaagtgacaatggtatatttgctcagcatttcctgtacctgaaacaacccttgaaaactgaaatagaaagagcaagtcaatggtaatatcatccagcactctgccaggcttatggcgaccttgcttacccgaaagcaaattacttccctctcatttctatataataagtactttacggctttgtgttttcatgcattgagatttccctaggagtctgagaagatgtccaggaataaaagagggaagaacaatgattaaactatttctaggactttagacattggattatattcagaaacccataatcagaccgttaatgaatgtcttcgcattcattatcagactctgaaaaagcatatccagtctctccatggactggccttcacatatgctttgctatctggtagaaatatctgcccaaaagattattttttatggaaataatagtgcacatgcagattctagatattattttctatttatcaactgcattcaggcagtgctaagtagatgactgatgctgaaattttactagatgatctttgctctctattttgttatatgacacatggggcaaatacgtgagatgagcaattagtgaaattctggaagggacagatttatgtcatactattgaaagggacaggaagtggattaagtatgatatatatatagtatgtgtgtgtgtgtaggtgtgtgtgtgtacgtataacaagttagtttccttttcctaccactgaaattgttaaatggaatggtgacgtagacactttacttctctactcctggacttactagtaaagaagaaatatataaaagagcaagatagtattgatctggggtggtactatggtatgtattaataccataccgtaattctatgatctattaatgtcacaaccagctacatttagctggcttttatatacgaatgtgcatagtactgttttgtattaaatatcaccagaagatatttgtcacataaaaacagtgagattaatgtttatatattttggcactcatgctagagttgaatgaggttctgtctgtggggataattctaggtatcctggaaaacctccacatatacaccaaacccagaatcaattcagataggcattactgttcgcagtcatctaatttcaagttagggtagtaggatatggattggggggcgtgattcttagtgccagagaaagattaaattattcatagggaaagatattcagcctaagatggataagactgaaatcaggtgcctggactctagaggattgggctctaaccgaaaaaaaaaaaaaaaaaaaaggagaatccagtaggaattcattgagtaagccaaggttacaatctgctggacttcagaggtagagttctagatgcccattttaccaccctaggtcagaagtggggagcagagagacagaaggctataagtgaggagacagtactgagacactaagtagacattctagccaactctgtagaggattctcatgttatgagctgaagtagaaaggctatgtttgaagattctgtctgattttgggcatcttggttctagatctatcataggtgcagattaaattgtttccaggctgtacttgatagttggtaaggatcaaacaataccctcacataacttgtcctagaactggttgtgctatggcatcattgtagtcccacatcctagcatggagcctaaaaaaaagtaggttcttcataaatagccaaggaatgaattaatgagtgatgggatgagtgtgagtggagaaataagcaaaattcctagaaatatggggtgggagtatggcagacaaacgttggcatcatccttcaaggaccagatcaaaatgccacatttccactacagctttctctgagttaattacttctctccactgttactatggtgatgtatttattctgctttaatagcatttatcaatcattttgtggttatattttatgatttctctcttcctcctagactatgaaatccttgactgtagaattgttggtttgtacctacattactgcagatagtatctggcaagggctgggctctcaataaatattgaccaaattgaggctgtaaagattccaatggaccaatatggcttgtgacccatgcttcatttacctaaatgaggccacaaggctctgtgatcacgtggcagtcaaataacaaaactctccaaaatcaggatttcttcttccattccttcaggttccctcccccatgggcatggttatctcatcctttacctcctggaaattatatattggaggttgtcagtgtgtgctgttctgtattgccctatagttaatgcacttctctgacgtagaggactgagctctctatagaactatgcagtgtcaaggaccctctgccttgacatagatgcttggaccacactgttaggtaactgagaagacaaagaatgtggctagaggctaaaagggacagagcaggaaaagcatgaagggcatgaaggaaggagcttgaatttttttcccaatgtactggggagcccaggagtggcatcactttgtactccagcagtgacattttaatttacaagccaagaatgcactgatcgccaactgcaaaaattgatttggttgttcatctgattcaacccatgtcagagtttgaaagtaattatgatagtggggctgataggcaggcaattacatttttgttctcttgctttctggctccttctccctctctttcccttcccacacctccacctgcaaggttgttcttgtcaggaaggcaatgtaagcaggagacgagagagtaatctttggagatgtggtatatggactcttgtggcagaggctataataaataatagtatggctggttctttatcctaatttttgttagcctcttatgaactctaaccagataaaagatgcaaactattttgtctccttctttaaagtacaaaatagaaaaagcacatgtactgtaaggcagtttctgtttctgatttaaatttgagttgtctttgcaacatctatagattcggtgtctttctaaaaaggtttgctccaaatcataatacaaaaggaacctgggatagggagagatttaggcaaagctaaaatccatctgagttggggagcagattccatgggagactgaaaatgtgtttcaaactgtagtgcaagaaattgaacaaagtattggaatttttctaaaaaaaaaaaaaggttcctttgctgaaagtagtacctggcatgtaaacctaaagtaatatagaagatgaagtggaaaagtatatcacaaggcaaaaattactttttagactgatgaagagatggatggatggatgtgaattttttttatctatttcttattttgaaggttatttatttattcacaaacactggaaaattcagtgtttttcactgagcaaaatagcttgtctggtccaaagccagtaaaataagaattttgtgggtggggtatctactccattagtatagcaaatgttgagatatataaattattttaatatatttattttattgacaatataaaaaaaaatttaacaggctccacaccaaggtcaatagaattcagaagcacatctgtcctcccaggaaacttgtggtttaactatttactatagctacctcaagattttacagaaaaaaaaaaaaatgagaccttctcttgaaaactaccatatcccagatctaggcttttctatgcactgtaacttctctataaacctcctttctactgactgccccacttcaatttggcacatacaccctttaaccagtaagcatgtgcatgtagtcagtgtgtcagacaggtttggctgaattgatataagactggtagcataggctgggcgtggtggctcacgcctgtaatcccaacactttgggaggccgaggcaggtggatcacgaggtcaggagtttgagaccagcccggccagcatggtgaaaccctgtctctactaaaaatacaaaaaattcactgggcatggtggtgcgcgcctgtaatcccaactactcaggaggctgaggcaggagaatcacttgaacccaggaggcggaggttgcagtgagctgagatcatgccactgcactccagcctgggcaatagagtgagactctgtctcaaaacaaaaaaacaaaacaaaacaaaacaaaaaaagatgagcagcatggaacatgatgttggcatgaggccctactacccggcagcagactatcagggaataaactagataaacctggaaaatgttttaacttcagtttattttattcacattaagtaatggagtagcatgttgtttgtttgtttgtttgttttacctctaaacctcctgtatagcccccttttaaaagaagggcaggggaagaggcttaaaatatggtagtattgactcccaggcctgttcagtctatacgaattttcaggctgtatagtttaaaaaaaacattgttcaatttcttatacgtttttactagtgatattactttagaaatgggcctcgaaagactcaggttacttttagatttgttcagggtttaaagcttcttttaggcacttcttgggcttcttctacctttcactgtaatatagtggtgaagagaaagactttggaatctgatagatttgggtcagaattgtagttttgccactcattacctttgggtaaccaagctctgtgaacctcagtctcttctgcaaaacagaaatggtgacatatttcctaagtctcttggcaggattaaatggaatacagtgcacaaaatactcagcacagtgcttggcacatagtaaatgccgaattaatggcaatgaattgttgttgttgttgttttctttttgagacagagttttgcttttgttgcccaggctagagtgcaatggctcaatcttggctcaccgcaacctctacctcctgggttcaagtgattctcctgcctcagcctctcgagtagctgggattacaaacatgggccacccatgcccggcttttttgtatttttagtagagacagggtttctccatgttggtcaggctggtctcgaactcccgacctcaggtgatccgcccacctcggcctcccaaagtgctgggattacaggcgtgagccaccatgcccggccaatcaattgttattgatttattactgagattgctttaaataaattcatccttatttctgttgtagtctttaccttgtctccagatctttggaagtctcaggttcatttgtctggactttgggggttttgtttaaaactgcctagtctctgcagccacatcctccaccactgtagcacatgatcaaaaaacttttctctgaggatactgagtatttcttagacctatgtcactagctccctgggaactctctctacccccatcccatcaactctctgaccacaagttttcaaggaatcttcctcattatactcatctatcattcttgcagttttctgtctcatcttgagctgttggtcaagagtagaccagagtatccatttctcaactcatttcttaataaggcaacaccatgttcaatgggcattcattgggccagttgaggctcctctgtaattttattttattttttgagacagagtcttgctctgttgtccaggctggagtgcagtggtgcaatctcagcttacagcaacttccgcctcctaggctcaagcaattctcctgcctcagcctcccaaagttctgggattacatgtgtgagccaccacgcccacccttctctataatttaaatgttatctctctttataacattttcataagaggatccacaattctattttcccattcacttataaagaacaaaaatatatccctaaggttccacaagtacctctggcctttggggaaaaaaaaaaaattcacagatgcttttttgaggaggtaattatttgtttgttgtgtccttgctattcattttgagatagatactcaagctctacacctcttagcttatataccagtttcaaatttatgtctttattatttattataaaatcttttaccagctgggcatggtggctcatgcctgtaatcccagcactttgagaggccgaggcaggcagatcacaaggtcaggagatcgagaccatcctggctaacacagtgaaacccggtctctactaaaaatacaaaaaaaaaacaaaattagccaggcgtggtggtgggtgcctgtaatcccagctacttaggaggctgaggcaggagaatggtgtgaacccgggaggcggagcttgcagtgagtcgagactgcgccactgcactccagcctgggcgacagagcgagactctgtccctaaataaataaataaataatctttaccttgaatattgagatgggttcaatacaatctcaatttagaatacttaaaagatgaaaagttccataaaataaattttctaatcaacagaaaacattttgttaagatgttgctgatgcaaataattctagcatgtatcactgttagttttctatctttgaaaactatcattcaactaccatcgtagttactagacttccattcaggatcttgcatgcctaagagtcatttcactgccaaaaatgaggaaatatagaaaactgagctgtgtttttatcatctaccatttcaaaaaaccctgtggaaaaaatatttcttttagcaaatctcagacattatcttgacttatatgtaagatgtacctctctctttaaatccaagtgcattgaaacttctggctcataaggtaatttttttttttaaataattaactaaacccttaaaactacatagaagtctactttgttttataaattaaccccattattttaggaattaatatagctttgtcttgtgagatgctgaagttatttttcctggttcttaatattcagtctttccgcttatctatttaattcctgatcactagccaaactatatactacagtttggttcatccaatttaaatagctggcctgtaactaagaaaagaaaaatatattttgtgaagaataggtatgaggtagagaaattagtggtagtatgatacgggaaaagagtaatgtcaaaatgcatggtaatttatgtgatatgccgaggactgcaagaagtcaagaaagaaacataacaagctaacagctgtcaccaacaaatagcaattaatttcagcattcattcccttgctcatgcttcatgaaagtatataggtaaacaggattcgtatcatgttctattttcttctctgggcctcaggcttccagccctctgagctactgtcttataacattctgaggatgtaagaaagaacttgatcctgttttctttttcagtctggagcagagacacggtgaagttcagtaaggtctgacacccattagcattttgtgtgactcaggatacgaatcaaacctactgttgtggaagcagctttccatataaatctaattcccaccaactcctgccaccaccaaagctaatagtcaagtgcttgtattgctgatagcaaaggtccaagattattcttattgttttactggggctacttatcaaaatctatttacttgtctattctatggatggggaggtggtaaagaaaaggcttaagtgtcctacagagattcattctatgctgcctcaaatgctttgaagcagtacaatttctcttttaactgcctcgatgtaggtgaagagtcttgcaggatatgttcactgctgaagagcaagcctgcctcattcataaccactagtagctgacaacctttggattctttccacagcttgaaaattcctccattccttgaaagcaccctgcactaatgctcgaagtattaagtgtgtttttatttcctagaaggatgcattttacacaagtcacttaaaagcttctggaagctttaattacaggttgactaatatttagaagaattgaaatacccctctctctcctctgtggtatgcatgagccagattctggttcattaaccagaagtctattacttttcccctatagtttcatggagtaaaatggtagatgcaaaccaagagaggtcaagggacctgagcttggttctgtctttgtcacaactaagagtctgaccttggatgagtcatggtaagactctgtgtcatatataaagagtattctgagagtaaaacacgcatacaaatgaaaagtatggttattatggtctcttgaatattcttagatcaatttcacccattggatggggctagtatatggttgatggatggtatttgtttcatttatctggcatgcatttaaatcttcaggtgcattaaacgaacaacacaaatttggtatatgattttcatgctctcttgcatgatagatataaaatcttaatcagtgattgtctggaaaccacagtctccaaaatgctgcctaggagtgctaaagagctgtcagatctaacttatatgagttgacaacatagagaagagaaagaagttgaattcagttaaacctggaaggagaaacccatagggtggaattatctgaatttgaatttttctgagttttattcccccctacattatgacacactaataagtggtctaccttgacccagagatacgaattttggcctcatttgtagaatagcacctggattcaggaataactccttgaagtgtcccccttaaatctctatgtggcattcaatgttcacttactcatagaccaaggagataaggacatttatcttctcaggtaaggtccctctgttgaacactgaaacaaaggggttacattaccactgcctatctttcagaaaaatgactgctgtgatagcataaatgtcccgagagctttgctttgatagaagtgtgtttttaatgatatgattttggtgtctggccctctgtggatagcttggcatgtgtcttgttctatttaaacagcactgactgataaagtggacgttaattggcagttagtgacgaggctgcaggtctttgttacccagcctttcagctaactgatcattaactaggaggaaatgtgtgacccagaaggtcattactgttattacgtgggaaaatacatttaaatgttacagattgcttttttatgaatcaggtgagcatttttagaaaagagagagcttgatttacaatggagtctgttttcagtcctgctcttttcctgtccctttgaagactaaacggtatatttctagattcccattgctgtattgcctagaacctcacaatgttgatattgactaaaaaacagaaatttcttcaactccattaagagcttttccaaaatcttaaaatttccaaataaaatcctttcgtctggatgccactcactttaacaagctttgagtaactttttttaatgaaaatgtgatagaaagtaatgtaactgcatatgttttattatgtaaaattctgatagtatcatgtatgtctttagaatttccgttgtcacacattgtctgtgctttgtaggattttgcagattaagccttagcactcattttgtgaggacagtgaatcctaattcctcttcttcattctttctgtgacctttttgattttgcctctttagtaatctcctcactgcccttgtaatgcaaaaaataagaataaaaatggtctgtttgggtgctgtgagtcttggcaattaaaacttcacatgaaatttgtctcctgagagaaaatattattctcccttttaataaaaggatacaattaaatactccctgaaacctctctccttcaaatatattgtcttatgtaaaagatggaaatggagccttgtttagctgaaaaactgaagagccaaaaacatttctaactataaattagtttatgcatattaaatatcccagccttagctctaataaaaacaaaaaaaatgtgaagcatggtgtgctctgtggttattaacctgttgttgaaaccctgacttcagttctaggcccttagcatgattacttctttccttctttgggttgcatgatgcttcaaggtctagaaatgccaatgtctttcccaaggggttttaccttttacctctgaagattgaagaaagcaactgagttgttcagaaatctctttaaattagatttaaaaggtactgggtttatttttgcatgtcttctttattttttcctccaaagattaagattgtattttagaaggctcttttggctcctttaaaaagaaagtttatccttgtatcatataggactgaaggagataggctgcagtttgaaggcaagagcatctgatctccaaagaatcagaaaatctcttcttttgttgcatttgtaggtactttttgttgtgttgcttttttttttttttttttttttttaatacaggtaaagttcaaacgagcacagcatggtccaaatggtgtttaaagctgtctaagtttcctttatgtaactttcacttcaacaagtatgttccagctgggagtctatcgggctgttaaaattaactttattcttcttttgttattctcatgcacacacacatacacacatgcctacatgcacatgtgcacacagacacacaggtgtgaacatgaccatttaatcacatccagcagggctgaatgtcactctgcggggctttattgactgttgtacaggctaaacatttcattcagttgcaagacagaaaaactctgcaggatgaatttcaaaacagagagcagaattgttacccacagataagaattctttgtaaggctttcaccttctcataaaagtgttagttaagaagaggtgaaaacaggtattccattcatctctgaagtgtatgcagtaatggcctcattcggctgagatttcccagcagcaaaaaatgtgcttggcagaacagttgctctaaatacctgggacatacattctttctaggattaaacaaataatacttgctgccctttgtataaaaagatcacttttctggtgcaccattagtgtacatttgatttgatttgtttgttaagcagcaaaggtgggtttccctggagccacttacacctcctctcggtcctctttgcctctggctgtatatgcatgttcattctaccacctgatgacttcatgcttactctgtgttctaactaaatcgaatgagtctcttattcccattccttcctttttactttcctgcctctaggcattaatttgtgccatttacctggactatctgctcccacctttgactattaatatcctatttattattctatcaaagccaaagaccatcatccccatgaattcctctgacatcccactcagaatctatctctctttcctcagagcacagttttttttctttttactatcatttaaggacagttaggccaaacacttacctacttaattataagcttcttgaggatttgggccacttcatatggcttttggttttccccaaagcattagctccaaaaagaaaggttgaatgaatgattggtgagtcatcaaccttggcatagttgggactaccctttgagaccactaaccagaatttttctcaatgaaatgaaatttattccccgacaaattgactgcaccatgttagtctccttaacatcatctgctgaaccatctcttaagaaacactttgatactagatggtaaataaccactgtgtcaagacctccaagtgccctttacctccaggtcacctgtgttcctgcagcaagacacacctctgtccccaccatgaggcagaatgaggcttgggacagataagacttccagaacccagctccagcactgtggccactgtctgattaatcagttcttcttctgcactgataattaaatactcactgttaaattttatattacccttgctagtatcattgttataaccaatgtgacagccacaaaagagaattaaagctatagactgtttatggactgtcttcacttcagcacagcagggaagaaaccagggatctgaataagtactagggatccttgctcattttcccaatttggctacaaaagttaatgaaattggggccaacgcttaaaatgcagatattgttatggatacattttatgatataaatagagatacacttgtttcatggaggggtaactagggacttagatttcatttggacctatgtgtgccgagcaattggaagcatattaaaactgttttatgtgtaagcatttattgcttttgcctataagatgttgcttatgtgggaaattaagagtccagtccaatgtattcctgggtatacagcttatgaaggcatttaaaacctaaagcatatttattctgcatttaaaagtgtttagagactgccttgtgtgttaatgtgtgctgtgcgactagcactatttaaatcctatccccctgcatgcattaatgtgtgcgtcgaagggaagaagagcaagggatgataaactctgttaactgcccaatgttcaactaagatttatgtaagaaagaacagtctagtgcattaatgtgaatattctaagatagatgtttatcttaatggactcagaggtacttacaaacagcataattgctgaagtcattttacagggcatttattcagagtgattacactactcttacttttctttacataaagaattccacttaagggtttaagtgagacaggctagtgtggccaaagaatcataggttcctcctatctgctgctcagcgctaaggctatttgaaaggaggagaagcaaaaccccaaatctccattttggcactttgcaagaaattggtccaaatgttcaatcactccagttttcagatctacatgatatttgacttactttaaacctatagtcctgcaaataagaaatttatctctctggtacatggttgtagaattcaaacattagttgtttatggacttttatggaccactgaggcattttctgtcttgaaagcaaatgtactcttccagagaaactcctgttctttttttaaagttttatttttaactgacaaattaataattgtatatataggtacgacgtgatgtttcaatgtctatattcattgtggaatgatcaacccaggataattaacatactcatcacctcaaattctttgtagcaagaacatttacaatttattcttttacatgaatgaattttaaaatatataattttgaaataggcaattcattattaactctagtcaccatgctgtgtaatagatcagaatctacttctcctgtctgaaactttgtagtcttcaaccaacatctcctcattccccattgacctttcctttctcagcctctgataaccaccactctactctctatttctgtgagtttgactttttagatttctacatacaggtgagatcatacgggatttgtctctctgtgcctggcttatttcacttagcataatgtcctttagctccatccacattgttccaagtagcagaatttcctgctttttaaaggctgaatattattccattgtgtgtgtgtatatatatatcacatttaaaaaattttattcatccattaatggaaaaccttcattcttgaaaaaatagcttataaagctatttatgtccctgatacctccaaagatcagaatgagtaataatctcacaaggatgggaaatacttcctctcttccaccttttgcatgtccatcctttgaacatgactcctggtgtgttagtctagtctgttctcatgctgctaataaagacatacctgagactggctaatttataaaggaaagaggtttaatggacttcacagctccacatgactgggggggcctcacaatcatggtggaagacagaagaagagcaaaggcacatcttacatggtggcaggcaagggagcatgttcaggggaactcccctttataaaaccatccgatctcatgaaacttattcactaccacaagaacagcatgggaaaaacccacccccatgattcaattacttcccaccgggttccctcccatgacacgtggggattatcgcaattcaaggtgagatttgggcaggacacagagccaaaccatatcacccgtcttacccaattctgttgaaataaacagacatttcctgagtacctgctatccattcaagttttttctatgagctaggctctggtccaggagtatagtaaccctacgggtgatttcagaccaataataagtaacactattaagaacacatcacagaagagtaacatctctgactcgctgatatccatttcaaaccacataacaatagcatgaagtagatgtcactgactcaaattaacagaagagaaaactagggtgcagtgtttgtgattaccttggactctcaccataatagactgagctcatgttttctgactcaaaacacaaaacttttcccttgatatagttgcctctagaagaagtcccttgtctccctcaaatagcaatcaagtagaagggaaaatagtgtaagtcaatatatattaagtactttcagtgtgattccaagaaactattgagttgcgatgctaaagggagcattttatttttcagccttgggatcagaaaaacattacataaagaagtgtttgggttggaccttaaaaaaaggtataccatttcagcaggtataaatggaatgaaatgcaaatagagttgggtaaggagcagtataagccaaaacataaagttatgaacttaatacccttgttcagagaattgaaaacatttaatagtcagtatgtggaggcatttatagggacaaatggtaatggaagatgatactacaaaattacactggagtccagaggtggaggatcttgaattttaattttttttaagtctagacttttgatagtgagataaatttgaaccaacagagtgaaacatgaaaactatatttttatcctggaagtactttctagagttcattaacaggaggaggtaagggtagacagggagtctgggtagggaattttaggattcatccacataagcaaccagggaagtaggaatgaaaactggagtaacattttagagatggctttgcaggacttggtgcctggaggtgtgacggggagcaggaaggatttgttacaggaaagaggtcccgacttagaccccaagagagggttcttggatctcacgcaagaaagaattcagggtgagttcacagggtacagtgaaagcaagtttcttaagaaagtaaaggaataaaagattggctacttcatagacagagcatccccaagggctgctagttgctcatttgtatggttcttgatgatatgctaaacaaggggtggattactcatgcctcccctttttagaccttatagggtaactactcttgtcccttgatgatatgctaaacaggccatggcatttgtgaactgttatgtcgctaatgagagtgtagcagtgaggatgaccagaggtcactctcatcgccatcttggttttgatagattttggctagcttctttactgcaacccgctttatcagcagggtctttatgacctgcatcttgtgctgacctcctatctcatcctgtgactcagaataccttaactatctgggaatgcagcccagtaggtctcagcctcattttacccagctcctattcaagatggagttgctctggttcaagcacctctgacagatttaaagatgaccctgagagtttgggcttgttcctagagagtaaggacaccatagacagaggccaggaaggcagcagagggaggagttaatcaattcagtctgggatatgctgactgctcatgtttccaagatatttaatcaaaaatattgtcccttatgtgttagtctatgttctattactataaaataaacttctgagactaaataatttatagagaaaagaggtttatttggctcacagtctgtaggctgtacaagcagtgccagcatctgcttggcttctggtaaggcctcaagaagctttcactcatggtgaatggcaaacagggagcaggcatgtcacatggtgagagagggagagagggagcaagggagacaggaggaggaggcgccacccttttttttattatttaattttttgagagggtggcacgatcatggctcactggagcctcaacctcccatgctcgagcaatcctgctgccttagcttcctgagtggctgggactacgggcctgcaccaccacacctaatgtttaatttttttttaattttttgttgagatgggatttcattattttccccaggctggtctcaaacttctgagttcaagtaatcctccctccttcatccccaaaagttctgtaattacaggcgtgggccactgtgtctggcccaggctctttttttttttttttttttttttgagacagagtctcgctctgtcacctaggctagagtgcagtggtgtgatctcagctcactgcaacctccgcctcccaggttcaagcgattctcctgcctcagccacccgagtatctgggattatagatgcatgccaccacacctggctaatttttgtgtttttagtagaggcagggtttcaccatcttggccaggtgggtcttgaactcctgacctcatgatccacccgccttggcctcccgatcttgtgatccacccgccttgacctcccaaagtgctgggattacaggcatgagccacctcacccggtccagctcagactcttttaaacaaccagatctcatgtgaactcattactatggggagggcaccaagccattcatgagggatccacccctctgagccaaacacctcccaccagccccacctccaacattagggattatatttcaatatgagatttggaggggacacacatccaagctgtggtgggcattgtaatcacggtggagctttcctcatcaggctgatacccaagtcccacccctgggtattgctagaatgtcacctggtgactaatgagtgccaaaggaggagaccaatcccgtggcgcccttgcatcctctctgcttgtggttgctctctctgtattgttctctctgttatgattggctctaacttccattaagagaaaacttgacctgcagtgactgaagacaggatacattttcttaaacaagaattccgaagtttagagaacataaaactgcttaatttggctcctataataggagccaaatttttattttataataaataattataataataattatatattgtaataattataattaattatatattgtaattataattaattatatattataataattataattaattatatataataaattattttattctaatttattttataattgtcaagtttaatatttgacaatatctgagtcagcttcccagttcttttcttggctttccccccaacttgccaccttatgggcacaagctgattgctgcagctccacatgtcccgtgcaaacccaaggaagaagggaaagcagtcagaccagccaagtctttttcgttttatcaagaatagaacaagcatttctagagcctctagaggatttccttgtttagctctttgtccagagctaccacatggccacttttagttgcaaaggaggcttggttaggccggtcacattgccagctctcgcaaggaggaagaggggaatggatattgacaatgtctgcaatagtcatcttccctgctacgctgaaagcactttaaaggcaaggaccaagctccgtcaggccatacttatgtccgtgctatgccacacttctcacctggcactttgctggacatatgaagacctgagatgagaagggtttgaggagacacttcctgcccactgtgctaagcactttcttgtgtcttttgggttctctgagcagctgtaggagtatagaagcctccagatatacgttaaactctttttcagcacctctcaaaacagaaaaaaaaagcaagaaaaagactacaagctgggaggaaatctatgctgctgtaaaaatagaatagggctggagtgcattcttcagtaatgaatgcatgaaaagcagcctcttcaattataaatgtggcttctcttgtttgttgcccagtaattctgttttattgatttctgtttacttccaatcacctcaaatgagactgtgttgcttagagatcttgatccctaaaagtttgtcattaaagctactctgctgtatttagttattttttgctcaaagcatttgaatcaatatgtatacaaacgaaacactttttcctttgctccctagaagactacaagaaaaaagaatctagaaaaactaaataaagatgcttagatttttttaaaaaaagtcccagcaaatgacatattgatttctttcaaagaggcagagtgtaaattaaaaatatttttctgacacagtttttaaagatgccactgactcagcagagtttgtgcttattgactttctcttcctagagggccagggtggaaaggccgcccacttttcctaagatcagctggctttcaaaatcctttgagggaagttagccttaaagccaatgcgagcaaaggttcttgattccctgtgatcaggtctgagttccggttttgtcatctaccacatcacttctgtgtataaaaaggtgttgtaatttttttttccagaaaattatatggtcatcattctttttcaaagtggttgcattaaaacccagaattctcagaggtggaaataaacaaaagctgcgcccttattagagaatactctctggaatgttattaaatgggtctgggcagatagagaggggagttagagtgggagcatgtgcattaaaagagccacaccaatacaggaatactagtgctgtttcctcctggtacctttgagagaataaagctagtttagacccacagtcggccgggcgcggtggctcaagcctgtaatcccagcactttgggaggccgaggcgggcggatcacgaggtcaggagatcgagaccatcctggctaacccggtgaaacaccatctctactaaaaatacaaaaaaaaatcagccgggcgccccagctattcgggagcctgaggcaggagaatggcgtgaacccgggaggcggagcttgcagtgagccgagatcaagccactgctctccagcctgggcgacagagcgagactccgtctcaaaaaaacaaaaacaaaaacaaaaacaaagacccacagtcatgaggctaggagggaagcacgagggacctggtttcaggaacataatctatttgtcataatttgagtttctgaaaccatgtcacactcctttggcctgttcaaaatcatttttcagaactgttctcagggttagctatataatttgtggaaaccaatgcaaaataaaactaagggcccccttgcccaaaaatccagaaaaaaaagtgttaaaagtgctagaatagaatttcttttctctttcttcaatagtctatttgttatgttttttatttgctattgaatgacatttaagtaaataaaaatgtaaattagcatgaatattaccattcgtccttatattgtgtgcaatgccagttttaaatccagatataagagcattcagctcaaatgcagaatcattgaaataacacaatttgtatgtcatagcccatatatgcatgtgtcttttgttcttattggaagagtggaaatgccatccaaaagtaacttactgctttttgtttcacttcttgatgcatgcacattctaccaacgctttttaacttcagcctaccgatgcatcaggtagaaccaaaaacaagaggtctcttgccctgtgcaagccaagcctttctgattagcaatcctagagagaacaggtggctcacgcctgtaatcccagcactttgggaggatgaggcaggtgaattacgaggtcaggagtttgagaccagcctagccaacatggtgaaaccccgtctctacaaaaaatacaaaaaattagcagggcgtggtggcaggcacctgtaatcccagctacttgggaggctgaggcagaagaattgcttgaacctgggaggcggaggttgcagtgagccaagatggtaccgctgcactccagcctgggcgacagagtgagactctgtctcaaaaacaaaaacaaacaaacaaacaaaaaaacaaaaaaaaaacaagaagaggtctccgggttgccctatctttccctttcatgtcatcgtctttactgtaaatggttggttgatacagagacttaagaaaggatgtgataggttctcctgaatgccattgccttctctctgtcttctaagcaacttctggttcaaagggagagcatgagctcctggggatgtcagtgttcctactcagcctgtagatataacatccttacctattatacagaggacacgatatagaatccggagagaggaaaagcaaaggaggccagctttggcctgagaacttaccctagtcactcttgcctagaagacagtaccaacctcccaaggagaaacattgggggataaattcaaataaagctgtttgattcagattactcctatatgtaagtgaatccacaggatcctgtgccattggggcatcaggaacactatatgaggatgagcagcaaggaatggaagtggacacacacattgcatgtatctcctctgcttgctttcatgccgcactgttccactgaacttcacttacaaaacacaagtgcaaagataaatgattaggaatttcaagatggtaagagcagagcatacaacctaacaaagggtctttgtgagcaaaaaaccctgtggatgacctcatggatctcatgcctgtgattacacctgctacatttccaacacccattttgacagcaaatgagtgttgctgtttatgaactggaacggggaaaattattagcctcactgtctatcagaaatgagaaacaattcatctcatctctttccacatagaagttctgttgtgtttgcttttgtaaattattttgaatcaatatctaagatgggtttatctatttactactaattgcagcctgggaataaggatgtgacttctggggttgagtgggcccatctgggtttctgaacttctcaatttaatagcacctgaagacattccctacctagagattttttatataaatcatagagctttatgggaacccatcctcccacatttctctgtgggaggttggtatttccttctaggcatgaatagggataaattctcaatcgaaagctgacctcctctgcatttttcctctactgggacttcataccatgttctcaaattgactctcatttttccttcatagttctgtctcaaacttactggccacagatcacttgtaactccctattttattaagtccagtttcaaataccaaaacttgctttaacttctgctattgctgtaacacctgtctctgacttttctaacattatattacatggctgagtgggatatactttttttttcacagtgtaataaggaaaagatagccttgtatttctagaagttgtattttatattcacttcattgcatttgattgttctggataagttttctgtgccacatactaagttttgggatgtactaacatgcactcttttcttgtgtttacatcttcttgagcttgcatctctttcttagagggaaggcatgagggaggaaaataagaagaaagaaagggaaaaagggagggaaaaaagtagatttggtctttggagcttcagttaaatttcccttataatggttagaccctaaatactcaaaatgagtatttgtggtgaaaacaaaagagctgacagtggaaacacagccaagcctttctaattagcaatcctagagaggacagcaccaataagaaagaagagcagccatcaaagccaggcctttatatgtatgtaatcaacaggcatctgatctagattcttaaagatggtgtggtttgggtgggtgattttatttattttatttttctgtctcctaaataatatgtaatttcttcaggccaagaaataaattgaaaggatttagagggatttgcttatcagtggaacaccacgtagcattacattcctcctgcttttgggaaggtacattgaagtttggttaatcttctgtggttcaatactcctcttccctctgtcagcctgccttgaacaacagattaatcccttttccacccactctcttctccttcctccctcccctctctcttgatctacccttccctttttgagcaaatagaagaaaaatcttaaaagtggggggaaaaaaaaattaaactgctgcactacatttatttatataatcctagaagacctcaagggtagaaataaaggatcccaatcctcggcacaaaatttggccaagcttagcttggtttttctactgttaattaaatcttgagtctgcaaagggatttccttaaagactaattcattagcaaaagttattataagtcacgtcattctttatcctgctctagtatatgcattgtggaaaagaagaaaaagaatatgctggctattgaggatgggtagaggttttagggagtgggtgatacgatttgcttgaattcctatgtagtctgctgtctttagtgacaatgaataattactgttgggtgacgcttatgagcccaacactaattttaagattttatagctaatgatttggcaactaatcagtgttttctggtttgacttggcttaaatctcagtagtctataaagtccatgaggacaaggaccaggtcagcctggtcccaagcacagtgattgactggcacatcataggcaattaataaacacttgtcaaggaaattagtgagtgaatgagtcaatgcaaatgtcagtacaaatgtaaataaaatcatatattcagaatatttttttaattcagttttagagagctctgttccaataacctaattttggtcagacagaatgcaatatctttagctcagggtgattctctttaaagctatctcatttcatggctatatgagcaagtaagttatgcatgtagtcatatcttggcaagtgattatcttcaggagtaggtagagggaagaggggaaagtaatagctggaagaacccatggcataaaccttgtaagacagttttaaaattcacagggtgttgttccaatcgaaatacttaagctcatagacataggatacaagggtcaccttagatagtatcttaacaagactagaattctgtcccttcacctccaacattcaggacctgcttcatgagatgcccccatctttcacacctgagtatgacaagttagagtcatttatgtttcatttgatcataacaatgtcagtggctttcaaaggtaactataaatgggatgtttaatcagaataaaataagagtataggtatgacagtcatacaatcttaccacactgtgaggttgtttctgtattgggcttaaattgagtgagtgagagggatgggggagagagggagataatggcttctaacaagcttgcccaagctctatgttttttctagttttgattacatataaaaatcattggcaagacatagtggctcatgcctgtagtcccagcactttgggagcccaaggtgggtgactcgcttcagcccaggggttagagaccagcctcggcaacatggcaaaaccctgtctctacaaaaaaataaaaataaataaattattcaggtgtggtggcgtgtacctatagtcctagatacctaggaggctgaggcaagaggatcacttaagcccaaggaggtcaaggctgcagtgagccatgattacgcccctgcactccagcctaggtgactgagagagaccctgtctcaaggaaaaaaaaaaaaaatcatccagttgtatgtgtgggtattagcactgatcaaagatgagactgtgatggccacaatttagtaaagaaaatcttaatagatacatttaaaaaaaaggtcaaacttttcaaatctcattaaaggttataggtttacttagagtcaataggtattaggtaattgaaaaactcaggcagcttgtatttaaatagagaatgaacattcataatgaagctagatgggtcctctctcatctgagatattcagagctccaactccatctcagaatgaaggtatagaggggaaagaactaaaacagcaaacatttaaaggaatttaattctttttagcgtggagcagctgcagagatgtatggctgttttctgtggggcttcagaatatttatgggcctttcccttttcctttttcaccggaagaaaggagatcatcattcttgagtgtgttatttataatttcataaagctgttctgtggcaggacttattttatctcatactaaatctcaaataactgtgcttccaaggagatgggtggggaaaattgattatccctcaaaatgattagcctattaccagtgtaagataaagagctgaagggtggaatttgaagttacaaaaggcagttgggcagtaaggaggggacagagtgaaacggtcttgagcagttctgatcacagctcacagcagtagacacttttctcatgcccaataatggattaataacgaagaacagtgtagaaccattgccaagaaagggtaaaacccttctgagtacataattagaagccaatgattatagaagcaataactcactggaggaaaatacgtcagatttgtgaaacttagggaattggaaggtaaatatacccataaatttacttgggtggacagagttctgagctttcttctgtcccagctttattctaaggtaatttcaataaacaatgttaggaggaaaaaaagaacataaatgcaataaaaaatcttccaggaaaggaatacatagggctcctgccagacagatattttattgaaagttattataatacctatctttagttttatgagtcctaacacagaacaaagtaatttcaacacgtggattaaaaatatgaaatacatattttaacatgtagtagtatgaattattgttttaaatataggacttggctaatatataggggcagaggaatatttttctccccttgagaaagcaagttaaggtgcttaatatgcattgtgaaactgcattgcagtcatactcatgcactatgttctataaaccatgtgtagtagcttccaaccaaatgggacagatgacactggtgagatgcagggagtggagaaaggagagaagtctgatagggcaggacatgaaattcatgctcagtatctaagttttcaagaacaacatagctcaagtagtggtcacactgtcattctagtccatcccttccctccagtcatcctctactactagtgggtgtataaataaaccgtgttttagacctctaagcctttgcaaatactatttcacctgaaatgcccttctccttctccagcccacccgtcctcacttccttcccctgtctcaccactgcctgtccctgagggctcatttcccacatgctctctgccttcttgctatttccttccttcacacattaatgcttcctcttgtcagagcattcggtttactacatcaagtttgcctgtttacttgcctgtctcatcagactgtgaattcccagagcagaggaactgtgtcttatctatagctttatcccttataactgttaaagtgcttgacatataggtgtttgaaaaagattcattaaagtaatgaatgaatgaaaaaagcaccttgatgacatataccactgacagtaaatctaacagcccagccactgtgaaaattatttggtgggtggtcatagagtttttaaaaaatgcttccttgaataacttatagagaatattggtatttgacataggggaaccatcatacgtcagcactttaagcatagccattgaaagttatgagagctttagacaatcattgtgaggggaaaaaatgtgaagatgacattgaacgcaacttgataaacattcccaacgtaactatgaatagaagagtttcctaaagcaacactgtttcctggaggagcgtggatggtggacagttaaaaataacaattcactacaagtgtttatacccttggttacagtgaatactaaattaatgtgaattaacagctcagcacaaagcctaaatgtagccagtgtttattaagtggtaaatgttattagtaggcatgagtctagatagtctagatatccatttctttgcaggcatactaactgctctttcttctaagtaattaaaagtaattacagacaatggttgtgattataggaaaatacacagacatgcagcctaaggctaccacattttattaaaaggcagagatccaccaatttgttctacttatagcaattctattctgagtctgagtctatctgcaacatgaaacctgttttacaagccatggaaagcaatcaaagaagtgtgccttttctttcaaggttcaacatcagatcctgcatttgcttacatctgaaaaagaacacagactgaaaaagccaaaacaacaacaacaacaaaaaactgctaaaagaaagccctgggttttctgaaagtatctttgaatccaattgccattaatttaggatatgatcttaagccgctcatatcatccaaaagccttggtttgtaatgtttggattttctagatgttagggacaaaagtagtttcaaaaaagtctaagtgtagcattcctaattctaagcctttttgcaaattaaggcctctggcagaggaagtctttccatactacacagtgttctgtggcaggtgtggccaatgttgcatgccaggttcttgaggaaaacattggttaccaaaacaggcaaagagggactgagatgtttgtaactgctttgggagtttcagttggctgtacctctaagtggtaacgatgaggtctgaaagacacaaaggaaggaactgaattcatataagacccacacagattgtctagattcacagccactgagaacagatcacctttgaatgattgtttaagctctttatgagtacatttttctttatcactcctcatggcaggtgcaaccagaaatagtatgtgtaccataaaatggaagtaatgaattgtcagcaacaaagaacacttctaatgtggggtaaatcgtaacaaatagagcacataggcagataccaaatttatttaaattaggagtggctatcaggcttggaattactttgattgagaggctgatgttgattaattgtgaagttaaactatgatgttgattaatagtgaagtaactaagtgacgtgtgtgcacgcacacacacacatcccaggtcactttctgaatctacgtagaggagttgggattcacagttgtgctatgtctagggccaggcccattcttacgacacactgctggatcatttccccttcaaactcctttgagtctgggcaccattgctaggagctactggtaaaatgtggttctgttgcctgggaagaacactgtattcacatgtactcatatagaagatcaacagaaaacaaatctttgggcaaagtggagcgcagagagggttaaaggtggaaaaagggggtcagaaggtgaaagatgatgtgtggggtctgcaatggggattaggggcccattcatgggatggaattggaggtagagaaggggtgggagagtggggctggggatggtgtcacctaaaccacaggggagagaaacttagtagtatgagaggaagccaaggaagctgagaggaagacagtatcttttcaacctcagagtctactcctttttctgaaaaaaaaaaaaaaaattacatttcttcttttggcccatgcaaatgaagaagtctcctctgagttaaagattcaactaatattatgttaatgtatgttttggtttctactgaagttatgcattgttttttaaacatttgttcaatggcctttaaactttattgccaggctttcagttcttgaaaggagctcattagattttcattaactcaccagctttcactcaatactagggaccaaagtcctaccgggccattctgcaaggcccttacagtcaaatcattaataatttccagttgaacacacttcagcagtgtattctcagcctctttattaccaccatcctaaggagttttttcagataagttttccccctaattgcccttttcccacaacatttcaattccaaagatatactacatattcatttatgtaactgtggccttttggagggtcacaaaccattgtaatatttaagattgtccctcagcccaaaccaaactttcctgcctttggtgggagacattgcccctataaagaatgcatgcttaaaaactactaaacaatgattgtggtccttccaaaatagtgttttcctcttataattgccgtatttatttcaacagttaactcttttcccacttaccagctcctttccctaagtaactagaagtagagctattatagggccccctctcagcaggaaacaccaagggaatatgcttaccatgtctctaacacaaataacagccccccaggatgtaactaccagtttcagttgctggaactgaaatgaacaattcagtagtgtgtgttttttttaagtatgtttaaaaattcttttttcggtgtggagaaggagagcatcaggataaacagctgatacacgcggggcttaatacctaggtgatgggctgataggcgcagcaaaccaccatcgcacccatttacctatgtaacaaacctgcacgttttgcacatgtatcctggaactttaataaaattaaaaaaataaaaattctttttttctgctagccttgaggagcaaggtttgaattatacccctttcagatgtagaataaagatcaatattgttgtgtagggcacttctctgccattgttaattaaatcaatgaattatctaatgtggtttttccagttctttgctgtgtccagtaattccatacctaggatgtctatttaaaaaaaggatgttttctggaactcctaagtagaaaggctgtcatatatattcatttattagggttgtcataacaaaatatcccagaccaggtggcttagacaatagaaatttatttcctcgaaattctggaggctagaagcctgaaatcaaggtgtcagcagaattagtgtcttctgagaactctccccttggcttgcagatgactatctgccagcgtctttatatggccttcctcccactgggtatgtctgcgtcctactgtcctctttttagagggacacaagtcatattggattagggctcatcctaatgcttcattttaacttcattacctctttaaggctttgtatcaaatacagtcacattctgaggggctggggagtaggacttcaacatatgaattttgaggggacataattctgtccataatgtaagaccaggtataaagaagcctattgcaagccacaaacacagaatttgactaagatgtatttattcaaattcccactatgtgttttactagctgtatgtctttcagcagctcacttaacctaactgcaattctaattagtcatgtaatagtcatccctgtcccaaaagacggttgtgagaatcacgtctaattaataactgtaactaaaaagtgtgtgtgtatatatatatatgtatatatatatatgtgtgtgtatatatatatgtatatatatatacatatatatgtatgtatgtatgtgtatatatatatgtatgtatgtatgtatatgtatgtctaggacagcatctggcttgtagtaattgctcaatagaaggggagtggtttattacctcttcctcttgaatttggatccagactttagtacatttgggaattggaagatcaacaagtcagtaaatattggtcacatgaagaaggggaaataaatgagcattattgaactataatatattgagtcttcttatgcacatagtaggccaaaagttttgttttttgcataagatctgtagattcattcattcaatatttattgtgcatgcaatatgtaccaaatacagaaagcagtcatctcacctactgtatggagggctcttctcacagctgatactcagtctcctatatttcttgtaatagattccctgggactggggagtttctgcgagactcagaatttaaaaggtgcctcaagtcgaactactattattgcagtcagaactgtttttgctctcttcaggaacagccttacctgtgttcagggactattgtgtggtatcatgctactggtctacattaccaattcagctattgcagcaattacatgaaggaattcttgctaatgataaaagccattatgcagttcctaaagagaatgcattccacagcattcattaattatgccagcctgtagatgcacaactaccacggcatacacttgagaccacacaccataaggattgaaactctctcaaagccacaatgtatgtctgtgttgctttgcactcttacattgcccatcctttacaacagcccttctcctgtccttctgattcctaaaactcaaaaccagaatgaagtaaggctacaaaatgtcatttatggggatgggtgaggcttaagtctcctggaaccatcttgggtcactcagctctacggaagacccccctaagacggtctagacccagagtcattctcagtcacacagtagttaagaattcttcatcctacggtatgccctctctagaaaaataatcgtaatgatgggagatgggacacagtgataaatctttgatgtctttgttcattagtttccttatctctctctcttctctctcttcccctaccccattattttctctttgacataaacagccaacatcagatgatcttgtttcatctgctgaatgttcaagtgatgatgaagactttgttgaatgtgagccgagtacaggtaggtcaggtcagtcttattttgcttgctttcttttttcttttgcaaaaaacaatacatacatatatgtgattatacatgtgttttatatatagattatagtgtgttaatgtgtgtatatttttatatctatatatgtataagtatacatatataaatattatatcaatgaaagcatcaaatcccatggaaagagcaataagatcctacaaaaattaagtcagtctcttgatagctaacaaaaaatcatggtatatgacttaacattgggcaagcagatgcccagacttaccactggagcagcaaatgtgtaggagccagtggcagctatgaaattcacagagggtgggaacatgaggaaatatatgttggaatgacatcaagaaaggatgaacccatggaggagcttaaagattggtaagtggagccataaagattggtaaatgacttaaaactcatgaattattctgagctaagagaaccaaaaatatatgtatatatatattttccatgggatttcaacagcagttaacatggtattatctttgtactaattttgttaactgtgtgtctagaaaacttgtgcaacaatatagtaaacacaaaattagtgctgtaccatgccgtgtcaacagctgtgatgcttcaaaatgtatctactgtgctgaagttgagaagactttagcaatcagaagcttcaatgtgttccccatttggacccagatacattttgatgttttatggtctttctttatagtgagctacatatgacctaatgtccagcaggcaattgcagtccctgattatttcctatcaacttttcccagttgtctgttttgagacttactataagttaaacgtttatatgtatataatagagaacagatatcatcgaatttctgtgtatgtttaatagaattaatagctggagttgggccaggatcttatttctgtgaagactaaaataaatagaattttctagttattttttgcattgctttcagatttttttccttttaagaaaaggaaagccattaaaaattctcttttgctaattctagaaaatttaagcttcatgaaaaaataatctaataaaaataaaaaccttccatttctgacccctaaatgatttacaagatttcaaatctgttgaagcctgactgctttggtttcttgcaagtggaattggatccaggaagttctgtgggttcatacccttagtatgacacagggacacatcattaatatgatagggcttccattctggagtgtaatctgttccattgggagctcagctgtgtggagggaaagtaaatgtgatctggtcagggctttctttttcatatttttaggtaataatctgtatgtgctatgtgaggttttaaccctaaaagggcagatacatccgaactataccagaacttgggtgccatgttttcattaatttattcattcattcattcaataaatatttttgagcactcaggcaggatacaatatatctctagatttgagtccttcctattctgttttttttttttaagaaattagctgtcagagaatagaatagttttgctatctaactcctcgcgtaattcaattcaacagatatttttgagagtcaactgtatatgttaagcatgtgctagatattaagggttcatatattaataggtcacaatcctcaatacgtacattaaattagcttgttttgtggcaaaccctttaagaaatctaggctttaattttatatatatatatatatatatatatttttttttttttttttttttttttttttttttgagatagggtctcactctgtcacctaggctggagtgcagtggcgtgtttatagctcgctgcagccttaaactcccgggctcaagtggtcctcctgcctgagcttcccaagtagctagaactacatgcaccactatgccagctaatttgttttattttgtgtacaaatgcggttctcaccatgttgctcaggctggtctcgagttccaggcctcaagaaatcctctcgctttgacctcccaaatgtttttcttcctttcttagcagtgatatctctatatgcagcaatgtttatcaaatctgtagattttaaggcttatcaaaattgaggcttggtcattctgaaatattatcaccatctttcctcaactactcaccctgcctcagaaagtcatctccacagcaacattcataataaggcagtgggcttttccagatctcagcttcagattctctagctctgtagctccccagtttatgggtatatattgctatttgttatgagacttgaatagcgtaaacctgaatggccccaaactaaatccatttgttttctagaggccacgcaggtattttctctgattcagaagcagaggacagaaattcaacaccaacatttcttgaataacatggggtgggtggggagatacagtttttagaacaatctgttgtgttctgtaagggagcatgagaggagataaagtgagtgacagaacccctacctttaaagagtgaacatgtagctctaggaggctgatattgatttcctccacctgtgattattcaactcatcacatttgaagaatgagcattgcatttttctaattttatttactccataaagtattcctggtgagtgatttggatatacagggaaatacgtcagtggtatatttaatacaagaagtaggtagatattcctagtaatgcagagagagaagaggtttgcccagaggacctgatttccactaatggggattacctgcttagagctatcaagccctctttttcattacataagaaatatctcctcagaagttcaagaccagcctggccaagagggtgaaaccccgtctctactaataatacaaaaaattagccaggcgtggtggcaggcgcctgtagtcccagctactcgggaggctgaggtagagaagtgcttgaacccgggaggcagaggttgcagggagccaagatcatgccactgctctccagcttgggcaacagagtgagactctctctcaattaaaaaaaaaaaaaaaatatatatatatatatatatgtatgtatgtatgtatgtatctcaggcttcacattttccaaaaacaatacagattaaaatcagaaatcagtttcttgggcaagatttgcactgcctaaagagaagggacctactgcccatgcagcaacagataatggtgacatttacacatctttgacataaattgccaatcttgcaattctacattaccactaagattaaaattctggttttgaacaccctaattcactgcctccatttctaaaacatttttccaggccttttgcttgatggaaatacactaaatttggctaacttccttggccttgttctatcatacttactactttatcttctttcactttgccagcgagtttattattttctagctgtctccgtttatgaggcatttaacttctacaggttatttcctgattaatttacatccatttgaagctctcacttttcataaatttgggtagtttagtgtgtgctataattcaatttttattttcatatgagcatcaaattttaaatgaaataatttattttttcttcaaatcacattggatttttaaactgctggttttgagttagttataagcaatcgcctttcactctcagaacttacttttgtgcttaagggtcaccacggtttggtatagcttaatcttattatatttaggaacaaggtaaatatttttggagtttggtcaataggagtctagaaaccttgcaaatccaatggaagtcaagttttcacggtatatttttgctggtaaatatgtagagaaatttaaagaaatcccaaatcatgagagcaaggcataaagtaaaagctcaattaggatttgtcgactaaattagtttgaaacagaactttatatctctaacttcatttcccctttaacagctaaaattaaacctattgactcatttaaaatttatgatttcatataatagggctgccctgacaaaatctatatttttaacaaatttgttttagaatttttatttctttattttgagactgggtaacaagactggctaacttttgtatttttggtagagacagggtttcgccatgttggccaggctggtctcaaactcctgggctcaagtgatccatccacttcagtctcccaaagtgctgggattacaagcataagccactgtgcctggccaaaacctacatttttttttaacaaagttattctctgctttttcctatccctacctttttctgggaactagattattttataagtcacagatacaatcacattttctgaatatttgcttcaagaacccagaattgaacctttaaacaataaagttataataaaaccatctgcatcaaatgaagatattcagaagtgtatctgaatagctatctagaggcgagggtctggattttaactcgatttgtaaatgttaattgtgttcttcacaaaacaaatcagtatctaatactttagattcgttctttgcatataaactgtttcattcccaactgcacttctattaatcttaaattgtgcagtaaattcatatttcattgtcctttttctctttgaatccaagaagaaaaacggatgagctggagagcattcaaataacccctaggaaaaggataccctcatgagattatggaagccaaatagcaattaagatcattagtaaattcacatttgtaatctaaaatgtgggaatgaattctgaaattcagagaaaataatacaattcacttcccatttcttctctttcccttacccctgctgctatccctagaattcccatctttggaaatagagtaatagtgaaaacaaatgtattcttggatgagcttttgtataattagatatgatcaacttcctggattttacatttttatagtttcaagattctaaaagtcttgggggcaggaggccacagagcagagcgaaaaaaaaaagtaatacttttatacctaataagtgggcatggcaatacttaaccacattgattcatccagtcgttatccaggggtatatttttcagtttgtcaagtagctagtttttctgccttcacttttcttaaatgtcctttgatcaaatctcaagggacagcacttccaccagagggcagacagtaaaaggaagtgaagatgaaacacatccatccatcaataagactgtgctaagcagctttcataatggttgggaaggagatgtttaaactaatggcagtaatatgagatgacaaaataattgctattcccagagtggttctcaggtatatttttactcctcaaatctacaatattcacatttgcatttcggtgttactgctacttagttcctctttgttagccctactataatatacaacccaagctgagtgaaatttaaatttggcataacaccaagatcacatctagtattttccaggtggaactggattcttaatctttatcagtctgagatgcctcgggaaagtatcatctgaaaatctggcactgagttactaaaagctcaccaaatcattttactttttatttgctggaacatggtagaaaatgcagctgaaatgttaatagataataataattttccagtgaaggatcaagagaagtttataccagaatttatagataacaagtaaatgtgctgattgttggccttaaatatgatgtttgaaatcttatagagatacgttttgtcatttgtgtctttgtcaagtttgaagttagcaacctgtatgtttttattacaaataagtcaattttatttaactatttattcactttagatttttctatatgaaaactcattagcaaatagaatcatgttaaaatttcattagtcaatggctattcagaatatagtacaaaaataaatgtccaagtaaaatctcataggaatgttggagtatgacagatctataaattcaatggtctgtaaatgctataaattctgataaaaggctcagatccacttaaacactttgaccaaagagataatggaaataatctaagataagcattttagctttggaaagagaactgtatatcgatagaaaattacttaatttaattcattattattggctgtggacatcagtcattttaaaatttgagttacaatacatgtctaatgctcacaaaagcaaatagttgttcacatacttaggtctaggctaaatcatatccatttttcaaccgccttcattgatctataaatgaatatagtatgttcatgggagtataatgttccagattaatgatacagtttttgtctttgttaacccaccaagttatttcactttcttttcttttttcttttttcttttttttttttttttttgagatggagtgtcactctgtcgcccaggctggagtgcaatggcatgatctcggctcactgcaagctccgcctcgtgggttcacgccattgtcctgcctcagtctcctgagtagctgggactacagacgcccgccaccacgcccggctaatttttttctatttttagtagagacgggttttcaccatgttagccaggatggtctcaatctcctgacctcgtgatccacccacctcagcctcccacagtgctgggattacagccgtgagccaccgcgcccggccagttatgtcacttttttataacagccccaacccaacccaagttattttttaaaccattgcagtaactatgtgcttttaaaatccttaatggtgaaatgctttgaaaattagggtaagaacagaaatataagaataggaaagatctactaattagctcttgcactttaggctgaggaatagtgtgcataatatatgtggcccatagatcgactattgtggatttcataacaaatatatttaataataaaaaaatgaaaaaaattctatccaactccattacccaagattttttagtaggttggagagcgaggcaggggaatccataaaatcaatgtatgagtgtatatacttctatctgaaagtttgataaatctcttctatatgtaacacttttgagtaactattacatgtaggcactagaataggtgctgggaaaacaaaagtattttgcttcagaaatatcgcttccagaagttcagtttattaggaaaggcagatataataagaggaataaaaggaagggaagaaacaatgaggacaatgaatggaaatgcccacgatattatcagcaccctaaggatgttggagcactccaattcagtgaacagcataccttatcagggatatgcaagaaaaaaaaaatcacacaagatgatgccaagcagtgacagattcaactaaccccaaggagcattcttctgtattttagtttggtgacacagaattctcatttattacgattgaagaattagtacagttcagtaaagtaaaaaagcaacactcttttggaattagtacagctcagtaaagaaaaaaagcaacactcttttggggacttcacatatacagtatggtcaaaggccacaccgtttttaggtaatagggtaaaggatggacatgttgaagggagaatttcaatctgaactcatgagaacttcctgattccaaatgccaatgcaagtggtacataaggagtgagcttaatgacatcattaagcaagtcccccaaaaataaataaagagggattgggttttaaaagagaagtttttatgggatttattctttttattctacatttttcttccataagccccaagtatatgtactgtgtgtatatatatatatatgatatgcacatatgcaaataatatactgcctgtcactccatatatatgtagacacagtataagtgatattagactaatgtaaccagagattaacagcccctaccatcagtcatgtgtttacacagaaattcacaccatcattcttaaccagcatcagccaacatagacatgcatgatactgttttaacttggcaaacaaagcatgttgatttttctttaagatttctttatcataattataatgctgactccataattcagttatccttgggaggggtggaaagaaaaaattatacagatatatctatccgtatatgcacattcctgtgtatatatataaatagatatataccttgtatatatttgaagaacattttgttgtttcacctcatcttgtgccgcatgaatttttggtggttcaatttattttgttttcatatttactattttgatcattatggctatttttaactcattgctatacttttatgagtaactataatcattattttcaaatactgagagatatatagatatacaaatcaaacaaggcaaaaaaatcttttcttgccatcctaatctcaaattcctcccctttcagcatatccctccagtatttatctcaaaacaaaacaaaccccaacgaaatccaagaaagttgtgtacaaaagaatgaatactgtgttttcctcttcctccttctatgcatatttttccttttaatttccgtttctttccttttgatttacccccatatctgcatggaccacttgcctttactttcccctttatgacaatgtaattaattgaaaagataagagtcagaaaaaaataaaagaaaaacacatagaaatgacagagaaacacacccctctccacaaatttcagatggcataaaaagaattttattgcagatatagaatatttgttgtatcttttatttctgtctggacaagcccaggatcattgtgtggcatgccgtgacaagttttgtagcgcatcaactaaccatggcctccatcacaagtgcatgacaccatcttgtgtttcatccaagtgacacatctaggctaacccagcaagtccagtgtatgagttgtgggaattacattcttttgtagttataatttcatgggtccttgtttttattattatttccattggatcatgacagccctaagagctgctctcgcagcatctctgtatggttttgttcttgtgttttcttttcttggcacagcagtcaagcatgtgtctcttgtttggcacatctgtcttgccatcttgtcttgtccactgtcgtggtgttgttctgtgattctgttctctgtaagatgtgatttgaaatcctctgcctttatttctcactctcctattgtctctacttttaaccttacccctagggaacttcacaaagaagcaaaacaaactttcagtcacattataaggctgatcactggtttgcatctggaagtcataagttgtactttttacctgacttaaggaggaaaaacttacagtgggaaactactgataattatactcaaacagcaaactgatcaacgacaataagaaacccttgttgattatttttggtatgattaaatgggcttactgttaaagggacttcatgtaagatcttatttccaaagagtttttttcataaattatcagtcttctagtcagaaacttttcttcaggagcagatcaacggaagatgtttttcgggaattgttagtgagggagcatcatttctgctgtgtagaacagtgcctgttcctgaattggggaggaactttatggaaatctgcaaatgttttattacaaaatgcatttatgtttatgtattaaaatataaatgtgttcagcaaggcatctgaggatgggaaaaaaaaactttttaactcactggttccacctcatgcatattttgaggtaagattatcttttgatctttctgagtcaactgatatacattttacttttttattttttaattcatggaagcattagagagccaacacttcaactttgacctaaattcattcttttcccattccagagaacacgacatacataatagctttagttctgagaatagagtctgaatttgagacaaacgtagaaggaagtgcccagttaattatccaaatgttggactctacctgtgattatccaggcgatttgatgctttacttggaaggatttgattagttggatacgaacagcatgaaaatgacactttgtaacaactttccctctttaagggttgagcacgagaatatcaaataggtataaaaatgagtaataggtgatatattaatagattaaagattattcaataggcctaaagatttcagatgaaaaatctgtatttgtaatctgaaaaagagaaagcatatccagacctgtggttttctgatgagatctttcagtcaggccagggtagctattggtttttcttaagggtaaggggaaaaaggccaaggatgaggaactggatggctctgtggactaagaacaactttctgatgaaagaaggaagggaaacaagaaaggcgaagaaagaggaggagggaaatgtaaaagaaaggaaggaggaaaggaagagatattgattatgagccaggtaaagctgcttgctgataaatattttaaaaccagcacacacacagagctctaatttgcagttttccagtttctgtatggtgtaaaatattcccaccatggctgatttctagctaccaatatgacagccctaaactcagaattgggaagtgtccttgctcgtacacaattatatggctttttcatcatacgtacactatagacgtcaagaacctcatagataatagtaaaatttagtaaaataattaggaagtaccgagttttaagtttttaattacctgtttttaatatacttgtaactttatatatatattaacttttgaaaatggccatgttttaacaaccagcttacaaatttcctagaaattttgcaatcagttgtcataaactggctcaagcacaccactagcccaggtactatactgggtacatgaaaacatagtattttatttaaatctcattttaagttattgtgagataaaaactagcttggtcatcttacagttgagaaaattgggattttaagtttgcttgttcaaggtcacatacctgcacataaatggtagaggtaatattcaagtccaaatctgtttgaaaatagacattttctttatattacagtgtgccagtcattctttcaacacttctcaaagtactaagttatcgaattttgacacgctcctttgtggagcttagcatgactcgggtttccctattgcctcaaggaggtccttggctttaactgtcttagataaaatggagtttaaatgtattatggttgtgtcaatggcaaaatgaagacagtgaagcaaaattagaactcctgattactctgtttgtaaatgccaccaaagttatgaccatgtcttcatgagaatgtccactttgactaattttgtttcctccaaatattcctcttttactaacattgacaatgaacaggatatttcttaggttttcatattctgtcccttgagctttggaaagactatcccagatacattttctgagcacatagaatctatagcatgatcccattacatagttaggttttataacttttaaactctaatgaattttatttagttacagtatgtaatgcatgttaattaaccaactgcacagtgaaatatgtcaatgtcctttgcttccacattttctaatagagtaagctagtatattaacatttaaaacagcatgagaaccatagtactgcagaaagcaactgcagtttttaaaaagatgattttattgtaagatacttaatcattgctctgtaaaagagtttgagaggcctgggaattaaaaaggaaagtgttgcagctttttagtccttctaatttgacaagatagataatttgattgggtttctgatagtgcagtattttgctttaatttggtgtgaagtttagttgcccccataattattattatttttttttggtcactctgtcacccatgctggaatttagtggcatgatctcagctcactacaacctccacctcccggattcaagcaattctcctgcctcagcctcctgagtatctgggactacaggcgtgtgccaccatacccagctaatttttgtatttttagtagagacggggttttaccatgttggccaggctggtcttgaactcctggcctcaagtgatctgcctgccttggcctcccgaagttctgggattacaggtatgagccaccgttccgggcctccctatatagtaaactttcgatggcagcatacacaacattgaataaagtcctttgaagtgacttctaggctttctcctataggtttgccactgctacaactttgtttcatcattcagtgaatattagcacttcctttagtgaaatatagtcttaagtacttcacattgttaactactttaatcctcacagcaatcatgtgagagtctattcttattatctccattttaaagataagtaaatggaggcacagaggagctaagcaaattatcaaggtcacacagcaaggaagtagaagaaatgggatctgaacccaagccaactgcccccagcgtggacacccatcactatgctatcctgtctcttacgtagcgcttattttccattaacctaaatatacgaaatagctgccggcctccttgataataaaagaaagtctgtgtattgaatgtattacatggttgggaagtagttgataaatgggttagttattatgtatcaaaaaggctttaacaatcttggttgatgggggttataaaattgttccattatgatttattcaaataaccgtggttaaaacaagttaccctggtttcccataaggaggaatgactccaatattggagagaaataccaacacttatgtgaggtgagtctcccttgatgtcacctatgcaataatatgtgcacttgggtttttttttttttttttttttttttttgagacggagtctcgctgtcacccaggctggagtgcagtggcgcgatctcggctcactgcaagctccgcctcccgggttcacgccattctcctgcctcagcctcccgagtagctgggactacaggtgcccgccaccacgcctggctaattttttgtgtttttagtagagacggggtttcaccgtggtagccaggatggtcatgatctcctgacctcgtgatccgcccgcctcggcctcccaaagtgctgggattacaggcgtgagccaccgcgcccggccgcacttggggtttctagctcattattcatgatcaattctgttcaaaacatatgcccagacaacagccacctttaactgatgttaggaatctaaggatagaggctcttagcgagagcttgggttaagatactgcattttctttatttcagaaataaatatgttccttagaacacagtgatttaggtgttacagctaaaagaaagcaaaaaacaacaacaacaacaaaacgaacttgtatttcttatcttagaccctttctgacacccacatgctcttgacatctcttaaagttgtaactatttgtttatcctccctttttcctcacttccttgcattatgcatccaaaactattttaaaagccaaaacacacacacactttttgtgggtctttgagtttcctatgcaagaaaagaatcttaaaatgagttataaagaactaaaaatcacaattaaaaaggaaacataattttaaaactgtgtttgcttgtattataatccttattccaaggcaagtatggcctgcacaaacatctgaggattccattacaaattatatcagtctcaacccatcccgaatccagatcataaactcataaactggaaaatgtgtatagttgaaaatgtttgcataccctctgtcctagagcagtgcttccatcttagctttgaagcacagagacctcctcttactaaaagatcatgaaaactggcaatactgtattgcccagtgttaaaatttgtcagattaattacccagagccaaagttagcaaactttttttctgtaagggctggggtgtaagtattttacactttgagcgtcttacagtccctgccctatctcctcaatcagctcttataatgacacatagcagccatggaaacaaataaatgagcagggctgtgttttcatgaaagttgatttccaaaagcagagatggagctggatttggctcagaggtcatagtttaccccaatctagagaagtcccataggttaaaaatgtgtagtctttttttttgtttttaatagataagaccttcttgcccattttatagtcgttcccaacatttgttgagttctccactaagtacatgagaccacataggatacaacaggacattaaaagcttttttttttttttttttttgagacggagtctttttctgtcacccaagctggagggcagtggcacaatctcggctcactacaacctccgcctcccaggttcaggcaattctcctgcctcaaccgcctgagtagctgggactaaaggcgtgagccaccacgcccagctaatttttgtgtttttagtagagacggggtttcaccatgttggccagactggtctcgaactcctgacctcgtgatttgcccccctcggcctcccaaagtgctgggattacaggcatcagccaccgcacccggccctaaaagttcatctttaaggacatttcccacctttgttttagatatgccactatctcagacatgaaacacaataacaaactaaaccagggtcatctccacccagcttgtacactacatatttgggtaggagcttaacgtcttgcccttcgctttgccagtgtgtcttctgagctccccacctctgctaggtgtgggctgcattcacccccaattttagacctctttggcagtagcttccttgatctcccgcccacatactgtgtcatatcccagtaattcttccccaaaccttggctatgggttattgagctgacaaatgtctaaatgactgagatacgatttcacaacctgctgagagcctcttctttccctgtactctttgatttgtagctttgtaagttttgtgaggaaagtgggaaaaacattcttggtgacacaggcagtgaatgaggaggacacaatggagtgggcaccatatctaggactcctgcctgcattgcgagcaaaagcatgtatttatatcttagccctctgaatgttagaggtagcagattatacagtatggtgcaggaaggagcatcctatgtcctgaggtgaataacgtgttctaccacctggcagcagattagaccagatcaggctatgagaatacaggttcacagccagatttagtactaccagccagatttagtactactgcaaaaatggcttttccttaagaagtttttgtttctaacttttattttaggtttatgggtacatgtgaaggtttgttacctatgtaaacatatcatgcggttttgttgtacatatcatttgatcatctaggtattaagcccagtatcaaaaaattatcttttctgctccctccatcctctcaccctccctgctcaagtagactccattgtctgtcgtttccttgtgttcctaagtcatcatttagctccaacttgttgagaacatgcagtataagttaatgcttactctctttaacatctttcacattagaaatctatggagaagaaatatgaaagactcatatataaacatggggcaaaccatgaagctaaatcttaatgtatcccaaaccccagagggagcataaggttaactttgggtggccagggtgcttagtgataacattatgagctttctacattagcagggccccctggtgtggttttgtgcctggagatgtaaggttctgaactacaaaggaagcaaacaaaatgaagagatgatgcaaggaggcaaaaaagatggaggcattaggaaaggctttgagggcaggaggcacggggtcatcttctaaaataacctattggaatgcatgttttaataagctttgaagatcaaagagattaacaagaacaagaggaaaacaagggtaaattaggcactattgatggcctgacaaggacttttttctccctttctgcttacaataacctctcattttaccatgtggctagttggtttgtttacttgtttgtttacacttactcattactagctttccctataaagcaagggaaaacactctgtccccaggggccagctgcataacatgaatagatgaaatagaccagaccagatgcaatctgcagtcatgggaactctgaactgaagagaacatgccctcatttaaaggcatccaaatgaaacattttaaaaacactaaaataaagagaccccatgaaggtcaaacaaggcataatgagacacacagtgttttttattcttttgtttcttaaattcctttaaatatagccctttcataaatttggcaggatgtgctctcagtaaaatttctggtttagtaaactcttggtgacattatcaaattaaacagcaatcccttccaaattcccctaaagctaagacctttttttttttttttttgcatgtctttttttctctgataatcccagagtttatataacctcaaactataagcttgatgaattttagagttcattgtaatgcttttggtttaggtgacaaaactgatgcctacaaagataaactgatttgctgaaggtcatggacctagtctttattggagttgtaattcaatcccaggtgtcctaaatctttaatccatgccattttattgatattatatattaagattttttttattgtatatccaaagatttctattttaaactgagataacatccaacagagaattcagaagtagtatgaaattgattatcttccctctactggacattgttgccatacaagacgatatcattgacccacttagggctcaaatatacaactctgtattattttagtcacaaagggaactaagagattatagacaagttgtgaagcagttagtggggactggaagtctcctgtggcacagactcaaatatatgctctagtgatgtgttctcagtcatgttatctgcccacacagaggacagattaagcaacctagagtactggttcccaagctcgaatttaaaactagtaccagtctatgccaaagctttcagtgacccatagtgaaatgagaaaagcaaggacaatatggtgagtctgcacaaagtcaaacttacagaactgccctatatttggatactgtatcatgtttttttggatggctaaaatcaatgtcttttacaaaagcagcattttgttactatgtatagcattcttaatcagcaaaataaaggttggcaatggtatgtcagtccttccctacagtttttctttgaagtttttttctcaggcattgaaaacaaacatccgaaaaagcaaaaaaacaagagttttaaagttttaaagtgttctctatgttgccacattagattgagtagatttcaaagactgaaggcctttttacatgtaaagttttattgtgaactaataatgatgatgttaagacccatctattttattgaggtcccaggaagttactagtttaagcatccgtcacttagataacaagcattaaggtaatttttaatttcagttaaaaaaatagattaaaggcacaaaatagatttccaaacaaacaaacaaacaaacaaacaaaaaaaccaaaaaagccaccctaggataaatataactagaaggccaagatcagtttagaagtctacttaaagaaagacagaaacttctaaggactgtgtggaaagataattcatgcctataaaaaagtctctgtgctaactctagatttttttcactgtaagccttgtaacaaaggagagagagctattttggaaagctgaattagcctacatttgagctaacatgatccatctttgtgtcaagagaaagtcaaatattatagtccccagccaaaataaggcatgtgatctacatcaaaggcaattcctgaatgtgtatctacgtcctcatcccctctcctcttttttgtctcttgggtaatctataccaataacctcctgattcatgaaatttattatctaaatattgaaaatattacactaaatttagcctaataaaaattcatgccaaatttactgagtatttattggaaatcagagacttaaggtcctgaatcaggtgtaagaattgtattatcaataacagacttaacagtgattatctctaggtggtgaccgatattttgataatcatactccaaaacatctatgtagaaattgggcatggtggcgcatgcctatagttccagctacttgggatgctgaggtgggaggattgcttgagcctgggaggtcaagggtgcagtgagccatgatcacaccactgcactccagcctgggcaacagagcaagaccctgtctcaaaaaatgaaacagaacaacaacaaaaatcgatgcagagcatgtattacatttgtaatcagagagaagggatatctgttatttcttaaaatatagaagagtatactaggagaccagcaagggaaatgttttaatatttagatacggaagcttcgccagacccgtaattttttaaaaatagtgaatcctttttcctgggttgaattatgatgtatggccctgcaaggaaagctgctggaggaattcaaagatgatgatgatgatgatatgcagggctctatatagcttaacacattagttccataaggtcagttctgttcatcaagtgacaaattgtccatggatacaccaggtggtaatgcagcagcagtgggcacaagctatcctgtaaatgacccattaccagaaagtttaaaatttctgcttggaacccaggaacacagatggaacacgaagtggctttcaccagagtcttgggaatatgcttgatcctttaaccccagcttcaggtgttgtgtacatacttaatgcctgaacagttctcatctgtacatctgctggttagatgaaaagatgcagttgcagacaagtaatttaaaactttacattcatgtctctctacctccctcttcctcttctgtctctccctcgataggatgtccagaaaattaaatcagctgcagattaattgagactctcttccatgtagggaacatctgtcactgcagctacaaagattatattaatgaattaaaacatttgattacctttaatccaagagaatgcagcagtctctttagtcatttagtttatcagggttttttgatggtttttttttccacgtgcatcttacgactatagtccacccctgaagctgtgagatctttcagcagatgttgttttccatatctttaccctttccgttgtggaagggggaaaaagccctcagaaaagcaattttggaggaggcagaaaaggtttccatcatgaacatacttttagaaacagctggtaaaacaaatggtccaagtgcaatgcctggagcatatctattcaaacaaggttgtttaaagataaaagcacccacttctaaatatcagcattagtagtgatttcctcacgtatatttaagagatggaagagcttgtgaagactttttgatttctattttgttttctgagacttctttaactcttttggttttgttagtatttgaatttatcagaagctgctcaaattgttaaaactgtatcatcatatgtaaaatatataaatttacatataacggatgcataaagatttgctttcttattctaagaatgttcttatttgataacatctatgcatagtccagaagattgacatgaaaaactgataatgtacttaggtattaccaatcctataacccaatttgtgaaaaggtcaggcactcctactaaagaacaaacgtttgtatttgtagcatttaaaaatctgattttattttgtatttgctacatttggagtcaaccttatcccttcccttctaatgacttcatttgtttaccaggctgttttgttctgcatcctctgccaaatgccattacgtaacttcctttgtcagaccaattggtgaaataattctttgtgtgcttttttttttttttttttttacggccgtccaattttcaaattatatgtggattttctgagtcaggcattgcacaaatgctgatttgttagcttgaactcgataaatgtgtgttcaccctatcagttgtcattcatgctgacttcttcctctactctcttcactctgattctgttttcatttaagaaaatttcagaagtagtgaagctaggagagttaatgagtagccacgttgaccctagtaggatcttacccattggagaaaagccctgttttaaaacgatgcacaaagaataagcttcaatgtcttcctctcctcaaccccagcatggagcacaatgcttatgtgatacacggaagtgagaaatttaagaagtgcttcactttaacttttctcaataagtaaataaaactgtcttttctagagtccaacacatcccaaagtgtgtgactttgctattttaccttaaactgactactctctgaatagattttcatgttatatagtctgagacttttctttccatcctgctggtgctggaagacatgatcataactactcacaacccagatcttaaaatatatatattgttacacttttatatacttgtattaaagcatcagttagtaagtttcatggttgtttcttctgatgtaaaagtaactgtagttatagatcctccagcacatgtcacactgaaaacctaatcacaaagtcaaaatatgtgcataaatattagcttgattatgtgtcacatgtaccccaaattacacatatatataccttcctcaaagattttttttttgtggggggacagtctcactctgtaatccaggctagagtgcagtggtgcgatctcggctcactgcaacctctgcctcctgggttcaagcaattttcctgcctcaggctcctgagtagctgagattacaggcacctgctaccatgcccagctagtttttatatttttagtagaggggtttcgccatagtggccaggctggtctcaaactcctggcctcaggtgatctgcctgccttgacctcccaaagtgctgagattacaggcatgagccgctgtgcccaacctgagattttttttttaaaccttggattttcaaataactttatagttggagaaaagttgcaagaatagtatatggaattcgttatgtccttactcaggttcaccagttgttaacatttgccacatttgctttaccattctctatatgtgtgagtgtacatgcacacatgagccatttgagagtatgcatacaaaacatatttatgtagatatgtatttcccctgaaccatttgaaactcagttgtagtcatcattccttttttaaataattcagtgtgtatttcctaacaaggactttctcttacaaaatcagagtacagtgatcaaaatcagtaaatgtaatcttgacacaaaatctcacctagagtacatattcacattgcaccagcgtctgcataatgggctttgggattatttttttcccagtctgtgatccaatccaagatcacacattgcatttagttgtcaagctcaccaacttttgaagcatcttcctgatacgttattttatttccccatttgtttactggtcacagaccagtaagagcaagtaaacttcttaaagtcctgccaggtgtgttggtgtagaagcgggaagatagagcctgtgcttcagcacaggaggaagatttcaatttttagaattaaaattatggcaaggaaggacctgtgtttcatctagtattcattccttagagagcacggatataatagtctgacaatgctttttattagtgttttcacttagctgcagattgagcatttactgtgtgctaagcactgaggatgcaagagtaagcaagaacagagatggcccttgtgggcctagtgggggacactgtcatgtaattaagtgacctccaaataaatgtgtgatgacaaacgttgatgaaggctatgaagcaaaggcacttggtgccatgagcataccatggtaggacaggtaacaaggcaggggtgggtgctaggaatgtagagaaggatgaggaaaccttctctgaaaaaaatgatatttgagcagaagagtgtgaaataagtgacagctaagaggaagaaaaaatgcattagagcttgcaaaaaattctgaacattagaaaaagtcagccatttctgggagagagttatctgggagcagcaactgtctcacaggattttgtccaaagtataaaataaggaagtgtgttaggctattcttgcattgctataaagaaatacccgagactgggtaatttataaagaaaagacgtttaattcgctcagagttctgcaggctatataagaagcatggtgctagcatctggggagcctcggggaaactacaatcatggcaaaaggtgaagggggaacaggtatgtcatatggccagagcaggaacaagcaggggtggagatgccacaaacttttttttttttttttttttgagatggattctcactcttgtcgcccaggctggagtgcaaagtcgtgatctcggctcactgcaacttccacctcctgggttccagcaattctcctgcctcagcctccccagtagctgggattacaggctcatgccaccacacccaggctaatttttctatttttagtagagacgaggtttcaccatgttggacaggctggtctcaaactcctgacctcaagtgatttgcccgccttggtcaattaaagtgttgggattacaggcgtgagccacagcacctggccgccacaaacttttatatgaccggatctcactgtcatgaggacagcaccaagccacaagagatccaccttcatgacccaaacacctcccaccaggccccacctccagctttggggattacagttcaacaagagattcaggcagagacaaatattccaaactatatcaggaattaagtaggctttgctgtccttttgcagctttgagtcaacccatatgagagtgaattctccgatcctgtactgctcctgggaggaaagggagtgggctttgtgaaaaatggagatttagtgagtaaagtgatgagttcactggaggaaggttggctagaaaaaaagtgacatggctgggcatggtggctcacgcctgtaatcccagcactttgggaggctgaggtgggcggatcacctgaggtcagaagttcaagactagcctggcaaacatggtgaaaccccatctctgctaaaaattcaaaaattagccaggcatggtggcaggcacctgtaatcccagctactcgggaggctgagccaggagaattgcttgaacccgggaggtggaggttacagtgagccgagatcacgctctgcactccagcctgggcaacagaggaagactccatctcaaaaaaaaaaaaaaaaaaaaaagtaaaattgtctttttttttttttttgcgtaccaaatcctatcaatgaaagagacaggaatagatttgactggaatagtcatgggagccatttccaggctctcatagtcttagagatgacacttggtagttcagtgtcttattgtgcttcttcaagcacatacagcctgattgagagagactcaagacagcatacaaattctaggcatttttacatctgcctagctgtagtgaattagtcatacaataattatttaaagaaagaaatgtttcctccatgttgtgctggagatacaatggtggagaggaagtggagatcaactattgatcgatttataatttacacaattccacactttggagaaaacacattccttcttcctcaccatcaccctcaccattataattattatcaattaacttgttcaatatgtaattttgaagttgccaatcatttaccagtgtgattcatcatgttaaaaggaaatggcttttacattattaatattctgcaataaaagtttgggtttgtgtgcttacagttagaataaaagaaaaatgctttgtactaagactatgttaataataatgataataataaagaaataacactttctccagaaaggaaatttcaggaaatctgtttcagaatacctgtctctaccacaagagctttctaagtcatgttttgattgctaacagcattccagtactgggttggaacatatgtattccttctatcaactgaggaacagcaggttttctgttattgcccatgcatggtcactctctgcttataaaaattcatcacttctgctgattgcattgtgtaggattcctactgattaccatttagatttgttaagtgacatagcacattttatggagtcaggagccagtaaccatcaaggtcaatagcagcaacctgaatcagttataaatgaattgtttaattacccacgcatgatcaatgtgtgcactgccataaaagattagttctagtccctgaatgtgtgtgtgtgcctgtgtgtagttctaagggattacagacttctctgaagtcttcttcattgaaagagattgcaagtgagtatcttttcagtggaatagaactgagttatggtaacaacatcatctatacatccagtctaccgtggccactgaatccaatgacttttttttttattaatatgaaggtgcctgcctatccaaagcactgcttactgtatttcattacaatgtattgcttcactcaacacactctgaatagagaagatatgctctacagcttcaaattcaggcacttcctccaagcagagcttgtttatctgtctgcaacacacttggagcatttgaaagactagtgatgaaatccattcatgctgtgaaaatgtgttgagcatcatggccgcttcctttacaatggcctggcatggaaggttggagaaggccattgttaccatataaatgactgtctatttgcctctggcatgacttgtccagacaagttgcatcattttaaaatgaatgaagttctagggagcatttttaactatagtaccttagttgtaactttgagagtttttaataagcttgcaaggaataaatttggaatctagagtagtttgttctatttctggaaaaaaaggaatgctttgtacatatgtaggatcctttacctggccacagagtttggtttgagaagtggacttgactctggatagtgaacaaaatgctttttcaatttttaaaatggaggcacctttttttctgagagcatagtcagtaactccccaaatgtgtgtctcttgtgtgatagaggaaccaagtaagagaatagcttggtgtgtgcctggttttcttccacaagtacccaattagtaaagggggcttttgctttttacaaagcatgaaaattaggggttgcctataggcctgagagccctgccagacagttgcctaatgccaccagccaggattatggaaaagaagccttggcatactattcaatggcaccgattcacccaaattgcaactgaggaaaacgtgttcatttttcaaatagagtttgagtaaccatagacacaggcaaagtaatctctccatttggtcacaatggactaaactaccttgttctattgtctaccttctctctcactgactccatcaaggcagacttgttcggtaaactattcaggtgactttgtgaacttttatttggtgcaaggctctgttaatagctgtaagtcagctgtttttggtcctccctctcattctcttcacactgattgatgaaatgggaaacaggttgaagaagctcacttttttagatgacaagtattaagttgacagataaacctttaggaggttccagttcatttcaggaacgtgttgacatgaggtctttaaagatcgacagtcctattagagatagagaccaccaggaaatcataaggaaaagaaaaatgaaggaaatatctagattcagtaggaaattgggggtgatgagagaattttaagaaaaacgcttgctttatcaccagctgtgtcattttgttcaaagggacaggaaacataatactctctctgaagcttaacagaactgcagacctattgccacagttttctcttttgcataatcttgtttagtcacttaagagctagtgagtgacagatttcacatgagaattggtcacgtacaagaatgttaatgcagaactaggtcagattatggcatttcacacatgcaagatgggaacacgcttcctctggttagacaaaggcttgacgattgcccatgcatctggtcctgctttaaaggaagctcatgtaatcatgagaactcacaatgtatccatagatttcttagatatcaagtttctatgagccttggcattgtgtatggttttattgttattttgccaaacgagggttttctagcttcacttagtatgcctggagaaagctattttggttcggcccagctccatcactctaagaaatgatgaggatgagcgctctcagtttgtaccgactactcatgagagactaagaactgatcatctggctgctggcaacattccactgcaacagctaatacagtgttttggaaagatgccgacaacaaccagattgcattaagcactttaccgtttaagatcagttttgcagttcagaacttgaagtcagcagcagatctaccttttagtttgcagtttactttgctccgagtttttcatgtcttctgtgagccccccacgtttatctcagggtggattctaacacacatatgcttatgtgaaaatttcataatactttagtatttaacaggcacttttatataagtcaattgatttcaggacaccccctcgccgccctgataccaaaatctgcagacgctcaaatctcttacataaaatggtgcagtgtgtacatataacttacacacatacttctatataatttaaataatttctagagtacttataatacccaatccaacatagttgttatactgtattgtttttgtgtttttaattgtaatattttcatttacctgcagttgttgaatgagtcgagggcaggtagatatggaaagctgactgttactacttcccttttacttatattacaatattatctatgttagtgatgttcatagttcaagagacacactaaaggaattacagtatggagtgtctcctaagttgcattgtggaactaaacactagagacaagagtcgagccctggctcaatagagccagtaataactcagtgtctttatgaccctgagccggtgccttaaattctctgcagcgtagtttctttaaacggtggttctaaactaaggggacttttgtccccaggggacatattgtcaattgtctggagatgtttttgattgccacaactgggaagatgctaacggcatctagtgggtagaggtcaggggtgttgccaaatagcctacagtgctcagacagcccccaccacagagaattatcccacccaaaatggcaatagtgtagaggttgaaaaatgtcactttaaaatgtaaataatgtctatcccattatcacaggattcctatggggctcaaccccacattttgtttaaaaaaagtaaaaaaaacataaattgcccttctatgtctgatgttactactatggggcattgcacatatggacaccaaacttttcccttaaaaaggaaaatggatttattcttttagattaaaagttataaataaagctatcagattaaaatatattaaatatatccactgaatcttggtttgtaattttatggttttaaatgaatgctctaaatataaagagaaacaatgaaaagttattaagtaggagaaacctactattcagtgactaatatagataaaggaaattggaatccatgcaactaatagacttttctattagggtacagccacagcacgtctttcctaatagaagcaagcctgaaatgataagttgtttggatcacattaattaacattcagctctattagatttgtacctgaggttgggttcattttactggtgctgatgaatatcaaactacacaatatctacgcacattatattagaataaaacatgttttacattgaaggcaaattttagattcgactcttaataatggtcttttatattaactcagataactagagatagtaaaagaatgaattaaaattccagtgagccaaactacaacattgataatagtaatgagaattaattctgtgttgattttatggtgcctttgcctcgtaggtatatataactctggagtttatgaggcatgtttatagatcttaacttcttaattttgtaatgctgtcctcttaaaatttttgcttgagacggacaaaacctcctgaatttcttcaatttacatgggcatttttactaggaaagagcatgcagccttcatcagattctcaatagggtttattaacaaaaaatgttgagaaatcaccttaaaaggcaggcagctcttaaatgcttgttctcactgaagtccttctaaaatgatattgcatggactctatcagtctcttagcagctcatctgtagaggtaccaactgatcaaaaattcaaagttcttaattgacatactcaggttttttaaaatttaaagatccagattggtagctcagccatatagctaaattgaataattatgcaaatgctgcacaatatttaattggaccttttggaatgaaaataacccaggtgtgcacaattctttgcaatctggagcaaccattctaatatatatctgcaagtgacaacatcttgtatgtaaacaggcagaggaaaagagttctggctgccctcccaggaaaatatacatgaaagaacgtttgtgttacagcatttgtgttacagcacatacatatttctgagttgtttgttattaaagtcccattgtatgaaaacaactatatagacagactggcaatccagagagttggtagttacataaacaggtcccacggctaccaataatattaacacggtattcttagcccttaagaaacaaaacacagaaatttctaatactgggagtttaaagtgccacaatggaaaagcaaactcaattacaaatgctggattccacctggagcctattcttttcattttcttacttctgtttctgccaccttcccttcttccgataacagattttcaagtactgctcttagaattgctaaatgtgttcagagaatgtgtgataagatctgattctcctggaaggccaggttattttaatctttccatttctcacaccaaccatttaactaggtattatttgtttctggacgtcacagctaaagacacaacattttacatgaaaatgtcagtgttgaaaatattatttatctatctatcaaaatgtagccacgcatctgttcttgtttgattctagtaaaccataaccctaaacatgacacaaaaggggctagtgaaatatttgccgagagcggtactctaagttaacagtaaataattgaaaataagtaagtcaaaaccaaaaccaggaaagtttgcattcattcccaatcatactttaacagaacttgcagctgccacagattcagacatcttcatcttcctgtggagcatttgtcttttcatagcagaggacaatctctgtgactttcttatatcactgagaccatcttgtacagtttatttcaaaagcaagagtgttctttttcgtttcatgccaccagtgacaatacgaaaccagatctaactgaaacttcactcaacacattcccgacccgccaccccaaccctaatagcctctcataaccaccgttctactctacttctgtgagttcaacttttgcagtctccaaaaagaagtcaggtcatgtgatatttgtctgtgcatggtccatttcacttagcataatagggggactaagttcaagagatctattgcacaacatggtgaccatagcaaataataacatcttgtattttgaaaatcactaagggagtagattttaagtgttcttagcagaaaagaaaatacaatgaggtaatgccggtataatttagcttgattcagccatttcacaacttgtatacatttcaaaacattatgttgcacatgataaatatgtacaatttttatttgccaatttgaaaaacagagaagtccctcttcagatcctgtcctatgcagctgtcactcacttggctttgtaagcctgcagacagtgtcatttaaaatattttcctctgtaccataacgcttttccttttaatgatatataagaataatatttctctctaaatagttatttctttaactttgaaataattcagcatctcatgattttgatttccatttctccatatatacattttttggggctctgttctgggatttagggctaacctttgtcatggagacatctgtttttggcagtctttgtttccagggagtgaaaatgtgtgtagaaagaattgaatagctacatcttaggtgacacaattgaggaactggatgaaagatatttgtggaaagcaacataattattcaaactggaatatggccattgccctgggtttcatatttatcttcataagcaaagtggtttgggattctgtgcaagtataaggatttaggatttaaacactaaaccacatccctgcacggagcacatgggctttgttgttgataatcatgatagtcgcacaggaaacttgacagtgacagcaggggaacagcacagtatcctacttggccactggtaggaggatgcaatttaaatcctggcatgcgtagaatagcctcacttatctgtggattgttattgtaatctacatagtaagtttcaatcagaactcagttttgtgcagttgatttccaattcccgactctgcatcattagggtacaatgttttctgtaagatttctttgtaatattatagagagaagagcagaacaaatgcagttattcctctcaaagttcagctgaatgctactaatagttcaagaatgtggattgtaatggttctgtgcattgaaagaacacaatggcaaatgacaaagatgacactaagtgtgagccacagctattgttttgatagcccactctgcttttctagttaactttcttacaaccatcagttccatatttaagactagaggatcagttctgatgatgctcattcaaactcttgccaactgacatttaatgcactttaaagttgttaaaaccaagagcaggaaatgttacacttgtagtatcaagcctggctcatgagaaagttccatccactattctggaaaaaaaatagaactagcctgcaggacacaaagctacctgtggtgatccgaactatgcttctcaaaaatctttcttttgtttggccacctttataataggagttctccaacagagaaagagctgcttacagcttcagagtacagatggataattgttgctgtgccatctctgaacatcttagattgagggtcccagagaacctcatgtatgtgaatgttagcacagtacaaaagatgggacagagctttccagagcagtaacagacagctgtgcccagcactttcttctaaaagttggagatgctggatggaaaatttgtcattgtttacatagcacccacacacacacaaaaaatcctgactcactagcttctgtgttgtcatttttttgtccatggttctattgctgcctaattttcatacgggaccctcacagtggttagtctgcacagtaaggagtcaactgtgacatcctcatccttgaatgctagactccccactttctcagctcaatattccatgtgtccaaagtaatactgttagtatcctacattattccaggatcttgtcatgccacttcaagaaacaaattatcaccgctttctaagacttaccaagctaggggtgttgtaaagtatgtatgcaattgacttttgacttttgattcttatgttgaaaggcaacatagaaaataagcttccattaatgtaatgatatagtgttaggaagacagtatctacagtccattcaaaatattctgaaaattatagtattgattttggaacagttttgattccattggccatagcgcttaccttaagtcatttttttttaaaaaaaccgtcttatccatttcatatgttttacaggcactaaaatggggcacagagactaagtcacttagttgagttaaccaataagtaaaattgccttcatattctgcttcctaatgttgtatcttctctagcaagttcaagagagcttactttctggaagctttgcttgttagtaggatgtataacctgtgggaaaagacccagcagcatccacttttacttatctccttgccttctctgaaaacacactgaacagaaatatccccatctctttctccatcgtgggtttttcctttgggccacaaatagtgaacgccactgctttacaaagttattcttttcaccactaatagttctttgatgtcattttttgtacaagtgtcaaagtttttctctagaggcttccacacagttaagttcttgcttttggattctttctaaaccaaataaataaatcttcgagactgcaggttaatcaaatgccttcaaacatgaaggctgtttaggagctaagctgcacagacattttccaacatttaaactcttcatgcagcatcttcctatctcaatttgtacccgttagccagttccacagggcatattgggaaataccttttattttcaatatttatatttgtcttatagatatttgtcctttcaagtaggacaaagtggtaatgacctgcctctatcaaaaaattctacctagtaatccaagataagcagtgtgttcctagtgagttgcttacataaaagccaatatattttgtactgaatagtatacagtgttaaaaactcagctttttgagggacccaagcaagcctaacctacatgattttacaaagacaatacttaaaagtcataaagtactaagtctcaactttcagacttaagactcataaacgttttaattttttatcccttaaaaatgttattttttggctaacagcattgaaataagcgttactatagattaatactatgaaacaggaacaaaactgttgagcagacattctcccagggaaggactgtgtgtgaacacattaaacttacgcataaaagtggagactgtaagtgggttccagggtttccccacgctgactttttaaattaaatgtggcagtattgctaaaaataaaatttagtgtttctcaaattttttttagatagatacctcatatggtactcacaagtagtgtgaaaacttaagtagtatatccatctaaagcagcacaagcaatatgtcagcaccttttcactattaccacagagaaatagtgttggagaccatattgaaaatgactgtagtctggctgaggagatattaagtgaccagatggcctctggcacttctgttttcaaagctgccttatagtgcctttctcactttgtgataccaagctgctgccatgctagtgtccaccctcgaacaccatgccactcagacatggtgggattcgtgtttctgaaggggcacagtaggaagctcattcttgggccttctggcctgcctgagactgtgctagcaatacagtctcattgtgcacaaaagaagccatttttcttaacacctttgagccattaatgaaacctaccagttagaggtggtcaaaagacaaaattacaacaaatttagcttaaagatgtattggttttacttgcaattgtagaattgggcaacaccttgttctataaaatagtatgttctgatgagctgggcaaggtgttgtctgactttatggacagaaaaggactgaagaaagcagaaacaaaatgagaagtagacaggttgtttcaacatttccttctttctaggctttaagcagagggtactttcttatgctggatcaggtaaagggccccttctgcttggttgctatgaatctcctgtttaaaaagaaaacaaaaacaccacacaaaaaaacctgacccattatggtttggtctggttggctgaggcctagggccggagtctagtctaaaacaatggcctcccctaaacttgaacagggttacattgtagaataacataacaggaaatgaaaagagaaatgtgatgctcttcaacaattggtttatggggccttttaaaaagtgtgtatagagtcaatgatgaattaagatgcagtgtgaaagaaaatgacacaggacagatattcagagatcatttgttcagttttaaaatcagattattagtattgctgttgagtcatttcagttccttgtgtattctggttattaatcccttgttaaatgaatagtagaaaatattttctcccactttttggttgtctcttcactttgtagattgtttcctttagtgtgcagaaggtttttaacttgatgtaatcatgtgtctatttttgcttttgttgcttatgcctttaaggtcttatccccccaaaaatctttgcccataccaatgtcttatagcatttccccaatgttctcttctagtagttgcagaaagcacttgtaatttaacagctcaggaagggaatcaaatcattcagaccaactgaagctttcaaaatgttactgcttgaatgggcagaatatccaaaaacatttattgtgtgatcctaacatctacatattagaaactgatagaaaacttctgatgtatcagtaagatgataattacccttgtaacatttctggaagcatgtatgtatgtatgtatgtatgtatttaaacgaatgcttgtatatctagcatctctttcaattgactcaatacccaaggaattttatctccattttacaaataagagagattatgacttatttcaggtcacagaagttggatcacagctggaactttagtccagttgggtctagaaattcaattttctttttactttcatgactaaggaccactctataactctgaggtaaaaagagcaaacataatgaagttatttagagtagtgtttctaaatctaattttgcatgagtcccttggggaacttttaaaacatgtagataaccaggcacttcctgttatcctttttccactgcccctagcagacagacttagtatgtctagcttaggtaacctgggattgtgcaaaaaagtaaatcttcagagtccctctgaatatcaattctcattatgcaattatgactcctaaggcttaaaagtatgaaataaatctgtagagatcttaggatctcctgtggaagttgtttttgtgcctaaagattagcttgtttgtaagttcccatactcagtgagaactgaatattttaaaaaactggtgaagggtggcactgtattttaacgtaaaacatgcaggactagatacagtcacggccattcaattttttaagttgtatatctttgggtgagttacttagcttatttcagcccagatttactgctatgtaaggtgtaattataattattgagtaaaataaactaaagcatttaacacgatgtctggcagagactaagtttttaatactcttaaaaacatcttctggaggtaggcttctagttaattagtgttttaattatgtaattataatttttgtttcctttctctgtcctcatatttgctagaaaaacactatgtcaaccatttgatcatactcatttgtttctaagcatatatcttaactaatctagagacccatattcattgagcttttggaatgactggaaaatttctcaaagcttcctcccttatctacggtttagtttacaaaaattaaataagcttatgatgtgtgtctcatccacccaagtacatctgcagggctcctctattgtaaatcagctgcctaaggctcaagttagacacagtcaaagccgtgtatatttagggtacataatcttgatgtcaagtgctggagtcttgggcaaacttttcatctttttatgtaaaactgatttccattaagtatgaaaacaccttggtggtattgattttatgaaccctgtacattccctgcaatgaagacagattttagggtaaaagaggatgtttgcaagaaatggtgagttttattgtaagagaacttaccggccctatagagaggagaaaacaggttggaatgtccagctgctaccacccaacgggatcccagcacaaagaaaacagtcaaaattatgttcatcatgacagagcaaatgagcttttggggaaaacagaagcaaaataaacctttttgaataatttattattctataaacacaatcataaagcgtaatggtatcagttcaggagaaaggtcccactgctcctgtgttctacgtcagtggctgcagggccacagcaggcagagataaccaagcatgctttcactgccctgatcaccattcccccattaataatttgcttggccctttccttcctactgcctgaagaaaatcaatgtttggcagctctaggttgaattactgtttattttatctttagcctacacaactgcaaaaggaaagcctgagttttccagtgcatattccaatacctgtttatggaagtgagaacgagtcagatagtgatgtattttttcagagagtttcttaagccagctgtggataagaaggtccaatttgcattggaactgctaactaggactcagggaaatcccatctggtttagagaagagtaaatgaaaataaaacagaattgtgaatgcaatgcttcaataattagtttgcaaaacatgtatccactgccttgtgtgggcaaagcaccatattaggaactatagaggactgcaagaaaaacagaaaaacagagtgggctccttttgcaaggtattcgtggctattccaggcatcctttcttctttcagcagtgatctcctgagttattactatgtgcctggcgctgttctgtggactgcggacaaagacaaagtctctgctctcttggagcttatattccagtgaagtgggggaggactaaatgtaaatacatgggcaaaagtcagctaataaatactgtgcagagaatcatgaggagttgatgttcagttagtgagcaggctggttcgttactagggaagatgtgaagggcctctgagaagtaaaattgtagcagagacctaaataacgagaaagacctagccaagcactgagcaaggcaagggatgttcctggaagggaagccagagagtatggccagagcccgagatatcctgggtctggtgagtcatagatgagactggagtactggagtaggcagctggcaggtcacagtggactttcccagtgagtcagggattttgatttggggaaacctttggggattttaaagaggaaagtgacttgatctgatttttattggatactttaagaaataaattttgttttgtatacttaaggaatacaacatgattctatgagatatatatatatagtaaaatagtcaccatagagaaacaaattaacatatctatcatctcacatagttatacattttccccttatgtcaagagtagccataatctgatttagcaaaaatcatgaatacaatacactattactaactacagtcctctgcacattagatctttagacttgttcatcctaaacacctgttacttggtattctctcacctacatgtcatttcctctcccacctctagtaaccactgttttattctctatctctgtgggtattagacattgtttttttagattccacatataaatgagatcatgtaatatctttctttctatgcctggcttatttctcttagcataaaaccctgcaagttatgtatattgtagcaaatggcaggatctccttatttaaggctgaataatattccacttaatattttataatgtgtccatcccttgacagatacttcgattgctttctatcttggctaatgtgaatataggtcgggtttggttccaaaccatttcaacaaagtgaatattacaacaaagcaagtcacatgaatttcttggtttcccagtgcatataaaagtatgtttataccatactgtgctttgttatatgtgaaacagcactatatcttttaaaaaaatactttgataaaaaatactttactgctaacaaaaatgctagtgatcaacagtattcagcgaatgtttttgctggtagagggtcccgtcttgatgttgatggctgctgacagatcaggatgtgggtgctgaaggttgggatggctgtggtaacttcctaagacaaaaatgatgtttgctgcactgactgatttttcttatcacaaaagatttctctgtagcatgcaatgctgtttcatagcattttaatcagagtacaacctctttcaaaattggagtcagtcctctcaaactgtgcctctatcaattaagtttatgtgatattaatatttaaatattttgtcatttcagcagtgttcacagcatcttcaccaggagattacttcttatgaagtcattttactaatccataagaagcaactccttaaccattaaagttttttaagaaaaattaattttaatagttttggggttataggtggtttttggttgcatggataagttctgtagtggtgattctgagattttagtgcacccatcacctgagcagtgtacattgtacccaatatatagtcttttatcccttgccccctcccaaccttcaagtccccaaagaccattatatcattcttgtacctttgtgtcctcatagcttatctcccacctataagagagagcatacaatatttacttttccattcctgagttacttcacttagtataaatggcctcgcactccatccaagttgctgcaaaagacattattttgttcccttttatggctgaatagtattccatggtggatatatataccactattaaagttttatcataacattacagcaattcagtcacatcttcaggtcttacttctaattatcttgctatttccaccatatcttcagttacttcctccactggtcttaaacccctcaaaactctccatgaggttttgcattaaacttcctcccacctcctgctaatgttgatattttgacttttctcatgaatcacaaatgttcttaatggtatctagaatggcggatccttctaacaattttttcaatttatttttcccagatccattagaagaatcactatctatggcagctattgccttacaaaacgtgtttcttaagtaagatgttaaagtcaaaattgctttttgatccatgcacagcagaatggatgttgtgttagcaggcacgaaaacaatgttagtctccttgtatatctccatcagagctcttggatgaccaggtgcactgtcaatgaacagtactattttgaaaggaatcttttattccaagcactaggtctcaacaatggacttaaaatatttagtaaaccatgctgtaaacaactgtcatctaggctttgctagtccacttaaagactacaggcatagtacatttagcataattcttaagaaccctaggaattttgaagtggcaaataagtattgactttaagtcaccagctacattagcccttaactagagaatctgcctgttctttgaagctttgaagccaagcactgactcctcttctctagctgtggaagtcctagatggcatctttttccaatataagaccattttgtctacattaaaaacctgttgtttagtgtagccactttgatcagttatcttagctagattttctggataacctgctgcagcttctacattagaactcgctgcttcactttgtgcttttatattatgaagatggcttttttttttcttaaacctcatgaaccaacccctggtagcttccaactttacttctgtagcttcctcacctgcctcagccttcatagaattgaagagttagggcctttctctgcattagggtttggttaacaggaatgttgtggctagtttgatctatctagaccactaaaatattttccatatcagcaataaggctgttttactttcttatcattcgggtatttactggaacaacaattttaatctctttcaagaacttttcctttgcattcacaactcagccaactgtttggcccaaaaggcctagtttttggcctatttcagctttcaacatgccttcctcactaagctcaatcatttctagctttaaagtgagaggtgggtgactctttctttcacttgaacacttagaggccactgcagtgttattaatttgtctaatttctatattgctgtgtctcaggaaatagggagatgggggtggggggctggagagagacaaggatagacagagagagagagagaccgacccagagagacagagagagagagagacagagagagagacggagacggggagagagacggagacggggagagagacggagacggggagagagacggagacggggagagagacggagacggggagagagacggagacggggagagagagggagacggggagagagagggagacggggagagagagggagacggggagagagagggagacggggagagagagggagacggggagagagagggagacggggagagagagggagacggggagagagagggagacggggagagagagagatggagagagagagagatggagagaaagacagagagagagacggagacagagagagatggagacagacagagacagacagggagagagatggaggaagggcaggttggtgaagaagaacacagacaatattaagttcactatcttatgagtgtggttcatggcaccccaaaatagttataatagtaacatcaaagatcacagatcaccataacagatacagtaagaaaaaaagtagaaatgtgagaattaccaaaatgtaacacagagttgcaaagtgagcacaggcaggtagaaaaatggtgccaacagagttcctggatgccgagttgccagaaacgttcaatttattaaaaatgtatctgtgaagcacagtaaagcaaagcacaataaaacaagatatacctgtatttgtttttaaatataaaaataatttgctttaatgctgaacaaaaatgtcccatgtaaaaaattcatgtgctatctgttcccaaactcagtttccacacctaattacagtaaatagaaaggagagaaaaaccaaactttcaagatggaaaggagaacccaggacagcctcaaacccaacacttagaatggtatttctgcatgcccaatctacagcaaactttcagacttaagaaggaagagagaatggataaaacgttacagaagacagtattacattttaaaaattggtaagatagtagaatgtttagatctggaaggactttaaattaatcttttttccttacattcagataagctttaatgtgtactaaattctatcccaaaatctctattctttgtgaccctactgtaccctacgcagatttttgttgactcaatactccactgcacttaatttgttttttagtctcagctagacctgaaacaactttaggaaagggatagtgtcttcttgcttacttttatttttcctaccaactagaatactaataatcattcaaatgtttattgaatgaattaatggataagcaaatgaattaatataattagttgcttatattttaccccccacactagcctatagctttaaagttgtggtgactacaatgtctagtcacttaacctcacagggcagatttgctcaactaataagattttgaatgagaaagtgcttaaaaattctaaaagtgcttctctaatatttgttactattgtgttcaaagactgttagctaccaaatgaaggtttcatagtcaacagaggaggctgaatcccagacaattacaactgaggcccgggctactccaagtgtgatctttggagtatctgactcagcaaacaaacaagaatcacctcaacccaaaaccctaacccaaatagccatcattactacttccttccaatctccatctccacaccctccaataatgatgaattcttaaagcttgaatacatgttttaattgtaaatttgggttatttctgcatgtaattttacagttattttatttcacccttgtgagttggagttaagctctgaaaaggtcttattttgatgtctttccataagattgtattccttttttggcaagagaacagatctggagttgagctcctgccctctaccaaactgtgaaatttgagacaagtcacttgtcccccatgccaacccctggggcctcacttttcttattcaaaaagatcaaagattttgtcctaactcatgaaatcatgagcattacatgtaaaattaccttagaaactataaaatattcatttcaaatgcatcaagatgttattagctatattttatgagctcagcactccttgatggtcctgaagagaccaaaggggctgaggccaaagggagaattctccttaaatctcttggaaacaatctgacagaccttagaattgtgtagtaagatgaggacataaaggaacagagggtcaaggtagtatcttagctcctttctcccaacgtgttgatactggttaagatacacaaaagggaaaacccacctaagaaactgccaggaattcttttttttttttttcattttgttttaatgctaacttaataatcatgtcttagtgtaactaagcttttcttcatcaagaacattataagctcattgatgcacaggctaaatctttatgcttatttggtgctttttaatctgtctagcacagaatagggcacaacacaggtcttcagtgtgcctttgctgaattgaaatacaaaaaaatagcacatctttcaatacttgaagctcatttttataaagtatatgtgtgtagtagggaattctaaaaactattttttgctggtactagtttatttaatcaagaggaaatatcttcataaagtcaaacaaccagaaaggacagtgcaaatggccctcaaagcttgagcttagcaactgctcccctgttcttagtcttgccactgtgtggaatttaggacttctatatgcagatagtttgttacttgcaaaccattagaccaagcttgtcctacccacagcacacagggcgcatgcagcccaggacagctttgagtgtggcccaacacaaatttgtaaactttcttaaaacattgagtttttgcaatgttttttggtctcataagctattgttagtgttagtgtttttttatgtgtggcccaagacaattcttcttccactgtggcccagggaagccaaaagattgaacacctctgcattagacccttttaatactattataggtaatatattttacaacataaaaaaatcatctgtgtaccagtcagaaatgaaggttttgtatgaaacattttcattcttcagtatcaacagcccaagattctcctgactttatttctccagccctggcccctcacctcaccatctcttagctggccccagatatggcccaggtgttttaatcttctgggtgatctgatccagcctcttgactttaaatggcatctatatgatgataattttcagtttaagcctcccttcagaattccagtttctcaaatccatctggctattcaacctttccactttgatatttaagagacactttgggttcagaagagctaaaacagaactttggattccccaaacttgcatgtcctccaaattttctcatctcttaaatttgattcaggtgtacaaactccacatttgtcatcattcttgggcccctgtcccaactctcttccccacacccagtcaagaagtcctgttgactctgcctcgataacaaattgctcacacatttcctttgctccagctacccatgctgtagtgtaagtcaccatcatttcttgcttgaattctgcaacggcttcccaattgatctccccaattctacttttgcttcccaaaagtccattctccataccgaagccaaagtaatctttaagaagtatacatctaaacaaaacacttcttcacagcaaagaaatcaatacaatgaaaaggtagcccacaggttgaggaaaacatatttgcaaaccatatatctagtaaggggctaacttccaaaatttataaacaactcatacagctcaataacaagaaaacttataacccgattttaaaaatagacaaagtaacccgaatagacattcctctaaaggagacaaaagtggccaacatgtatgtgaaaagatgcttagcataactaatcaccagggacatgccaataaaaatcaccatgagatatcacctcatacatggtagggtaggtattatcaaaaagacaagggacaacatgtgtcgatgagagtgtggagaaaagggaaccgttgtacactgtgggtgggaatttggattggtccagccattacagaaaacagtatggaagttcctaaattaaaaatggaattgccatataacccagcaatgccttttctgagtatatacccaagggaaaggaaattaccatcttgtagaggtatctgcactccatgttcattgcagcattactgtaccgcattatgaaatgggttccttcaccccttttctgagcaccctccatgtctacagaagaagttatgaggaacaaaggtatatgcagggctcgttttgtaatgctgacaacagcaatcctcacatccagacttccatgtccatgtacagggttctctactttcgttctaagtcaaactgtgattcagaaatgagccatccattctcccagaattcctccattcaccccacagacacaaaaatcaaatctatgaaaatgtttttgtatatttcataggagaaacagatgtggaggcttaactcatgtatccaatgccaaaagtcttcaaaatcttcattaggtatttgttatgccaacttctttctcagccctcccggtttgtaactttttaaatctttacccagtgttgcacgaagactgttgagatggttccctctgccttcctctctctagtattctccctgggaagtttaaaatatataatgttatgtaaagtaactcactggggccttcctcttgggcctcacctctatacactgaagacaatgctttctagcaaggaggacccatgcttccagagaggagggtttgcaactggagtaacttgagtatgtctttgggattcttgagctcaacccaaagcagttcagaaacatttctttgaaacaagttcccaagatgaattctaacaactgtaatatcgcatttggcattttaaaaattttgattttacatttagacagagctattaggacatggtgggataaaaatggtagtatcgaaatatactgtttcaaatcaaattattgtattatttgttctcaatgacagacataacccaaacacattcttagtacccagaataaaggcacagccatgaaatcaggcagttattaataaaaacctagtgtagatagctaatgaaagatgaaaatgaagctgtgacatgattatgaactgctattagcaagcaatgtcattttgtatcttagagaccaaacaaggtttgtgtatgtgaactaatggttgacttatatggtaaagatatacatgcattatattcaggctatgttggcttcatttgaaactacagcttccatgggtttaaaaaatacacatatgatttgcaaagtgacaaccctaaattttcgtatattcaattgttcaaaccagtgatttctagaatgtaagtggtgtcctacttgtaagagttttaaaacaggcaattttggaataggtaaattactcagtagaagccttagagaacccaaattgctgatgtatctttttcgaaatgcctctcattatccaggagaatgtgtgtattggaagtatcttattctttaagtctcacacttagaccggttatgtttcctacttttaaaaattgtagaactttattctacagatgtcatttgatgccttttgagaccgaccatatatgcatttatacaatcttaattcaatgttaaaagtataattagtccaaaaaaatcaactaaatggcaacaagggtttttctttttctatattattaatttttttttcctccatctaaaactttccagctgctctttgtgaagttcccagaataatgattaacattattaaaccagagactaaaaatcttggtacggactgacccatggggacacattgctataattattttaaagtaaaataataaaaggggcgtcccatagcgggcaaaagttggactcatcctcaaaatttactctatttgtcaaagtcccctaaaagagttcttaggagtggttggaattggttgtcagaaccaggtgctctcaagtgtcttgcctttgtggttcgcctacctgggtttcccagtccttggttgaacattaatgttctcaacgagatataatactgaatataactcttgtgatctcttccagtggaggctgaggccatttctaaaaattccttccctctgtttcttctacagtatcttcctctccgtgtgcatacatgtgagaggcatagttttccccaacgtacttcagataaaccttattggcatagttttcctcaaagcacttccaataaactttattcctttcatgattgtcctgtagtttacagacactgatattgtactctttggagtggagaggggttttgccattcttacaaaaaaaaaattggctattcctccatttatcaggctcattttattaacattctactgtcatcattgtgctctgtcactttgactaagcccaagaaccctcccacagagcaatgttaattataacccctctatgcccgtaaaatatgccatctaaaggctttgaataaatttgggataaatttcctgaagcagaactcatgaacccatatgtattttgattccaattcctgtcaatacaggttctagttcaactcccaacacacacacacacacacacacacacacacacacacacacacacacctctcacatgctttccttctaattggcaagaagccttcagatgtccttcacccctactggaaaggcatgaaacaaaacccagtaccttcctcctacccctaaactggttttgtcttgctgcccctaatcctagcttgctgttctgtttttctattttcccctaaatgcaacttactttaagcatgtgttaactggattaacattcctacaattgaaggatagtatatgataacccatttgtcagtctagctactttcttctcttttaaatgtctacttacgacgtacatccagactgcacgccctttttattttttcaaagcaaagccaaaaaataaagaaaacgtaaaattagtttttaaagaaaatgcacaatctgtttttaattttggctatcacgaaaaggggaattaaccagccaaaaaagcaaagcaaaaaaaacgtgtcccctgactgctctgtctgtgcctttcaagcctgtgcgtctggttgttcatctctgaaagtgtgtgaaatacttttttctttaaactttttgtttttttctcccttcttgtttgggaattaagtgctttttatattatatatatctatatatatatatcaatgtgtttcttttaattgctagatctttatcttagatttgattttatctaaaattatgagaaaaaaagttatgaattgttttctgcagtttttccccactccctctttaaatgtggaacaacttcagctgcagaatcctcacatccacatctttcaaattagcctggtctcattgccaattgcgtgcaacatgggtggcataaggaagatggatgatgtcgtttggaaaatgccatttctctatagagaagtaattagcaacccagtgcgtgggccccctgcttagtagtgcgtctcaatcacctctgtagatttctgaacctcccccactctagatggggctgtgtggctgccgatgaagttgttcaacttgaatgcataaatctagtcttcttgtttttgctttaaactttttgatcatgactactagtattttatgtattttggctatttttagtaggaaaaagtttaactgtttttattatttgaaaatctttaatgaaactgtaataatttttggagtaattgcatgttgaagaagttgcagcttagggtgtgtgagattgtcagtgttagagttctgttctttatttccatagatgggcatgtgtaggctcatttgtttttgtatattgcccatcccttccttacagccagaagctctaatgcagctagatcactccgtgccgcccttacatggacatggcgactcacttacacatttactcctatcatcttcatctcctgtgtagttcactcatagatatgaccctccccttcctgcatctttccttcccattctccccctttctttagcattgttaaaatttatgtgctgtcatccatctccctaaattaaagaaagcctaaaatttgtcaaaaagacaaaaaaatatatatatctgaaaacttataaatgcagaaattcattcaaaacccgttagagtcatagaattttttgaaaggcaaattataaaagtaaacaggtttttttgtttggtttttcaatcatagcaatcggaattattttaaattcaaaaattgatgccctcccaaaccccccaaagtaaaaatttgttaaagtgcagattttttttttctttttatgttatgtggtgtggatgtatgtgttgttgcctccctgtatcatcctctgttgtaaattattatatttgaaaaattagacattttgctcaaaagtttttaagaaatgacaacaaaaaaagcaagttacaagaatgtggcaattctatttgtccaagagcattcttacacaactttcttttgtaaatttttctttcatgccaaaaaacatgcgggcaatttgttgatgtaagttgactataaattaatatggtatgcttttttagtttaaattattttgcctatatggaaatgatttctttttttcccagaacagcttctatttttaatttgcttttactttttctttccattcttattatattgtgaatgcctcaatgttatttgctctccttctcccagcttactttggctacgaagttgattttattttctactatataattttgaagactatattttttatttcatttgtgtcgatttgctgaattttcactgttatgttttgtgctgaattgcttctaataatcaatgtgaattctactctcagtagaagggggttaatacattgttcttaccacccaaagaaagcctggcctctttgcctgaactttttcaccaccgtgtttaaagccttgaaagtattggtaggctctatttggtatcttaaaattgtttccagccagtgggaggcctgtaccctagaagaaaatgagttgagttagctccaagtagtaccagtggtatttgcatctttttaaaattccttaaaaagcatttaggaaattagttcttttccttcagcaaaggggaaataaggtactctcaagtgactatggtagagtttggttatccaggatcatactctcacttttgcttcaggctacaaaatcaattatactgaaaatgcagatatcaagaatcccaggtgtttcgagtattgttctatgatactgacgccttccagtgtatggaactaacaactggcaaaaacacagacacacacagaaggcacacacacattctctctctccctctttcctttgtctcttctccttttccctttttcatttctctcaaggatttaatcaggtaagctttcagggatcttaagattctaccaagaaaacatgatgattttcatatctaaagttatacttagaaaatatttcaggtgggtaccatcatcgtgtaactacagggtaagactattccttcaccttaagattatttgaaccaatgctgccttatgtacttcaacatacataagattggtaagaagcactatataattttttcatcaagaagttacttgttttgctttacagatatttgtgttatttgaactgttatagaaatatcaaactgaatggtggataagagtgtttccaagccagcagcttaatatttgggctctctctacctcagtttatgcgattttgtgttgtttgacatgctggataatattttaggtctaaaacttagaacttcctaaatgggatgttgttttatcttgatgcattaaaatattttctttctatgaaaaagatatccaaaggtaaatttaataaaatgttatttttaaaaaatacaagctatttgaattataaattatttcttatattctattatttaaaatagcctcaatatataattatacttctactttagcatgaagccactaaataaaaaagggttagaagaaagtgattatgtaagtgtttatagctcagatacattagtagaaataataacattagtaactagcatttctgaatagtagtaggtactgtgttaaccatctaacatataaaaaatacttgatatgcattattttaatatttgcattgatggtttgaggtagggtattttattattctcattttccagagtttaagaaatttgaccaaattcctagcactagtaggaactcctagagagttccgatgttaagagtctgagttacttcagaagcaaagctcttaataagcaaatgaaacactccacttgacatttcctgttttgtaatacataatgatatcaaggggctgtggctcatcttattgttgaaaaatataatctgtagcctttccaaatcaaacctatttcagacaaaccctttgctggggtggaagggtggtggggaagcgagggagaatgccctacctagaaattctcatcctgttaaaatacaagttaagcctctttgagacacttgagtttttctactgtcttctccccaggtacttgccctgtttgtccatgactattttttcccgaaggttgatagagagcaatttcatggttacaagctttatgatatttatgtgttacaaatacacacttctatgtcaccaaagagctaaatatctttgaaaaattaattcttggggggaaaagaattatttccccttatcatgtgaattttcaggaagaaatttggaataatgcaaataagagatgaagtaaaatacccaaatatataaaaagaattcaaggaattcaagcatggtgtcctgtcccagagtctcactgttcagcatcactgttttggtattttcgtgaactctcaaaacccaaatatctccagagaggcaagtgttgaaacttcatgcttgtttttttgttctttttttttttttttccaaagataacccactgcattcactatcacccacaacattctcacagttcagaagaattctattaaattttttatacactgtcttttttgatggcagtgagccccttttgctggatatcagccctagaggcatgaattatatatctacaaatacactcataaagcaaaaaagccgggaagccttcagggctaaaatagaccttttatatctctaatgatctctctagtttaaagaaaagcacaatcctgccaaaaaggggtatgtatgcctgattttaaaatgctaactttaaagaatatagatagcttttatcccaaactaaagaaaaattctggggatagcataggaaattaggattttgatggattacaggttttgtattactctgctcataaccctttatgactttgggttatttgcttccatgaatacttttgtaggcatgggacacatagttgatcactgacttcatgatctctgggaagtgaagaaaatattatcagctacttgaacatttctcagggtagtcacttttgattaaaataaacaagaagctttgaatagcttcccaccaaactacttttttgtttgtttgtttgctttttgagacagagtctcgctctgtcgcccaggctggagtgcagtggcgtgatctcggctcactgcaagctctgcctcccaggttcacgccattctcctgcctcagcctccccagtagctgggactacaggtgccagccactatgcctggctaatttttttgtatttttagtagagatggggtttcaccgtgttagccaggatggtttcgatctcctgacctcatgatccgcctgcctcggcctcccaaagtgctgggattacaggcgtgagccaccgtgcctggccaaactaagttatttctattaatgatcttatagtaggagaaatacatcactttctcctctcaaatgatgtgtgcctttgatcccccaggacactattatcatctgcaatcttaaacatggaatttaatattaaaattaattacaccaacatatacacttgtcccaggcatttttcatgtttacagttatctaaaatgttctacctattttcattagaattgctatttgtcataaggacccccgtgtactgcagttgacttcattttaaactaaaggcaatcttcccacttcttgagaagccaggaaagaggggttaggaaagcttctaccactttgttgtctaaaaatcagcataatttgggctcagattttcccaacagagggtatcatttatcatttttatcgctgctaccgagattaataacaaaatggcaaagaaaactagagatcagtagttctgaaagattttgttttctaaactctgagatggcatacccatcattttagttttaaaataagctcttatcatttcactttgggactcaccaggcttttagaagctctttataaattaacaagcttcagaaccctcttactgtagagttataaaaaatgtggttactcttttttttttttttttaaatctaagatacttgcattagtgtgttaaatgagagggagatagcaaagtaaagtaattcaactgcagagtgaacagtttgtagattttgaaacaacaagtacactgtggaaactttagctggtattgaaaggagaaaaaacaaaccgaaaaaacaaaaaggcaaatttaagactccggttgggtgtcacagatggtacactaaaattgcaaatgaatgccactctgtaatcatgaagatggtgatcttaatcccacttaaagggacactagcctcttacccaacagtttgcctttatattcaaactatttgtaccagggctttgcctcctaagatatcagttattccttgtcctttaacctagtttcctctttgcttactctacatggggtagatttgtcattgccataaggaacaaatgactcggtgtttgtgccagaaaagaacacacatgttaaacctgtgttacagataagttaaaaaaaaaaatcctgccttgtcctctgaaggtaagtaaaactgtgcctgagaaatccttacggaagctttagacagagtccatgggccttcacttcctctctctcatcactgctctcctattactcaaaccttgccctctttcatatatcaccttaaatctaccacttgggaccccctagcagaagaataataaaaaagtttgctcagagttagttttaggactggcttacctttagggaactgcactccaaatcccatttgtaaaaactagcaaaagtgtgtaaattatgcattaaataagttgtaaggcatatgaattatatatgttcacaatgtaaaaaaaagaaaaaaaaaaaaaacaggtgtctgctggtctagtacagtaagtgtgaatctttggcaaatctgcacagatcattttgctcaatagtttcaaactctgagcaccagaatagaggcttaggtttagagcacatactacaagatcatcttgagaatctcaaaaaggtatttttttaaatttcatagtaaaattatcacataggccagagatgacactgcaacattctgttgtcccttcccttctaaatggtacacattatatgctttctcggttccctcagaaactcagtttctttctgcagaacacaattgttattggctaaacagggagagaataaaggcttctgacatgggcaccaacagtttctcagtgcttgaaggtaggtattagctttcttctcaggaagcccttctcttagcacacctgaaacctggacaatttggatgcatgggaaaggtttcaggatgcaaggtgtggaaaggttgcatcttgaagcatttcctatgcattcaaaaggagagttttaatttgtgaatcaatcttcataggaaaaaccctggaagactgtgtaggctccaaggcttattcacttggagtcccctagaactctggtactgaatcacctccttgtctggctttgttactgatgaggtgggtacctcagctacagtcttatctgttaacagctactcaaacactgattatactatcacagcaaagttattaccaagtgtaagagacacacgtacgtggtaccagttgacagctcaatgggtcagctcagaaagaggccttcaacaataacgtcacattagtacctcaaccttctaaataactggggcagggaaacattcgcagcatccctgcgagtggattttttttaagtgatagtgggaatacatttttctggaatatattcaataaagagacatggactatgacttcttaagattcttcctttgcttggaaaacaacattataaagacactgaagagagatcagttatcctgctgacatagatgcatagcaatcttggccttacagtagggtaagcaaccactactgcagaatatttgtggtacccatgatctgcaaggccctgttatttaatgaactattctgagctttctttcccaacttagtctgtatgattctaagtgcaataacgagggtctatgggtaaacagatatgtttttgccacactagttagcaatcaccaatttaaaaaactcactttgctaagtcaacatttctgagtctaacagtttcaagtcatggatatctaggctgagtattttgaaaatctagcttccagctcagcatatattgcatacagcatgaaagcaatgcatacaaatattagactaatgcaaggcaagctgtcatttaatagtcagggggatttctggaaaagcatggtcaaaatggatttgttagatgaatatttttaactttttaaaaatccctattgctcagcttatagtaaacaaggactgtgattaataagtgtgaaataaaaggaagtaacttaagaaaacacaaaagacacaatcttttatgtttcttgatcttggtctcaataagatggtgaatcggtcattctcatcctcctgggagcaaatgagcagaatcccaagaaggcaataaagaaatcttaaacgcatgttaataaattcttaagttaagcacacaatgtgtgcgtgtacccacacatgccaattttgatagccagccagtatttataacagtatcattgactgaatgtcatcagcccataagcagatcctggaaagaacatatatagttgaattttatctaaataattacttgagagtatctttaaaaaatctaagcccctgatctagggatttcaggtttgggtggcaagaggcatacagaaggctccaaatctgcctagaatgattagactccatccagaaaagatccagatctttttattataatttctgaggcataatctgtgaatgacgttggttgagtgagagttgtttacaaatatactaattgtttttctttttcttttccatcccaggaggtgaattagttatccctcttcttgtagaagaccctttagctacccctcctattgctactcgtgcaccttccattacactcccccctacctttcgccccctcctcaccattattgagaccaccaaagattccctgtccatgacctctgaggcggggttaccttgcttgtcggaccaaggcagcgatggttgtgatgatgatggcttggtgatatctgggtatggctcaggggaaacctttgactctaacctgccccctactgatgatgaagatttttacaccaccttctccttggtaacagataagagtctttccacttcaatcttcgaaggtggctacaaagcacatgcgcccaagtgggaatccaaggactttagacctaacaaagtctccgaaactagtaggactactaccacatctttatcccctgagctgatccgcttcacagcttcctcctcgtctgggatggtgcccaaattgccagctggcaaaatgaataaccgtgatctcaaaccccagcctgatatagtcttgcttccgttgcccactgcctatgagctagacagcaccaaactgaagagcccactaattacttcccccatgttccgtaatgtgcccacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactacaacaacaaaaaaagaaaaaagttaaaaaagaaaaaaacaccaaaaaacaaaaacaaacaaaaaaaaaaacccacaacccttatctggttctgaccagtgtgcgtgtaactttatgatctgaggggaaaaatggcttttgggtttttgtttatttttttgataatgactggacatcagaagaggaaaaaaactcaaaacaaaagcgagagagactattgccatatgaactcaaaagctatcatggtgttcactctacatatcaggttatggtgtctctagaatctgttgtttgtttcctataagatgctttgctgaacacatagcaaaattcatgtgacggatgataaattgattcgaaaagctggtcccccaggatctaatttcagaatttaccacccaaacccggaacagatgggtttagggctggtgttatcagagctattggctttacgtaacaatattgttcctgtccattcacccagccaaattgtgttaaagaggaaagccccacaaactaaaacagcctttcctagggaagaggaaggggaggtgggctggatctgtgactgattgaaatgcatgcaaataaaaaagacaatattaaagtctgttatcaaaccagacagtaggggagttcaactcgtgatggaaccacaaaaggtcacacaagccaaccatgtcatgccagagtacaaaacacatagttctttccccgccccgaatgtgacaatggttttcatagtggtttaattttgtagcctgacatttatggataactctgtccttccatttgctcacttctctcttcacccatcttttttaaaaacaaataaatgaataaagctgctgtgacacacacacaaaaggaatttaatagtataatatatatataaataaatatatatacagatatatttatcatggtatgtttgatgggatgactgacacaggaaatctgttaaagtcttaaaatggaatgagaatgttgttttaaaagaaaatagcaaaacaacaaaaaagcaaaccttaaaatgtgaagaaagtgtgaattttagttttgtcacagttaactgtgtcaaagagaattaaaaaaaaaaacttcagattttgtttacatattttactacatttttgctggtataattccttagccacctatgtacatactgctttaagaaatgtttttttcctgtttatttctgtttggtttatattctggttgtctttttctttttgtaaagaggaaacaatgtacagaaaaacaataaactggttgtatggccatagctatccgaaaagcaagagacaaagcaagacaaatattcacacaaaaatgaagtgtgtcctctggagggtcagatatacaatttcttttgtacagatgaaaatcaatcagctgcttagatttagaaatctactcttgctggtctttgtaagttgcatgaatatttgactttgaaaaaatatcttaacgacatggggcaaaaagtgcaatctaaatggtagcctttactaatgtgtgtggaaagaggtgttcctcattatctaatatttcaatgtgttaagagtttaatttttttgttatcattaaaaaagacaggattataaagagatatcaaagcacgattttagataacctaaacggcccagcctatacgaagttgattatatctcgatgtctgtaaaagattgctgttcttggagtcttgaggtcttgtgaattgatttcctgctttctttcatttttttcaatttaagtaataatacatttgttatattcctttcagtgtaagtttctatttggacaattttatgggaacatgtgcattctctatgtgagcttctatcatattcctgttttattagcagaacctaaaggaatttatttaatgatgttgtgacattactgctttttcttttttcttttcttagttcatatttgcattttcgttcaaggatatgcttagcaataaaatgttcttcccaaaaccttgtatgctgatgcacttttattttcttaacatttgagaaaatctcgcactgaagctaattatgtcatatcttattaaaagccgagtaagagctagaccactttcatgtgatagaagatattctaagcagttactaattattacattatcaaaatgccatatttatgagataattatctgttacttgaggcattattttttagattgctatgatagaataaccaggagggagtgcatttttctggaaagatgatagaaacattgtattctagaaaagattattggatactatggttttgtttgtttgtttttgttttttgtttttcgttttttgtttgttttttttttgagacagagtctcgctctgtcgcccgggctggagtgcagtggcacgatctcggctcactgcaagctccgcctcccgggttcacaccattctcctgcctcagccccccgagtaggtgggactacaggtgcccgccaccacgcccggctaattttttgtatttttcgtagagacggggtttcaccgtgttagccgggatggtctcgatctcctgacctcgtaatccacccgcctcggcctcccaaagtgctgggattacaggcgtgagccaccgcgcccggcttggatactatgttttttaaaggcatttcgtaccttttacgtattttctataagtcaacaagctttaaacagtatttaaaactatgttcacatagtgccataagcactagaaagtcttagatgtcttctttccaagcctcccaccatattaaaatttaaaattaaaaaacagaatccaaaaccaaaatttaaatgagttcttcaattttaacagcttcttacaagaatttctgattacaacttgtttcatacacccattgtagcagtaatgtctcatatttctcgttctctcagcacacacttacttggccaattggataatccatctaccctttgttcttcactgtaatctagaaatatagatttaactgaacagctgtcctttatccatatgttggttaccagttttcaaagagttagaattttaaaaatatatatttagttaagcctgtgccttcaagataacattagtggagtggttatactatcgactatgttaggaatgggggggagaaagtcaggttcagtgatgtcaaattatgtaaagttttttttttgttcctgtcttcaaagttctgtattagatgttctcccatcattttttgagatggagtcttgcagcctacagtgcagtggcatgatattggctcactgcaacctctgcctctcaacctcaaacgattctcctgcctcagcctcctgagtagctgcgactacaggcatgggccaccacacccagctcattttttaatttattttttatttttttagtaaggaagggtttcaccatgttggcaaggctggtctcgaactccttacttcaagtgatccacccaccttggccttgcaaaatgctgggattataggtgtgagccactcctcctgaaatctttctaaatctcactaatatataattctaggactactttaagcattcactttttctttaattcaagaaacatttattgaacacttatgtacaagctagtctactattggctattgttactttgtttcaatgaaggcagaaaatggctagaaggattttaagcctttttgtctcttgtataaatctatacaggtccagtctctctttgctcatattcaaattgaagtttgatctttctccaaaaaatatccaagccctgtgtttgtcccagttgaactaatatcttgattatatagtttaagatcagtttgataatgtctattgaatatttactaaatgattatgggatattaaattgagagccttgggagcttatcatctagtaaagatgaacaaaaaatggtactatagtgaatgcaaataagctatcaaaaagtacaaactaagttgggagcttagaagaaattatgtaagggaaggcttcatagaaggggtgacattttggtaaaccttggaaaactgataggcagaaataagggctgtatatcattctaagcaaacccttaaagtgggagcaagcaggatcaaaaccataatttggattgatgacagactgcaaaaagtacattggaggaagatatgagtaggaaggtttttgaaatcatgtcaatgaatgggaagagagaaatgggagaatagcttgagaagttcaaggtcaagggctgctttgtcgagtacaaaggactcgagcatatttgaaatgaaaggtaataactgatctactcttatggagcaaccgagtttcctgatagagatgtttatctgggggaaaaaggcataagtcaatcttcttggagagaatgggatcagaaactgacatattgctacagaggttacaaaagctgtagtcagagggcttcagtgttctggatatattaaaggacaaggtcagatacccaagtgggaccgtgagtgattaatggcagcagtccactgacagcaccagtaggaaggcgctaatgaaaagatctctaaatatcagtaaggggttagctgccattaataatacaactttatagctttactattttttcttttattgttgaaatagtgagggcacgtatttttctaattgtgtttattacaaagaaaacagacccgaagaacttaaatgacttctccaaggtcacacagctaatacatgacaatgtcatgacttaaaatccagtcttgtggttccaaatttagagctctttcataaacctgtctctagagaagcaagtcattttctactttttccagaagcatttgaagtggaagctaaggcaggaaatgagaggatattgtgttagtctactgggattaccctggcaaaataccacaggctgggtagacaactgaaatgtatttctcagttccagaaacaaagttgcagatcaaagtttgttagggctcagtttctgggaagggctctcttcctggcttgtagataataagctaccttctcactatgtactcacagggcctttcttctgttcatgcactgagagatttctttttcttgctcttcttataagaccaccagtgctattggttaaagccctgccattatgactttgtttgaccttaattacttcctaaagacactacctcccaatacagtcatgtttggggttgggacttcaacatatgaatgttggaggggatatggttctgtttctagcaaatgtatagtagtgggaattgcaaaggttgaagttccaaagtatcaagggaatcagaattgggaagcaattctaacctttttgaagtggttacatggcccaagtagaagagcaaataattccaagagacaccaagccacagagcaggtaggatcacgtgagtagggcccaggatagaagagcagtgttagggttgcatgagagtgagggcatataagacaacaacagctaaaagcaatgcatgctcagatcttgggagatgtattaaatgagtagagtgaatttcaagatatctgagttttttttttttaatgattacatgggttctagagtcaaaatgccatggctcatctggtactgtaacttaagataaactgcttagctaaggctcagctttcatacctataattttgttatacttatcttgcaggtttcttgagaaatattggatgaaataattcatgtgaaatgcttaacatatgtgtgacaaataattatccttaaataaatgttggtcgttattacaattggctttgttacttgattcaggcaggatcaaaattagctgctatatgcatgactaaccaggaccaaaaagttaataaaaatacgaaagtttggcactcttagtttttctctaattctttcatttgccaagacaatataaaatttagttgctagctcattagcaaagattttccttcatcagcactagttatttgtttccagctaccagcttcagttaggcccagggaagccctgcatcccgagaatgtcactccttttctgagtttccatccttcagctttcttgtggcccttggtcagccaaatacctcaggcaaccttgcacccctttattgatatgcattattttgtttttaactttttattgtgaacgttttacaaatataccccaaagagaatggcgcaacaaacccccatttatccatcacttggtttcaagatcaatattttgttacccttgttttatctgtgcccacctccctatgaaagaatatcttgtaatattacacaaagttataaaacaaaaagcattcaaagagttgctgctgggcctctcgacctgagtcttatttagtgtttcagtgtacctaagcctaacgttctttctgatggacaattaatggcatgattctagttctttattcagtgacaacctaaaagagattagctgctaagtagactcttcatcatttaatgagattgcctgaaaaagtgaaagatgtttcagcttgtacgtatttcaattcaactgtgctcaatcaccttttaaaatgaataaaaagcggtctatagattatatattgctgctatatcttttgtaaaatgtgccattgtggaagagaatctgtactctttcaagagagtaagtaaaaggggagacttctaatttgtacatgtgaaagctaagaaatacctttacctctaaaaacatgatcacagatctactagcatattttaagagggttatattcatgtattttcaatagctgtaactatactgaatttacatgagtctacacagaagagatatccttaagcacattttcaagttatgattttttactgctccattgtcttttgacaatgattttcttctttgttctcactcacttgccatttttgacctagaattttcactataaaaatatcatgagagagagactcagagacacagagttatagactatttgatagtacattcttttctaccataaagtcaaggtaagtgttaggatgaatggacagaaccactataaacttttgcttcttcatttcatggagccaaatggaacatagaataattagtttcaacaagttaatgatttttctgttcctactctgcatttggtagtttgatattttatttattttggaaatttagcagagcatatataaacattcttaaggcaggtcctttaggtttgcaaaagagtacagtagacaggctgatgggtgggggtcagaaagtagataaaaacagaggcatcattaaaactgaatagctaaaacttccttggcattacagtatagttttcaatgttcatataccacgcaggaaaatgtacttatatgcatgtatgggtatgagtaaccagatctggtttgatgtcaaatttgatgtgggaagtctaggacagttctttcttaaaaaccaaagcaagaaagaagaaaaggtagggcaggggaagagagcagaggcaggagagctgcttctaagcagtttgtaactgctcagaagacagttccagaattaaagcatgtaaaataataatgaggtctctcccttcatgccagtagtgtctgatgctaacagataagctctgaattcacgcacacacacacacacacacacacacacacacacactctctctctctctctctcctgtctctctctctctctctctctgtctccacttcttttgaacaaaaggaaaaaaatgagttgcttgttcctatatggtaatacattgtaaatcgcttcaggtattgtgcttgtcttttgtactagaacttgtgtatctttttcttttaaaaatgcaaaacatatttaaacactgctattataaacaccacttccctaaaatatattttaagaacataattcccatatgtgcttaggtggacaggcttgacttcctcatctggcaaatgacaagctgcaatttggtacatatatgtacaccagggcaatagcatttttttttttttttgagacggagtctcagtctgtcgcccaggctggagtgcactggtgcgatctcggttcactgcaacctctgccttcctggttcaagtgattctcctgcctcagcctcccaagtagctgggattataggcacttgccaccatgcccggctaattttgtgtatttttagtagagatggggttttgctatgttggccaggctagtctcgaactcctgaccttgcgatctgcccactttggcctctcagagtgctgggattacaggcatgagccaccgtgcccggccggcaatagcttttataactagacaggttgatgttatgaagtagtaactggcaagtgtattttactgagaacattaggtatagataagttaatgggctttgaaaaaaaaaaaggataaaaagtaattggaccactccttggtcacgattaacactgaaaacagtaatatttttttttaattaaaagattttacaggtcaaccatacatggacatgtgactttgatatttctatgacataaatcagttgaagtgggaccgccatcatgcctatatcaaaaagccctctacatgcacacaaaaaggagaaagttttcaaagcctaagccagtcaaataatgctcagatgaaacagcggattacaaggcctcggttaacaagtactccagctcccgaaccagtgggcatcccaacattgactttggcaggcaggtgctggatgacatgcagaaggggtccttagaggctgtttccccttacacaacctcaaagaagtttaaattttcaatttactttttaaaagcagatacacagtaaacattggaatgtgagttttatgctaaatacattttggtttcagagtagttatctcatgctgccagaatagccctgaggattaagatggtttattgggatcaaatgcctaggagatttattatagtgcagactgtttactcattcccattaaaatgctgataatgcttatttctttacctctctctcccgcctgctttcttccttcctccataacccatattctattattttattttcctgctttaggttgaatctacttagatttttattctttattaaaaattgaatccttggaagctctctgactttatggctgcaagaaagtggcaatggcatacatgcagctcattaaagccttgggaacacggaatccctgcttagcaatttagatctaagaagtattttcagggagagtgtctaatgactggagagatgggtacacactggaacaatttatattaaaagatcaaaaacaccctggctatcatcatctataatataaagtcacgtagaagtaaagataattttcttccaggtagatgctttagttggataaagaggaagattatctactttatggccaaattctatgtaaattatatgtaaaacattcaagaaggcagatgagtttacacacaatatagcagcttttaggaaaatagacatgagacatcagaaaatatgatcacttaaactggaaagctagagcccaggaagtaatcctggagaacttgataatgcatccatatttataagaaagccaatcattgaatctatgaaaatatgtagaatgattttatgaaagttgtggttggtcaggcaagtgtttgccatgatctaaaatattcatcttgaatcctcagtaacccttacagtgtctggcacagaggaggtgactgagcaactttagtggaaggaacaattgaatatagctgatctgatactcatgggatgtacaaacacatctttatcattttccttttttttttcccccagtactttgctttgaaaatttgaggccagccatttgtcaaactttagcacgtgtgagaatcacctggagggctcttcacgacacagatcactgaccccactaactacagttcatctggaatgagatctaaacatttgcatttctaacctgcaaaggcagttctgtgctgctggtccatggaccacattttgagaagcacagtagcctataaagtcacaaaagagcaattatatacttcagggcaaaagagtagtcaactccattaatttaaaaagcatgacttgatgtcttttcctgcccaatggctcagatgtcttccaatctgaaagctctttgaatctatgatgaattatttggatactgctgatgtggcagagaaggaagctgatttgctagaggaaagtgataaaagaggaatgcagccaattgagccttactattaggatctgtgctaaactcttatctcttgtcacaattgagaaaaatcaggcttagagagtttaagtgacttgtccaagttcacacttccagtaagttgtgagatcagaacttgatccttccctgatacctaagaaattaagacatgtaagccaaattccaaatataggccatggtagcagaaccagtattgacagcaatattaacagtgccaacaattatagcaatttgaatattactcctaaagagtcctatgatatggatattatcttcattttatctttgagaaaactcagaaaaataatctgtctgagattacatagctagcaagatatggactaaggagtataaactccaaagcctgccttgtttatacaccactaagacctaacatcaagcagtacccttcctagaccctttaatgtaaatacatttatcaaatgtggatggcctataatgttactataggattccactaaatgaaattttgtcatttgcccattaacgacagatgaatgctgtgatgacctacctgatgcatagtgtcaaacttttatgtccctatccataggtttactgggtccaatagtacatttttataatttattttaacaaagcaatatatacatatagtttaatgggacaaataaaagctttacaataaataacagcagccccctgctctagttttccttcactcctcccacatcctgcttgccagaggaaaccacattctggtcttattttctctggtaattacctccacatttctccagataaaatatgaacctatcttttgactcactgatttcagatgttactgacttcctaatgttaaatgttaggattttgtctgacacctccctttctcttcctcattcttccaatatagttatattatacattttaattaaatactgttaggtccttttatgattatgactacaaaaatactgtcctgttgactaaagtatttttagaattccttttgcttttctacctaaatttttataaaatgcttagctttttctggaattgataatcacttttcattccccccccacctcacctacttggattcatttggctaaatcttctcactcccattaatagctttcacaaatgactcaagataagctttcacaaatgactcaagacaagctttcacattgtcaagtcttactaatgatgtattcaatctccttgtgttaatctttgaggcatctcccccagagttctctattttcttgctccaatctgaactggttgctctttcaaccactttcacagctactacccatcatcatcaacttggttttttcatcctctcctgtgatggatttcctgttttctggtttcacattgttcctttacattattcccttagtttagtaaagcacattctctagtagccccctgaaaatggatgtatcatatgtatctcaagatttttcatatctggaaatattatcatttacatttgatacttttcttcaagtacagaactctagagataaaattctttcccctatttattgtatttctctatggtcttctagcttctaatgttcctgctgggtggaccaatgacattttggttctttgtcttctgcgtgtgacctgttatttttttttccccagaatattctctccctggtgtttcaagtgccatgatgacatgctttggtggctgctgcttggttagcaactctatgaaccttacaatcttgtcagcagaataaggattatattcagagtttaatcaaatatttcctcctcccatctttttgtaaccgtatgcacacactgcaagagagactgcatgcttcctttttgcaaaactctgtgcaaggcatggttcctcctttcaggatgcttgacatctagtaaagtcaggtgtgataagcacctaatctaaaatagaaaacagaattttaagcatcatatatgaaaagtatcacattgcttcaagaaagataaataattttagatagggagatgggaaatatgctaagagtgaggggatgtttggtgagttaagaatgttggaagagtggtaaaggtagacgggaagttagcattggaaggtgtctgaagtctgggtggttagcacctgtagaagaggtagaagaggcattcagtcataggcatcaatatgtggaaggcataaaatgggaaaatgaaagacttttcaagaataacaaggtggctggattctagttgacacatggggaaatgggagatacataagaggaatttggggccaaaatacggcaagctttgcatgcaaactcaattgtagggaggtaattgatttcaattcaattttttcatttactagttcacatttgctgacagattaccgtgaaccagtccctggctgggtgctggagagagacctgaaagaaacaaggctcctgctctcaagcagttaggtgtctgtctcacgtgagactatgttgtgttgtacttctgtttgtacctaagttctacagatgaagtgtgaatgagatatataatttgcattgggaacacagaaaaaggaagagccagattgcctggattgtttagaaacggccaaaaagagatgatggcaccaagaagagaaatgctattggtatagtttattggaagtattggtagagtattcttggcaaaggaaatcacacattcaaagacacagagataagaacactggtatgtatatacacttatatttattcattcatcctacaatttttttttttttttgagacagagtcttgctctgtcactcaggctggagtgcagtagtgtgatctcagctcactgcaacctctatctcccaggttcgagtgattgtcctgccacagcctcctgagtagctgggattacaggcacacaccaccatgtctggctaatttctttttctttttcttttttttttttttttttttttttttttagtagagacgggatttcaccatgtcggccaggctggtctccaactcctgacctcaggtgatccaccagcctcggcctcccaaagtgctgggattacagacataagccacggcacccagccacaaatttttgttgagtgcttattaggcactagccatagtactagccatgctcgaggaactatagatctttcagtagagaatatggtgtccctcctaggctgtcagcttcatgaggccaggagttatatctatcttatttgttgttttgccaatactttatatttgttaagtgaatatatacggtactatagtaacagatatctatagagaatatgagtacacaatgataaacatgttcatgaaagagatgttttaaaaattagaaatgtttaatgttaattaaaataaggagtacagataaaattgtttagaggctatgtgtgtatatacatatgtgtgtgcatatgcacgtgcatatatgtgtatacatagacatatatagacactgagggctgactatgtctatagtcattctccttcctcagtgtccatggggaattggttccagtgtcaccccagggataccaaagtccagatgctcaagttccttatataaaatcatgtagtatttgcatatagcctatgagcatacccctgtatactttacgccatctctagattacttataataccggataaaacttataggctatattaatagttatttgtatcaattaggaaataatgacaaggaaaaaaagtctgcacaagttcagtacagatgcaaccatccttctttgttcccaaatattttcaatctgcagttggttgaatccctgaatgcagaacccatggataaggagggccgactgtacacacacacatacatacacatgtacgtacatacacacatatacacacacacgtatttccagtaaaaagaacagaggtcaaggaatgaaatacatgggaactcaaacatttttgcacgaaataggaaagtactatcattacaggagaggcgacatctaccacgccagagggaaggtttgtttatttatatcccctgtaaactttgactggtaaaattgaacaacttatctctggagaatttttttttctttttttttagacggagtctcactctgtcaccagcctggagtgcagtggcacaatcacagcttactgtaatctccgcccccccaggttcaagcaactcccctgcctcagcctcccgagtagctgggactacaggtgtgcaccaccacacccagctaatttttttgtattttagtagagacagggtttcaccatattggccaggatggtcttgatctcctgaccacgtgatccacccacctcagcctcgcaaagtgctgggattacaggaatgagccaccatgcccggcctctttggagaattttataagtgccccttctaaaaacctcaatgctctgtctccctcagcccttgaacatttggttccaccagccaacatgattcctgcctctagaattggtgtttctactttgcctttctttagtcattgaatcctagttatatccaaactcaaacttagctcatgccctgtgtgcctcaccaaatagaaaccaatcccagtgtttcttccccatggaacataaccatgatctagccacttgaccacactacaatcaagaaaaccctatcctcttctcaatggggcattttgacacgggacaaagtggccgcagaaggtacaaactactttaaagcattatcaccaaagcatcacgaaagggagaactgcctttttgaagcacagcatttaataagacctgaaaagtaggtcggacccaggggctcacacctgtaatctcagcacttcgggaggccgaggtgggtggatgacctgacgtcaggagttcgagaccagcctggccagcttggcaaaaccccctctctactaaaaatacaaaagattagccgggcatggtggcaggtgcctgcaatctcagctactcaggaggctgaggcagaagaatcgcttgaacctgagaggcagagttacaataagccaagatcacgccactgcattctccagcctgggtgacaaagcaagactctctctcaaaaaaaacaaaaacaaaaacaaaaacaaaaaaacacctgaaaagtattcttcgacttccaggaatagaacaaagacaaactttttgccctcaagaggctcaaggccttaagagacaacactcactataggtaaatatttaattcccctaggtaagcccagcgctgcaataggtttatggtgggtacccactgtatggttgtggaatgaattaatgcacatgccatccacgctctcacctgtttctttgacttgggtttggcacctagaaggtcattgttgcccacataagaagattttccatgcagtaatagaagcagaagtcagacagcaaaaactaaggactgtgtgaaagatgagaaagtcaagtaaatgggcagacaacctactattctggaaagattaagtttttaagagacatacaaattttcttgatggcaattatttgaaaataaaagtcagagtgccccacgattttacaatgcaagtagattctccatatgccttctatccctcaaaagtataaaagacaagtagtcagtttgcttggcagcctgaaatctctttaaggacaaggaccagcttttatttattattgccattcctacagttcttaacttggcatttgttgcataataggtacaatgtttaaagtacatatgttgaataaattcacttatgaataacacaaataatatgctggctatttttacatattctacagtataagcaaggggagaggagtaaaactttaatagcaaaagatggaaattgggcaaaatgtatcacttggccacattttacacatgacatccccatgagataaacaaactgttggtggtaaatgacagtgagtgaatgaataaatgcaacattagatagaaaatattcaacatatgtacaatcttagttatgaggttattttaatgatcaaaggccttactggatattgaagtgtttgtttagtcgatgtgtgttcatcagcatgacacctacaactgttcgccaagcattttggggtgaatttatcagaacggactccaagccatctctaatgataaaatgcataaatatatccagaaggagaagcaggtcactttttcctacctcacattccctttcccaaaggaaactgattgccaaaaagtgccacctctctgcttatttttattattcagcagagagtggggaatatagtgccatctcatgcattaccattccagagacgtgatcagtaagtgcagtaattgctatgtggaagcaagaacagattgtcatgattccttaacctgggtagaaaacagtgcatgcatcttgtaatttgctttgtagattgctaaagtgattgacactgtgggttacagtgtataattttcccttttttgtgtgtaagactgcataattccaggcatgtttgccatcatatggcacgaggcattatcattcaccttgaatttttcctaaacttgtcttccagaaaaaaggacgaaaacaaggcagcaccctgtcttcccatggccatataaccacttttgaggagagaatgcaatgaaataagtaccatgagaaagggactaatctttctttaaatgacaagatcttccatagagactgcagcccagtgatagaaacttcttctacactgttcctgatgctttattttatttaccacagcagctaacactccactctgggaccagaatacaccagcagaaagatctataaagaatcattagagttttagacagatgtattcacaattctacaaaatacattctcaactggagttagttattagctggtaatcagctttggtagcaacatgtatcaaagctcaaggaacctcctcatactgatcactcaccatcttgtgccatctgggtagaaatgtacaaattcagattttacacatttataccgacaatgggctacactactagaaaaggtggtgggagagctactagcatcacctgaaatgtttcctatctgactgaaatattcaattatggctactccaataaagatacaagttctgggaaataactgttttcagaacgaagtcagttctctatcagtggtttgacaaggcagaatgactgattgtgaagagagtctttcagagaaatggccaaataattcctagtggggacattgcatcactttaatgtaaaatgttgggaagaaaattgaaacaaaaatgaatacattgaacgacactttgaaagtaagtacaaaatagtaaggatacctgtctttatacagagaagtttccatttaactggtaggcatttccagaaactagacatgttttatttatttttaaaactaaaatgtatttttttatttttataaatatgctataaaaataaacaaaataaataagcctattttatgtttcctttttctactactcaaaatattgcttcacaaaagtgagatgtcattttcccagaattttttttttttttacatttacctatttttatacctgatttagattccctcttccaggagctaaaactggctaccatgcagataatgtcaaaggaggaggaataaaatataagaggtatcaataggaagcttgaatttcctgagagtggagagtcatgagatctgctcatctttcaatgtgtgcttaagatgccatgcctttgaagagacaggacaccaagcgcaggataacatccattgtttcacaccatggaaatatagcctattttaagatagcatctacagaatgccccaaaaggaattccagtgctttctattatttattttagtttacctcaacctccttttgggattgaaagttagtggttccagatccctaaatcttcctgaggactaagggtacatttgttattttttttttgtcctgttttcagccctactcctctgaaatagcctgagtacacacgtttttgccttgctgaacttttttccttttacctcccatttgccctctccaattcaatttccttaaaaaaataaaataaaataaatgggctgtcagaaactaaagctttacacactggagcctccctgcattcaggaggtaatgagtgattctttcacttgttcactacactctaatcctaatttaaggcaattcattttatgattttatgtcttggtgatagtatctcatgaataacaatgaaagaatgaaagaatattctatcactgcagactctcttacaaagtggtgacatataaatgcaaagataattgccatttaaaaataaaggttcttttttctttaaaggcaatcagttgatactaaaaactagtcaaaacatatgttttccacttcctgctttagtctgattaatacagacaagctttgacccaaggatactatcactttgagagtgtcactgatgtttacagtaaaagtaacgagttctacttaaaaattgacactatgcattagaagcaagaagttatctaataaaagaagattggtacatatgcaattagggattcaaggatcaattgtgcttttaattacttagcacatcaggaacttgatctcaataatccaaaccatgtagacagatcttgattctatggcaaaaatgatctgagaaactggaataattaaaactcacagataatcccaaaccgttatggcaacaattcattaagatctccttccttagagaaatggttttataagagctacaaatcattacaaaactggctggcttatgtctcctctcctttgatgattccactgaaatctccggggaaggccatgcaaagcagtgaaatagccaagtcaggaaggaagagaaaagggacagagcttcaaggagaagccataaaacttccaaatgcactagactgtcagtggtgagtgtgtcctcgagaatagttgaaaacaggatttgcatcattccacgtaaaacaggagtgagtgagtaacctatgggagaaggtgtgtgctgatccaggtggcaatccccaagctagaacatgaataatttatagtttggtaactacgtagaaagacgttttagacatcatttttcccttattttctgcctcccttctattagcctcagtaataccagcatacaagactctttgttatatccaagtaagagaaaatcgcagtactctcaactttatctttctcctttttgttatttttcactggcataccccctgccttatcagtcacagcctggactaagctcttgttacagacgacctaacttctgattcaccaagttccttgattaaacaatattttatcctcaaaacttcattttacaaaacctagatacatgtctgccaggtcttcatgccctcatttcaacaagactctagaaaactctaagcaagctttatcattctgtctcacagtcatctatcaaaatctatgtttatgcatgctcttgacagtaattttcatcaggatgttgcaaacacatttcccaacatgaataaaggaaatcatactcaggaatgccaaaggagcacagtgacttatagacaattgacccaggaggggttttcctctctcagagggatatcctttggccaaggatgcaacatggagaaggggcatatgtagaatattaatagagaaagaggtttaggcccaacaactaaaataatctgccaaattaacctgggcaaccaatacataacaaatacaacaataccattgttgatactttctgaaatcaggcaaaaaaatactgcctctttctcttttccctccttcccttccttcttgtcttgcttgacccctattaacttccatatggacggcatcagattcaagaggttgaagaagagacccggagccagagaacaaatcagagttcaattgggagaacttacttacagggaggtgcaaccgcagtaggctggacaggagaacagcaaccgcttctgaagaagcatgccatttatatagcagtatcacttagcaactcccctcagcgatctccacattgcaaccctcatttcttaagctaagtcaggtgtgtctgccataaggtcatcattaagttactgctgtcaggtgtgtccatcatacagggtccttctcaaggtttacttaatttattgctgtcaggtgaatctgccacacactttctttttttcttggttctttccctccttccttcactatcacttcttgagcacgattccagatactctaagaggtactgataaaatggtgagggagatagactcaggccttgacctgaagcttacagtccaataggaaagttgcacaaattaaaaagttcaaaaaacaaaaacaaacttaacagggtaaaaaaaaaaaaaaattggtgcatccacccagcagttgtcaattgtaattaatttagtctagggtttctatcagagtcagaggaaggctaaggaagtaactttcgaagtgagacctaaaggatgaagaattaaccaaatagcacagtagagaggagatgagaaagtaggcagtagaagcctttcaggtagagaataatagaagtagagaggaagcctcagagagcatgagtcctgcaaggaacagaaatgaggccggttaggctggagcggaggatgcaaagggagaaaacagagagtgataagaatacaaacgtaggcaggaaccagagcataaatattcttgtgagctaggtgctcatggtgcaaaatcccaggctctaaaattcagacatgaaagcatctatctccattttaccttaactcaacatatttttaattatgagtattatgataaagatcggttagctgtttaccaaatccatttcccattcctcctagacatgtgagtagacaaggtttgccaatctgtctcgctattagttatggcatgagtctgagttctgaccagtggaatgaaagatgataacatatgcatcttctaggcctggcccataaaaacctccagtgtagtcctcgctatcttccactatctcttccactatcagtcagtgggatattgatgtccaaggtgaccttggaaaccatgtggaaaagagcattgctaccccattactgtatgcacatgcatgcacacaaccacactgaacagttgttataaggatgatgtttctattgtgctaagcatttgagattttcgtgtttatctattatgccagcaaatcttaaaatatggtttcaggagtagcagcatcagcatcaccttgtaagaaatgcaaattcgtgagtcccagcccagaactagagaatcagaaactttggaggtgtggccagcagtctgtgatgtatcaagccctccaggcgatcctgatactggttaaatttatgaacattctattacatcatttcacattaccttaatccactcaatccataataaaagtaaagtgtaattaattcaggagagttgcaaccaattcagtgtttccttagtcaattcaacccatgtacagtgctaatgcataagattgggtccatctgacccttagttattttactcacctgtgtgatctttacgatttctttttcttttcttgacaggctttggttgtttctctgtgaagatttgtcttccttatgtcaacttataagcttcttcatgttgggcctccagctacttttgcatctttctttacacacaagacctgaatgctcccttcaggaaaacctaaattctcatgcagttgtctctgctctaatgttttctgctgtaggagagctctttgttttccaactcctcagactctccctgggttgttaggtacaggtgtcccatattctaagatccccctcccaaacctgcctgagttttacgctcctctttaaccaactcacctagtacagaggcaggagtaggactgtcttagaaacaaataacacaatattccaatgagataatatatggccagtttttaaaaactatctcagtgaatcccttttctctggcctattatgaagcaaggaaaactggctcttcaattgctgatattttcacgttttgctaaatctattctttatggcataaaatttgtgttttagtttttatgaagtcaaaaggtaactgaaagaaagtaaaaagactagcaatatactgggagaacatgtttgcaacatataaacacaaagaattgtatagttatacatatgttcatatataaacatacctatataggtaggttaatacagagatagatagctagatagatatcttactaaatcaatagaaaaaacaaacatgccaatagaaaaatgggggaaattcagaaatagctatgtacaggaaagtaaacacatggttaataaacaggttcggccatgttactaatgctttagagaagctaataaaaaacacatgagatataatttgatctcatttaattggtaaaacaaagtcaagaaaaaccagaacagtgatcaacagggtttctaatacagtactcattgaaggataaattgatacaatcactcttttctttttttgagaccaagtcttgctccgtcacccaggctggagtgcagtggtgcaatctcggctcactgcaagctccgcctgccgggttcacgccattctcctgcctcagcctcgcagcagctgggacaacaggcacacgccgccacgcccgactaatttttttttttttttttttgtatgtttagtagagacagggcttcaccgtgtgatacaatcactgtttaaacaatttagcattatctattatggttggatatctaatgaggttgctatgttccagcaattcttcttctgcttacccaagaacaattcatgcttatgtgctcaagaatgaaattacaaggtgaggataaacaaaatttgggagttatccttgcggggtaggcagaagggtgagatagaagaagagcatgtaagtagatgcaagttattggtaaagctcttgttcttggatggtatgctgagtttgtgggtgctccctacattattaaaaatgaaacaaaataaataagggctttgtaggagccaatgaaagggggtttcatgagccaagggtcagaactcatttaatgacgagcatgcagggtccataggagaaaaaataataataatcctttggcttttgtaagtcataagctctttttttgctgagaccggtaagattttaaattacattaattattacaattattatcattattattatttgcttctctgtggcaacttttctctcctaaggcattgaatggattccatgaggtgaaaaaaaaaccattgctggcagcaaaacaagcatttggctggcatatgaaaaaactattaataataagatgtgtagatgtacacttttaagggcttttcatttaaacagaattatggggtcttcatgagttatatagaatattaacaaattaacatatcctacattttcagaaagtctgagataggtcagtttgcatgattagctactttctagtcatttatcttgagacaaagcagttgttcccatttattatttgtgaaatgtggtttatgtactatttgcttaacttcctcacagacatgcaaagaaaaagattttcattttttcaaacaaagatgatgcattgtgaaaagtatctgtgaaagaaaaacctgatacctaaccatttcacccacaaataaatattctttgataatacagtgtctgggttaattttttttcccccaatccaaagtgtcattggtgggtcccattgtagcttttaacaacatgaaacacattcttaaactgtaacttagtgcttctaatgaaggacactttctttttttgtgtgtttttgaaacatgatagcaatttaatattaattcttcaatttggaaaatattggaaatattctagaaatataaacagaggaaatagagataaacagaagaaacactatcatatcataaactcctgacaaccattaggcaataaacacagttttgagaacatacaattaaaagattatcctcactggtaaaggcctgacttcgttcaaattatgaaagaggatttcagaaaagctgctcttaagtaaacttacacacaaaaagaaacaataggaaggccccaaatagattttttaaaggaaatgttacttagatatattttagctagtttgctttaaatgaaggccccaatttgtgctctgtaggatattgtttattttaaaatatatataattttagtaataagttctttatgtgaaaaaaatgtacctatagctatgaattactataattaaattgaacatccaattgcttgtatcattatttataatattaaagaaagtagacacaatattcaatagggaattatttaaattatgttatatcattaaaattcaactaaaataaaaataattattagcctttgcagtactgtttcaatcattttgcggatattaaaatacatgtttatcacaattgtaactatatgagcattttattattgccctgttgctgtgttgggagagcaagcagtatttttctatatttccgaattttttatagaaattacaaccaccatgataagcatccttgtgggaaaaacctttgttcatattcatcgttgccttacaactaattcctataaatagatttgttaaattaaagaacattttcaagacttcttacctagtgccaattgccatctggaagtttgtacaaacgtacattcctgccagtagtaaataaggatgcccccattgttattgtgaagaaagaatggtggaacaagccatcaatatttgagcctccttttcccaaatgcgattctcaaatagcatcatttttttggtgaaggaattgaaaaaaaaaagcattaagtcatgtgctgctgcttctaagcatggtagcaagtgcacttggaaattgcccagtgttttctctgattaagaagctttgtatagatccttgggagacataatccctacaagtttatgtagtcaaggtaaagctagttctggcagctccgggtgagatcactctgcaattactaccccttgaagaccacttctactctctgtgggccacccaaagtaatttgtgtctggatttttctcacttttgagaatcgtccttactttcattcagtttcatttgtccagatttcccatgctaataattaaacaccatgaaattttaaccaagtcattagctaagttttttaatgaactatagcactttatgaatttaataaatcacttttcatcttgtcattcagtaaattttaggaaaatgagagaatacattcttattcaaaataagaggttcactttcatttttattttattttttgtttcattgtaaactgcaacacttatctgtgccttgggcatcattggttggaattttctacaactgaaacacattgatatgttataaaaaagatgtaatgaattctggaactagaacatctgaacctaattttttttttaataatgctgtagtttcttcatctaatgggaggacactaatagtaactgccacatagggttttatgagtttaaataagataatatttgtaaaacatttaacaaatatgaatgtatcactaagtatatgccagacactacttcacttgttgtcatcaccatcatcattaacaaactcattgtgggaaaccttctcaataagtagttctcaaacaccagtgagtgattttaaatgaaaattcttgggtctccatttccaaaaattctgactcagtatgtaaaaggtggggcctgggtgattctgatgtaattggtcaaatgagggcattttgaataattcagaacttctgacttatttaggagtcaaggtagataatttaactctcctattatttgttttcagtccaataacacagaagaggaaacaattagaaaaatactgtttcaaaaaggcagttcgtttctaaattggttatcccatgttaagatgtgaacagctattgataatctaccaaagtgtacatgtctttggtgcatatagagtcctcttcttttctctcctgatgctttccttccgggaaatttaattgttccacttaaatggactggaacagaaagaagaggagatccaaagcagtttaccgtcaccagtgcagtggtcaaaacatgaatattgatgctgcatggcctagaaacatattgtggtttaatcacttaactcctctgtgcctacattcttacctgtaaaataagaaactaataatacctaacttaaagcattgttgtgaaaatgaagtaatcggaatttgaaatggtatgactaaaattaaagtgcattttaattaatcatctttgtccagctgtcttcctccccaaaaagtgggcagtcattgatcaaacaatgtgtcctatttcctcctcttgccagccaaagatgctgcatcggatagagaatacacattataaaaggaaacatggaacactggtcaagcaaaatgtatttctctgcctgcaatttcccttctctactccagatattaaaaactaattctctcagttattcattgctggcagagatgattaatttaacctttatagataaagtaatatgtttggatgaaaggagcaaatactctgctgagtctaattgcaaggcaccttcgggtgaataattcattgtgtacagtataatgatatcatagatggttagccaagaacaaacatcaattgtataaaggaattaaactaaactgagtccatttggcagtgaaaaatagatagagcccttatcaccaatatggatcttgttttggtaaatcttaccatggtctgagatttcatttttaccaatttctgataacctgtcatgtgtgccttcacttctcatacagattctccacttaggtaaaaaacgttagagtaactctggtgattagaaatgtgtgagagtaagagagacattggtaaaatcccacactgctactaagcttggaggccttgggcatgcgacttaacctccacaagctttccatttctcacccaaaaaatgaggaaacaaaacatcaggttgttgtgaaaatatgagacttacttaaaacttcacgtaatacattgctgggtttatagtaaatacttgatcggaaagaaatatggggacatattatatgtgaacatgtataaacatacatataaatacatacacacattctgaaaaatatttctactcatccttctatattctacctatctttatttttaccacccagccctgttcatttctgtcttttttcaaggtatttttcccctttcctctgcacattttataatcctcatcaacaaatacaaaaagaaaacagatggaaagattctttttctcattagtagttaaaaatgcaaattatagcatcctggaaactaggattaaaaaaaaataagctgatgtggctaagataaaccagtttcttcctatcactactgccaaactgatgcaatctttttgtaaatctatatttcaaaagtaagagcataaatgtgtccatagccagcaccccttctttaaaagttatctcaaaggaacaatccacctaaagtggaattattgtgacacaactaatatttgcatggataaatctaaaattgcaaaaatttttttaaaagagcccaaatggaaggttgtataatttgacgtaaccaatgaaatgttatacagttattaaaagtggtaataaaatgcataaaaatattaaaacctaaaaacatttgataatgtaaacataaataaattgtatattatgattgtgactatttggatgtgtatatgtagaagttaaagcaaaattagagctttcagagaggtgaaaatatgagcaatttttgcaatcacaattttttgaactttttttattttggctttttctttactgaaaaatgaagatttaactctgatatactctgcaaaggcttcccaatatacgcaaattatatgcattttcttcccttttttaaaaatagtacaataccatttcgttttagtgcttattctagaccttacattatattggctttatcactccctacttctctcatgttaatctcttcccagaaagactctgaaccttttaaagataaaggctgggtaatttccatttaaaaaacacatcacaatatctaagccagaaccataaagtgtaagtatgtttttaaactttatgtctgaatccctaaggaccggatggaggtaggtgataccttcaccctacccgacaaaattggggttgacactgaatgcagctatattacctggtagtaaaaatagcacagcagttttgcacctctgaaaccctaccctatgtgaacgggaatggactgagggcgagggtaagaaaaaagaaatgaataaatggatatgtaatgaggaaaatccaatcatggcttcaacactttaaaagaggctcagagcaagagataatagtgtgccttagattaattgtatcagatgccctttaaagggtaaagttgtatgtttgctgagaccacttttgctttcacaacctgacaagatgcaatggaagtctgcaaacctgagtggcttcaccctgagaaatatttttataagatatagatatataattatggacttagactaattgacagtgggattctagtaacgtggcagtatcttttgagttgtatatccttttgatataaaggatccatcttcaaagactgggaatgaactgtgctattataagctgtaataacatatatatatttggtcttcctccccatttccaggcatggagttcgtagatcctttagtgttacagggaattggcaacaaacgtgaatgaatcacaaaagtgttagcaagttacttaaataaaattgattttatcaactttagaagtggttaaccaaaccaaaatgtttgttaggcatcttcatacagtttctagtaagcactgtgaatcccaactatctgagacaggtctcagttaatttttttttttttttttgagacagagtcttgctctgttgctctgtcgccagcctggagtgcagtggtgcgatgtcggctaccttggctcattgcaacctccgcctcccggggttcgaacgattctgctgcctcagtctcccgagcagctgggagtacaggtgcgtgccacgatgcccagctatttttttgtacttttagtagagacggggtttcactgtgtagccaggatggtcttgatctcctgacctcgtgatccacctgcctctgcctcccaaagtgctgggattacaggcgtgagccactgctcccggcggtctcagttaatttagaaagtgtattttgccaaggttaaggatgcacacccatgaccatgatagagcctcaggaggtcctgatgacataggcccaaggtggtcagagcacagtttgatcttatacattttgaggactcatgagatatcaatcaacatatgtaagatgaacattggtttggtccggaaaggcaagacaactcaaagcaaagctgggacaacttttttgggaagcagggaaggggcttccaggtcaaaggtagataagactagataagagccaaatgggtgcattcttttaccttctgattaacctctccaaaggaggcaatcagatatgcacggatgactttgaatagaatgttaggcaggtttgccctgagccgttcccagcttgacttttccctttagcttagtgattttggaacctcaatgtttattttcctttcacatttctccccttttctttgttaaaatcttttggagaaagcattttagaggaaaatgagtctctggtctcaggtttcatctgatctctgatggctaagatggtttattcctagacaggtagttatgcctgtttccatggtatctgtgcatatgtgctggcagatgctagagtgactgcaaaggtgaagtttctagagggaggtgggcactctgcagtgtctcactgtgggaagatacttgtttaataaggacaagggcatgaagattcagtgactggggagggtagatgtatgtatgtggatgcagggaatgaagtcaaggtcggaaaactctcagatatggcagaggaatatttttctctgtttactttataaagcaatataatttgccaaagtgatatatgttgattttttttaaagtatgttcctatgtaatgaagttaaaacctccctcatcctccatttttccatctctcaggtttatccaatcaaacctctgaatcatgagaactaataaatattgttttgagtaagttttggggtagtttattgtgcagtaaaagttaactcatagagacaggtatcttgcaatgcaaaaatataaatatatgaacataaatatacaaaaaccactcttgtttataatcacctgaatagtatatgattatattctttgaaactccagccctgcacacaaggtgaaagaatcctttaatcagaagcccaccatcctggtctcgtagatgctgtcatgactgagtgtgcatccttctggatttctgccagctttttgaattagaaaacagaaatttttaccttatttgcttttactttaaacacaacagcgtgtcttggaaatatacccataccagtaagcataaatcaattcctgtatacacagaagactgctttaattcctgaagctttatgagatgatttgaattctgttagatcaagttattctcatttattctttttcaagacttccttttctcatatttattccttcacttgaatattagactcagctggtcaagatgatgaaaatatttctggggggaattttgggggattccattgaatttactaagtttgaaagaattgatgactttaataaaatattgcaagcatcttcccattcataaacttgttatagttttcttttcttttcttttcttttctttttttcttttttttttttttctttttgagatggagtcttgctgtgtcgcccaggccggagtgtagtggcacgatcttggctcactgcaacctccacctcccgggttccagcaattctcctgcctcaaccccccaagtagctgagattacaggcatgtgccaccatgcccagctaatttttgcatttttggtagagattgggtttcaccatgttggccaggctggtctcgaattcctaacttcatgatctgcccaccttggcctcccaaagtgctgggattacaggcatgagccactgtgcctagcatatttttcttttactgaagttttttttcaccatctgtggtgaatttttctaattttctatacattattagacatttatttctaaatttcttccctgttgctttatatttctcattgccatcagaaaaaggatctcaaatttattacgttttgctggtatacaagaaagcttcagatcgtttttatcatctatcttgttaggccacaatgctgaactcttatttattctaatagaaaaattaggacaatcaactgacaaactatgtggatgatgttattacttgtaaataatagcagtttggcctcttccttttagtatgtgtcctttgtatatttttcttattagcttggagttccaatgctatgttaagtagtaaaggaattagcaggcatctgtatctagttcctgactttgatggaaatgttgctagtgattcactgtttactgtggtgtttgctgtagatcactggtagaaatctcatatcaaattagttgcctcttagttctcatttgcatagagatatgcaataaaattgcttttttttaaaaaaaataaagaatggcttttggatatcatcaaatgcttttttagtatctactgagatgatcctacagtctttttccttatttatgaactgagttacaatgttaataaattctaatattaaacaactcttgcattcttgagttaaaccataattaatcatgttgtattattttcaatacattttgatgctctattaatagtattttgttttagatatcacactcctgttcacaaatgaaattttttaactgttttattttctcattctctctttatatagctagatttgttttttttttagatggagcctcactctgttgcccaggctgaagtgcagtggtgcgatctcggctcactgtaaccttcgcgtcctgggttcaagcgagtctcctgcctcagcctcccaagcagctgggattacaggcatacgccaccatccctggctaatcttttgtatttttgtggagatggggtttcaccatgttggtcaggctggtctcgaactcttgaacgctgcaaactgcccacttcggcctcccaaagtgctgggattacaggtgtgagccactgcgcccgacctttttctagctttaataacacataaatatatactcctttctccctgataatctaagatttgaaaatgatatcttgagattaaggtgctatttctatgcttgtgtctgtgttttgttctgccaatggcttacatttattaagttcaggtaaaatcttcttatttatcttatgcccatctttctgctgttggctcccctgagtaacttctgtttgcatcttctaaaataggtgttgaaatttctaattctttctccaatgcctctcactttctcttaaatttttctcagcttttttagataatagttaataatagtagctagtgtttatatagttccttatacacacacactattcccagtgctttacacatagaaactcaatttaatctccattactacccactcctgactgaatatgataggattgattcaagaaaacaaaactatactagatatttcaacaaagagagctaacgtagggaattggctaagtattgaagaaacaaaatgagaacactgaagtaatctagaagcacatagaagtaataaagcagctactactcccatgtctaggggaaccaaaggaagattattcgaatctagaaactccatagagtgggagtgcagaactcagaacaagggatgccactctaggtaacacagtgaaaggaggagtctcttggaaatgaggcagagcccattgtgctgacactggtgagggaatgtgcagaggcctgttcagggaggctaaaagatagaaactagaaccaaccgctgctgccagaattgcttcctgctgttaggacaatggtgacagaaacaacagcaaattaaaagattcggtccatccctcctaccccttaggagcacaaccccttagttgtgcttttgtgccctctattttagcatgactttacaggaaaccagtggaaaaggagaaactagcccctgctttacaaataagaatattagaaggtatgtttggagctcagagaaaatagattaataataaacacaaaacagtgaaatttttttttcaatgttacacagctagtaattcagatacagtatttgaatccaggcggtctgtttgcagaatcctttctcttaaccactactcaatgcttcctctccaacaatttgaaatctagaaaagtccttggctgaaattccagcttactcatttctcttgaactatggcctttcttctctgttcagcccagctgctgagttttatgtccatgatgacagttttgatttccactatctatcatgttgattttattatgggtggaatatcttcttacatttctgaggctgtaaattgtacttcctctgaacttcctgttctacttgttcttctaagtctctgttccccagattaagttcttttgttgaggaacagcaaagcattggctttcctcaaatgataggcagctcttgacgtgccttcatctttgcacctgagataccctgctggattgtctgttgcatctgcttatgagaaaggctgagctgacctgttgtgacttgtgcgttgtgcagctttctttcaggatgggaggcttgggataatgtgccatgcatgtagtaccatagcagtcagcactgtctcatttctctgaccccaagttctcactggataactctccccatcccacctgagtcagatacccctgtagctgctttttggactatgtaggtaggatatgtagaagctgacctgcttggcccttctgattatccaattggttactcttaaacttctcttgatcccagtatccatacatacacactcccttggtactgtgcccagattttctaacagaaaaattcactctgtgtttggggaccttactttttctaatcactttcctttcatttctcatctttcaggaatttttcatgcgttttgttccatcagggttttccttcttgatttacatagtggttgtgaattttaaaaggaaaatacatgatcatttctagagattttataagaaatgagaaagctatgtctgcaatctagaatagaaattgtgtttctcttaaaaaacgggattctgctgctcataatgttttgcaaattatttttttaatgtatcaataaaacacgggcatgtttccatgaaagtagatatgtattattttaatggctgcaaaagtattctagatataaatgtgccacacagacattctcctattgatggccattttagtctgttttccatttttactattacaaataatactgcagtgagcatccttatgcactcctaaattatttctatagcctagatttttcaatgtggatttgtaatataaaagggaatgttcataggacatggttttcaaataaataaataaataaataaataaataattctttttactgtcaggcggtgtgtgtggggagacagagtctcactctgtcacccaggctggagtgcagtggtgtgatctcagtttactacaacctctgcctcctgggttcaagccatcctcccacctcagtctcctgagtagctgggactacagacatacatgtaccaccacacccggctaactttttttttttttttttgtagagacaaggttttgcaattttcccaggctggtcttgaactcctgagctcaagccatctgcccactttggcctcccaaagtgctgagattacaggcatgacccaccgtgcccggcccttttttttgttttgttttgttttttttttgtttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgcccggccctttttatgcttttgtaacacccaactgcattagctcaagtttctctttctggcatgttccataatttggccacttccatccagggaaatggccttggagaggtcaggctcatcacttatcagtgtcctcactgggtcaaggaaatagcaccaggacagagcaggaaattatttaaagacctggagaagttggaggccaaaaacctgtatcactcatatattctaaaaacattaaatattggagctataataccacttgatgaataaaataagaatttttttcttcatataaatgtttaggcagggcacggtgtctcacacctgtaatcccagcactttgggaggctgaggcgggtggatcacctgaggtcgggagttcgagaccagcctggccaacatggagaaaacctgtctctactaaaaatacaaaattagccaggcgtggtggcaggcacctgtaatcccagctactcgggaggctgaggcaggagaatcacttgaacccaggaggcggagtttgtggtgagccaagtttgcaccattgcactccagcctgggcgacaagaatgaaactccatctcaaaaaataaaataaaataaaagtttacttagttgtgtgtaggaaaataacatatcctaaaatcagaatatcttcagaagtttcacatataccaagaaacatttaattaatccctttcagcaaaaagttctttccttcacaccctaaattcctcctctcagtagagtcaaatcccaatatttgaccttgttcttcttctaagcattttatttatcctgttcttttttttatcctcaagcacaaacttgaaaatacctgtattggaaccagtatctggcatatctaccttataacccatctgctataaatcagctctttgcagacaagtctaatctgtaatgagctgatttataacagatgatcaaaataccactagaatttactagaaatacagttttcatgtgtacttgctatttttcttagaaactataagaaaagcaaaagcaagacataaccaaaaaaaaagaagaaagagaaaaagaaaaaaaaggaaataatcactagcagattgtattttccaaaatatgtgcacagccatgttcccagttccacaatctcagaaccctgatgcttctctcatcaaaacatggagttgaatttctaccccttgaatgtaggtcactgtgactgctcaataagtagaagcaaatgaagagacatttgtgacttttgagactaggacacaaaaggtgatacagcttccatctggctcattctctctagggacactcacttttggatcacagccaccatattttgaggaaccccactccacatggagaggccacttgtaagtgatctagctgacaggcccagattatctcccagccgatggccattatcagccaccaagcatgtgaataaatagcttgcagatgattctagcctccagccttagaaccttccagctgaggcctcagacaatatgggttgtagaaaagctatcctttctgtgctgttatggttaatttttgtagcttcatattgcctccacatccactttgaatatgggtttaacttacgtaaaccagaagcagagcttacttgccctcaccacaatttccagttctctacctcttgccagttcctcagtgtgatggacccagataactcctcatacaacacctcctggcgaccacctcccagtgggacaactacctacaacctatttggctcaccccactaacccccacagcccacatggactgtgcagatataccactgtgaccaattctctgtcacagtgtgactcctcagaactcatgcctgcgtgctctaaacccaccaattaactccctgaaggaaaacctgcctgggtaataccctcaattccaataaaggcactggtctacaaatcccttgctctctttttctctgctgatttaatatgtgtgtccccgagggctccccacttcctcctggccctgcaaggtatgctgccctctcttttctctgcaatctgtgagtaatacgttgcttcttttatttcaggtatgttgttgagttaccagctctgtgtctcatctgtccaacacactctaacctaacttctttctatctcagggctcctctagagagtggctatcttggtagaagtaaactggacacaggggagacaagagccataaaggaacctgtcagtataacaagtttcttgtgataggggtaactaatcatgggttggacaactgagcattaggctgttggccaaaataaacaagtatcctgtgtgatcacattatatgtggtcttttgttactgtatcctttcacttgacaaaatattttcagggttcatccacactgtagcaggtatcagtctttcattcactttcctggctaagtggtgttccattgtggatgtatcacatttgtgtgtgtgtgtgtgtatgtgtatgtgtgtgcattcatcagctgatggacagttgagttatttccaccttttggctattgagaatggtgctgttatagacattgatgtacaaaaagaagtatccagtgaaaggtacactgtaaatatccatgacctatacccctagagcccaatcagatcaggactagagttaatagccactctcctaagacagacctccagaccaaattagaggaaaatacaacagctctgttcaaatttctgacatacaaagaatctgcaatgaatggctgtttataccataagttcccccccgtttaaaaaaattgtggtaaatatgcaacataaaatttaccatcataaccatttctcagtgtacagttcagtgatttaaaatacattcataaagttatacaaccattatcaccatctctctctacagttttcatcttgaacaactggaaactatgttcattaaacaataactccccactccccaagcccttggcaactaccatctactactttctgtttctatgatttcgataactctaaacaccgcatgtaagtggactcatacaatacttgtctttctgtgactggcattggtataagaataatgttttaatgttctttcatactgcagcatatgtcagaatttcatttctttttaaagttgagtaatactccattgtatgaatataccacatattacttatcctgtcaatagacattgggttgcctccacattttaactattgtgagtaatgctgcaataaacatgggtgtacaactatttctttgggatttcctgttaattactttgggcatatggcaagaattaatgttgctgattcatatggtaattaaagatatatgtgtgtgtgtatatatatatatatatatatatatatatatatatatatatatatttttttttttttttttgagacaggctggagtgcagtggcacgatctcggttcactgcaacctccaccttctgggttcaagtgatcctcccatctcagcctcccaagtaggtgggcctacaggtgagtgccaccgtgcccggctgatttttatattttcagtagagacagggttcactattttggccagactggtctcagactcctggcctcaagtgatccgcctgccttggcatcctgaagtgctgagattacaggcatgagacactgcggtcggcccatatggtaattatatttttaatttttgtggaacagccatactgttttcaacagctattgtaaaattttgcagtcccaccaacagtgcacaggagtcccaatttctccatgtccttgccaatacttgttattttcttttttgataagggttatcataataggtgtgaggtggtatctcatagttttgatatgcattttcctattagcgatgttgaccatctttttgtgtgtttattggtaatttgcatattttttggagaaatgtctactcaagtcctttgttcattttgaactgggttgtttctctttttgctattgagttttaagagttatctatatatgctgggtatcaatcccttatcagatatatgatttgcagatattttctcccattctatgagctgcttgtttttactctaatgatgttgtcttttgaggcaaaattttttaattcacgaaattcaatttgtgtatttttgactttgttgcctgtgcctttggtgtcatgtccaaaatatcattgccaaatccaatgccataaagttttgcccagtgctttctgctaggattttcatagttttcagtcaaacatttaggttagaactttcaatactatgttgaatagaagtgagaacagtatgcatccttacctcattctcaatctcagaggaaaagctttccatttttcatgatttgagtatcatgtttgctgtgggtttctcatatatggcttttattatatagtttcctactatttttagtttgttacattttttatcacaaaagggtgttaaatcttgtcaaatacattttgtgtatcaattgagatgatcatgtgaattctttcctcttcattgtgctaatgatcccttcattctgttacattgattgatgtgcatatgtttaaccatctttgcattctaggaataaatttcactcagtcatggtgtataatccttttaaaatgttgctgaattttttttgctagtatctgttaagggcttttgcttaaaagttcataaggggctgggtgtggtggctcatgcctgtaatcccagcactttgggaggccgagacaggcggatcacgaggtcaggagatcaagaacatcctggctaacacggtgaaaccctgtccatactaaaaatacaaaaaattagccgggcacggtggcgggcacctgtagtcccagctactcgggaggctgaggcaggagaatggcgtgaacctgggaggcagagcttgtagtgagctgagatcatgccactgcactccagactgggcaacagagcgagactctgtctcaaaaaaaaaaaatgttcataaaggatattagtctgaggttattttcttgtagtgtctttgtctgattttagtatcagagtaatgctggcctcatagaataagtcaaaaagtattccctctcattttattttttggaaaagtttaagaaggattggtgttggtttctctttaaatattgggtagaattcactagcactagtaaagccattgatctaggacttttctttgttgagagatttttgattattgactcaatcgccttaatagttataggtctactcagattttgtatttctccatgatttgtcttgataggttttctgtttctaagaatttatacattttcgtttaggttatacaatttgttggcatataattgttcatagtactcttataatcttttttatttacattgaattgctagtaatatgtccactttgattttagagatttgagtatcctctcttttctgattacttcatctagctaaaatttgttgatttggtggttttgtcaaagaactaacttttggtttcactgattttctctattatttttctcttctgtatcctgtttatctctgctgtaatcttcattatttcctactttgtctagctttgcatttagttagttctttttctagtgcctcaagttgtaaatgttaggttgttgatttaagatctttatttttaacataagcatttatagttataaatttcatgtctaatactgctttacataccgtttttcccaccttggctcccacaagctctttgcaagttgctccaggaacacatgtacggctcactgtcatgtggctgagataggtaattactactgtactcatctgaaattgactaaaattaaccacaatttaccatccaagtctttctttgtaagttgcaagccttcagtagactccagagtcccaaaataattacatcgaacagcttctgctagtgcaattgttgtctaagtaggtagagagattcctggtactccctactcttccatcttcccagaatcctctccttttttaaacctcagtcttgccacaatattttatgtagtaagtggaaaaatcactgcaaccactaaaaacaataaaaaagttctcttatgctattaaaataaataaatattgaaggatatatgtttagagcagtaggtgtgaacagggctagacatgtacacctttccaccactgatgctgcttctagtgtagaattaatgctttcactagagaagagaatcagtatcaatggatctgaagagattcaggagggcatcttttcccatctttgggcattttctccggtctatagttggaaaggtttaaaatggcaatagattctcctcatgtttaattgaacattgcccttgctatgtgttaaggcatcttctctgagcttcctatctaatgacttgtcaaccttgactcctccattccatactgcacatttttggctgagattcagttctcttccttagcacctatatatttcctgtcaggtttgctagacttgattagaattaattatttatttggaagaaattggtgtttattatttagcaaatatatttcagaatgccttagcctcatctatcaatgcctcctttttctttagcttgtgaaaaaagcagtaagggctttacccaagttatttattaggccaaccctgtgaagagaaatcaaactggttatgacttgtttttgcttttagttttactgagaaagactccttgaactaaaagcttgatgcaacagctaatgggaaattttttctctagctctctctttgttattgtgtaaaatagtcacacagttgtgtgtacggcatatattcaatcagagattaaagcctccactcacatatggtatcttcaaatctgttttagtgagatttaatacaaaaaattacactgcaggtaattctaatacaattgttatctgcctacgtttataacccctgccatgccgtttttggacaaaaataatgaaatttcacagaggattaattttctatatctgttttttctttaattacccaatatggctatgtgaaagaagggtgaaaaaaatctttaaaaactggattctattctgttgtttttgttgaatctaatgcagctgtgattttcctcttccagatttttcagactgaagactttccactgatattggtattttatttccccaggtgaaacataggtaatgagatgctgctgcccattttggagaagaatgtgttggaaagctgttaggattaaataccaatttgcaatttgttgggttaaatagtccagtattactttaaagtcaccatcacataaataaaaacagcccaaagtgattaaaagtgggaaatatgtagcattgttaatctactcactgtgtctgaaaagtactagtggctaatttgtttatgatctgggtgtgtatgtatgtatatgtgttcatatttataaaatgaaacaaagaccaggaaagtctattgtctgatagaaatagcataaaaacaggaaaagcttttgtccctggagttattggtaacccttcttctagtctactttcagactgtttttctcaaacagttgtagtgttgagaggggggtgcacagcagacaataggatattacccccgcttcctctgcacctgtaaaagtagactactataagtttccatctcaaccaatcttcctttttgacagtttccaagcttatttctactgtcataacacaatcatgtacacaagagacctctaaacatagtggatattgctagacaatctttattcaattatgagctaaaatataagtggctagaaccatacacatgtgctcatataaaaatgtgttttgtgcacatgaaaaaatgctcatcatcactggccatcagagaaatgcaaatcaaaaccgcaatgagataccatctcacaccacttagaatggcaatcattaaaaagtcaggaaacaacaggtgctggagcgcatgtggagaaataggaacacttttacactattggtgggactgcaaactagttcaaccattgtggaagtcagtgtggcgattcctcagggatctagaactagaaataccatttgacccagccatcccattactgggtatatacccaaaggactataaatcatgctgctataaagacacatgcacacgtatgtttaatgcggcattattcacaatagcaaaaacttggaaccaacccaaatgtccaacaatgatagactggattaagaaaatgtggcacatatacaccatggaatactatgcagccataaaaaatgatgagttcatgtcctttgtagggacttggatgaaattggaaatcatcattctcagtaaactatcgcaagaacaaaaaaccaaacaccgcatattctcactcataggtgggaattgaacaatgagatcacatggacacaggaaagggaatatcacactctggggactgttgtggggtggggggaagggggagggatagcattgggagatatacctaatgctagttgacgagttagtgggtgcagcacaccagcatggcacatgtatacatatgtaactaacctgcacaatgtgcacatgtaccctaaaacttaaagtataataaaaaataataataataaaaaaagtgttttttgtttgtttttggttttaaacaaggttttgctgatttcagattttgcttcacattcttgcctgtaggaggaatttccaatgtgtgttttattaggcaattaatctcatgctttctagttattgtgatagaatttttgtagtggctataattttctttctttttttctttatacaccactacaaaatatccttcatctagtcaacacttaactgtggtctatgatgtgtgaccgaatctgttggtaaagttatctattcatgcaagaaatcagtgcatacagatttgggagataattagtttgtactccacaatctcagctattttttccttgaagaaactctaggtattattcttagaccatttaggttgcaagtcttttggtcacttttttttttttaacagcaattgccaccactaagtattactatcatcacatttttttgtagatacctactagacgtcagacactgctctagatgctagctaaacatatgtggcctccttaatttttttgaagatgatatcagtcctgttttacatatgaggaaatcatagtcatgtgcatagtggaaataggaaaactactgatgtcagacagttttggactcactctcttctgctttggagctgtattatgattgtgccagtcattggatctctttgagtctcaatggtgtatcagataaacatgtttgatttcaggtgatcatgatgaaaaaagcaaatgaaaacaaaagcaaaatgtaaaaaactacattaacacaaagccgaaacgggtaaccaaactttaaggtctttgcttcctctggttgcatatattgttattaaagttactcaactagaggaactttaacttcagatttttttttccttgaattgtaatagaacaaccattctcactgatatgctgaggcttttaaccaatcaaggaatgaattttatttgtgcactatgcactatgcacataactacgatttgctcatatgtaaaatagggctgtttttatatatgcatttaaattttaagctcctaaaatataattttgcccccattttaaagatttctggacattatgatagaatctgtgattaatcaagggttttgctcatttcactttgaatcattgtcttattgaagaaaacctaagaattaactggattgaggttgatttcaagtcattgtgtctttggtcattcttccttttcaaacgaagttctttagttttttggtttttgtattttgtttttactaatacctttaaatcaagacatgtaactgacactaatttagaaataattttttaaaggacactatggagtatacaagggaattttaaaccttagctatgaaaagacaatttacatatccagtctttaatggttaatggaaaacattagtccagatgtaaaatacttcttagcaagattttaaagccttcatttggcccagtgtatgagaaatctttgacgctttctctgggcagaaatgtatatagtaaaatatcacctctgtttgcccacagaggcaaccttctggggttacagcatcctaacctaatttgaatggtctctgtgatatcctgtgtccacaaaggaagagctgtgtattgatgtctgaccaatagctcatactactctagaatcttcccttttcatcttctgttttcagatgatcatcataatccagggggaacattgttttatgcttaggggacctttttcttctgaaaacttcaaggtgaaactatcattaaacccaagtggcagtcattatttgtccaaaactcaagtgaatatatgaattgtgactaaatggctaagggcttagtcactaacagaattctaaacctgaattctgaacctatgcattgtcatatagactgcagggacagattttatattagggaggttcagtaagggagatattctctaattgtggttagggtttattcatttaaaaatactcagcacacatttattgaatgcctaccatgtgaaatgtaggccctgagtccagtcattcccttggaactgctctgggaaaaaagaagtattttcagaggagatgctaagcccacagtcgttttcaagttctcaacagctaagactttagaagtgtggtttcacactaaaattttccaactggaattaaatgctggaaaagacttgagagtcaaagacatagctaattccacaccctacagtcagatacagaacacttaattagaaaagactttactgaaaacacaattctctctagtgtaaagtgtcttaaggggaatattcacaatttttttatagaggtccaaacccatggttgttagaaattgctgtcctcctgtttccttgaattttagagataatatttttctttccctttttgaactgtttatctcctggtatttcttcattatataatgcttactctattccattatcatttccatggaactgtggtttggatgttgatacctgaacaatttattttgttgtttgagacagaatctcactgtcactcaagctggagtgctgtggagtgattgaggtccactgcaatctccacatccttgtgctcaggcgatccttctaccttaggttcctgagtagctggtactacaggtgcatgccaccatgccccgccaagttttgtattttttgtagagatgaggtttcaccatatttcccaggatggacaatttctaaagagttggccaacctcttccctgcctgaaaggcaacttgataatcatctcagactcactagaatgtctgcaatttatattacatataaattaagagtaagtacatttttgaggtaaaatataaggctgagaaagccacatttaaataaccccaggtgaacatctctctttagttatcagtttttaaaattattcccttattaaaatctgaggtaaatgaaggcacgaagggtctctgccactttgatcattaattatctgcttttcttccccagataatgaaagataatcttttgccttttggttttctttcatttgtatattaaagaatgctttgcctgaatacctttgacacattgcatttcatatcctgcttagccttttgtgatccagagagcttggcttttcttccttagaaggcccatttacttagagacaaatgatatgaaataatcagcaaaaatggccttgggtgataaacatgtgcctatgctgttcatcttcatgcccttcaactcagtgcaaattaattttctatccattaattaaatcattagctccttatgggcagagagtacatctgtctctttttcttcctctctctctcccttctctgtctccttttccttggtgcctagcagagtgcaatatacatcgtgagcacattgagaaaagggtactggcatactttggagaaatagtaatataataataataaaaccttccattctcttttctagtttcctaatctaaactctgtatctttctatcaatcattcttatggtccccctcagctcccttcttttcaattgtattcttcccctaagaaaatgaacaaaccaatgtcaattttcacgtggcaatctcatgcatttccatggctttatttactatgcatgcaggtgacagccagatcattccatcaatcacagaggtaaattcccatgagtccccaagatgcctcgatttattatccttggactattccctttgagagatttatcagagaaagggtatttcagagaaacctaaaaatccttgcattgaggttcactcaatcattcagacagtctaaggaatcatatttgtgaaggcttttgatgcatagaataatgcatagagagaaataaaactcacactggacttacactagtgagaaggccatgattatagtgattaaaaatgcagtgattcagattcagtctaggttcaaatcacagctcactgattactgactgcgtgtgggagccagtttctgaatctcatatgaaacaaaacaaacaaacaaacaaaaagaataccaacctcataggtctgctaagaatttcaaatgagatgatatttataaggaagaaacctcgagaagtatctggaacatgctgcatcttcctaaaactgtaactatagttattcttaaaggttgcaaaatggttaatttcattatgaggagatttggtatcacagttccagaggtacttttagttaagtcatattttaaaaaaatacccctactgaacatggtggggagcacatattatcagatatcagtggttccattttgccacctccagcattatcgaggagttggggaatgttcaaattgcactttaactctctcaggattaagaaaaaaatatataacctgaatgataggctataggttaattagttcaaaagccaacggagtacttgattttaagttcaacttgaaaatttaaatttatttctcagttcagtggactagtaatgttaatagctaatattaattgagcgactccttatgctaggcacttgatttcctagcctagatatttcttcatttagaagagatttcttagagtccctgggacaatgatctttgggtaggcaataactatcatgctttctcctcaaattaaaattcaaatcaagctctcctttgactttgggtatgccaacacctggcagctacattgacatccatgtctcagcaggccatttataactctctaattttcccatctctctgatggctgtattttcatgagttcctcaccaatgtgtaaagcctttaaagtttagtggatgtgcatagtcagatgagaattttcagggaccagctgtgctactgtgatggtcatttgcaccaccactgggacatttcttcttgtccaatttttatctatgtgatgacaaagcagaggaaatattggatagttaaaactgttaacacagaatgatatagctgaaaagcttataaatagagtaacaggctgcacaggactaaaagcaataatttcatcatgggaaagttgcctaaaggtcttatttcacattctgatgatgtagcagatctagacaccagcattttagagtaatacctgaactgccaaacattaaccagaaatcattgtccatgatacaggtagcaatctatcatcgtaaatgtcactatagggaagacctaaaagccaaataaaacaaaaaaagacgagacacagagctcatccaactgaactttgctctccagaggaatggtaaattcagattataattgggtgacttctgctttttacaagttctcaaaaacttctctggccctgggtggtggtgttacggccctgcatgattacatatcacatcccattacaacacaagcagtctttggatgacataaaagttttgcaacttttaaatcatggcccatgtttttcaaaagataagctcaacatgataaaatttcaaagtagcaccaataatagagttggattcattctcggaatcagtactaactaaataagctctctctcttgagtttattttttattttttttgcaaataatctttcaaataaaaccaaaactaatcaaagatcacaagctaaatacatgagcttccacttttgatctaatatccttatttctatcaatgatatgataaaaatgtcatattaatttttttcaaaataaaacttaaatataatgcttatctgatcaaaaagcctccaggacacttgtcccagaaataaagcctaaatcatcagcagaatgtttaattttcctaagtgacccccaacttaactttccacactttttttctaccatttccacatacctccaaaattcatacctaagtcacagccacatggatcagttgctatttctccaatgtgtcatatactttttcttctctgtatcttctgcttaaaatgactgacactcttctgcataaacaattctaaattatccttaaacctcagctcaactacaactaacagaacttgttgctttttcctctatctgtacacagtgcctatatcagacctgccacattgtgctggcttctgactgtatcacagacagcaatcaactctattttgtctttgtatctccagcactcaaaatatcatttgggaggcagtaaacaataatttattttttcttaatgaatcattcccaggactactgtgtacatcaggacatctagggcccacaattcagatagactgtgatttaaatagaaaccttgcagttgtgaagtgtacattaagaacaaccttacatagcagcgtgtcactcactcatgctaacatatttatattcttgcatgataaattttaatgttttctgcatgccctcctccatcagttgtggaatcctaacaagtcagtataagctaggttttgctgcagtaacaagtacccaatttcagtactttgatatacaaaagttaacttctcactcatactacatgtctgatacagttggcaggaaaacttcatagtccatcagggaacagagctgacagaggttccaccttgacacatgaattcataatcaccgaggcattaaaatcagaatgcagcagattatgtactagttactagagcttctatttggatgtagcacacacactcctagtcatacttcactagccaaatgtaatcaagtagccgttaacttcaaaggtgccaaaggaaatccaattttaccatgtgctataaagaaaagaaaaacatttaaaaatgtctttattgacaggtacagtcagctccttaatatctcacaatttctcctattcatactccatttaattgttttaactcttttttacttcatccttggactattgtagcagctcacttaaccttcctgccttctttttctttatcccactttgccctcagcccttctccctataaccaacaggttagccaccctaaagcgcaactctttacttctttcaagaaggtatttttaattaatacctttagtgattccccaccaactatgaaattaggccccagtttcttccttcattaaatctttccttccatttattccacaaacagcattgactacttaagagggatgaaaaaccatatgaaactctgaaagaacaaagaaaaatagttcctggacataatagacctcatcgttagataggggagttggccacaaagaaaatgagggcaagtcagtgtgatgagcttgatgctaaagtggcatagttcagtggtaacatcaaggagaaaatgactttgatgggagatcagtgaaggcatctctgaggaggagatgtttaaggtagttctgggattttgaacacatgttttccaagcaaatatagttggagatagaagaatggaggatggatgaggaacatggaggcataaaagttaggtatgttgcaagaaataccaatgtttctataagctggaattgaggttagtgtggtggtgggataggaagagttctgaggggatagaaagtacaactgaaaagagagattgagacaaattaagaaacagagaaggcttaaatgttaatattaaggagtctggctttttgtcctttgggaaatgtgtaattattgaatagtgagcctgagaagaagaagacttggtgtggaaacattggccacattcaagtatgttaagtgctgtcattcatgaggacaaatctagttttagtagctccagattgcaaactgtggaaattataaaaagtaccagatttcaagtcagctggagaaagaacgacttgaggtgcatttcattgttgtatgaaatttccagtaaaatgttggatattttgcattttataaatgttttttaaatgagtgaaataagttataagcattagattgatttggcaaaaaaatgtgtaaagaggctgaagctttgataaaattgtaatgaaaactagaatttggaatttaagatgcatatcatggaaaagtaggatgcaaatgtcactattagtgcgtataaatcatgttggagctcaccaagctctgataaattaatacaattttcccaggtagctacctggaactacctactggtagctgttttacaaatgtaggttgctttacagtttagatctcatttcatacactcatctcactcaatcctcataatagtcttcagtgcttagaattgacaagtcaggaactcatccaagacatgttaattggcttgccaaagacagcaaaacctaaagtggaagaggtgtgacttgaactcacatttacctgtgctgtttctgatatttatacccattacccaaaagctacaggaaaaccttgatttcagttccaggaacttacatttgaattaaaatttactgccgaaactagctcagtgcttttcaggatgatcataatgcagatactaactaatgatttgctaacaatggaggtagacataatctgatgggattgatcaaatgtggctccggttgccccagaagtaatttccatagactacacagagaacctaattatgtaaatcactcgagagatccccaactgaccttcttgacaagaactaaccagcagtgatcagtgggaagaaaaataaaattgaaacctggatcatttcctcagacaaatctagagttgattacaccaccatttgaatttggatgctgcagctctgactgggagctataacatgttgattcaaactctctaaatgggctgatgtatagatttaccaggaagtaaactaaaaagagacctgtttctgtatgacctacttttatgtttattaaaatttgaaatgttttttaaagtgttgataaacttcaactggcaaggaaaaaaaaagtcaccctgtattttctaatcaaggaggattaaaaggctgtgaaactatatccaatgcacaaatgttgtaattgcaataaatatttgtcctttctgttttctctacaaactcaaaaatcctagagtctgtgtttggcacattcgggagattacagccatctgctgggagacaaagctgtcaattacaaagcaatctggctttctgttccattccatttccaggttaaatatggcccaattgaggtaggatctttttattattattattacaattggaagcttcttggtactgtccaacctttgaccctattctcaggatcccaagagagatttacatgtctctgaacttggagtttgcaacacaaggtcaaccatgtcttatacaagccgtttaataaggtaaaccactcttaggcagggctctgagctcgttagccaacttgaacacaagatgagggtttcattcaattaaagtgtgctttagcctgaggaggaaaatcatagcaaatagaaactaataaatagagacaggggtatcttctgtttgctggggtgatgagcatttaaaacagaggctttaaggattgaaaacagtacaaaaatgctccatgaaacatggaaattaatagccaatttaataatgtaagattcggcaacattgaggagggacagttcaaaaccacagcagaaatattttaatagaagaggcagttggccctaaaactgcggacactaaagacctaatggaagtgaattagcctttctttcggccagattccaagcctgaaaattcaccctgtttcctttaattcttcctgcagttttactggaaacagttaccttgtgttttgtcctaaaacagttaaattgcctttcaacagacttttcagaaaatcttgtgttcctcagcaggagtggaaacaagaattggcttttaagcagacatgtaaaagtagagaagaaaatttttctcatctagatctgtgcttgggtcaagcctgagggcacctctaaggagtcattgaaagctaataattaagaatctgtttatatagcactaatcacatgattatctggaagaattctccagcaagaccattagtgaccagagggaagtgaaaatgatcctttaaattttcccaagtgcacctgattcctcacctcaattcaattcacacccatatcttgcatttcaaaatagtgacctaatcttggtccataattttacccactgactcttgcaatcaagggggataaaagactattttacaggtgaagagcccactggaacctaattgaaaaattgctaatacttctcagttaaatattaacatacttatgtaaaaggattcagtttaaaggaaattgggtaataattaagggcatctggctctagctcatggatgcagctttggcctctgggttcagtaagaaggttaggttggatttcaaagtcatcctcaactttccagctgaccatattctcccatatggtgaccacttaccatcacaggatccctaaagccgttatttcatttgctgttcttctctctggcttctcttacccagccatcaatatttatgtgtcccaggtctgcttctgtcaactgggttaaatgttaatctcatagtgaggatcagctgactaatcttactgtccagcacaccagttcttagcttcagtgtcatattatactgctaggtcataagcaactgtgaggtttgtcacaatcaacttgacacctttacagagattcctctggtaaagggctttcaacttcagtgctttcatagatataaatgaagcttcactgcaaaagtatattaacatttttgtctccaacaaatgggatcagtgatcctgcagataagtgttaagaaagatcaggatttgccatcccaacatttgctactttggcacaagtattattctgaactgaaggcaattgagaatcaacagatgcaggaagagttctctgccctccccttatctacctaaaaacagggcatacatttccctttgtgaaggtacccccatcttaccagaaagtgaagaccaactcttatcattggagatggaacatttatgcagagatgagtttctataaacaaactgaactaaaataacccttatctttcattagttccacaagatatttcctagttactttcccatgacttattgtcctttgaagcccaaatctcctttcctttgttaaagtggtatataacccctgagtttaactgcttctttgagtttcacttattttctatgactctagtatacacataaatgttaataaaaaggtatgcctttgccttttctcctgttaacatgtcttttattagtttaattcacaggcccccagttactgagcctaagaaggcagaagaaaaatctttccttcctgacaatgtccagaaattaaatttcaacattgtttgcccaagattaatataggaggaggagagaagtatatttgagactgtaaagcctacatacagtaaagttactgttgctgaaaatttttctcagagctatgaattatagttcagactcaaggctatttgcacatcataaaggcgaatgtcaaggaagagaatgatgataaccaacgaagtttgtagaggacatgaattccctgtgtggcacccactgcttaataacctacaatatctattatctttttctttctttttttttttttttttgagacggagtctcactctgtcgcccagcctggagtgcagtggcgcgatctcggctcactgcaagctctgcctcccgggttcacgccattctcctgcctcagcctcctgagtagctgggactacaagtgtctgccaccctgcctggctaattttttgtatttttagtagagacgtggtttcaccatgttagccaggatgttctcgatctcctgacctcgtgatccacctgcctcggcctcccaaagtgctgggattacaggtgtgagccaccgcacctggcccagctctattatctttttcttattcataactattaattccttatcaggtcttgttttattcaggaccccagtgtttaactgtttaggccagttaaaataattttccccctcagactcccttgcaactaagaaattatgtggctttgttgtcactaaggaggggaggcttccaggcagggaatgagaatgctactgttttcctgtcaaaaaggaataaattcagccagcatgaacatcttgctgtttattcttctcttattttttctgctagaatcaagacaaaatgtctggagtctagcagccattttacaatcatgaagttaaaaggtacaagctaagggtggtggaccagcaggtagaaggaatctagttctttgatgacttcctagagccactgcaccaattttggactgccacctctggaattcttgttatataagaaaaatctttatttgcttcagctcttgtcagggtttctattgcatgccaccatcacaattccaagtgacacacactgctattgatgacatatgtttgttttggtgagaaaagggcttaaaaggtctgattttaaagctgaaggatcagattttaaatctgcaggatcagctcacatttctcttcaggaacacgtactggatgaaacaagttaattttttcctttgtagctatggatttataaaaataaaagaagaaagaagaaggcttacatagagacattttggctatttattttctttgtcaaagagctaagattaggaaattatttctctctatatcaattaacactcactgaagaatatttcctataataatgccttcctccctccctccattgtccgtggaagtttgccagttacaatagaagggtggagctccaagtaacaacttggaattgggcacagtcatgaacacaccttggaagtctatctggtttgagaatatccttgggcatatttgcacagggaaatagttttaaactgctggaaataataaagtcagctggtattagttctctgaattgacacacttcaatttttataatctatctttaaaatgcaaaatcttgatccagcaaagtgctgtgggggaagaagaaggtgaatatttgggggaattgcaacttttcagtattcttcaacattttctctacctccatggctaagctcttctagcatatgaatgctacatggagtctatgctggtggaaaagctaaaggaggaaaaagatgtgaccttctttacagtactttgattatgcatccttaagctctcctcagtaggtctgcttgcacagtagtcattccttagaaatcctgccatcaggtagagattctatcatcagttttgtgacttggaaaattccattgctgcctcactgtcactggcaggaaccacactcatcaatcagcatcacttccccaaagctctgtttgcaatcaaaaggaccaaaggtctccttgtttataattatgccagggaaacaccccgctagaactagatccacatgggatcaccagcatcacacatcctcaccccaacacccagctcataaagaatacacactcttctgttgcctagagagagcttagcaagctgcttaatagctacacagaaaccctacacagaactgaaatgcaaaggcatgtaacggatctgatagaatggcaggggaaatttcagatggcagaatgtaattacctaagttactgaggttaaataaacaccacactctcttatctaaaagatgtccacgatcttcagtatccataaatgacctggatcttagttttataactccatggttgagagggaggcaattctccagcagcacaggagcctttcgcttggaaactcttgtttctcatccggcaccacctgtgtgtccccttggctgccccccagccaggtgctcatgcagccaaacccagtgagcccataaaagtggccagagatgcagcagaaggtgtcgggctttctggcccctggttgaggccatctggactctccgttacacctgtttgggagggtttccgtggcatgatttacaaatgtaaatgcaactctggaaatattcctgtccagtgcgtatctcttgctttcacttttggaggagttaattatgcaacaagatcatttctatgcccattttcctcttccattataaactttagatggtgaaaaatgtgcttctcagtatttttttagtgaatgaacagatgtaaaagtgctttcaattccttaataaatgtgacattaggccagatttgatattacactaagtctcacataacatttaaaaatgggttttttcaaccataaaattactaattgatctgtcttgtaaaaagataaaggaaatgaatgcctatttgagtttcatttctgtcaggctcccgatttcttattttatgtagcagaaaatgaattttaatgaagcagcctccaaatttcaaaatatgccattacccttccgaagtaattggcatatttgactgcctttgcctttcttagagtctgtctgacattctaatcttgaagtcaatgttccattcaagatgttcttctgcataccatctgaaagaagtaaattagaacaaggggaagaactacaacagaaagcactcattcatttaggcattcaagaacttatatatggaatccccattgtatatcaggcactgtttcagatgctacagaagacagtagagggcaagatagtgaaaaatccctgctctcatgaagtttctattttagtagagtgggataatacaaaaacatagacaaatactgtatgcaacatccaagtgataatcaatgctataaggaaaaatagtgcactttaatgggtagggaagggcagaagagaggaccgttgtatataattttttatagagggaagcccacacagacttctctagggagatgatggttgagcagaaacctgaatgaagtgagagaatgacccatactgggaaagaaaatcaacagatagaataatctttcttctatattttttgcccacttggtatgtataaggagaaaaaaaatggcttttttcaaagcaagtctagttattttgtctaatctgggaggatactgagtgggtgaaggaggaaggcaactttgattgagtacctacctatcatgccagaatatgcatcatttatgcttttcataaatgtgtgtgacaactctctgaggctgatgatctgagcctaattttacaactggggaagcagaagcttaggggcaggtagcttggtagtagaatgtttcttcttttcttgttcttcttcttgttcttcttgttcttgttcttcttcttcttcttcttcttcttcttcttcttcttcttcttcttcttcttcttcttctttcttcttcttcttcttcttcttcttcttcttcttcttcttcttcttctttcttcttctttcttcttctttccttcttcttcttacatttatatagagacagggtttcactatgttgtccagatggtctcgaactcctggccccaagggatcctcctacctcagcttcccaaagttctgagattacagccttgagccaccatgcctggcctatttattttatttgtataaatttaagggattcaagtgcagttttgttacatggatatattgtgtatggtgaagtttgcactttcagtgtaaccatcaccaaaagaatgtacattgactacttttaagtaatttttcatccctcaactctccacccttctgagactctgatgtctattattccacactctatgtctatgtgtatacattatttagctcccacttgtgagtgagaacaagtggtatttgattttctgtttctgaggcgtttcacttatgataacagcctccagttccatccatgttgctgcaaaagacatgatttgttcttttttatggctgaatagtattccatggtgtgtgtgtgtgtgtgtgtgcatatacacctatacatacatacatatatatcttcatatatatatacacatacactattgtgaatagttgttgctacattacaaacttctaaattctatggcttaaaataagagcaattgcttgtttttcttatgaacatgaattgtgggcaataattaatagaaagggctgaatctgctccatgtggcaccagttgagagcacaccttgaggctgggtgatcaattcccaagacagctccctccatggctggcaagttagtgctggttatttgctgatagatcagctgggcttgaaggcctgtaggcctttatttctctctatgctgattggacttcctcatagcatggtgactgggattctagggcaagtgttctaagaaagagaacaaggcagaggagtattgcatttatgatacacttgcagtcttggaagtctcatcaacccagctctgcatctcactagtgatgaactttcagcaaattgacagcactggaacccttcacaaggacattttttcccaaataacaggctttgtctgttttcatccatttagtcagcaggcatttttgagtaattctagcacaattgtttgaaatacctgctgtgaagtccaattgctcaaatttgcattccaattctgccactcacttcctgaaaaaacttctgatttttacctaaactctgtgcctctattttattaaatgcaaaacatgaggatttaaggaaattctagagaacttctcatgcacctaataaggctacccctataattctagcacttcagctccatcacctaaaataatcaatctcaaggaaggagctaaaattagaatgatggcccttcttctccaaaaagactctcatgtcttatatttccacaagaggaccaagacacacatgatatctttcttcacaaacactactattttcctatggttctgtatacacctgaatctaactcaagctcttactcttcctgatccactaatcccctcgactttgcccttggaaattcataatctatcatcagaaaaaaaaaaacctactctctaagtagtcccctcaccttctttctgtaagggaaagtgagtggtttcctaaagttctcttctatgatagttatttctttaccaccacaatcctgtgtagcctagggctttttggtgggatggataccctttttgttctttgttaccaggtctacattatttcttctttctacatccccaaatctaatgtcctttgaagcaaatgccatcaggctatactgcctacaatcctttcttcacaaagtcatccatcaatgcccctgaccatttctcaccctttacccaagactttagcacctggctcattcactagatttctctctaccagtattcctgtcaccatgttatgtgtctttatcacacatgtagatgatccatccaccatcttggcctctaacaataattcatgacttcattttttcaggctgctgtaacaaaaatcccatagcctgtgtggcttaaacagcaaacatttatttcttacagttctggaggatgggaagtccaagttcaaggcatcagcagattcagtatctgttgagggcccacttcctggttcttagatggccttcttcttactgtgcccttacatgatggaggggtaaggatattctctggggtctcttttataagaataccaatcaaattcatggtgactctatcctaatgacctaattacttcccaaagaacctacctcctaataacttcacattgggggttaggattttaacctgcacatttttggtggggaggggacaaacattcagtcctacacaattcctctttcaacaatctcatcttttatcccatctcaaccacctactcttatagccatgccatatcctagatgtcatatctttccagcttatgtcttttacaacctggattccaattattctccaaccaatcaagtgttttaatccactttttcttattacctctctcatgttacttacttacacagagctaagtaggatcacatgtccattattaataatcacccttcacatactatctcaacaacttgaccttcactacgtgtatattagttttatattgctgctgagacaaattgccatgaatttattattttaaaagaacactcatttgttatatcacagttctataggtcagaaatctggagggctcttatctgaaggctctagggacttacaagctccttcaaattgttggtgaatctagtttctcaaggttgtagcactgagatttctatttcctttcttgctagctgctggctggaggccatccatagccactttatgtctctctctagtcctttcatgtgggccactacatttcagaggcaacaaggtacatcaaaacgttctcacagtttgaatttctttgatcttaccttttgactcatctctctgcttttaatggctcatgttaattatattggatccatccggctaatgcaggataatctcccatcttaaattcagctgattaataaccttaattattcttcaaagtccattcacagcaggacctggagttgtgtctgaataatgtaggggatggaaatcctgaaagggcatctttagaattctgtcaccaccacccatgtaatttttacctgacaaactccaccttgatttaaacctgactcttcacccctccgcaactgctccatagcacctcagtgtagctgaagaaaaatacaacgtactaacaaggctcattctaaatttgtgatgggaaatctcaaggaggcctcagcacagcccagcaatcattttacatttccctaaacaattcctgtttccactctcccagacaacattttgtacatttttcttctactcaaaactctaaccatcttcctaacactccatgttcagaagatgacctcaactcttatttcactggagtggagatttgaagagattagaagaaaactaccacatttcctcatcaccaaatctagtaatctgcctgcatttttatgcatatattcagccttgctgctcctgtttaactctccttgctgttatcctcttatttaatgacaacctcccatgaaggtactctatctctttctctcttgactgttcaattatctttctattacaattactctttctccccaggattctttttctctctctactgctttgctgctataaccatacaaaatatttcctaagaaagaaagaaaggaagaaagagagaaaggaaggaaggaaggaaggagaaagaaagaaagaaagaaagaaagaaagaaagaaagaaagaaagaagaaagagaaagaaataagaaagaaagaaagaaagaaagaaagaaaaaagagaaagaaagaaggaaagaaagaaagaaagaaagaaagaaagaaagaaagaaagaaagaaagaaagaaagaaagaaagttagttcttccctggactttgttttagtaaggggttctatggcttttagatgtaacgcaatgtattttggcccttttatcttacattgtgctagacgccttacctcttaccttagactgtgctggaatttgcctggtaatgcataacaatcttaggaagagtccaaacattcaatgttcaatattttaaaaatagtaacttagtgaaaagctgaaattaatagttttctaattggctttttggggtttctatatcaactggtagttaggacacatttcttcttctgcactcccattagactgcctctgcccttaagtcccatgaaatcctgaagcactgccccatttctctgctcatctttatagcaaaactccccagaaaattgtctgtactttctaccttgatatggtttgactctgtgtccccagccaaatctcatcgtgaattatactcccctaaatcccacctgttgtgggagggatgcgatgggagataatgtgaatcatgggggtggttcccccatactgttcttgtggtagtgaacaagtctcatgaatctgatggttttatcaggggtttccgattttgcatccttctcattttcttttgttgctgccatgtaagaagtgcctttcacctcctgccatgattctgaggcctctccagccatgtggaactgtaagtccaattcaacctctttttcttcccagtctcaggtatggctttatcagcagcatgaaaacagactaatgcatacttcttcttccttaatggttatcttcttttaaacccatccttgtcagtcttgtccttagcgtttactgatattccacttctgaaggtcaccatgaacctccagtatgctaaatctaatgaacaattcccagttatcagcagcatctgacacagttgatagatcccctgttctaaaaacaccttctttattcatctcctggtgattatagtttcctgggttttcttccccctccatgacagttcattttcagttttcttttcttgattatccttattctttctgagctctaaatattggacttcctcagggctcagccctgagcccttttctattttctagctacactctctctataattgaaattagttccattgttttaaacatcttctatatgttgatgactcccagttttacatttctagcactaacctctcctctgagcattaaatttatttaccaattgcctcctcaacaccaccacttggttgactaataaagttctcaaaattggcatgtctaaaataaaattcatgcttttctctacctcttctcttcctccctttgcactcccattcatttttctgactttctcatcttgttcagtgttacacaaccactcatcttgttgctcagatgaaaactgtattagccagggttttccagagaagcagaatcgataatatgtgtctacatctagaaagagggatttattttcggaaattaactttcataattatgagaattggcaagtctaaaatctgcagggaaggttgacaggttagaaacttagggaagagttcatgttctagcttgaatccaaacaagatctagaggcagaattccttcttcctcaaggcatcccagttattttcttaaggccttcaacctgactggacaaggcccacccacattatggagtaatgtggtaatctgctttactcaaactctactgatttaaatgttaatcacatgttaaaaaatacattcatgacatctaaactggtctttgaaaaactaggtatcatggcatagcgaagttgacacataaaattaaccatcacagcctacttcttttcacctcagcacccacatctatttccagacttaatctcaaaagaaagacaataataaggtcatacttctgacctaacatgttctgcctaacatgatacaactctcttgtgtacaaccaaaaatgctgtgttagtcagttcatgctgctataacaaagtgccatagactgggtggcttataaacaacaaaaacttatttctaaactgctctggctgttcaaagtcccagatcagaatatcagcacaatcgagcccttatgaaggcacacttggaggttgtgcactgccggcttctccttgtatccttatatggtgagaagagagctagagagctctcataaggacactaattccacctcccaatgccatcacattgggggttaggattttaacatatgaatttgtgatggggaaaacaaaaacattcaatcataataaatgtcccaatgctttttctagaagatgcaaagctcttagctgatgttcactgaacataatatcctataattaaatactataatgcaatgttgatacatatacaacaaagatatttgctatatgcgtatacacacatatatacatatacaaacattcataacaaaataaggaatatttatataataattacagtcctcatgttaataactggtcacatgcttatagcaggtatttataagcttttttccactatgaattttgtattttctttgctttcagtgagaacctcagctagtcatgattctttacctaggaggtgacccaaaacttattcctgaaggatctggaccattcatagccctgtctcaattgggttgttagagtattctattgtatttagtcagagagcgtagtagtactaagagatgctctaggaaatcttccatatttcaaacacacacttccttctctccattttagagcagtctaaatttctcatggtgatcaggatcaatcatcctagctagcagaacagctccctcctttgcctgttcattcaaaggtataaagctaaaagtggctgaggggcaatctttccttcaagttatcattgttgtagttctagttggaccacagtgacatttgagacctcctagatgtagtatctattcaaagtcagtccagtaatcccccaaaagtctgattatttcctttgttgcaatgtacaatcaccttggtgaaagaccataagtttctctgaagaagactgagagaaagattaacagtataaattgttgtcagtgcagcaagatcgtttttcatagagacccagcctccccttcatttgagaggttctaagcccataaactggctcaaagtctgagagttgattaaaggagtctaaccctctgcttttgtgacttttgttcccttaacccacaattctccacttatacagattaggaacaatttagcagatttcccacctatgtcactttctagggacacaatgattaactagctaacatcatagatctctgtgagtcattttattctgattgctgctttgattctgttttccatcatggtaaccatgcttactttgcctttggtgagtaaatgccatcactttgtccctgccaccctgggacctagttatcctcattgcatttaggtttaccaatccagtggcagcaattaccactgtaatttctgacccacagagaagagctatcacaagctcttcaaggatgcattgctcccctcgcaaattcatttctcactgttatggtgaaagctgtcctctggacccttcccagtgggtgagaagatcgtaagtgataaatccacttgaatattccaatttttctaaggctttaaatacctttttctatagtataccaaggcagttatggtatttcaattcgtttagtgtatgtcaccttttggtccatgtttcagccaaccaaacaaacaatttgagctctttctaataccccaagctgcaacattaaatctagatttttttgcttagtgggcccatgtcagtaaattctgcctgattcaatctcccagtataatacgcccttaatactgaaactgcctttgcaaaattatgatggagagagtgaaaaaggtctaacataactgattccatcttgcttctaacctccaagctgtccttgttcactcctgggcataggttgaactaactttgggaggaactcagtttataaaacaaagacaataacagctttttcctaaaacaaacatccttcttccttagggattagactgtctttacaggactaacaaattagccacaagattagaaattatggtttaggagtcaggcagctggaggctacaaggttctgatcctccctaaaatgctgctaagatcagtgcttgagatattttgcggaccctgcacttgatggatcagctggcaccacccagattgataaactggctcatgtgatcttgtggcccccacccaggaactgactcagtacaagaggatagcttcaacttcacatgattggttgggtcaagagtgctgacccaacgaatcagcactcttgaatcactggccttcctccacccacaaaattatccttaaaaactctgatccatgaatgctcagggagactgatttgaactctggtctctcacacagccggctctgcacaaattactttttctctattgcaattcccctgtctcaataaatcagctctgtctaggcagcaggcaaggtgagcccattgggtggttacaatatccactcccacacattctctagatttctgtctgtaaatattagaaaaatcatattgttattttgtagtgtaacaacctcctcatggggcacaatttgcatctcatctttagaggcctactgagacttgagtttagttataggtctacgaaaaaaaggggttgtaagggtgggtcctgaggagaatcagcagtgttttgtaaggcagttacctcagaggtgaccattactctttcatcaggcaaagcagaggtcatcttctcagatagagatggagtggcttcttctactgacaaagcatcttcagaatgtaggagtttaatgccccccagcttcatcaggatcttcccatatgtccccattccaattttcaggaccccattcctttccaattaatgctaccactttaacagcagacaccctgtgagcttaggaattcaatttgcattgtaattcagctacttgcaaaatggcactgtgtttagttttcagcaatctcagctttttggctacaggtaacaaaactttcttccagggcattcatacaaaattttaggtcatttatgcagtgcatgagctgggaatttgaatccttgaattcatccttttatttctacactttgtttacatcaataaggagcaaccagccaatctctttgtactcatcaatttaacaaaattgttctagggtatcaaatacatggtcacttttgtctcttataagtattgattatggtcactgaaaactttgtctcttataggtgtttgattaggaatatccacagtaatattttgggtatctcaactgatatgtcacaccatgtactatctatgctctttttgcttctagaaatatcattagtgcctttaaatctagttagattagagaaccagttccagaaaccccataaccaattcagaaatctcatccttaagattctgttgctctagaacaactcttcttatccaaatttgtattagtcatgattcttcagataaatagaaccaataagatgtgtattacacacacacacacatatatatatacacacacacacatatatatgatgtatagatagatctatatatctgagagagagatttattctaaggaattggctcacttaggagggctggcaagtctgaaatctgcaaagaatgccagcaggctggagccccagaaaagaggtgattttgcagtcctaacgcagtctgcaaggagtctggaagcaggatttcttcctgggcaaaccccagtcttttctcttaagtctttcatctgtttggataaggctcacccatattattgaaaataatctgctttactaaaaatctgctgattcaaacattaaacacatctaaaaatattttcatatgaacatcttgactggagattgaccaaaagccaggtaccatggcctagccaagttgatacataaaatgaaacaacataaaaatctagaagtcatccttagtatccttcactcttaccacacatctgattcatcaactctactttcaaaatatatcttgactctgatcacttatcatgtgtgtcattcttagcttcctagtacaagctaccttcatctttacctgctgtcctaaacagtctttttgttctccttgctttcactctgccttctatcctgctggccccctgccctctgagcccactattcaggcagcaatcaaaatgatctatttaatgacctaaatctaattattctactcaacagctcaaaaacctccaatggtccccatgaaactcaaagcaaaacccaaaactttgtattattgttacaatcttatttattctggttctgcctccctcgctctgacttcatttaacatgcaccagtgttttcactcacttgctaatgtccatctgaaggtgtttttgtctctttggtctagaaaactcctagatgtttctatggctccactcagatcattgctcagaaattatttctttaaaattctttcaggattactgtatttcagctaacagtattacatactattcctttatgctaattaatttttcatagaatttattactgtcctgacttgtattatatatgtgtttggtttatgtctgccttctcaatcagaataaagcctccaaaaggacaaggacttatttcctaccaaaccccagggcactagtactaggtctaaggcacagtcatgcacaatcatatttgtcaagtgaatgagtgggaataataatactttagagtgagtattcacggggttgttgagaagattcaatgtcataatgcatgaatgttaaagacttctaattgctttgtaatgtcaattctcacttccttccttactaatataatctccaatttgtatgtgggcacatggctgcctggaatacagacttcctttcttgccctttcagttaggaatggtcttatgactgagttccagctaataaggtgcaagcagaagtgccacattcaacttctgggaagagagctttaaaataggtgggtgggggagtttgttccttttctctttccctgctgactggaattggggcatcataactggaactccagaggctctagatgaaacatgagatgaccctaacagtagaaatcaaccaagaaggatcactaggaacaaaaagcctgggtccttgctaccatggagtgatatatcatgcccagatcgacaactttgaaactttttgaatatgagggaaaaataaactactatcatactaactacctgctatttttgggttttctgttccttgcaatcatatctacttcttgcaattttaacatgtaaattgatcatgacaaatattgacttgtagtaagccctcaataaatatcattgtttgcttcatattcttataactgttttcaattttttctatttctatcttttcttgttaacattgtttttgttgttataggctgtgtactatgtgaagtgctagggataagaatgagaataagatagaaatttcacttaaaggacattgtggtctagggagcatacaaagaaattataatacaacgtgagatgtattttcatggcagcaataaaaccatgctgtggggacacacaggaagtacagaataagtctgccaggggataccagagacagattcattgctgaagatgtagatcttaaatcaagacttaaacatgcctagaagactatcatgaggacaaggggtggagagtgcagagggaaaagcaagggaattgactgcacataggcctccctattaggttcaggaaaaatatgaatcatacccccaacctaaaaaagaaaaaaaaagacttcattgcccctaaggaagctaaggcactccatttttctcgtctcatctgaaacttcattggaaatgtggggttgctgtgtttaaaaagtcattatttccaattctgtgaagaaagtgattggtagcttgatggggatggcattgaatctgtaaattaccttgggcagtatagccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggatttcactcatgatttggctctctgtttgtctgttgttggtgtataagaatgcttgtgatttttgtacattgattttatatcctgagactttgctaaagttgcttatcagctgaaggagattttgggctgagacaatggggttttctagatatacgatcatgtcgcctgcaaacagggacaatttgacttcctcttttcctaattgaataccctttatttccttctcctgcctaattgccctggccagaacttccaacactatgttgaataggagtggtgagagagggcatccctgtcttgtgccagttttcaagggaatgcttccagtttttgcccattcagtatgatattggctgtgggtttgtcatagatagctcttattattttgaaatacgtcccatcaatacctaatttattgagagtttttagcatgaagggtggttgaattttgtcaaagaacttttctgcatctattgagataatcatgtggtttttgtctttggttctgtttatatgctggattacactgattgatttgcatatgttgaaccagccttgcatcccagggatgaagcccacttgatcatggtggataagctttttgatgtgctactggattcgttttgccagtattttattgaggatttttgcatcaatgttcatcaaggatattggtctaaaattctcttttttggttgtgtctctgcccagctttggtatcaggatgatgctggcctcataaaatgagttagggaggattccctctttttctattgattggaatagtttcagaaggaatggtaccagttcctccttgcacctctggtagaaatcagctgtgaatccatctggtcctggactctttttggttggtaagctattgattattgccacaatttcagctcctcttattcgtctattcagagattcaacttcttcctggtttagtcttgggagagtgtatgtgtcaaggaatttatccatttcttctagattttctagtttattttcatagaggtgtttgtagtattctctgatggtagtttgtatttctgtgggatcggtggtgatatccgctctgtcattttttattgcgtctatttgattcttctctctttttttctttattagtcttgctagtggtctatcaattttgttgatcctttcaaaaaaccacctcctggattcattaattttttgaagggttttttgtgtctatttccttcagttctgctctgattttagttatttcttgccttctgctagcttttgaatgtgtttgctcttgcttttctagttcttttagttgtgatgttagggtgtcaattttggatctttcctgctttctcttgtgggcatttagtgccataagtttccctctacacactgctttgaatgcgtcccagagattctggtatgttgtgtctttgttctcgttggtttcaaagaacgtctttatttctgccttcatttcgttatgtacccagtagtcattcaggagcaggttgttcagtttccatgtagttgagcggttttgagtaagattcttaatcctgacctcagccaaaagaacaaagctggaggcatcacactacctgacttcaaactatactacaaggctacagtaaccaaaacagcatggtactggtaccaaaacagagatatagatcaatggaacagaacagagtcctcagaaataacgccgcatatctacaactatctgatctttgacaaacctgagaaaaacaagcaatggggaaaggattccctatttaataaatggtgctgggaaaactggctagccatatgtagaaagctcaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatgttcgcaacctactcatatgacaaagggctaatatccagaatctacaatgaactcaaacaaatttgcaagaaaaaaacaaacaaacccatcaaaaagtgggcgaaggacatgaacagacacttctcaaaagaagacatttatgcagccaaaaaacacatgaaaaaatgctcagcatcactggctatcagagaaatgcaaatcaaaaccacaatgagataccatctcataccacttagaatggcaatcattaaaaagtcaggaaacaacaggttctggagagcatgtggagaaataggaacacttttacactgttggtgggactgtaaactagttcaaccattgtggaagtcagtgtggcgattcctcagggatctagaactagaaataccatttgacccagccatctcattactgggtatatacccaaaggactataaatcatgctgctataaagacacatgcacacgtatgtttactgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactctcacaaggacaaaaaccaaacaccgcatgttctcactcataggtgggaattgaacaatgagaacacttggacacaggaaggggaacatcacactctggggactgttgtggggtgtggggaggggggagggatagcattaggagatatacctcatgctagatgactagttagtgggtgcagcgcaccagcatggcacatgtatacatatgtaactaacctgcacattgtgcacaggtaccctaaaacttaaagtaaaataataataaatttaaaaaaagactaatcccaaaacacattgcaactacaagaaaaaaaaaaagtcattatttctaaatagtctgattacaagaggagttgacttagaaagcaaagaggcgattactatatggaatatacataatcagaattgtccaaagaaagcacaatggcatatcctggatgtgagttttttgggagataggaacacagaaagggagagaggacatgacgggaaagtacatagacagataaaattagggaggtttcccagggaaagggaaccacttacagtacttaaggcaacaatttttgaagtcgtttctaaaaaatgaactgtaagaactccctattctattccttacattgacaggctataagctacttaggataatattcactttacttaatattcagtgcaatgctttgtataaatttcaaaatctttaccctagctgcactagatatgttatgtagtataaggcagagggcaagggaggcaacactaagcaaaataacaatagacaggttagaatttcctccttaagacatcactagtgcaacatcagcagatttgctgactcttaatttgggctctcagtattcttgacattgtccatttaactgcttggaactaaattaaccttaaattttcttctaaactttccctttacttctaacactaagtttaacatttgctcacagcttctctaatactatatttatcttgatactgtctcacattaatgatcattttaaacaaaattttttatgtatctaaaagccaagtgcatttctatgcaaacatgcctctgaaaatataatggagaactgttggaaaacatgtggcctgtaaacgttcgatctacagattttaaatttcaagaaaggctgtataataaaaacaaaataataaaatttaataaacaaaaataaacaaaaaccccacaaagctaccctatagaaattgatttctggggctgaagagaaaaggaaaaatagcacttccttaatattaatctattataatgtatccttcacctcagcttctctttgccacattataaagcagcaacgctttgcattgaccgtataattcaaatctttctttggagaaatatgcaatagttggtaattgtctgcattctgaagcatctcattttacgccccccaaatgcatgattcactttgaatgataaatatggctatgaaatggagtgtttccgacattcacagatcaaatgtaactggggaggaataattcagatgcatcctgatgttttatatttccatgcactaatatttgcttcacaccatatgtcacagtaacacaagagtgtgatcatgtagaacagcccagtggttttctcctccaacatctggtcttctgaggaagtctagcactttagagattcatgtgtaaatcccaagacaggtggtaaaaatcaaatgccttggtgacgggaagtaaaaagaaggctagaaaggctttttcctgtcatcagattggcatcaaggaatgctgtgatcatcttagtggaattaaacaaacagaaccagtagtccactggaccctctctgaaaagccacacactatgtacattcacagggcagtaaagagaaccagttgtcagcaggcgttttaatcggtggcccccctcttcaagtctgctgactcttggctctgttgaaggcatccagccctggaggcactatagcttcgtaaggagcaatggcaacatcatcttcctctggaagctggcttgaccactctccagagaagaagaccaagaccactttaggtgtactgacagcatttacaatacaagctagtctctctaatccttaaaaaaaagagaggagtggggggaataagctttcatatttcctactctcctgcaggcataaattagctagatttattctatttcctcagctcctctttattcttcaggttggtacagtgtggtttctgtccctaccacttcatagaagctacccactgagttcctaaatggctactgtgtaagctaaacttcatttacccttttctaacttcattttgcttcaccacagtgtttaacagggttgactgctctccacttcttggaacactctttttttttttttttttaactgagttagatgttacacttctctgcttttctaactaccctctaaatctttttttgtgattcctttactttcctagactttcaagtttcgatgtttagcaaactgtgctcttacgccttctttttgtctgtttacattgacttctggatgacctaagtccctctcaaaattccaattcctaatcacccctatgctgcaagtactgtcatcctgtgtttgctgctgcctatctattacccacccttctccaccctgccctgggccctgggatggtgatctctaaaagctgcatcatcagactcctcgtattttgaatgatggtttgttttgttaacggcagatagtatcagaaaatgggatggtaggaagaaaaagaggtgggacgttaatttttttttttgtaatttaatagacttttccaaccttgcgtaattaggataaatcccccttggtcatcttgtattattctttttataaactgttagattcaatttgctaacattttgttgaggatttttgcatctattctcatgagagatatttgtctgtagtgttcttttcttatactgcctttgtttggctttggtgttagagtaattctggcctaatggatagagttaggaagtattccctctgcttctatcctctgaaagagattgtagagaattggtataatttctttcttaacgtttggtagaattcaccagtgaactatctgggtctagtgttttctgttttggaatgtaattaactattgatttgcttttaaaaatagatataggcaaattcagattgcttttctcttctggcatgagttttctcttccatacttttaatctgctttttgtgattttaattgagcatttatcgtattttatattctaattctacaagtagtccaattctgcttttaaataaccccataccacttcacaaagctagtactttgtaataacacaatactaattcctccctttcatcccttttgccattgttgtcattcattttccttacatatttgcatacccaagtgtctatgtaatcattgttgctattattattatgaacaaactgttttctgtttactaaattaaaaataagaaaaaacaaatgttttcattttgctttcccttcttcctttttatgtattgatccaagcttctggcttatatataataactttcctcctccctaaagaacttcttctaataattcttgcaaggtatgctgtcaataaattccatcaatttttgtttgtctgagaaagtatttatttcttctttattttcgatggataattttacaagacatgtaattctaggtgtttccccgccccccccccctcagcactttaaatatttcacttcattctctttttacttttatggtttctgaggagaaatcagatttaattcttaccttcgttcctctgtaggtaaggcttttttttttttcttctggtttctttcagaacattttttttaatctttgatttttctgtagtttgaatatagaatgcctatgcatagtttttagtttttggttttgttttttcgcatttatactgattggtgttctcagaacttcttggatctgtggtttggtatctgacattaacttgggggaagttctcagtcattacctcaaatatttcttctatacttccctctctttcttctctttctgttattcccattatacatacattccatcttttgtagttgtcccatcgttcttggatattatgttcttctttttcagtcttttttgtttgtttgtttgcttgcttgcttttcagttttggaagcttctattgagatttcaagttcagagactctttcttcagttgtgtccagtctactaataagctcatcaaaagtaatggtcgtttctgctttagttgcttttgatctctggaatttcttttcagttctttcttggaatttccatctctctgtttgcattgctgatctgttcttgcatgctgtctactttattcattagagcctttagcatcttaaccatagttgttttaaattcccagttgaataattgcaacatctttgctatatttgagctctggtgctgatgctagatttatctcctcaaactgttttttgcctttcagtatccctcataacgttttcttgataactggacacgttgtactgagtaaaacaaatttttacaaatataggtctttagtaatgtggtagtaaactgtgtggggagggaaaatattctatagtcctatgattgggcattagtcttctagtgatgctgtgctcctggactatgaacttcacaagggcctctcagtcccttgccccttagttgggacaggttggctagagtggactggagttggctagagtgggctgcagttggatatttcctctcctccacatggaagctagaggggactgcagttgagtattttccttccccaaggtcaattagattctgataaaaccccagcaggtttagatctagtgaaacagtttcacctaaggataggcaatacatttctgtttaagcctcccagttcatggtctttgttacagcagccctagcagaagaatacagcaggaatcatgtctgccttgattactgtgatataccaagtttctagcatgtgtcaaacatttatggtaggaattctagacatatctattgaatgattgattaaattcctataattactgtgaagtaaaatgacatattgggaaagtaattaaaccaatttggtaatgggacataattattgaaatacaaggttatcacgttaaaacctgatcccacatctgaaaatagaagaaaaatgttttaatcagtccacaccacatttaatattaattaatcaagtaggaaaacggagaatattttctatcagggaaagtaataaaataaatactaaagatcactactcagaataataacttatttttaaaatgctatatcaggttttcttacctcaattcacgagccctttagattttacgtttctaagtaatagtctttattgtcaatagagtcttaagcacagggagtgaaggagtttgagtgggtcctttgtcatttttacttatatcagaggcaagaggcgaaggagattgtttagttgctactttctgagtttatctcttcataattcaaacctgagaatttcaactcccccaacaaggtacttacaggctgaagttaagaaaccctttaaaaattttgtggaccagaataaaattatcagttcattcaactttccataacgcttccaaggtagaggtgattcagctaagagacagcatgtggatttcttaatgaatagtaaactttgtaagtttgtatgtaccctaaaaagtttttgccttaacccaatcacatatgttaaagtcagacaatatcttagaaacaaagaccttccttccattcccaaatgacaagttggcatttcacaaatacctctttagttaaataatggggtggtcataatgatgaagtggtgaatataatttgaactaaaatatattctgaatgctcatgtgtagaaaaataagcagcctaataaaacatattagtagtgactttgtactagatgtcatcaatgatatcttctaatcctgagtcttcaaatgtagtcacaaacatgccattggtacattcttatgagatatcaccaaggaacggagagtacttgaatttagccactttaatttccttcttactaacttctattttccacatctacagcaggaatcaagattttaaatgtatttgattttgtcatattatactcatacaactctgtaaccccagttaagtcctccacaaagagaaactaagtgaccaaaatcttgcatgcactttctttaaataataaatctgctccatatcatgtggccaactttcaaacagagaagacctgatacactggtacattcttggactatatcccaaactcaattgcctcattgaactttaattcttcctaacatgttattggaaccatcgttttattgagcactccagccctagatctgatgatcaacaatgactttctgctatcactcttgacttctccccaagccaagccctacagcataccctcattttgtattaccctttggctagccatgcaaattttacactaccttgaaccattcagatcttaatactttaccatgtcattgatcatgtaggcacagatttccacagtcctgaagtggaaaaccaaataattatgaaagacgtacattttgcctttgttactagttcaaggctcccttttctatacccatagtctcttacaatcttggttcataaactcttagagatatgtcgatgtcatgatggttgctctatagactccttctgcctaaatcagagatgtacaatttttgtaaaagcttatagatgtcacagaatacttcctccctcagtgaaatattttatagtatgcttcctgtgttcgtcttcttccatcaccatggtgattaaaggactgatcagtaccacggctacctggaacacaaactcagacataattgctctggaacttctcctgtagttcaatcgttgcttgagccagcagaaatttgattttatgttacttgcaaataaaagatgcctagcatctaattcagtctttcgtctcagggaactgcttattctactttaagactttaggagacaggggaagaagacaataggagacaggggaagaagacaagggcagcatgtgacaagagcaaaaaatcaatttgatggactaacataacaaatcttgtgttctctgaaacaacggggccagcttaacagacttcacaagattgtcatgatgaacatattcagcaactcactgctcaggcagtgtttcaggaagcttgtccaggtatctatgagacaatcatcaaatcgttgagtctaatcagcatgaaataaaatggttgcttttaaatattcttaaatactctcagttctgagcctttggcacttttaaaatacatgcaaagaataagtttttcttgagttttgatatgaattatgagaactgagaatttgacactgacctaaattactaacaaaaggctttaaatatcaatgaataaaagtggaacagaagaaaaatgttcattttaatttttaaagaaaacattttcattttattaatctttctaacaaaaatataattatcttcaaatgaaagagcaagattattaataattttcacttttagaagaacttgaaagagaatagaaacattttctagtggagtgaatcttttaaatgcaggtggccgggcgtggtggctcatgcctataatcctagcactttgggaggctgaggtgggcgaatcacttgaggtcaggagttcaagaccagactggccaacatggtgaaaccctgtgtctactaagaatacaaaaattagctgggcgtagtggcgggtgcctgtaatcccagttactcaagaggctgaggcaggagaatcgcttgaacccaggaggtggaaattgcaatgaggcaagattgtgccactgcactccagcctgggcaacagagtgaaactctgtctcaaaaaataaataaataaaaataaataaataaataaaataaaatgcaggtaaatgtgatctagtgaagacattatgaactcaggccttttattactaagtaaatataattcaatgtttaccctttaaaaaatattgaaatctggctgacaaaatgcatcataagtggaattccatttaggggaagaaaagtcaggcctttccatggtttctttaggtcagcattggaataattatacactagcatataagcaaaaaataagctaaatatatataacttgatctgatataaaattcaaatgtcttctcatggctcagttcgtcaacatttttctcaattttaaagaaaaaaagcacaagaaacacaagcaattttctctttcatgttgacttccaaaataatgtctgcatgaagcctgcagggaagcttgggaattagaatcctttttcaattagcaaaggaaaatctaagaaaatttccagtagtgactcaattaatccaactacagcagggagtatatactaatagttagaataagaaatggagagaaggtgcctcaaacacccttctaattccaaagcctgaaaacggagttgccaaaggcaattctacttgcctgcctgtccttcagatttccccattgtaaaaataaacaaatgaaatttaatctagttcaatcatagggcaatgtttatagaatacttacaagttttactaacagtgttcatagagcagggccaagaaagggtctagagactgacaaggctattaattgctagttacgtcctacattaagtttgtgttcctcacatcttccttgacgatgagaatattttcacatttgtcttcattctcagatagttctacttttctggatggggagacattttgtcagtgtaactgagacagctttaatagaatcaatttcaattttaaatctctcttgagaggcactcacatcttgtaggttcacctaggctgattccaatgatgtctcttgagtaactatcctcgggccatatgcatgcattttggcttctagctgagattccgctgaattaatagttgattaaaattgttttaagaaaaatgtcactgaatggcaaaatgccaaataacaactgaattcatttgtgaggcacaaagacgagtgttactatctccaccccatctcccacaggccaatggcagtcctgacaaagtacaaagtgaagctctcgtctcaaagaaaagacacaaaatccccagcagccccatcccagagaggatatgacagcagagctccaggggggacacagctcatgataacagtggatttctcttgcttccccttgatatgatatcataccttttattttttccaatcaaaatgtagattaaatttcataatgcactgcaaagtgttttcaaaatgcaaactcgttacaaaaacccattgagtaatattattaatttatgtttattgctatatagaaagaatcttgctgcttttctgtttttgactatttgcacatgctctttcctctgtttggaatgcctttctcattttccgcttggagaaagcccaacccaccaggagaaaaaccttccttggcaaacttgccactaccccagagcctcttgtgactcctatgggttcccagagcctactgtgacccctcttacttcttagctcttggcatgctctaatataatgttagattaatatagctcttctggctgctagacagtgactgtcctgaaagtagaggaaagagagcatcatgttggtatctggtgggtgtttaagaacaatgcctagtacaaaggtgtactaaaataaacatgttttttgaattaatgtaactagtgctgcccagtaataaatgctttcaataagcaacataatttagatttctgtatcctatggagttacctcagtactttcaaaacacacactagcaatgtaggtaatgggttatcattaaagtcttacttttttttaggttgactgctgactcaaatgtgctttattttgtagccataatttgttcacatttgtcttctttattaccccataggctctttgataaaagagatggtgccccaattcttgtgcctagcaggcacaaaaagaaatacatttgaataagtaaataatcaaatatggaaagatgacttatggtgcccatggctaggcagagggtgtaggtattgtggattgattcaatagctacacaatcaaatagagatgataactggagttaagatgtaacattggatctgggacagggagagtttaggaaactaacaataaaatccttccataaactaaagaacgctcgccactatcaggatgaaaaaatatgtcctatggaaagatgttgccatagaaatagggtatatgaccctacaatgcagaagagttaaaactggtactgatgaaagaggtttgttattcatctgagaattagtaaaataatgtctagctatcccaactccataaatggcctaaaggaaaggactgtaacaagcagttttccagaaaaaaggacaagttgcttggacatagagcaaaggggaaaatatgaggacatgatcgattccatccatggacaactgcctgagaatcagggaggaatgaggttggaaaatccccctttattttttttccgcataggtgtgttcatttccaagcagtttggcttctttcaatcctggccttcttcctgctgaatacagaatcatttcaggggcccaatagtttaccaatacctagtccagatgcactgacaattctggcatgcctctccattttatcaaagcacccagacatcagagcatctgtattgcaccagctggaggccagcccctttatcctcatgcttatgtgttcttaggatacataagcacttggaaaaccacttagagggattaccagccaaggtaccacataatgcagctagccactattaccaacagagacctaacaccagtacatgttttgttgagaaaaattaaaaagctactcagctgtaaaagccatttcccactcaattgttggcagcctcaaattgcagttatgtggacccaagcaagcagtaacacacacgcatacccttcagttaaagctcaagagccacatgatttagctttgagtcccagcaaataactagaaaggttttcctttctttttcttcttccagttggtcgacaggtataacaagttgactgggtctgcagtcagctccatcagagagtgtgaataacagagcaaaaggcagaaagattttatgtgtctggcgaacagagcatccccagggaaatcttcagaggttgaaaacatttttcggaattactgcaatatactacctttgtcaaaggtgcttacagtgattgaaacatattaattaagtttccttcctgacctttgggattgggactgtaaagtagcattaaagcagatttgtagaagataacaaaggggctgttatccaaccagtgctgacccaatcatgcatgcatagggtctccttatcaccatgcttttttctccacagtctgtatagccagagagaagtcaggctaggcttatattcaggtactttcttccgctctctaaagtttgaaggatattgtaaagcttatagtagggtggggaaagggggtcttcaaagacatgaaatggcaaaaaagaaatatgaaatttggagaggagcagtatagtgaaaattgctcatggcttttcttaccaattggtttttagcaatgatgatctctacaaatagtgttctcagtcattttgaatggagagatgaactaatacaattcatttttaatcagtatttaggaaaactgccagattgcaggaagccaaaattggttgactgttagtctttcccctggattaacaatcatctctaaatggataacttccttgtctgtgcctcaatttcaatgttctcaatagacctcatatggcatttcctgttgaaatagttcctgagctctctggtgaattttggaggtgtttgagaggtagatcatcctcctgttcatgagcccctggccttttgtgagtatcccttacactcttcaggacccttcctcccacagcactgccctcctgccagggaacccca

SEQ ID NO: 2446 - DNA, 8890 bp, Homo sapiens
cggtgagagggcttccagactgcttgcccattggaactgcgactccccacagaggatgggcctctgccagccaacacagaggacagagccccaaggttgtctcagcctcaagccatggggctggataaagaggtggctttttaatctacttctgacatgcaatttgtgctgaaatagatttaactttatcattgtgtcctttggttggaatcaggttagaattcctgtcaattcattatcgttgaaagtctgtgagaaatgattccagctcataaggaaagtcttcaaacgagttctgctttaatgcccacactgaaaaggcacttgggtaggatggattcgtgccgggtaaatcctgagagggctcttgacaagcagggcgagaaggagagagaagtcagtggaaggaactttccttactcagcgctcctgtgcaacaggcactgtcaatacccaccgcagccacagcccccaggtgggctctctccggggtttacagtgaggactgccagggagtgacagagctgggattcgcacctctgccatctgcctcccagtccgagctccttcctctctttctcctttcccctcccctccccttttctttcctttcctttccctctatgttctctttcttttctttctttcctttttaaaaatgttttatccccctccatgagcaggatccagcttctttcagcaccacactacctcctccccagagctcctcggtctcatttctgctgggctccactgccaggagcccagggagaggccagacttcacaccagtccctggggctccccttgaaccctcaggccagcatcttgcctgcctagccccgcagtggtggtggctctgggccctgcctctcctagggtctggcaagaaggagatgataacttgctggtccaacccctgccactcatgcccagcagcccccaggagacgcagagggaaaatggagaaggtggtttgtttccaccttgagtgtgggcggccttgcagctccttgcatgctcagtaggggaggggacagtactaatggtcacagggcccctgccacgtgctataggctttgcacacagcatgtctaatcctcactgcagctgccagcagtgattatttccattttaaaggagaggaaactgaggctcagaggggcaaagcagcttgctcagtgcctcccagtggtgcatagccagcagggatttgaagccatgtctgtacaactacagattctgtgcccttcccaccgtgccgtgtgtggcagtttcttctcacaaagcacttccctggtcttactgattctcttaaccccttgcagagtggccagactcagggagtttgatgccacttgatgatggtgatgactgggctgatgatggcagcacttactactgagcactgtgtgctgggcattcttccacagcctctatacagcatcttatttaggccccactcaccctttgagacaggcgccatcagaatcagctgtacacacactggccaggggcacaaaccagcaagtgacagagccaggatgcacgcaggtctgctaggccccaaagcctgctgcctgactgttacactctgttgtctgcatgtcccataagatatgcttgataggcgagacagagctgaacaagacccagtgcctaccctggagaagctcctgtctgctggagaagacagaagtgcagagtcaatcccaaattgcagtgatggagaaagacacaggaattgcaagaacatctagattggaaaatcaaggaagacttcctggaggaagtgaaacctgagctgagccacagattaggtggacagagaattaggatggaggaggtatggttgatgaggaggaaagtaggttcttgcagatggaacaaggacagagctgacacaggaacagggttccatgtagtatgcatggaaaccaaagcaggatgtaatatggggtgcaggggctggggcagatgagtctgaggagtgcaggaggggaaaccccagcctgtgggtcaggtgagcacatgtgggtagcacaccgctcacagagtgacaagctcactcacacacaccgtcggattactcaaatcaaattcatttgatggcattgatgggttcatagtggcccttaagcattattctctcaatcaacagaagttaaacaaatgcatgcaattgtatgtgtgggtgggtgtgagtggggtgtcttgacagggggttctgaaatttttagacattcaaagagggtcctcctgtctgatgagtcagggactgccatagcagctggcgggcagaggccattgctgagtttgaagcaggcaagagtcagggcttggtctgtgctttgagtagtcctccttggtagctcccactggtcctgtgtgacctgcagcccctggtggagagttggaggagtgggaggtagaatgccttgcctggttggtgataggactgcgtttggagaacagcttgtctggccccaggcccaatgtgcccctctagctgtggtgtgttgggtgtgtaaagaaaagcatggccctgcccccagggcattaccatccagtgggggaggtgattgaggacttcttcactccatccctctgctaggaatggcgctcaccactgggttcattcaactgttgaatgaactgttgaattcaactcttgaaggccccgtttcgttcactccgcagttgcttattgtgcacccactgcgtgtaggacttggtgctgaggccacagtggagagtgtggtgggcccctgggagagaatggttgagggatttggacctcacccttggggaagcgctgcacacacagacagggtctctgctgctgagggtggttggtttccatgtccctctccctggctggcttgggagctccatgaggatgggagcctgtcctggtggtctttgtgtctctatcctctggccagggctggcttggagcagctgctcagtacctgtgtgggtaagatgtgctgagtttgtccttgccaggtcctcctatctgggcagtgaagcccatcagggactgccagggctggtcggggggcctccacctatgtctccccctatgtctcctaccttatctctgcacatcccacctccagcttttggtaagtgctctctttagccattggggtgggctctgcaggccctgtggctttcgtcccgctttgacttgtcttgtcctttctcttcgctgagtctgatctccctttctactggatctgcctttttccgcccttggtgatttggctttttcatttcaatctaattagggctccctgccaggagaaggcagtgcagggcgttctcaccgcagcgctttgggaattagtcacttggtgcccattgtcattaatttggcgccaaggccatttatcctggtgtcctcaatcaatacagttaaaaatctgtggattctgtaatgtcaatacctggcctgaaatacggagggccagcaccattttatctcattaatttatagttctgacaggttgttggcttatagaacaaccatgaatcaacacttaaataaaacttgctcacaattatttttggtgctcttgtttcagtctgtaatcttcctaacaaaacgtctgtggcacgttaggctgaggtggcctcagggaacgctggccgactccaccagggccctgagtgtcacctgtcttatgagtcagctgtgccacacgccagctcagccagtctcctcagaatcccccggagagctccctcagttctaagcggtcctgtcatgtttcttgcagactccaggccctgaggcaggtgtcccagcctgaccctcgaggctgcagctgtagaggcatgcagggcctctgtcctttacctttgatggctgcaaaggagattcctcttcctggagccctggagccccggctgggcagggaaccctgtcctccttcctgtgcatgggccggctctcctgatgtgcgctggctcctctgagccatctgtgcagtgccacctgggtctacctcccagatcctggaggcagcacgcgtgagagggcacatagacagggtacaggtgttggctcttctgcctccccgaaccaggcctcttcacctgtttctaccacaccacctggtgctggggctgttgaagggagcagctgtgataacacatatagggtgctttgcagaatgcctggcgtgtggtaggtcctcagcaaggaactcctctcctcctccgtcatggcccatgaggcccttgttcctgctaagctgtccagatggcccttgttggcaggccatttccccacatggggccacttttcgatcatcatccagaggcccctgctggtcccctcagtgagcttacagatgtgctgttggtcccctgcgtgggtcttgggggcagactgggaggaggccttgggccatcatgggttctcccagcatctcctccacattccccttcctcctggtaatgggacaacacgcactctttattagggctctcgagtgggtatacagacccccagcctgcccggcctgaccctctccagagccccaggcactcatggctgcaggaggcctatggccctcttccttcagatgcccacagcctgcagctctgctgtccccagcttttggctggctcctcctgccctgggtgtcccagtgtcttttggtgggagtcatgttgtgtggaagtgagcagccaactgggactgggctcataaatgaccatttctccttgctttccaagaggtgtcttcttgtctctcccttgttttcaatctatgactggggcttccattcacagaaatgctacaaggaaaaagagaatgacaggttatcgagcccttgctgtgggctgggccctgggctatgtgccctgggttccagcacgctgcctggcctgtgtggaggtgaaatgagtgagtggatggtagactctttgcttatgtgactcctcctgtgagaggagtgtttttaatcccatttcatggacccagaaactgaggcttagcatggtcagtgactttcttgaggtgacagaggtgggatccagtgctggcatgtgactagtagagctcctgctgttgaggtatggtgtggcatgccctccccacgtctgtttccctgctgtgaacaaacagggaaacaatggggaacccaacttaacctgactcctggggagcctgctgggcagcagctggccacctgcagaggataacatggggcctctgggaagaaggagtgctccagactcatggggactgatccctctgattaagtgggccactgagggaaagatgcctcttcagtgatggatggccacgctccaatgacgactttagaccacttggcatgggaagggtgagaagtgtccaaatgaaaaccatggcaaagagccccaagagctcctgggctttggagaaggggccacagaaggaggctccttgttgtgctaagcctttgaggtggtgctggctcctgccggtccttggaagaagtgccgtggaggggcctgggcttctccgttctttggctttctggcactgtggctggagtttcgctagcgtagcttaggaggacttgattaggtatccctcaggtgcccacagacccaaaggaagtagaagaaagcttgtgggcacatttacaaagcatctgatacttacatgtacatgctccttgagtcctagggactgttgccactgatccagaagtgaaggctcagaggggctccacagcctagcgaggtctgagctgatgagggttccctggctgccgccctttatgtgcctccttgtccagttagcagccgcctactttcttgcccacttgtgagtgggtctattttccaaggccagtctctgttgccacgaatatccttcgtttctcactctgaaagtgcttctcctctggctcaatcttgttttctctttccttacttctttggagtgagaagctgaccctagttacggatattaaatcaaatgttattaaacttcattacaacaccatgccagcccttaactgccacttggaaaagtgcctagagatccttcacatctccacaaacacagctcacgccagccctctaggcaaagaaaagatggtttctaattcaaattcttgttttgttcatgaccgtgactgcacagtagtgatgtctggcgtgtgtgtgtttggttgcagctgcatcacagtttggtgcccttgttaggtaaggctgccattattgactgactctggagcccaaacgtgtttacggcatgtctgctattggaatggcgagttccgagtttcagaaaaccaacttactagtaaagcactgggatacaccttgtttgaaagttgagaactcttattattattttttaaattttggaacattcggtcttgtccagagaattaaaagcagtggctgacaatggtctgggcaatgattttttggataggacttaaagcactggcagcaaaagcaaatataggcaaaagaattgcatcaaactaaaaagcttctgcacagcaaaggaaacagttaacagagtgaagagacagcccgtggattggaagagaaagtttgcaaatcatacatcttgtgaggggctaatatggaaaatgcatgaggaacttaactcaacagcaagaagccaaataacctgatttttaaaatgagcaaaggatctgaacagacttttctcaaaagaagagatatgaatggccaacagatattagaaaaaatgctcaacatctgtaatcatggggaaatgcaaattaaaaccacaatgagatatcacctcaaacctgttggaatgcctattttcaaaaagacaaatgatagcaagtattggtgaggatgtggagaaaagggaatccttgtacaatgtaaatgagtacagctattttggaaaatagtgtggaggttcttcaaaagactaaaaatagaattaccgtatgatcctgcaatcccacttctgggtgtatctccaaaggaattgaaatcggtgtgtggaagggatctctgcacccccgtattcattgcagcactgttcacagtagccaagatatggaagccacctcggtgtccatcagcagatgagtggataaagaaaatgcggtgaatattcacaatggaatactctacagccttaaaaaagaagaatattctgtcatttttgacaacatgggtgaacctggaggacattacaataagtgggataagcgaaggcacagaaagacaaatactgcatgatctcacttatatgtggaagctaaaaaagttgatctcgtagaagcgttgagtagaaaggtgttaccaggggtttgggggtaggggtggatatggaaagtggagatgttgatgaaagggtataaagtttcagttagaatgaaggaataagttttggtgatctattgcactgcatgatgaccacagttaataatgtgtatttcataactgctaaaagaatgcacttttaacattctgtccacaaaaaataaattagtgaggtgatagatatgttaattatcttgattaaatctttctacaatgtatatacagatcaaaacatcacattgtacccccaaatatatatatatataaaattatttatcaattaaaattaatttaaaatgaaacaaaaaagaatgggaaggaaagagctggtgtaagtatgttattagaagacaaattttaaaaaatgactgcaactactactatttcttctgttactactattattacaatgctacagctactgtttattgggccctatcagttgtctggggcttagctctcctacatacattattgctaattctcacaaccaccttttgtggtcctgagtctacagatgaggataccagggctggagaggattgctggccgatgcagggccacagctgatggggaatgttcagatgcaggcccagctggctctcaggccagacccttcccaggcctttgcccggattgctaagatggcccctgtttctgatgcataaagtttgatttgaaagttagtaagtttcttttctcgttaactttgagtcaggatggctaaatttatagctggctgaatacttcccagaggatgagtgtaacgatattgattttagcgaagtgagtcatatgcctactgcctggaaacacaagctcaattaccacaagccaacagcataagctttcccttgtcaacatttttcctacatgttcatgagtctgtggatgtgaacaaagcactaggagaagcaaaggtcacgaataactggcggcgatgcaaggtagggtgccgagagctggccttgagattagacagggccagtctccgtctcagtgtggctgactcatgtggctctgagcgagtctctcacctcgctgagcttccatttccctggctgtgagagatgggttaattacacctaccacccagggtgccgtgtgatgcgtgcaagctccagacaggcctggaggtaacaggctcctgataaatgttgttccccttccttgactgtgaactgctttgccagggctgcctctgagctccctggagaggggggcatgagcttctcttttctctcctggagacccatacttgggtttcatgtggcctggacgaaatacctattatgtgccaggaactaggctgggagtcagtcatgctgaatggaagaggaaggccctcacaggcctggagccctgcatgatgataggattcctagtatagacgtttgcaacttctatgttaactaagaacttcttagttagcaagatggacaggtggtgctgccccggccacatggttggtcactttgggaagctggatatctccacctgagaaaggaagaggggcagcttggaggagccactattccagagttcccagatgccttatc

SEQ ID NO: 2447 - DNA, 8652 bp, Homo sapiens
tcaacacaggtaaatctccagaaaagaacaagagtaaaagcttagtttcaaaaggacatatacagcatgataacattcatgtaaaatgttaaaatacaaaatactcaaccatctgtggatacagactatagcacaaatacaaaaatgtcaacatcgattgtgagaccctggttggctgtgggggtggagaaggtgtgaatccaaggcagaggaaaaagtatctgaggtgaataatctattaggtgaaaataaagagggtctgcggactaaggtttccatgcatttgaagaacaggtgttagaggaatagctgaacaagcaaactggattcaggtccatttttcataaagaaaacaagacagttggtaacgctgaagccccctgtgcacccctccctgagcccttccccccactagcaggccgctgtcctgagtgtggtgtttatgccgccacacgcgtggatacttccagttcatgcttttcatttctctgttctgtctcactgcggcactccctgactccttggggataaggaagacaaaggcagttctcggaatgtgggccagagtttattttcattgctgtcagcagccagtttaggtcagaggaatatcaaagacctactgacagggtcacacatagtcaaggtttcactctgagttctgtccctgaaaggccagaacaaactgcctcctagggtaacactaagtgctactgccatttgagacagacgtgtgcacagacagccctagctcacaggattgtaggtccccagcggatgaatgaactggctgtttgctgggtgccgggaagatgctttggagccacccatagatggacctgcatggggacttgcttttccaggagagatgattgattcaccatgctgacctgaccactctcccacgtggtcttcctagtgatcagatggggtatctgaaggttcagaaacagatcaaagaaaacgctgtgcacatggagtgaatgtgagttgcttttgctgaatacccttcctgttgggtcaggaggtatcctttatgggttgtggaggctgaaggtgtggcagagagtccctcgccccattccttagcaagctggggcataagcatgtgatctagagttagacattcacttccttccaccagagaggagtgctgaaccttggggaaatgacacgaagacacagtgaaaataagaatttactcatggtggtggcggcttcctaactcttttctaagcctagttctccaactttcccattaatcctgtgacaaattctccaaaacattttcttttctgcttaaattagttagaatcagcttctttggtttgctattgaaagtgatgataaggctgggcacggtggctaatgcctgtaattccagcactctgggaggcagaggcgggaggattgtttgaggctaggagtttgaaaccacctggcaatatggtgagaccctgtctctacaaaaaataaaaacaaattaactgggtgtggtggcgtatgcatgtgggctcagctacttgggaggctgaggcaggaagatcacttgaggccaggagtttgaggcagtgagccatggacccaccactatactccagcctgggtgagagagtgagaccctgtcacaaaaacaaaacaaaacaaaacaaacaaaaccacaattggtaaacaatcctcccctcacccccatttaagatttcggaatacctcttactgtcggttccgaaagaaacctgccacccaaactgaaacacagctgctgctgctagctgcgctcgcgccaaccctgccgtgcttgtgccaacccagccgtgcagatgcagtctctcttcctcccagggccgcctgggttgaatggttacctttgattgcaacacttgtgtttaaactttaacttaaatttgagttcctaacagttaatttaagcatctttaaaaaagatgccatttcaatgctatagtgaaatcaaaagttattaggaacagagctgccagatttaagtttactataagtgacgccaatactcatgtctggaggaacaggtacatatccatattttcttgtgttaaagcaacaatgagagcttaatatagttcgagaagtacaggtaggcagagctgtgtttgttctgtccctgagcaggtgtaagaggacggtctgtcacacatcaggcaacacaatcaaaggagtagaaatcacagtgtccaaaagagagcaaggaatgatcaaagctgggagaggttggtctgcttaccacctccccctacaaagttaggattattttgctactttaagcattttaagtgtactgcacagtggcattaaataagtcacattgtcgtacaaccaccaccaccatccaactgaaactctgaacccattaagcactaattctcccctcctctctctagcccctggcgaccaccattctactttttgtctctatgaatttgactactctaggtacttcagagaagtgtccttttgtgcccggcttctttcactcagcacaacgtcctcaaggtccatctgtggtgtagcatgtgtcagagtctctccctcctcctaaggctgaataggtcggcttgattcttgtgtcatgaaggactcaggcggcaaatacctagctacccaaaaatcccagcggatctaactcccaacatgtcatttagtctgcctgctaaaggaaaacggtgattcagaaggacctagagaccactgatcctcaaagcctgttcctgtgttggaatgaaataaggggcttgctaaagtttagactcctaggcccctccccagagccactgaatcagaatccctggggctgagcctggggatctgcacttggaagcttcccaggtgattgcaatgcatggtgcagtttgaggatcactgtctagactgaataccagggtggggaaattgtacagataggtttatgttcctgttggttagcaagcaacaaagcaaatcaaacacatttaaagtagtattagttccttttattccaaaaagttaccaatagatgtttaggtggtgcatcacaggtcgaggaaacagaactgaaacatgcttatctgaagacagattttaaaactcacccaagctccctgcttttgcccatgctgggctatggccctggtgaacccttcctctatggtctagactgagcctagaaagccagcccaaaccctagtcattcttcaaaatatctgggccaactttgattaagttagacattacttaacgttaagctccagtttttttcacctgtaagatcgggttgttgagtgattacctgagaaaatgcttttatccataaggcattgagactttgttaactttcagcaaatttgagctgtggttactctggtttcctcaactgctccccatcctgagttcccttgcctgtgctgcctatggcaccacttcacacagggtattaaaatcagagggatgggctggtctctttcattagattatatattctctaaccacaggaactgtgtcttcatcatggtcacacaagatagtggcggacaatgtgggccttggacccagactgcctgggaccttcctggctccatcacttactaattctgcgaccttgggcaaattacttcacctctctgtgcctcgtttcctcatctgtaataacagtgtcttggggctaccctagggctgataatagtatccacaggcctcaggagctgcagagttaatatacgtgaagcatttagaatcaccttggcacctagaaagctgtccaaaatgctatctactggttatttaaaaaatctttgtatccagtgcctggcatacaggggggatgcaagaaatatttgtgggagaagtgacagaaagcaggcagtggctgcctatgacgggagcccggctggtgagtggaacagacaaacagggagcgtctcagggtgatggaaagtttctatatcttgatgatggccatagtcacacgagtatgcaaatatgtcaaattcaccaaactgtacaattagatagaatagatgcatttttcacgcctgtaatcccagcattttgggaggtcaaggcaggtggatcgcctgaggtcaggagttcgagaccagcctggccaacttcgcgaaaccctgtctctactaaaaatacaaaaattagccaggctaatttttggcagatacctgtaatcccagctacttgggaggctgaggcaggagaatcgcttcaacccaagaggcggaggctgcagtgagccgagactgtgccgctgtactccagcctgggtgacagcgagggactgtatctcaaaaaaaaaaaaaaaggtgcatttaatcatatgttatacttcaacaaaattgacttaaaaagcaaaagtaaataggaagaaaagaaagaaaaatcccaaggctgctaaacttgtttaaagatacacatctccacaaactgctgaatggaccaggaagttgaaatctgttcatcaaggggctacatacctaagctggctgtatatggaggtgaacgaagctatagtagaagccttaagctttagaagaaatcggccttaagaaccactcgaagcggctaacctgcatcctgctttctggccaaggtgatgaaaacctctcatggtgacagaacaggagtgagaatgctccaagtttgtgagaactggtttcagctaggcacaatgcaacgtggcctggggcatggaacgatctggacctatgtgtgtttgcatgtactagtgtgtgttgtgggtgcaggactcaacataatcatagaatcatcccacggtgctcagtatattttcaacacttattcatgcaattaatagaaatttcaatcctttaagaccttccagtgaaacttgtattagtctggaacaaaaaagagatgtaatcagtccagttgtttcaaaatatagtttctttctttgccaaaggacccaaaagctacacagcttggggaactaggagaaagaatttgtcctgcggaagatcccagattggcattcctggctccatgttctgggaacaaaaggagggggcaggaaggaaggagccccttctacccaatcaagggcttcccgtcacagcccctgtggaaactgtggtcctccatcctggccagagaaagagccaccagggaatggcataaggggttagaacagttgctccctggctcaggtaaatatagcacgggggtccctgaggaagcaaatttggcagtctatttttaatagaacaagagaaaaataatgcttacatttcttttcagagccaagtttctaattatgagttttaaacaagatgtgtgtctatggccaggtgcggtggctcagacctgtaatcccagcactttgggaggccaaggcaagaggattacttgagctcaggagtttgagaccagcctgggtgagtgaggccctgtctctacttaaataaaaaaaacaaagaaagatgtgtgttaatgaaaggatgcaaggcaatggaaggcaggcagaaatgcagccgagctccccctgccatgtccctcctcccactcctggggtgggcagggccacttgcccgtggtggtgacggaacactgcctaaaactgctcaaacctctcctcttttcgaggccctgcccgcccctcccatagttagtagctccagttccatgtgggcattcctaccactgcccccagcactttctgtgtggctctgtctgtgcaaccccaggctctcctggctgcatgttcacctttgtgtccctccagcacccgtgcagtgagcatccagcacgaggcaggcaccaagagttccttcttgtccccaggttccaacctcactaatctagccctcagacgatccccatcccttcttagaactcaaagattatctccaaaactgtgagtgtccctgattatgtctagaataaatgtttccagaacaaattctccatgactagcctctgctgcaattctcaacctttgctcagtctcttactaagccccaccctctccactgcacaaaccacactgggctctgctgttccgcagcagcatcctgtacttccctgtctccacacccttgctcaggcttttctttctgtctggaatgccctttcctcttctccaactacagccactcatccctctggggaactttcctccaggtggccttcccccacccagtggaacagaaccgcctttcctgtttcctcctgatggggtctgtagcagcctgagagcagggccaagtcttcactgtgtctgtaacccaaaggcccactgcagatgccttacactatcaaatcaggttcccggggatagagtcttatagctttaatgaatttccttcatagcacttatactctgaaatggtatatacatttgctgactataagacagaaattctgagggcagagactccactccttattctattcaccactatacacccaggaattactactgagcacagtaggtgttcaatacatttggtttattcctccaaaaactaaaaatggaactatcatatcatccagcaatcccactttgggtatttgtccaaaagaactgaaatcaggactttgaagagatatctgcacacccatgttcactgcagcattattggcatcatttctttatccattcattcattgatggacgctttatggcaacagccaagatgtagaaataagaaaagcatccatcagtgaatgaacggatagagaaaatgtggtgtacacatccaatggaatactattcagccttaaaaaaaattctgcaatatgcaacaacatggatggcccttgaggaaaaaaacatgctaagtgaaataagcccatcacagaaggacaaacatacataattctacttgtataagatatgtaaaatagtcaaacacacaaaatcagagaggggaaccatgactgccagaggctgtggggagaaggaaatggggctttgctaatcaaccagcataaaatttcagttaggcaagatgaataagttctagagatttgcggaaccacactgtgcctatagccacattgtgcttgtaatggatacttaaaaatgcgtaaagagggtagatttcgttaagtgttcttatcacagtaaaatacagtaaaattggtttaatcaagtgaattcacttgaacaagaaatgtaactgatttttagcaatctggcaagtttagttgcttaaatagtggtatgcgtttctaaaaaagggttgttactaactaggggaagtgtaaatcatctcaaagtaaacatcaactatctgggatcgctcaggtattataaatacacttcgaaaagagtccctttagttaataataacagccacttcagggcaaggagtctctgcattgtttcctggctgagtttacttcgcaactagaaaagtctgcttctgaaaatgtcttctgaaaatgtcattgtggcagagagcaaaatgatagctataaatcaacaactgcagcaaatatttacttagctcttactacattcctgcactgccctgtgagctccatatcactacaatcttgtaatccttgcaacaatcccatgaagtaggtacttttattacccccattttacaggggaggaaaaaagactcagagaggttaagtatccgacccaaggcacacagctgtttctcaggggagcccggattcaaacccagggactcggatcctagagcctgtgctttcacccgctgcgctgcaccatatgtgtaccaggatggtagaatcagaggtgagtgtactttattttctcctttttgatttgtggtttcctaagtgttctacaatgaatatatattatttttatatcaagaaaacaaatatgcatattgtaaaaattattggcccacttgcattattattgaggaggttgttctttttcttctacaatggtgcttctggtgaaggtctggattccagcatttccctgccagaggctatggtgggtgtgccgagcaccaccctgagggggaagcagtatctcagcaactacacccccgaggaagaggcagtccccaatcagcgggagcaatgggacctgctgatgacaaaataagccacagaatgaatggctctgctccactggccttctctcctccctgcccccttttccccagctgaccagatgcagggcagtggcagggaggggctgataccaaacccggtctgggagactgcccggagggaacacaggttcccaagctccttttggagaggctggatgtgagttcacctcgaacctttcagctggtaatggccacctcttggagaatgtaactggttaccagaaaaccccagaggttgtctcccagtacctagcctaaagtgggtgtggccacagaacctaccaaaatttaaataaaagcaagaactaggcgtgtccagggatggcgttgtgctgtttatccgctctctgctcttcccactcctccttcctttgggattttgtccaagactctgtaaattaatttttctgtgcctgtttcctcataaaataaacaagctaacctcacagcctgtccctccttcctctgggggatatgtgacaataacagatgggtgagccacatgtccctgaaggcccctccagggcaagggcgggagagccccacatcacaggttcgtgccacgcca

SEQ ID NO: 2448 - DNA, 23541 bp, Homo sapiens
gagaagccacacttacttgaggatgtccttcttattgaagaaggtgcagtcctgttgagggaaaacacacaacacacagtcagtgtgcggctcccagactttcttcctcagaggcctcgatgccacagggctcacaggggatagctccggactggggacagaagagtcactactatccctttccaccttgccctcacccactggggacagctggctctagtaggtatagaaaatgcctcccaaaacctttatccatcctgggctaggcctaaggagcttagtgcatggtggggggctgtagcatgctttagggtacacatgtaggaggaagatgaatgctcacaggtatgcgtggctgatttgagtgccagtgggatacactgggggatgacagggaggtggctgggagacaactccgaatgaggacccacagggccacctcgtgtagctgcatggggtgccatcctcactgtagccctgagcatggtgctaggggggttgtgcagtcccaggctcagagactgagagttccaggcacatagactggggaagcatcagtatatacttggtgtctgaagccagaaagggatgaggtcacccagagaagggagtgaagaggccagggagatatgggagggagaaacgtgggcagggggaaccaggtagcatctggggtagaggtgagggtaggggctgctggggatccccaggtaagcattactccaggtggggggcagcacttggctcctagggccatccagatgacaaactcatctcggaggggtcctgtctttgtttagatgaactgcctctatccacagcttggcctgcccaaggtgagtatcaaccactgggagtcagtgacaatggccactatgccagcccttggtgaaaagtatagaggtgaagaggacccagcactttgtaaaatgcccaaccgtaaagggcttttgtgcacctcccctgctgtttagctcctccgcctttgtccactgttacagcatgaagcaagaaggcctcctaggtctgcagagcccagagcccatagggcctcctggggccataagctgaccagagccagctctgatgaggagtgaatggctgaaactcaggcctgcaaacagccaggcttgccctgaatgagacctgaagccgctggacatcagggcaattggattgcgtgttaagaggcccaaagagaggacgcctgcaggatgcacacaacatctggggtttccactgggtgccttcgggagagctgaaaaggggagagctggtgggaatttccaggccccatttggcccaacaagtctgtccttctaagctgctgctccctgggagttagactaaggatccatgctggcttcttggaaacacgaggggttctcctgggggtctcagctttgcttttgacagtggttcctctgtaggagcccagaaaggctcaggctggggaagcagtgccccctgctcctcacccaacacagacagaaaactccctacttagcaggcctcaggcacagacaggctggagacacagtgggctgatttatcagcaaactccagaaacatggtgcagaatgtggacttccctccaccccagggccgtttccatggtctaaggtgcccagtgagaagggccagggctctcccacctagcctggaggaggcagtcagcagaactggaaatggggagaggtcccaactcctgctctcttccccccgatctgtcctccttcccctcccctcttctctctcctatcccatgtgttggaaaggaactatccaggtcctgattcaagggttctcctgacaaaagatgcaaacacttcccctataaccctgctccctgtcacaattacttacacctccctacatcaatggtcctcacgctgtggctcctggaccagcagcatcagcctcactgggaacttggtgaaaatgtagattcttaggctccactccagatctcttgaatcagaaactctgtgggtggggtccagggatctgcactttaaaaaaccctcccaatgatgctgatgcatgttgaagtgtgaggaagtctgctctagagcagaatcacttgggggactgtttaggatacctgtgtcccccatccctcagcagaccccagacaaattgtagagaaatccccaaggatggatccaggcattggctgttttcaaagccactcaggtggtcccaacgtgcaacccaggctgaaaaccacatcacaaccagtacatgatgtaccatgcacctggcacctggggctctaaatatccaatttttcttaatccttatcattagccaatgggggtgggcattatctctctatcttaaagatgggcaacttgagactcagcaaagttgagtagcttgccttaagttgcacacacagcccaggagggctgggaatggaacttaggcctctgtgcttccctttcccctgccccccccccttttttttttgagacggagtcttgctctgtcacccaggctggagtacagtggcatgatctcagctcactgcaacctccgcctcctgggttcaagtgattctcctgtctcagccttccaagtagctgggattacaggcatgcgccaccatgcctggctaatttttgtattcttagtatagagatggggtttcaccatattggtcaggctggtctcgaactcctgacctcaggtgttcacccaactaggcttcccaaagtgccgggattataggcatgagctaccacgcatagccttctttttttctttttaatgggagtagaccttggggccctcactggcaaggaagcagaggcaagaaaagatcctctgtgcttcttggccactgcctatgactacaaacagagccatgaccactgtacaccagccactccatgtcctgcgtctgctgtgtattcctatacttatacacagcaggtgcttaatacaggcttgtgggatgagtgaccagacttttccatctatgccttccacagcagttacgttatttcagtggctgcagagtccctgcctagtcttaatctttcttctctttctgaacatttagtaacacctatttcttggttttaacatcactgacaaaactgccatgaacctgctcatcaactgatgtttcactttttcttctgttcacttgtttccctgggactcaccccaaggaggcagtgcacaggtagtgaatatggcaggtgttcttaaaagcttctcagggctcagggtggcctagaagtgtggcaggggaaaaggtttggtagtcagggtcaaattctagtctagcttcagacccttaggcaagtcattctcctttctgagcctcagtttctgcatctgtaaagtggaaataggcctctctgaaggggacagtgtgaagagcaaatgagataaggtacaggaagtctataggccccagctgataggaaagagtacaacagctccatccaccacccaggtcccaaaggcatctccccagagtcggtagctctgctgtctttcccttctctggagtcaccaaacaccctgcccaccactacaccctcagctgccctgggagctacagccctatgtctgaaggaaccctttcttacacttttggagagcaagtgccccatcactgcttggttcctgacagtacacagggacacagggacaggtcttccggcaaaggtcaggtctgggtcatgaggagtggaagggagggaaggagagagggggcctaacccaggagtgatgggctctcagaacattggcagcagaaaacaggacaggctgggcttttacagtagaagcccagacgttttcccagttaaggcttgagttctgcctccgagcctatattcaccctattccccaactggagtgccctctcctctttctccaggttgtccaaaccctttctccaaagctcaactcaagggtgacttgttccaggtaacccacctgcctcccatctcctacatgcctggtctgcctgtgccagctgtcaggagccgagccatgggccctcccagctctaatggaaatggctctccatccagctctgccagctcaggcctcagcactgcccaggggaccatcacacggctcaaggtcagtctccagtgatcttagttgatccccacaagaaccctgtgacatgagcacagctgggttagtagttcccattttagaggtggagacacttaggcccagaagggaacagtggcttgctaaggcccacagcatcaactacccagctgacttgaatctagggcttcagaatctttgtctagagttctttgctctcctggagccacgccttaacaaatatttgttcattcatttgacaacatcctccaaacatctcttttgtgcctggacagaggccatacaagaaggaagctggagtgtaaacagtgaggtgcccagtataaaccattctgtggccacacaagggactggggatgtatatgtgtcaggctccctgagtactcccagctgaatggattggtggagagagagtcagggagcccgtcccaaagaggtgaggcctggcctggacagaaagatgggccagactaggttagcaaaggagcagggagagcagcaggagaacaagggccagaggtgagggagggcttggctagaagcccttcagtgtgcctaaaactttgggtgcaaagggaaagggagtaagaaatgaggctggaggcccggcgcggtggctcacacctgtaatcccaacactctgggaggccaaggcaggtggatcacctgaggtcaggagtttgagaccagcctggccaacatggcaaaaccctgtttttactaaaaatacaaaaattagatgggcatggtggtgggtgcctgtaatcccagctacttgggaggctgaggcagggaaaattgcttgaacctgggaggcggagctgggatgcggaggttgcagtgagccgagatcacaccactgcactccagcctgggtgacagggcgagcgagactccgtctcaaaaaaaaaaaaaaggaagagaaagaaagagatgaaggaagagtgagagaactaagagggcgggtggctggagggggatgggcaggaggggcgcaggagggagcagtcagacctccagtttgcaggagactgagcaggcctagcccagggccctggctgtcgtgatggaggaggggacctccaggtgacccacaaaagaggctgagtcacaggccttgttcttaactgaaaacatgggctgagggagagcagagagttgaaatggctggaggagcagcagtgggtgttggagaggctgtgacccctgttttggagtttgaggggtctgggggatggccgtacaatgcagaggagtgttctggacagaagcttaaatgttgggaatcaccggcaccgggaaccaagagggtgcaccctgcccaggaaaggttagactaccaggctgggaggtcccaagaaaccctaggtgtcacttaggggagagggtgctgtaactcaggctcacccccactcagcccgggctggcaatggctggctggagagccagagggtaggagatgtggggctctcaggtttcacagctctcatttctcccaccccgcctggcagggtctagctaggctctggcaaagaatcagaacataacactgggactggctccgatgagtaacccaatgccaggctggttggagtgggaacctgggctccccacccccatgaagctactcctcacttctgagcatggcttgcctgcttgcccctgcccactcccaagcctttatccacgctgtcccctccacctggaatgcctcctctgggccccactgggcaaaacccgacctatcttcccaaggcctgctcaagtgctgtatcgtttctggactttgtcccccttccctgctggcctcccactgcccactagtgcccttccctagaacacactccaccacctgcctctatcacaagggccacacactggaggtgagagtctgtctctgagtgtctgagactgagtgccttgggaacaaaaagcacacatggcccagcccagcccactcccaactaaagaagtgagcctaggagtcaagattcgaaatcctgtgtgagccctgaatggctcctcagcctctgtttacacgtctgtaaaatgggctaataatccacctcactgtgatgatcaagtgagttgatgcgtagagggcatcaattactgtgcctggtacacagcaggtgctccataaatgcgtctcccctcttccttcccagggcctcacctggggagctgagaaatccattactgacaactagggcttctaggaggagaaggggcctttgttttaccttcacccacatcagaggacccacacttcacacctgctttccttcacagccaaagtaagcactgatgaaggcaacaagtgcctatggagaccctgttggtgttcctcctgcccagttacacaggccacaacacaatcctgccccctccgcctggggagtcaggggagaggcatcagatgtgggacttgaagggtgaaagagatcctctggaggggggaaaggcatccaggcccaggaaatggcatgggcagagggagagagggagggaggaatgagcctggtgagctggagcaactgcaaatggttttaaggcggctgccatgcagagggcagggaagggacctggggagactgaggctgcagagataagctgagcaattggccagggctccgggtaagccaaggggttgggcttcatcctgcaaccacagcgaagtttttacctgggtgggacggtattgggattccagatctggaaagctggctctggaggcaggaaaacctagaaaggtctaaggaggtggctactgagggcctaagggagctgggagaggtggccctggaaggctgctaccgggcttgcgttcttgctccagttatctccatgctggggtcagaaggagcgaaccccagccgataaacaagacagtcccaagggaagactgcatgtggggactgatgcaccccactcctagaccagacaggacgccagctctcatttctgctttacagagactcgctctcctgggctccttcctggggctggggggcagggagcggggagggcggtcctccgtccagcctagtttactgactccctctccgggccagatgggcgctggaatgggtggctggagaggggttcgggtcctgcctagggcgagagtagctggagagaggcgcgcctgagaggttcttccaactggaaagagctcttattccaccggtggggaaactgaggcacggcgaggggaagtcaccggcccaaggtcacgcgtcgagctgaaggcagaggcagggtttgaacctgggagagctggctctcgggaggcctcggccagcgaccgagaaaagggaggggcggcggggcggcggggcctgtgttgggggccgggcgcgccgagctcacctggtagttgtctagctgctcttcggtgaagatggtctgcttgttccccatggtggccgccgcgccgccgctcgcccgcccgggctccgactcccatcagcggccgccagacccggagccagcgccccgtgcccgcggccctcggcagccccgcggctggcagcggcccacggtggccggacccttcccgccccgcagctcgcctggaggaggcgcgcgggggtctcggaggcggggacgggaacccggagcggcagcgactccgccgccggcgggaagagggcggggcacccggctccgcggctgcagcgcgcccgggtcccggcaggaggcgacctggccccgggagacgctgcccggcacgaacccttggctcccgcggccggaagtgctgggggcgcgcgggggtctcggaggcggggacaaagacccggagcggcggcgactccgccccgcagcaggaagaggtgtgagcccgggtcccgccgtgggagtccaggtcgcacggcgtgagggtgcggggcctgggaaaaaaccctctcgaggcgggcagtggggcgagtggcgccccttgacctggggcgggggcggcagcgaggactgtgagtgcgtggatctagctggggccgggctccgccaccgtctcgcgtcgcgaccttggtcaagcccttacccgggccctgtccctctggggagaaggagggggtcagtcaagctgacatctgaggccctcccggccaggcctcgggaagcccatctggcctttgggcgcggcctaggcagggcatctcagaccttctgtgttccttagggagcaggacaggatttacttggcttggttacaaacgtgagacttgagaggatttaaaggacttgactgtgtccacagaagtgtgacaaaggccaagacattttttggagcttttaagcagatgccattgtaagggaagcaggactttacctctgccctcctagggtctttggctgggcttgagaattaatttggcataagacagattaaggggagaaaaacagatttaatacaagttttacatgacgtggaagccctcataaggaaatgaagaccctgagaactggcaaaatctaaatacttttttttttttttgagatggagtctccctctgtcgcccaggctggagtgcagtagcgcgatcttggctcgctacaacctccgcctcctgggttcaagcgattcttctgcctcagcctcccctagtaggtgggactacaggggcatgccaccacacccagctaatttttttttgtatttttagtagagagaggtttcaccatgttggctgggctggtctcgaaatcttgacctcaggtgatccacctgcctcagcctcccgaagtgctaggattagaggcctgagtcaccacgcccggccaattattgtattttttttgtagagatggggttttgccgtgttgcccaggctggttttgaattcccaggctcgagcaatccacccactttggcttctcacccaaagtgctgggattataggatgtgagccatcatgcccggcctcatctcctgttttttagaaaaagaaggatgatcaagagtgcccttcttgcatctgctatttttcaagtgcctttaactcaaatactcaatatgccagagcagcatatgttgtggtggcatgttctgaactccttccccatccaccaaatggagtcaccgctatctttttggggtccagcccatacaactgttatttctaaactcaggacaactgaatcagtaggtattatctccatattataggcaaagagttgggctgagagaggttcagtaacttgcccagggtcccacagctgggaattagtagaacctggactggacccaggcactggctcaacataccattccacaactgccagtggactttgaagagatcaggatttttttttatttatatatataaaaaaaaatagagatggagtctcactatgttgtccaggctggtctccaactcccaggttcaagtgatccttctgccttggcctcccaaagtactaggattacaggcgtgagccaccatgcctgggcgagatcaagactttatgctttaaaatgcgtggtttgttactttaggatagtggttctgaaaccacctgggagcatgtatcaaaattacttgggaggctgcacccctagattttctgatttagaaggtctggggtggctaagaatgtgggtatcgaaagggttcctgggtgacactgatgcagctggtcttggaaccatactttgagagtgcttaggctgctgaagcttgtgggttctgatgggaacagggcttcaagtttggcagatgatccctcatgcttttagttttcttttatatctgaggctactggttggggttttccaaccttattttgccactccctggtgagaacagcagccatcagctaaacagacatgtcaccctgttaaaatcacaagagtcttcagaggcaccatcaattgctatcagaggggtaagaagcaattcattagcctggggattggtgaccagccttcaggggtcacctcaccatcttttcatcattgtggacacatgcaataggggcctaacccatgggaaagaaggcaggatgtgtccccagagatttggagcatgtggaattttagagcagagaaggcacatttaaaagattctctcttctgtacctcccctttttcctgtgttggagttggggaaaaggaaacccttttgaaaccacataaccactattacacaagttttccttcttcccatcttattagattccacactgtgcatgaacaagccagaattctgtgtgttcagatcctgctctggcgcattcttgtacaattgctaacatgctgcttatttgcataccaggtgttccaggtagaaaatctggaacctatacaaagaggactgtgttttcagtcccgggagcccttcctctcataggagagaaatagaggtaaccaactgaactagaaaattcctctcaaaaatccttttaggccaggtgcggtggctcacacctgtaatcccaacactttgggaggccgacacagacggatcacctgaggtcaggagtttgagaccagcctggtcaacatggcgaaaccctgtctctgctaaaaatacaaaaaattggcctggcgtggtggcgtgcctgtagtcccagctactcaggaggctgaggcaggaggatcacttgaacccgagaggcagaggttgctgtgagccaagatcgtgccattgcactccagccggggcgacaagagcgaaactccatctcaaaaaaaaaaaaaaatctttttggatcattattaccatggcctatctgaagctctctctcttgagcaatgctgtgaggaggggcaaggaacacaattcccatgttacagataagaaacctggggctcagagaggccaaatgacttgcctgatgccccccagctgggaagtggcaaagcaaagctctaacgtcgttctctgattccaaatcctgtgctttagctgctccctgatgttgagtgtggtccctgaggagcagagtgtgtgtgtttgctgggagggaggatgggccgagggagaagaataaaacattactgattacttatctagtgcccagaattgtactggatgtgctatatttactgaatttgattattccacaatagcctcctcagtctgtggagtttcatattattatcccatttcacaggtgaagaaatagtttcagagaaggtgacttgcccaaggtcacatagctggtaacaggtagatttaaatctgggccctgactcttttcttttcttttttctttttttttttttttttttttgagacagtcttactctgtcgcccaggggcatgatctcagctcactgcaacctctgcctcccgggtttaagtgattcttctgcctcagcctcctgagtagctgggactacaggtgggagccaccacacccagctaatttttgtatttttaatagagacggtgtttcaccatgttggccaggctggtctcgaactcctgacctcctcagcctcccaaagttgggattacaggcatgagccaccgtgccctgccggactcttctcttgatcacacagtctaggacagggaaacgtggttaccagtgtttaaagggggctgactccttgtcaattgcagtcttgtaaataatgtaaaaggaaaaggcagcaggggtgccagatactcattaaatgttagcttattttttttcatttctgattcacacaatgaagtttattttaaaatttggaaggaaaacaggaataaatgctaccaagtgcttctttgggatgagaggtcatcttgacctgctgcccaagtgctcgtttgtgatgatgatgcactttgtgatcaagatgacctctcatcccagagaagccttgtagcatttactgcagaacaactcaatctgcaagttgttcttctaagacttagaatctagatagatctttttgtttgtttgtttttgttttgttttgtttttttgagacggagtctcgctctgtcgcccaggctggagtgcagtggcgcgatcttggctcactgcaagctccgcctcctgggttcctgccattctcctgcctcagcctcttaagtagctgggactgcaggcgcctgccaccatgcccagctatttttttgtatttttagtagagacggggtttcactgtgttagccaggatggtcttgatctcctgaccctgtgatccgcccgtctcagcctgaatctaggtagatcttaatgacagagatggaagatccctgggcccaaggtctgggtgggaccatctcttaaagtaaacgaagcctgcagcctgtcttctagcagctctgtgggccctgtgagtcattccccagtcctccactcaaatcctttactatcccacctctactttttatcagctcaggaccccacctgctatcttggctcatgggaatcttctctatcttaggggcaattcaaatcttactcttatctttacctataaagcattgtcatcttggcgtcttccctgacatggctgtgatttatagtgtgtgagcagttactaggtctgcctcagtctctctctctttctctctctctccctctctctctcacacacacataccctgcaaccccttgtttaacctggcctatatcctagcactgaacagcttgtctctgtttctctagcattttgcacatagtaggttcttaatgagtatttggtggataaataaatacacaccctgggactgtttttttttttgtcctgaggagggttatttttccctctcaaacactaagaaacaggagggctgggaccagggctgggaccacatgttcgtctgtatccccagacacagaggaatctcccagggtctagcacatggtcttagcaaatgtaaaatcaacaccctttaaaagagtacattttcctggacctgttcatacatttaatcaactagatccccaaatattctgacttgaaaaagattttcttactggaggatttagtgaccagtcgtttagcgcagagccaacagaatgaaacccctttctctcttccgggagactgacctgccctagagccttccccagaagctactctggatgtgagaagttactggatggctcaaatgggaccccagctggatggcgactgtcctgttgttgagggaggagggggtcaatttcctccacaaatctgcttcttctggatcgtgtcccacccacctcttggatgcctttgacatctttggaggcacccttgatttctctccttccctcagacccctcagtccattagcacagccagtcatatctagaagccagccacttcttagcactccattgctatcactgtggtccacgcccccctcacctctctcctgttatggccgtatctatcatgaaatgacctaaaccaattcatccacaactaggttcattttactgcagatctcagtaatctccagtaatgagtggtaggtaggggtgttgtgtttccttccacaaaccttgctatgagggggtctgaggcaagcaagtctcagactgaagtccacaccttgtaccatcacttatcagcaagcaggtccccaacagtcatataaccttctctatgagctcaatgaaggcctagctccctgaccttttgcatatttcaataaactttcctcttgaaagatttagttcaggctgggtgcagtgctcatgcctataatcccagtaccttgggaggctgaggcaggaggatcacttgagctcaggagtttgagaccagcctgggcaacatagtgagaaccccatctctaaaaaaaatacaaaaaatagctggacgtggtggcacacgcctgtagtcccaactactcaggaggctgaggtgggaagatcacttgagcctgaggggttgaggccgcagtgagctgagattgcaccactgcactccagcctgagcaacagagtgagactctgtctcagaaaataggggggagggatttcattcaaggaagttgcaaacaatatttaaggagcaagatttgaacaaccttcaatttgggatcaggcaactgcattcttactcagaagcttgaacctgaccagacggactcctaagacctagaccccatcaaaactccctaggtttttgtgtcctgtctgtctgtgtaagggcagaggtacttggacaacccttcacatatctaaaataccactcatttgatcaatggacaattatttcagccatccattttgctaatgaacagaccctctgctgctggaatggcatcaagacagctgaagcccttgtggaagggtctctggagtgtgggcttctgggtaaagtcccaactgcttctagaatggcctctctcaaagtgtgatcgtgggtctcctggggtctctgggatcttttcagagagtctgcaagggcaacaatatctcataataatactgagacattatttgcctttttcattctcattttctcacaagtgtagagtgaagatttccagaagttatatgggtatgtgatattgcaacaggttgaatgaagaagcaaatgtgagaatccagcagttttctattttgtttttgtttttttgagacagagtctcgctctgtcacccaggctggagtgcagtggtgtgatctctgctccctgcaagctctgcctcccgggttcatgccattctcctgcctcagactcccgcccggctaatttttttgtatttttagtagacacagggtttcaccatgttagccaggatggtctcgatctcctgacctcgtgatccgcctgcctcagcctcccaaagtgctgggattacaggtgtgagccactgtgcccagcccgagcagttttctattaagccaagctctaaagacatttgcaagcatgtaaaacaatgccactcttctcaataaatatttttgtcttcaaatatatgattatttttcataaaagtctgttaactaagccaacatataatggttttgtctttgcagtgggtaggaagaacccatcgggtgattacacttgccaagctttcagtatcagagaggaaggtgggggtgtccgtagggtgaaaatagcaccccaaatgtcttagatcctcatactttttttttgagatggagtctcactctgccacccaggctggagtgtagtgatgtaatctcggctcactgcaaccttggcctctcaggttcaagcaattcttatgcctcagcctcctgagtagctaggactacaggcgcccaccaccatgcccagctaatttttttttttttttgtattttttttgtattttttttttttgtagagctagggtttcaccatgttggccaagctggtcttgaactccttacctcaggtgatccgcccacctcggcctcccaaagtgctgggattacaggcgtgagccaccgcaactggccagatcctcatactttttaagaacaggctgctttcatcatcaagaggagctcttcatcacacttaaggtggttctgcaagacctctgggagaatcccagtgagctggggtccctgtgtctgtagaggcctggcatcatggtttacacaaaaggaacaaaagaaactacctgggaatcccttaacccttcccaagctctatcaactcaggtcacattgatgtctctgaagcatcttgtcataatatgaactgtcttccagagctatctttgtggctctcccaggctactatgggttcctcagaggcaggccctgaatgattagatgttcatttctgtgtttggaggattgttgggaagtttgtgtagggagggttctcatttaatcagtttccctgcatcttctgatctgatcagcccaggagaatgggagcttcagcaggtctgtgtgaccgcaaccattcttgtgttgctataaagaaatacctgagactgggtaatttataaagaggtttaattggttcatggttctgcaggctgtgcaggaaacatggcttctgatgaggcctcaggaagcttttattctcggcagaaggtgaaacagcagcttgcgtaacacaggtggaaagcaggagcaagggggaggtgccatacacttttaaatgaccagatcgcactataactcactatcacaaagacagcaccaagccatgggggacctggccccaaacaccttccaccaggccccacctctagcattggggattacacttcaacatgagatttgggcggggacaaatatccaaagtatatcaaagtcttttgtcattctattagcttcagcttactcaaacatctttaaagatgttataaggtgtcacattaatcagagagtcttctgaattctccgtgggagtgttaataactccattttacaggtgagagaatggaaggtcaaattcacacatctggagagtgtcaatgtgagaactgggacccaggtttgcctggaggatcttccactattgccctggcacctatactgagaataaatgttgtccctttgaaaggggcagctagttcctttgttcaccccagagactatgagaataggctttcaagtatttactccattaaccttgcagcccaaggctcagctactccaggaagagagagggactgggagtcagtatctgctttgagggaagttttatcactttttatagcaacctctgaacttgacccatggacttaggcagatagagcaaagccagtccctgcagtataaacagatgggagataagtcaggtcaatttgatttgatcaacacccctgattgcatttatttccttatttctaggctggctccagagatgctatccccaaatgggcctctggaggacaaatcttttggtgaacattcattaagcaaaataatgcacttatgagtaaagcacatggtgacttggatggtgtgccattacctccccaggacagagtccaaactgcttgccatgataggtgcatgtggtctggatcctgcctttccccacttcttcccacctggccctttgttcctggtatcctttctgcctggcactccttttccttcccttctttctgtttggaaaattggcctcccttaagtcttgtctgcttgtaacaatctctgctttaacccccatgacactctcatctcccctagttcttgaggtaccccaggcttagaggacccacagaccctggaatccatattacagcatttgtttcagtggattgggatcaactgtttgaatatttaccctctagatcagtgttcgtatgggagggatactgctccctaaggaatgttttgagctgtatgggtgttttgtggatgcaatgacaagagggtactatttccacttagtgcctgggttttggggatgctgatgttctgtaatgccgggacaatcctgcccactggagaatgtctcatgtcctgcaggaccttgaggagatcaaccagatactcctgtaggaaacaaacctgtttataatgacctgagcttggaacccaactctgttttataaataaactcctttttgtgtgatcttaacatatgttcagttatccaggaatgcaaatcaagggaagactaaaatttactttgttcaaaactttaacaagactcgatcaccattttggaggtaacatcggagatggcaacgtgacttgtgattgagaaagaagaaattaacccagatgcctgtggcaactaagaattttgcttgatgtggcctggtgcagcagctcatgcctgtaatcccaacactttaggaggctgaggcgggaggattgcttgagcccaggagttccagactagcctgagcaacatagcaagaccctatctctacaaaaaattaaaaagttagctgggagtggtggctcatgactgcattcccagctacttgggaggctgaagtaggaggattgcttgaccctgtctcaaaaaaaagaaagaaaaagaattttgcttgaccccatacaacacacctgtattcatctgcatttgtgaacgtcaccatcactgtgattcatggtctattaacatctacttttttagctcttatttttaaatgtcaaagataaaaactgtggcctgaatattatcatacctctctcaaatccaaacttacttgttataagtaggtgcaagcatgtgactgcttcataatgtcttttagagtttaggcctgagcatttatgtattgaaacccattattttattacagtattccttttatttctctttcatattacagtagcagcattatattgattttgttttttcattatgtgtataagtggtttagattatccatgaatttcgtttcagtatggtaaagaggatattcaaaatatttgttataaaaagggagcatctggcagcattgagaaccactctaaggttcaggaggcagggacttcgcctcccctgggttactccattcttctttgtgcctagcatagggcctggaatatcacagatgcacaaagaatcttttctgaatgagtgatgaaggaattgaggctgatactctggtttggtaaccacctaggtatgtgatgaggccctctgctgagatgggaacacaggagagagggcaggttttggggagagtaatgagttcagttttcattgtgaaagtttggagagccctggaatttctaggtggagaggcctgaggcccagggctgtgtgggccttgatttctctcaaggccacagaagagtggaaagtgcaaagtcgtagtaacagttcatctctttagtcagtaatcattgctgagtctctccatgcaggatgaatagaccagtgagagctgcccatgaggtgtctccctcctcctgtggtgatctgtgtacctgcccaggccctcagaggctaggagctcctccaaggtaggggatagaaatccttcatctctagcccctctgacttcctgccccatcctgacatagtaggtggctcggcaatgatagctggagggaccacgcagtaaaacccatctgtggaaacacatgtattcagagcaactttttttggcctgaagtcactgcagtggaacatttgggagcaagtttccccagggcccagctccttcccgctaggctctgccatgcctcctgtttattaacagggaggcgtgacaaagggaaaaatctcctgattgaagactcatctcagacatcttttcactcctctagggaagggtgcaattctgggctttaatgacatatgacggggcaggcagtagaggtgttgcgcattttaggcaatacatgtgctgctagaaagttgaggtatagggactttttaggaacacaatttttattgacaagtaacctttcaagaacaataaagaaaatcagaaagaaaacctatgttcatagcagcatcattcataatagcgaaaacaactcaaatggccatcaactgacgaacgtatgaataaaatgtggtctattcatgtgatggaatataacttgaccgtcatgaggaatgaaggactgatgcatgctatgatatggataagtcttgaaaacatcatgctaaatgaaagaagccagacacaagagaccagatattttatgactccgtttatatgaaatgcccagagtaggtgaatacattgggatgtaaaagagattggtggttgccagggtctgggagaggggagatggggagtggctgatggaacaagccatatggaaaagcattccaggcattgggagcagtaagtgcaaaggccctgcagtgggaggaagcatggccgattaaagaacagcaaggaggtaggtcggcttcaagggagacagtggtgggggagaagctcagagaggggctagcaggactagaccctttagggctttatggggcactgccagggcattgccttttacttggagagagacaggatgtcgctggcagctttgggcagagaaggatgtatctgtcttatgtttgaacacaatccctctggcaggagatggattttaaggggtagaagtagggaagccagtttgggggccactgtgttggttcaggcaagaggtaactctgacttggaccctggtggcagcagctgccaaggggaaaagtgtccaaaactgaacctattttgaaaacagctcatcttcaggcttttggcctcagcaactagaaggctggagttgaattttattgggtgggggaattctgtgggagggagcaggtttccttctactctttgttcacatataaaaagaagttataagagaacatagataatagtttaaatttttatttttttctgaacattcaaccataaacatttatcaagatgctaaagtcttcataatactcactttaaaaatgttttttttggccaggcgcggtcgctcatgcctgtaatcccagcacttgggaggccgaggcaggcggatcacgaggtcaggagatcaagaccaccctggctaacatggtgaaaccctgtctctactaaaaatacaaaaaattagctgagcatggtggcgggcgcctgtagttccagctacttgggaggctgaggcaggagaatggcatgaacgcaggagaatggcgtgaacccaggaggcggagcttgcagtgagccaagacagcgccactgcactccagcctgggcgacagagccagactccatctcaaaaaaaaaaattattttttaattttatttttagagataaggtcttcctctgtcatccaggctggagtgcagtggtgcaatcatggctcactgtagcctctaactcctgggctcaagtgagccttccacctcagcctcccaagtggctgggactacaggtacatgccaccatgcctggctaaatttttatattttgtagagactatgtcttgctatgttgcccaggctggtcttcaactcctggcctcaagtgatcacctcggcctcccaaagtgctgggattgcagatgtgaaccaccatgccaggccattgatcacttttgaaggctgcatgatggtccacttcattcatttcccctaaattacataaccatttcttctgttaatcatttagactgcttttttctctttttagttttcaaaattaaggataattgtataatgaatatctttgtgttgatggctttttctttctggatttttttccccaagagtttaattctcaggaatggatttactaggtgaaagagtaagaacagttaatgtctctcttaagacacattgctaaactgttttccaaagagattgtggaaatgtataaggccagccaagcagtgcgccataaattggatggtataaggcattgcattttattaatatttttaaataaaaataattttttttagaaatttgcatgcatttgactattgttaagattgaacatttatttaaaagtttatttggctgtgaattgattattcaggtccttttcccgttttgttttgtttttttttttcccgagacggagtcttactcagtcacccaggctggagtgcagtggtgtgatctcgcctcactgcaacttccacctcccaggttcaagtgattctcctgcctcagcctccccagtagctgggactacaggtgtgcaccaccatgcctccctaagttttgtatttttagtagagagggggttttactatgttaaccaggctggtcttgacctcctgaccttgtgatctgcccgcctcggcctccaaaagtgctgggattacaggaatgagccaccatgcccggcctatgttttttgttttgttttgtttgagacagagtcttactctgtcgcccaggctggagtgcagtggcacgatctcggctcactgcaacctcggcctcccaggttcaagcagttctctgcctcagcctcctttgtagctgggattacaggtacccgccaccacgcccagctaattttttgtatttttagtagagacaggctttcaccatcttggccaggctggtcttgaactccggacctcgtgatccacccacctctgcctcccaaagtgctgggattacaggcgtgagccaccgcgcccagtccccttttcccatttatttactaaagtcctaataccttctttaccaatttgttggatcttttcctaacttagagatagggatgaaccctttgccaatcatatctttaatgaaaataatattttaaataaagtaggaaaactgttgaaatgaatttcttttgtaacaaaaaataaacatttggtatgtgaataatgtatattctgttttgctgatttattcacttaaaaattgctatcttgattttattatttatttatttgacacagagtctcgctctgtcacccaggttggagtgcagtggtgcgatcttggatcactgcaatctccgcctcccaggttcaagtgattctcctgcctcagcgtcctgagtagctgggactacagatgcacaccaccacccctggctaatttttgttacttttaggagagatggggtttcaccatattggccaggctggtctcaaactcctgacctcaggcgatccacccacctctgcctcccaaagtgctgcgattacaggagtgagccaccgcacctggcctcttgattttaaaatctttttttttttccttagagtgaagcacacctggattggatagtgcttgttattacagataagggtgcactttctagattcttctcctgagtggcaaagttttcccaccgtcttgtccaaacatactttgctgatggtatctctgggcactacacagtgcaagggacaaggaaaaagggcttttccagaggagagtgacctgcatcttggaggaactctagaacatgttcgaggaatggtgactggggcttctggagccaagggctgactcagggaacagatctcagctcaaggtgaggtcatttctgtttcctgcatgtccctccagctgctgacattttacctcttcaaggactgattcaaatgccatctccattgtgcaatcttccttgatcaccccccaacttccatctgagacttctgagtttctccctcactagatctggagggtaggagtgggtcttgttcattttttgttctcacagtgcacttgctagagaatggcttgggaagcctttgtaggattggactggccctcagcgaaagttcagcagttaggagaactgccttagtacttaggaagcttcctagtgtgaatgccagcatcatcacttactagctgtacttcagttttctcatagggttgttgtgaagattaaatgaagactggacaaagtcagtcaatgtttatttcacaatcactgagcagcaagtattccttgtgtaccagtctctgttccagaaacaacgtcataagagatcatcaagattatctctggacttaaggcatatcttctctctatctcttttgagacagagtctcgctctgtcacccagactggagtgcagtggcatgatctcggctcactgcaacctctgcctcgtgggttcaagcgattctgatgcctcagtctcctgagtcactgggatta

SEQ ID NO: 2449 - DNA, 17639 bp, Homo sapiens
acaaacagagccatgaccactgtacaccagccactccatgtcctgcgtctgctgtgtattcctatacttatacacagcaggtgcttaatacaggcttgtgggatgagtgaccagacttttccatctatgccttccacagcagttacgttatttcagtggctgcagagtccctgcctagtcttaatctttcttctctttctgaacatttagtaacacctatttcttggttttaacatcactgacaaaactgccatgaacctgctcatcaactgatgtttcactttttcttctgttcacttgtttccctgggactcaccccaaggaggcagtgcacaggtagtgaatatggcaggtgttcttaaaagcttctcagggctcagggtggcctagaagtgtggcaggggaaaaggtttggtagtcagggtcaaattctagtctagcttcagacccttaggcaagtcattctcctttctgagcctcagtttctgcatctgtaaagtggaaataggcctctctgaaggggacagtgtgaagagcaaatgagataaggtacaggaagtctataggccccagctgataggaaagagtacaacagctccatccaccacccaggtcccaaaggcatctccccagagtcggtagctctgctgtctttcccttctctggagtcaccaaacaccctgcccaccactacaccctcagctgccctgggagctacagccctatgtctgaaggaaccctttcttacacttttggagagcaagtgccccatcactgcttggttcctgacagtacacagggacacagggacaggtcttccggcaaaggtcaggtctgggtcatgaggagtggaagggagggaaggagagagggggcctaacccaggagtgatgggctctcagaacattggcagcagaaaacaggacaggctgggcttttacagtagaagcccagacgttttcccagttaaggcttgagttctgcctccgagcctatattcaccctattccccaactggagtgccctctcctctttctccaggttgtccaaaccctttctccaaagctcaactcaagggtgacttgttccaggtaacccacctgcctcccatctcctacatgcctggtctgcctgtgccagctgtcaggagccgagccatgggccctcccagctctaatggaaatggctctccatccagctctgccagctcaggcctcagcactgcccaggggaccatcacacggctcaaggtcagtctccagtgatcttagttgatccccacaagaaccctgtgacatgagcacagctgggttagtagttcccattttagaggtggagacacttaggcccagaagggaacagtggcttgctaaggcccacagcatcaactacccagctgacttgaatctagggcttcagaatctttgtctagagttctttgctctcctggagccacgccttaacaaatatttgttcattcatttgacaacatcctccaaacatctcttttgtgcctggacagaggccatacaagaaggaagctggagtgtaaacagtgaggtgcccagtataaaccattctgtggccacacaagggactggggatgtatatgtgtcaggctccctgagtactcccagctgaatggattggtggagagagagtcagggagcccgtcccaaagaggtgaggcctggcctggacagaaagatgggccagactaggttagcaaaggagcagggagagcagcaggagaacaagggccagaggtgagggagggcttggctagaagcccttcagtgtgcctaaaactttgggtgcaaagggaaagggagtaagaaatgaggctggaggcccggcgcggtggctcacacctgtaatcccaacactctgggaggccaaggcaggtggatcacctgaggtcaggagtttgagaccagcctggccaacatggcaaaaccctgtttttactaaaaatacaaaaattagatgggcatggtggtgggtgcctgtaatcccagctacttgggaggctgaggcagggaaaattgcttgaacctgggaggcggagctgggatgcggaggttgcagtgagccgagatcacaccactgcactccagcctgggtgacagggcgagcgagactccgtctcaaaaaaaaaaaaaaggaagagaaagaaagagatgaaggaagagtgagagaactaagagggcgggtggctggagggggatgggcaggaggggcgcaggagggagcagtcagacctccagtttgcaggagactgagcaggcctagcccagggccctggctgtcgtgatggaggaggggacctccaggtgacccacaaaagaggctgagtcacaggccttgttcttaactgaaaacatgggctgagggagagcagagagttgaaatggctggaggagcagcagtgggtgttggagaggctgtgacccctgttttggagtttgaggggtctgggggatggccgtacaatgcagaggagtgttctggacagaagcttaaatgttgggaatcaccggcaccgggaaccaagagggtgcaccctgcccaggaaaggttagactaccaggctgggaggtcccaagaaaccctaggtgtcacttaggggagagggtgctgtaactcaggctcacccccactcagcccgggctggcaatggctggctggagagccagagggtaggagatgtggggctctcaggtttcacagctctcatttctcccaccccgcctggcagggtctagctaggctctggcaaagaatcagaacataacactgggactggctccgatgagtaacccaatgccaggctggttggagtgggaacctgggctccccacccccatgaagctactcctcacttctgagcatggcttgcctgcttgcccctgcccactcccaagcctttatccacgctgtcccctccacctggaatgcctcctctgggccccactgggcaaaacccgacctatcttcccaaggcctgctcaagtgctgtatcgtttctggactttgtcccccttccctgctggcctcccactgcccactagtgcccttccctagaacacactccaccacctgcctctatcacaagggccacacactggaggtgagagtctgtctctgagtgtctgagactgagtgccttgggaacaaaaagcacacatggcccagcccagcccactcccaactaaagaagtgagcctaggagtcaagattcgaaatcctgtgtgagccctgaatggctcctcagcctctgtttacacgtctgtaaaatgggctaataatccacctcactgtgatgatcaagtgagttgatgcgtagagggcatcaattactgtgcctggtacacagcaggtgctccataaatgcgtctcccctcttccttcccagggcctcacctggggagctgagaaatccattactgacaactagggcttctaggaggagaaggggcctttgttttaccttcacccacatcagaggacccacacttcacacctgctttccttcacagccaaagtaagcactgatgaaggcaacaagtgcctatggagaccctgttggtgttcctcctgcccagttacacaggccacaacacaatcctgccccctccgcctggggagtcaggggagaggcatcagatgtgggacttgaagggtgaaagagatcctctggaggggggaaaggcatccaggcccaggaaatggcatgggcagagggagagagggagggaggaatgagcctggtgagctggagcaactgcaaatggttttaaggcggctgccatgcagagggcagggaagggacctggggagactgaggctgcagagataagctgagcaattggccagggctccgggtaagccaaggggttgggcttcatcctgcaaccacagcgaagtttttacctgggtgggacggtattgggattccagatctggaaagctggctctggaggcaggaaaacctagaaaggtctaaggaggtggctactgagggcctaagggagctgggagaggtggccctggaaggctgctaccgggcttgcgttcttgctccagttatctccatgctggggtcagaaggagcgaaccccagccgataaacaagacagtcccaagggaagactgcatgtggggactgatgcaccccactcctagaccagacaggacgccagctctcatttctgctttacagagactcgctctcctgggctccttcctggggctggggggcagggagcggggagggcggtcctccgtccagcctagtttactgactccctctccgggccagatgggcgctggaatgggtggctggagaggggttcgggtcctgcctagggcgagagtagctggagagaggcgcgcctgagaggttcttccaactggaaagagctcttattccaccggtggggaaactgaggcacggcgaggggaagtcaccggcccaaggtcacgcgtcgagctgaaggcagaggcagggtttgaacctgggagagctggctctcgggaggcctcggccagcgaccgagaaaagggaggggcggcggggcggcggggcctgtgttgggggccgggcgcgccgagctcacctggtagttgtctagctgctcttcggtgaagatggtctgcttgttccccatggtggccgccgcgccgccgctcgcccgcccgggctccgactcccatcagcggccgccagacccggagccagcgccccgtgcccgcggccctcggcagccccgcggctggcagcggcccacggtggccggacccttcccgccccgcagctcgcctggaggaggcgcgcgggggtctcggaggcggggacgggaacccggagcggcagcgactccgccgccggcgggaagagggcggggcacccggctccgcggctgcagcgcgcccgggtcccggcaggaggcgacctggccccgggagacgctgcccggcacgaacccttggctcccgcggccggaagtgctgggggcgcgcgggggtctcggaggcggggacaaagacccggagcggcggcgactccgccccgcagcaggaagaggtgtgagcccgggtcccgccgtgggagtccaggtcgcacggcgtgagggtgcggggcctgggaaaaaaccctctcgaggcgggcagtggggcgagtggcgccccttgacctggggcgggggcggcagcgaggactgtgagtgcgtggatctagctggggccgggctccgccaccgtctcgcgtcgcgaccttggtcaagcccttacccgggccctgtccctctggggagaaggagggggtcagtcaagctgacatctgaggccctcccggccaggcctcgggaagcccatctggcctttgggcgcggcctaggcagggcatctcagaccttctgtgttccttagggagcaggacaggatttacttggcttggttacaaacgtgagacttgagaggatttaaaggacttgactgtgtccacagaagtgtgacaaaggccaagacattttttggagcttttaagcagatgccattgtaagggaagcaggactttacctctgccctcctagggtctttggctgggcttgagaattaatttggcataagacagattaaggggagaaaaacagatttaatacaagttttacatgacgtggaagccctcataaggaaatgaagaccctgagaactggcaaaatctaaatacttttttttttttttgagatggagtctccctctgtcgcccaggctggagtgcagtagcgcgatcttggctcgctacaacctccgcctcctgggttcaagcgattcttctgcctcagcctcccctagtaggtgggactacaggggcatgccaccacacccagctaatttttttttgtatttttagtagagagaggtttcaccatgttggctgggctggtctcgaaatcttgacctcaggtgatccacctgcctcagcctcccgaagtgctaggattagaggcctgagtcaccacgcccggccaattattgtattttttttgtagagatggggttttgccgtgttgcccaggctggttttgaattcccaggctcgagcaatccacccactttggcttctcacccaaagtgctgggattataggatgtgagccatcatgcccggcctcatctcctgttttttagaaaaagaaggatgatcaagagtgcccttcttgcatctgctatttttcaagtgcctttaactcaaatactcaatatgccagagcagcatatgttgtggtggcatgttctgaactccttccccatccaccaaatggagtcaccgctatctttttggggtccagcccatacaactgttatttctaaactcaggacaactgaatcagtaggtattatctccatattataggcaaagagttgggctgagagaggttcagtaacttgcccagggtcccacagctgggaattagtagaacctggactggacccaggcactggctcaacataccattccacaactgccagtggactttgaagagatcaggatttttttttatttatatatataaaaaaaaatagagatggagtctcactatgttgtccaggctggtctccaactcccaggttcaagtgatccttctgccttggcctcccaaagtactaggattacaggcgtgagccaccatgcctgggcgagatcaagactttatgctttaaaatgcgtggtttgttactttaggatagtggttctgaaaccacctgggagcatgtatcaaaattacttgggaggctgcacccctagattttctgatttagaaggtctggggtggctaagaatgtgggtatcgaaagggttcctgggtgacactgatgcagctggtcttggaaccatactttgagagtgcttaggctgctgaagcttgtgggttctgatgggaacagggcttcaagtttggcagatgatccctcatgcttttagttttcttttatatctgaggctactggttggggttttccaaccttattttgccactccctggtgagaacagcagccatcagctaaacagacatgtcaccctgttaaaatcacaagagtcttcagaggcaccatcaattgctatcagaggggtaagaagcaattcattagcctggggattggtgaccagccttcaggggtcacctcaccatcttttcatcattgtggacacatgcaataggggcctaacccatgggaaagaaggcaggatgtgtccccagagatttggagcatgtggaattttagagcagagaaggcacatttaaaagattctctcttctgtacctcccctttttcctgtgttggagttggggaaaaggaaacccttttgaaaccacataaccactattacacaagttttccttcttcccatcttattagattccacactgtgcatgaacaagccagaattctgtgtgttcagatcctgctctggcgcattcttgtacaattgctaacatgctgcttatttgcataccaggtgttccaggtagaaaatctggaacctatacaaagaggactgtgttttcagtcccgggagcccttcctctcataggagagaaatagaggtaaccaactgaactagaaaattcctctcaaaaatccttttaggccaggtgcggtggctcacacctgtaatcccaacactttgggaggccgacacagacggatcacctgaggtcaggagtttgagaccagcctggtcaacatggcgaaaccctgtctctgctaaaaatacaaaaaattggcctggcgtggtggcgtgcctgtagtcccagctactcaggaggctgaggcaggaggatcacttgaacccgagaggcagaggttgctgtgagccaagatcgtgccattgcactccagccggggcgacaagagcgaaactccatctcaaaaaaaaaaaaaaatctttttggatcattattaccatggcctatctgaagctctctctcttgagcaatgctgtgaggaggggcaaggaacacaattcccatgttacagataagaaacctggggctcagagaggccaaatgacttgcctgatgccccccagctgggaagtggcaaagcaaagctctaacgtcgttctctgattccaaatcctgtgctttagctgctccctgatgttgagtgtggtccctgaggagcagagtgtgtgtgtttgctgggagggaggatgggccgagggagaagaataaaacattactgattacttatctagtgcccagaattgtactggatgtgctatatttactgaatttgattattccacaatagcctcctcagtctgtggagtttcatattattatcccatttcacaggtgaagaaatagtttcagagaaggtgacttgcccaaggtcacatagctggtaacaggtagatttaaatctgggccctgactcttttcttttcttttttctttttttttttttttttttttgagacagtcttactctgtcgcccaggggcatgatctcagctcactgcaacctctgcctcccgggtttaagtgattcttctgcctcagcctcctgagtagctgggactacaggtgggagccaccacacccagctaatttttgtatttttaatagagacggtgtttcaccatgttggccaggctggtctcgaactcctgacctcctcagcctcccaaagttgggattacaggcatgagccaccgtgccctgccggactcttctcttgatcacacagtctaggacagggaaacgtggttaccagtgtttaaagggggctgactccttgtcaattgcagtcttgtaaataatgtaaaaggaaaaggcagcaggggtgccagatactcattaaatgttagcttattttttttcatttctgattcacacaatgaagtttattttaaaatttggaaggaaaacaggaataaatgctaccaagtgcttctttgggatgagaggtcatcttgacctgctgcccaagtgctcgtttgtgatgatgatgcactttgtgatcaagatgacctctcatcccagagaagccttgtagcatttactgcagaacaactcaatctgcaagttgttcttctaagacttagaatctagatagatctttttgtttgtttgtttttgttttgttttgtttttttgagacggagtctcgctctgtcgcccaggctggagtgcagtggcgcgatcttggctcactgcaagctccgcctcctgggttcctgccattctcctgcctcagcctcttaagtagctgggactgcaggcgcctgccaccatgcccagctatttttttgtatttttagtagagacggggtttcactgtgttagccaggatggtcttgatctcctgaccctgtgatccgcccgtctcagcctgaatctaggtagatcttaatgacagagatggaagatccctgggcccaaggtctgggtgggaccatctcttaaagtaaacgaagcctgcagcctgtcttctagcagctctgtgggccctgtgagtcattccccagtcctccactcaaatcctttactatcccacctctactttttatcagctcaggaccccacctgctatcttggctcatgggaatcttctctatcttaggggcaattcaaatcttactcttatctttacctataaagcattgtcatcttggcgtcttccctgacatggctgtgatttatagtgtgtgagcagttactaggtctgcctcagtctctctctctttctctctctctccctctctctctcacacacacataccctgcaaccccttgtttaacctggcctatatcctagcactgaacagcttgtctctgtttctctagcattttgcacatagtaggttcttaatgagtatttggtggataaataaatacacaccctgggactgtttttttttttgtcctgaggagggttatttttccctctcaaacactaagaaacaggagggctgggaccagggctgggaccacatgttcgtctgtatccccagacacagaggaatctcccagggtctagcacatggtcttagcaaatgtaaaatcaacaccctttaaaagagtacattttcctggacctgttcatacatttaatcaactagatccccaaatattctgacttgaaaaagattttcttactggaggatttagtgaccagtcgtttagcgcagagccaacagaatgaaacccctttctctcttccgggagactgacctgccctagagccttccccagaagctactctggatgtgagaagttactggatggctcaaatgggaccccagctggatggcgactgtcctgttgttgagggaggagggggtcaatttcctccacaaatctgcttcttctggatcgtgtcccacccacctcttggatgcctttgacatctttggaggcacccttgatttctctccttccctcagacccctcagtccattagcacagccagtcatatctagaagccagccacttcttagcactccattgctatcactgtggtccacgcccccctcacctctctcctgttatggccgtatctatcatgaaatgacctaaaccaattcatccacaactaggttcattttactgcagatctcagtaatctccagtaatgagtggtaggtaggggtgttgtgtttccttccacaaaccttgctatgagggggtctgaggcaagcaagtctcagactgaagtccacaccttgtaccatcacttatcagcaagcaggtccccaacagtcatataaccttctctatgagctcaatgaaggcctagctccctgaccttttgcatatttcaataaactttcctcttgaaagatttagttcaggctgggtgcagtgctcatgcctataatcccagtaccttgggaggctgaggcaggaggatcacttgagctcaggagtttgagaccagcctgggcaacatagtgagaaccccatctctaaaaaaaatacaaaaaatagctggacgtggtggcacacgcctgtagtcccaactactcaggaggctgaggtgggaagatcacttgagcctgaggggttgaggccgcagtgagctgagattgcaccactgcactccagcctgagcaacagagtgagactctgtctcagaaaataggggggagggatttcattcaaggaagttgcaaacaatatttaaggagcaagatttgaacaaccttcaatttgggatcaggcaactgcattcttactcagaagcttgaacctgaccagacggactcctaagacctagaccccatcaaaactccctaggtttttgtgtcctgtctgtctgtgtaagggcagaggtacttggacaacccttcacatatctaaaataccactcatttgatcaatggacaattatttcagccatccattttgctaatgaacagaccctctgctgctggaatggcatcaagacagctgaagcccttgtggaagggtctctggagtgtgggcttctgggtaaagtcccaactgcttctagaatggcctctctcaaagtgtgatcgtgggtctcctggggtctctgggatcttttcagagagtctgcaagggcaacaatatctcataataatactgagacattatttgcctttttcattctcattttctcacaagtgtagagtgaagatttccagaagttatatgggtatgtgatattgcaacaggttgaatgaagaagcaaatgtgagaatccagcagttttctattttgtttttgtttttttgagacagagtctcgctctgtcacccaggctggagtgcagtggtgtgatctctgctccctgcaagctctgcctcccgggttcatgccattctcctgcctcagactcccgcccggctaatttttttgtatttttagtagacacagggtttcaccatgttagccaggatggtctcgatctcctgacctcgtgatccgcctgcctcagcctcccaaagtgctgggattacaggtgtgagccactgtgcccagcccgagcagttttctattaagccaagctctaaagacatttgcaagcatgtaaaacaatgccactcttctcaataaatatttttgtcttcaaatatatgattatttttcataaaagtctgttaactaagccaacatataatggttttgtctttgcagtgggtaggaagaacccatcgggtgattacacttgccaagctttcagtatcagagaggaaggtgggggtgtccgtagggtgaaaatagcaccccaaatgtcttagatcctcatactttttttttgagatggagtctcactctgccacccaggctggagtgtagtgatgtaatctcggctcactgcaaccttggcctctcaggttcaagcaattcttatgcctcagcctcctgagtagctaggactacaggcgcccaccaccatgcccagctaatttttttttttttttgtattttttttgtattttttttttttgtagagctagggtttcaccatgttggccaagctggtcttgaactccttacctcaggtgatccgcccacctcggcctcccaaagtgctgggattacaggcgtgagccaccgcaactggccagatcctcatactttttaagaacaggctgctttcatcatcaagaggagctcttcatcacacttaaggtggttctgcaagacctctgggagaatcccagtgagctggggtccctgtgtctgtagaggcctggcatcatggtttacacaaaaggaacaaaagaaactacctgggaatcccttaacccttcccaagctctatcaactcaggtcacattgatgtctctgaagcatcttgtcataatatgaactgtcttccagagctatctttgtggctctcccaggctactatgggttcctcagaggcaggccctgaatgattagatgttcatttctgtgtttggaggattgttgggaagtttgtgtagggagggttctcatttaatcagtttccctgcatcttctgatctgatcagcccaggagaatgggagcttcagcaggtctgtgtgaccgcaaccattcttgtgttgctataaagaaatacctgagactgggtaatttataaagaggtttaattggttcatggttctgcaggctgtgcaggaaacatggcttctgatgaggcctcaggaagcttttattctcggcagaaggtgaaacagcagcttgcgtaacacaggtggaaagcaggagcaagggggaggtgccatacacttttaaatgaccagatcgcactataactcactatcacaaagacagcaccaagccatgggggacctggccccaaacaccttccaccaggccccacctctagcattggggattacacttcaacatgagatttgggcggggacaaatatccaaagtatatcaaagtcttttgtcattctattagcttcagcttactcaaacatctttaaagatgttataaggtgtcacattaatcagagagtcttctgaattctccgtgggagtgttaataactccattttacaggtgagagaatggaaggtcaaattcacacatctggagagtgtcaatgtgagaactgggacccaggtttgcctggaggatcttccactattgccctggcacctatactgagaataaatgttgtccctttgaaaggggcagctagttcctttgttcaccccagagactatgagaataggctttcaagtatttactccattaaccttgcagcccaaggctcagctactccaggaagagagagggactgggagtcagtatctgctttgagggaagttttatcactttttatagcaacctctgaacttgacccatggacttaggcagatagagcaaagccagtccctgcagtataaacagatgggagataagtcaggtcaatttgatttgatcaacacccctgattgcatttatttccttatttctaggctggctccagagatgctatccccaaatgggcctctggaggacaaatcttttggtgaacattcattaagcaaaataatgcacttatgagtaaagcacatggtgacttggatggtgtgccattacctccccaggacagagtccaaactgcttgccatgataggtgcatgtggtctggatcctgcctttccccacttcttcccacctggccctttgttcctggtatcctttctgcctggcactccttttccttcccttctttctgtttggaaaattggcctcccttaagtcttgtctgcttgtaacaatctctgctttaacccccatgacactctcatctcccctagttcttgaggtaccccaggcttagaggacccacagaccctggaatccatattacagcatttgtttcagtggattgggatcaactgtttgaatatttaccctctagatcagtgttcgtatgggagggatactgctccctaaggaatgttttgagctgtatgggtgttttgtggatgcaatgacaagagggtactatttccacttagtgcctgggttttggggatgctgatgttctgtaatgccgggacaatcctgcccactggagaatgtctcatgtcctgcaggaccttgaggagatcaaccagatactcctgtaggaaacaaacctgtttataatgacctgagcttggaacccaactctgttttataaataaactcctttttgtgtgatcttaacatatgttcagttatccaggaatgcaaatcaagggaagactaaaatttactttgttcaaaactttaacaagactcgatcaccattttggaggtaacatcggagatggcaacgtgacttgtgattgagaaagaagaaattaacccagatgcctgtggcaactaagaattttgcttgatgtggcctggtgcagcagctcatgcctgtaatcccaacactttaggaggctgaggcgggaggattgcttgagcccaggagttccagactagcctgagcaacatagcaagaccctatctctacaaaaaattaaaaagttagctgggagtggtggctcatgactgcattcccagctacttgggaggctgaagtaggaggattgcttgaccctgtctcaaaaaaaagaaagaaaaagaattttgcttgaccccatacaacacacctgtattcatctgcatttgtgaacgtcaccatcactgtgattcatggtctattaacatctacttttttagctcttatttttaaatgtcaaagataaaaactgtggcctgaatattatcatacctctctcaaatccaaacttacttgttataagtaggtgcaagcatgtgactgcttcataatgtcttttagagtttaggcctgagcatttatgtattgaaacccattattttattacagtattccttttatttctctttcatattacagtagcagcattatattgattttgttttttcattatgtgtataagtggtttagattatccatgaatttcgtttcagtatggtaaagaggatattcaaaatatttgttataaaaagggagcatctggcagcattgagaaccactctaaggttcaggaggcagggacttcgcctcccctgggttactccattcttctttgtgcctagcatagggcctggaatatcacagatgcacaaagaatcttttctgaatgagtgatgaaggaattgaggctgatactctggtttggtaaccacctaggtatgtgatgaggccctctgctgagatgggaacacaggagagagggcaggttttggggagagtaatgagttcagttttcattgtgaaagtttggagagccctggaatttctaggtggagaggcctgaggcccagggctgtgtgggccttgatttctctcaaggccacagaagagtggaaagtgcaaagtcgtagtaacagttcatctctttagtcagtaatcattgctgagtctctccatgcaggatgaatagaccagtgagagctgcccatgaggtgtctccctcctcctgtggtgatctgtgtacctgcccaggccctcagaggctaggagctcctccaaggtaggggatagaaatccttcatctctagcccctctgacttcctgccccatcctgacatagtaggtggctcggcaatgatagctggagggaccacgcagtaaaacccatctgtggaaacacatgtattcagagcaactttttttggcctgaagtcactgcagtggaacatttgggagcaagtttccccagggcccagctccttcccgctaggctctgccatgcctcctgtttattaacagggaggcgtgacaaagggaaaaatctcctgattgaagactcatctcagacatcttttcactcctctagggaagggtgcaattctgggctttaatgacatatgacggggcaggcagtagaggtgttgcgcattttaggcaatacatgtgctgctagaaagttgaggtatagggactttttaggaacacaatttttattgacaagtaacctttcaagaacaataaagaaaatcagaaagaaaacctatgttcatagcagcatcattcataatagcgaaaacaactcaaatggccatcaactgacgaacgtatgaataaaatgtggtctattcatgtgatggaatataacttgaccgtcatgaggaatgaaggactgatgcatgctatgatatggataagtcttgaaaacatcatgctaaatgaaagaagccagacacaagagaccagatattttatgactccgtttatatgaaatgcccagagtaggtgaatacattgggatgtaaaagagattggtggttgccagggtctgggagaggggagatggggagtggctgatggaacaagccatatggaaaagcattccaggcattgggagcagtaagtgcaaaggccctgcagtgggaggaagcatggccgattaaagaacagcaaggaggtaggtcggcttcaagggagacagtggtgggggagaagctcagagaggggctagcaggactagaccctttagggctttatggggcactgccagggcattgccttttacttggagagagacaggatgtcgctggcagctttgggcagagaaggatgtatctgtcttatgtttgaacacaatccctctggcaggagatggattttaaggggtagaagtagggaagccagtttgggggccactgtgttggttcaggcaagaggtaactctgacttggaccctggtggcagcagctgccaaggggaaaagtgtccaaaactgaacctattttgaaaacagctcatcttcaggcttttggcctcagcaactagaaggctggagttgaattttattgggtgggggaattctgtgggagggagcaggtttccttctactctttgttcacatataaaaagaagttataagagaacatagataatagtttaaatttttatttttttctgaacattcaaccataaacatttatcaagatgctaaagtcttcataatactcactttaaaaatgttttttttggccaggcgcggtcgctcatgcctgtaatcccagcacttgggaggccgaggcaggcggatcacgaggtcaggagatcaagaccaccctggctaacatggtgaaaccctgtctctactaaaaataca

SEQ ID NO: 2450 - DNA, 18728 bp, Homo sapiens
acaaacagagccatgaccactgtacaccagccactccatgtcctgcgtctgctgtgtattcctatacttatacacagcaggtgcttaatacaggcttgtgggatgagtgaccagacttttccatctatgccttccacagcagttacgttatttcagtggctgcagagtccctgcctagtcttaatctttcttctctttctgaacatttagtaacacctatttcttggttttaacatcactgacaaaactgccatgaacctgctcatcaactgatgtttcactttttcttctgttcacttgtttccctgggactcaccccaaggaggcagtgcacaggtagtgaatatggcaggtgttcttaaaagcttctcagggctcagggtggcctagaagtgtggcaggggaaaaggtttggtagtcagggtcaaattctagtctagcttcagacccttaggcaagtcattctcctttctgagcctcagtttctgcatctgtaaagtggaaataggcctctctgaaggggacagtgtgaagagcaaatgagataaggtacaggaagtctataggccccagctgataggaaagagtacaacagctccatccaccacccaggtcccaaaggcatctccccagagtcggtagctctgctgtctttcccttctctggagtcaccaaacaccctgcccaccactacaccctcagctgccctgggagctacagccctatgtctgaaggaaccctttcttacacttttggagagcaagtgccccatcactgcttggttcctgacagtacacagggacacagggacaggtcttccggcaaaggtcaggtctgggtcatgaggagtggaagggagggaaggagagagggggcctaacccaggagtgatgggctctcagaacattggcagcagaaaacaggacaggctgggcttttacagtagaagcccagacgttttcccagttaaggcttgagttctgcctccgagcctatattcaccctattccccaactggagtgccctctcctctttctccaggttgtccaaaccctttctccaaagctcaactcaagggtgacttgttccaggtaacccacctgcctcccatctcctacatgcctggtctgcctgtgccagctgtcaggagccgagccatgggccctcccagctctaatggaaatggctctccatccagctctgccagctcaggcctcagcactgcccaggggaccatcacacggctcaaggtcagtctccagtgatcttagttgatccccacaagaaccctgtgacatgagcacagctgggttagtagttcccattttagaggtggagacacttaggcccagaagggaacagtggcttgctaaggcccacagcatcaactacccagctgacttgaatctagggcttcagaatctttgtctagagttctttgctctcctggagccacgccttaacaaatatttgttcattcatttgacaacatcctccaaacatctcttttgtgcctggacagaggccatacaagaaggaagctggagtgtaaacagtgaggtgcccagtataaaccattctgtggccacacaagggactggggatgtatatgtgtcaggctccctgagtactcccagctgaatggattggtggagagagagtcagggagcccgtcccaaagaggtgaggcctggcctggacagaaagatgggccagactaggttagcaaaggagcagggagagcagcaggagaacaagggccagaggtgagggagggcttggctagaagcccttcagtgtgcctaaaactttgggtgcaaagggaaagggagtaagaaatgaggctggaggcccggcgcggtggctcacacctgtaatcccaacactctgggaggccaaggcaggtggatcacctgaggtcaggagtttgagaccagcctggccaacatggcaaaaccctgtttttactaaaaatacaaaaattagatgggcatggtggtgggtgcctgtaatcccagctacttgggaggctgaggcagggaaaattgcttgaacctgggaggcggagctgggatgcggaggttgcagtgagccgagatcacaccactgcactccagcctgggtgacagggcgagcgagactccgtctcaaaaaaaaaaaaaaggaagagaaagaaagagatgaaggaagagtgagagaactaagagggcgggtggctggagggggatgggcaggaggggcgcaggagggagcagtcagacctccagtttgcaggagactgagcaggcctagcccagggccctggctgtcgtgatggaggaggggacctccaggtgacccacaaaagaggctgagtcacaggccttgttcttaactgaaaacatgggctgagggagagcagagagttgaaatggctggaggagcagcagtgggtgttggagaggctgtgacccctgttttggagtttgaggggtctgggggatggccgtacaatgcagaggagtgttctggacagaagcttaaatgttgggaatcaccggcaccgggaaccaagagggtgcaccctgcccaggaaaggttagactaccaggctgggaggtcccaagaaaccctaggtgtcacttaggggagagggtgctgtaactcaggctcacccccactcagcccgggctggcaatggctggctggagagccagagggtaggagatgtggggctctcaggtttcacagctctcatttctcccaccccgcctggcagggtctagctaggctctggcaaagaatcagaacataacactgggactggctccgatgagtaacccaatgccaggctggttggagtgggaacctgggctccccacccccatgaagctactcctcacttctgagcatggcttgcctgcttgcccctgcccactcccaagcctttatccacgctgtcccctccacctggaatgcctcctctgggccccactgggcaaaacccgacctatcttcccaaggcctgctcaagtgctgtatcgtttctggactttgtcccccttccctgctggcctcccactgcccactagtgcccttccctagaacacactccaccacctgcctctatcacaagggccacacactggaggtgagagtctgtctctgagtgtctgagactgagtgccttgggaacaaaaagcacacatggcccagcccagcccactcccaactaaagaagtgagcctaggagtcaagattcgaaatcctgtgtgagccctgaatggctcctcagcctctgtttacacgtctgtaaaatgggctaataatccacctcactgtgatgatcaagtgagttgatgcgtagagggcatcaattactgtgcctggtacacagcaggtgctccataaatgcgtctcccctcttccttcccagggcctcacctggggagctgagaaatccattactgacaactagggcttctaggaggagaaggggcctttgttttaccttcacccacatcagaggacccacacttcacacctgctttccttcacagccaaagtaagcactgatgaaggcaacaagtgcctatggagaccctgttggtgttcctcctgcccagttacacaggccacaacacaatcctgccccctccgcctggggagtcaggggagaggcatcagatgtgggacttgaagggtgaaagagatcctctggaggggggaaaggcatccaggcccaggaaatggcatgggcagagggagagagggagggaggaatgagcctggtgagctggagcaactgcaaatggttttaaggcggctgccatgcagagggcagggaagggacctggggagactgaggctgcagagataagctgagcaattggccagggctccgggtaagccaaggggttgggcttcatcctgcaaccacagcgaagtttttacctgggtgggacggtattgggattccagatctggaaagctggctctggaggcaggaaaacctagaaaggtctaaggaggtggctactgagggcctaagggagctgggagaggtggccctggaaggctgctaccgggcttgcgttcttgctccagttatctccatgctggggtcagaaggagcgaaccccagccgataaacaagacagtcccaagggaagactgcatgtggggactgatgcaccccactcctagaccagacaggacgccagctctcatttctgctttacagagactcgctctcctgggctccttcctggggctggggggcagggagcggggagggcggtcctccgtccagcctagtttactgactccctctccgggccagatgggcgctggaatgggtggctggagaggggttcgggtcctgcctagggcgagagtagctggagagaggcgcgcctgagaggttcttccaactggaaagagctcttattccaccggtggggaaactgaggcacggcgaggggaagtcaccggcccaaggtcacgcgtcgagctgaaggcagaggcagggtttgaacctgggagagctggctctcgggaggcctcggccagcgaccgagaaaagggaggggcggcggggcggcggggcctgtgttgggggccgggcgcgccgagctcacctggtagttgtctagctgctcttcggtgaagatggtctgcttgttccccatggtggccgccgcgccgccgctcgcccgcccgggctccgactcccatcagcggccgccagacccggagccagcgccccgtgcccgcggccctcggcagccccgcggctggcagcggcccacggtggccggacccttcccgccccgcagctcgcctggaggaggcgcgcgggggtctcggaggcggggacgggaacccggagcggcagcgactccgccgccggcgggaagagggcggggcacccggctccgcggctgcagcgcgcccgggtcccggcaggaggcgacctggccccgggagacgctgcccggcacgaacccttggctcccgcggccggaagtgctgggggcgcgcgggggtctcggaggcggggacaaagacccggagcggcggcgactccgccccgcagcaggaagaggtgtgagcccgggtcccgccgtgggagtccaggtcgcacggcgtgagggtgcggggcctgggaaaaaaccctctcgaggcgggcagtggggcgagtggcgccccttgacctggggcgggggcggcagcgaggactgtgagtgcgtggatctagctggggccgggctccgccaccgtctcgcgtcgcgaccttggtcaagcccttacccgggccctgtccctctggggagaaggagggggtcagtcaagctgacatctgaggccctcccggccaggcctcgggaagcccatctggcctttgggcgcggcctaggcagggcatctcagaccttctgtgttccttagggagcaggacaggatttacttggcttggttacaaacgtgagacttgagaggatttaaaggacttgactgtgtccacagaagtgtgacaaaggccaagacattttttggagcttttaagcagatgccattgtaagggaagcaggactttacctctgccctcctagggtctttggctgggcttgagaattaatttggcataagacagattaaggggagaaaaacagatttaatacaagttttacatgacgtggaagccctcataaggaaatgaagaccctgagaactggcaaaatctaaatacttttttttttttttgagatggagtctccctctgtcgcccaggctggagtgcagtagcgcgatcttggctcgctacaacctccgcctcctgggttcaagcgattcttctgcctcagcctcccctagtaggtgggactacaggggcatgccaccacacccagctaatttttttttgtatttttagtagagagaggtttcaccatgttggctgggctggtctcgaaatcttgacctcaggtgatccacctgcctcagcctcccgaagtgctaggattagaggcctgagtcaccacgcccggccaattattgtattttttttgtagagatggggttttgccgtgttgcccaggctggttttgaattcccaggctcgagcaatccacccactttggcttctcacccaaagtgctgggattataggatgtgagccatcatgcccggcctcatctcctgttttttagaaaaagaaggatgatcaagagtgcccttcttgcatctgctatttttcaagtgcctttaactcaaatactcaatatgccagagcagcatatgttgtggtggcatgttctgaactccttccccatccaccaaatggagtcaccgctatctttttggggtccagcccatacaactgttatttctaaactcaggacaactgaatcagtaggtattatctccatattataggcaaagagttgggctgagagaggttcagtaacttgcccagggtcccacagctgggaattagtagaacctggactggacccaggcactggctcaacataccattccacaactgccagtggactttgaagagatcaggatttttttttatttatatatataaaaaaaaatagagatggagtctcactatgttgtccaggctggtctccaactcccaggttcaagtgatccttctgccttggcctcccaaagtactaggattacaggcgtgagccaccatgcctgggcgagatcaagactttatgctttaaaatgcgtggtttgttactttaggatagtggttctgaaaccacctgggagcatgtatcaaaattacttgggaggctgcacccctagattttctgatttagaaggtctggggtggctaagaatgtgggtatcgaaagggttcctgggtgacactgatgcagctggtcttggaaccatactttgagagtgcttaggctgctgaagcttgtgggttctgatgggaacagggcttcaagtttggcagatgatccctcatgcttttagttttcttttatatctgaggctactggttggggttttccaaccttattttgccactccctggtgagaacagcagccatcagctaaacagacatgtcaccctgttaaaatcacaagagtcttcagaggcaccatcaattgctatcagaggggtaagaagcaattcattagcctggggattggtgaccagccttcaggggtcacctcaccatcttttcatcattgtggacacatgcaataggggcctaacccatgggaaagaaggcaggatgtgtccccagagatttggagcatgtggaattttagagcagagaaggcacatttaaaagattctctcttctgtacctcccctttttcctgtgttggagttggggaaaaggaaacccttttgaaaccacataaccactattacacaagttttccttcttcccatcttattagattccacactgtgcatgaacaagccagaattctgtgtgttcagatcctgctctggcgcattcttgtacaattgctaacatgctgcttatttgcataccaggtgttccaggtagaaaatctggaacctatacaaagaggactgtgttttcagtcccgggagcccttcctctcataggagagaaatagaggtaaccaactgaactagaaaattcctctcaaaaatccttttaggccaggtgcggtggctcacacctgtaatcccaacactttgggaggccgacacagacggatcacctgaggtcaggagtttgagaccagcctggtcaacatggcgaaaccctgtctctgctaaaaatacaaaaaattggcctggcgtggtggcgtgcctgtagtcccagctactcaggaggctgaggcaggaggatcacttgaacccgagaggcagaggttgctgtgagccaagatcgtgccattgcactccagccggggcgacaagagcgaaactccatctcaaaaaaaaaaaaaaatctttttggatcattattaccatggcctatctgaagctctctctcttgagcaatgctgtgaggaggggcaaggaacacaattcccatgttacagataagaaacctggggctcagagaggccaaatgacttgcctgatgccccccagctgggaagtggcaaagcaaagctctaacgtcgttctctgattccaaatcctgtgctttagctgctccctgatgttgagtgtggtccctgaggagcagagtgtgtgtgtttgctgggagggaggatgggccgagggagaagaataaaacattactgattacttatctagtgcccagaattgtactggatgtgctatatttactgaatttgattattccacaatagcctcctcagtctgtggagtttcatattattatcccatttcacaggtgaagaaatagtttcagagaaggtgacttgcccaaggtcacatagctggtaacaggtagatttaaatctgggccctgactcttttcttttcttttttctttttttttttttttttttttgagacagtcttactctgtcgcccaggggcatgatctcagctcactgcaacctctgcctcccgggtttaagtgattcttctgcctcagcctcctgagtagctgggactacaggtgggagccaccacacccagctaatttttgtatttttaatagagacggtgtttcaccatgttggccaggctggtctcgaactcctgacctcctcagcctcccaaagttgggattacaggcatgagccaccgtgccctgccggactcttctcttgatcacacagtctaggacagggaaacgtggttaccagtgtttaaagggggctgactccttgtcaattgcagtcttgtaaataatgtaaaaggaaaaggcagcaggggtgccagatactcattaaatgttagcttattttttttcatttctgattcacacaatgaagtttattttaaaatttggaaggaaaacaggaataaatgctaccaagtgcttctttgggatgagaggtcatcttgacctgctgcccaagtgctcgtttgtgatgatgatgcactttgtgatcaagatgacctctcatcccagagaagccttgtagcatttactgcagaacaactcaatctgcaagttgttcttctaagacttagaatctagatagatctttttgtttgtttgtttttgttttgttttgtttttttgagacggagtctcgctctgtcgcccaggctggagtgcagtggcgcgatcttggctcactgcaagctccgcctcctgggttcctgccattctcctgcctcagcctcttaagtagctgggactgcaggcgcctgccaccatgcccagctatttttttgtatttttagtagagacggggtttcactgtgttagccaggatggtcttgatctcctgaccctgtgatccgcccgtctcagcctgaatctaggtagatcttaatgacagagatggaagatccctgggcccaaggtctgggtgggaccatctcttaaagtaaacgaagcctgcagcctgtcttctagcagctctgtgggccctgtgagtcattccccagtcctccactcaaatcctttactatcccacctctactttttatcagctcaggaccccacctgctatcttggctcatgggaatcttctctatcttaggggcaattcaaatcttactcttatctttacctataaagcattgtcatcttggcgtcttccctgacatggctgtgatttatagtgtgtgagcagttactaggtctgcctcagtctctctctctttctctctctctccctctctctctcacacacacataccctgcaaccccttgtttaacctggcctatatcctagcactgaacagcttgtctctgtttctctagcattttgcacatagtaggttcttaatgagtatttggtggataaataaatacacaccctgggactgtttttttttttgtcctgaggagggttatttttccctctcaaacactaagaaacaggagggctgggaccagggctgggaccacatgttcgtctgtatccccagacacagaggaatctcccagggtctagcacatggtcttagcaaatgtaaaatcaacaccctttaaaagagtacattttcctggacctgttcatacatttaatcaactagatccccaaatattctgacttgaaaaagattttcttactggaggatttagtgaccagtcgtttagcgcagagccaacagaatgaaacccctttctctcttccgggagactgacctgccctagagccttccccagaagctactctggatgtgagaagttactggatggctcaaatgggaccccagctggatggcgactgtcctgttgttgagggaggagggggtcaatttcctccacaaatctgcttcttctggatcgtgtcccacccacctcttggatgcctttgacatctttggaggcacccttgatttctctccttccctcagacccctcagtccattagcacagccagtcatatctagaagccagccacttcttagcactccattgctatcactgtggtccacgcccccctcacctctctcctgttatggccgtatctatcatgaaatgacctaaaccaattcatccacaactaggttcattttactgcagatctcagtaatctccagtaatgagtggtaggtaggggtgttgtgtttccttccacaaaccttgctatgagggggtctgaggcaagcaagtctcagactgaagtccacaccttgtaccatcacttatcagcaagcaggtccccaacagtcatataaccttctctatgagctcaatgaaggcctagctccctgaccttttgcatatttcaataaactttcctcttgaaagatttagttcaggctgggtgcagtgctcatgcctataatcccagtaccttgggaggctgaggcaggaggatcacttgagctcaggagtttgagaccagcctgggcaacatagtgagaaccccatctctaaaaaaaatacaaaaaatagctggacgtggtggcacacgcctgtagtcccaactactcaggaggctgaggtgggaagatcacttgagcctgaggggttgaggccgcagtgagctgagattgcaccactgcactccagcctgagcaacagagtgagactctgtctcagaaaataggggggagggatttcattcaaggaagttgcaaacaatatttaaggagcaagatttgaacaaccttcaatttgggatcaggcaactgcattcttactcagaagcttgaacctgaccagacggactcctaagacctagaccccatcaaaactccctaggtttttgtgtcctgtctgtctgtgtaagggcagaggtacttggacaacccttcacatatctaaaataccactcatttgatcaatggacaattatttcagccatccattttgctaatgaacagaccctctgctgctggaatggcatcaagacagctgaagcccttgtggaagggtctctggagtgtgggcttctgggtaaagtcccaactgcttctagaatggcctctctcaaagtgtgatcgtgggtctcctggggtctctgggatcttttcagagagtctgcaagggcaacaatatctcataataatactgagacattatttgcctttttcattctcattttctcacaagtgtagagtgaagatttccagaagttatatgggtatgtgatattgcaacaggttgaatgaagaagcaaatgtgagaatccagcagttttctattttgtttttgtttttttgagacagagtctcgctctgtcacccaggctggagtgcagtggtgtgatctctgctccctgcaagctctgcctcccgggttcatgccattctcctgcctcagactcccgcccggctaatttttttgtatttttagtagacacagggtttcaccatgttagccaggatggtctcgatctcctgacctcgtgatccgcctgcctcagcctcccaaagtgctgggattacaggtgtgagccactgtgcccagcccgagcagttttctattaagccaagctctaaagacatttgcaagcatgtaaaacaatgccactcttctcaataaatatttttgtcttcaaatatatgattatttttcataaaagtctgttaactaagccaacatataatggttttgtctttgcagtgggtaggaagaacccatcgggtgattacacttgccaagctttcagtatcagagaggaaggtgggggtgtccgtagggtgaaaatagcaccccaaatgtcttagatcctcatactttttttttgagatggagtctcactctgccacccaggctggagtgtagtgatgtaatctcggctcactgcaaccttggcctctcaggttcaagcaattcttatgcctcagcctcctgagtagctaggactacaggcgcccaccaccatgcccagctaatttttttttttttttgtattttttttgtattttttttttttgtagagctagggtttcaccatgttggccaagctggtcttgaactccttacctcaggtgatccgcccacctcggcctcccaaagtgctgggattacaggcgtgagccaccgcaactggccagatcctcatactttttaagaacaggctgctttcatcatcaagaggagctcttcatcacacttaaggtggttctgcaagacctctgggagaatcccagtgagctggggtccctgtgtctgtagaggcctggcatcatggtttacacaaaaggaacaaaagaaactacctgggaatcccttaacccttcccaagctctatcaactcaggtcacattgatgtctctgaagcatcttgtcataatatgaactgtcttccagagctatctttgtggctctcccaggctactatgggttcctcagaggcaggccctgaatgattagatgttcatttctgtgtttggaggattgttgggaagtttgtgtagggagggttctcatttaatcagtttccctgcatcttctgatctgatcagcccaggagaatgggagcttcagcaggtctgtgtgaccgcaaccattcttgtgttgctataaagaaatacctgagactgggtaatttataaagaggtttaattggttcatggttctgcaggctgtgcaggaaacatggcttctgatgaggcctcaggaagcttttattctcggcagaaggtgaaacagcagcttgcgtaacacaggtggaaagcaggagcaagggggaggtgccatacacttttaaatgaccagatcgcactataactcactatcacaaagacagcaccaagccatgggggacctggccccaaacaccttccaccaggccccacctctagcattggggattacacttcaacatgagatttgggcggggacaaatatccaaagtatatcaaagtcttttgtcattctattagcttcagcttactcaaacatctttaaagatgttataaggtgtcacattaatcagagagtcttctgaattctccgtgggagtgttaataactccattttacaggtgagagaatggaaggtcaaattcacacatctggagagtgtcaatgtgagaactgggacccaggtttgcctggaggatcttccactattgccctggcacctatactgagaataaatgttgtccctttgaaaggggcagctagttcctttgttcaccccagagactatgagaataggctttcaagtatttactccattaaccttgcagcccaaggctcagctactccaggaagagagagggactgggagtcagtatctgctttgagggaagttttatcactttttatagcaacctctgaacttgacccatggacttaggcagatagagcaaagccagtccctgcagtataaacagatgggagataagtcaggtcaatttgatttgatcaacacccctgattgcatttatttccttatttctaggctggctccagagatgctatccccaaatgggcctctggaggacaaatcttttggtgaacattcattaagcaaaataatgcacttatgagtaaagcacatggtgacttggatggtgtgccattacctccccaggacagagtccaaactgcttgccatgataggtgcatgtggtctggatcctgcctttccccacttcttcccacctggccctttgttcctggtatcctttctgcctggcactccttttccttcccttctttctgtttggaaaattggcctcccttaagtcttgtctgcttgtaacaatctctgctttaacccccatgacactctcatctcccctagttcttgaggtaccccaggcttagaggacccacagaccctggaatccatattacagcatttgtttcagtggattgggatcaactgtttgaatatttaccctctagatcagtgttcgtatgggagggatactgctccctaaggaatgttttgagctgtatgggtgttttgtggatgcaatgacaagagggtactatttccacttagtgcctgggttttggggatgctgatgttctgtaatgccgggacaatcctgcccactggagaatgtctcatgtcctgcaggaccttgaggagatcaaccagatactcctgtaggaaacaaacctgtttataatgacctgagcttggaacccaactctgttttataaataaactcctttttgtgtgatcttaacatatgttcagttatccaggaatgcaaatcaagggaagactaaaatttactttgttcaaaactttaacaagactcgatcaccattttggaggtaacatcggagatggcaacgtgacttgtgattgagaaagaagaaattaacccagatgcctgtggcaactaagaattttgcttgatgtggcctggtgcagcagctcatgcctgtaatcccaacactttaggaggctgaggcgggaggattgcttgagcccaggagttccagactagcctgagcaacatagcaagaccctatctctacaaaaaattaaaaagttagctgggagtggtggctcatgactgcattcccagctacttgggaggctgaagtaggaggattgcttgaccctgtctcaaaaaaaagaaagaaaaagaattttgcttgaccccatacaacacacctgtattcatctgcatttgtgaacgtcaccatcactgtgattcatggtctattaacatctacttttttagctcttatttttaaatgtcaaagataaaaactgtggcctgaatattatcatacctctctcaaatccaaacttacttgttataagtaggtgcaagcatgtgactgcttcataatgtcttttagagtttaggcctgagcatttatgtattgaaacccattattttattacagtattccttttatttctctttcatattacagtagcagcattatattgattttgttttttcattatgtgtataagtggtttagattatccatgaatttcgtttcagtatggtaaagaggatattcaaaatatttgttataaaaagggagcatctggcagcattgagaaccactctaaggttcaggaggcagggacttcgcctcccctgggttactccattcttctttgtgcctagcatagggcctggaatatcacagatgcacaaagaatcttttctgaatgagtgatgaaggaattgaggctgatactctggtttggtaaccacctaggtatgtgatgaggccctctgctgagatgggaacacaggagagagggcaggttttggggagagtaatgagttcagttttcattgtgaaagtttggagagccctggaatttctaggtggagaggcctgaggcccagggctgtgtgggccttgatttctctcaaggccacagaagagtggaaagtgcaaagtcgtagtaacagttcatctctttagtcagtaatcattgctgagtctctccatgcaggatgaatagaccagtgagagctgcccatgaggtgtctccctcctcctgtggtgatctgtgtacctgcccaggccctcagaggctaggagctcctccaaggtaggggatagaaatccttcatctctagcccctctgacttcctgccccatcctgacatagtaggtggctcggcaatgatagctggagggaccacgcagtaaaacccatctgtggaaacacatgtattcagagcaactttttttggcctgaagtcactgcagtggaacatttgggagcaagtttccccagggcccagctccttcccgctaggctctgccatgcctcctgtttattaacagggaggcgtgacaaagggaaaaatctcctgattgaagactcatctcagacatcttttcactcctctagggaagggtgcaattctgggctttaatgacatatgacggggcaggcagtagaggtgttgcgcattttaggcaatacatgtgctgctagaaagttgaggtatagggactttttaggaacacaatttttattgacaagtaacctttcaagaacaataaagaaaatcagaaagaaaacctatgttcatagcagcatcattcataatagcgaaaacaactcaaatggccatcaactgacgaacgtatgaataaaatgtggtctattcatgtgatggaatataacttgaccgtcatgaggaatgaaggactgatgcatgctatgatatggataagtcttgaaaacatcatgctaaatgaaagaagccagacacaagagaccagatattttatgactccgtttatatgaaatgcccagagtaggtgaatacattgggatgtaaaagagattggtggttgccagggtctgggagaggggagatggggagtggctgatggaacaagccatatggaaaagcattccaggcattgggagcagtaagtgcaaaggccctgcagtgggaggaagcatggccgattaaagaacagcaaggaggtaggtcggcttcaagggagacagtggtgggggagaagctcagagaggggctagcaggactagaccctttagggctttatggggcactgccagggcattgccttttacttggagagagacaggatgtcgctggcagctttgggcagagaaggatgtatctgtcttatgtttgaacacaatccctctggcaggagatggattttaaggggtagaagtagggaagccagtttgggggccactgtgttggttcaggcaagaggtaactctgacttggaccctggtggcagcagctgccaaggggaaaagtgtccaaaactgaacctattttgaaaacagctcatcttcaggcttttggcctcagcaactagaaggctggagttgaattttattgggtgggggaattctgtgggagggagcaggtttccttctactctttgttcacatataaaaagaagttataagagaacatagataatagtttaaatttttatttttttctgaacattcaaccataaacatttatcaagatgctaaagtcttcataatactcactttaaaaatgttttttttggccaggcgcggtcgctcatgcctgtaatcccagcacttgggaggccgaggcaggcggatcacgaggtcaggagatcaagaccaccctggctaacatggtgaaaccctgtctctactaaaaatacaaaaaattagctgagcatggtggcgggcgcctgtagttccagctacttgggaggctgaggcaggagaatggcatgaacgcaggagaatggcgtgaacccaggaggcggagcttgcagtgagccaagacagcgccactgcactccagcctgggcgacagagccagactccatctcaaaaaaaaaaattattttttaattttatttttagagataaggtcttcctctgtcatccaggctggagtgcagtggtgcaatcatggctcactgtagcctctaactcctgggctcaagtgagccttccacctcagcctcccaagtggctgggactacaggtacatgccaccatgcctggctaaatttttatattttgtagagactatgtcttgctatgttgcccaggctggtcttcaactcctggcctcaagtgatcacctcggcctcccaaagtgctgggattgcagatgtgaaccaccatgccaggccattgatcacttttgaaggctgcatgatggtccacttcattcatttcccctaaattacataaccatttcttctgttaatcatttagactgcttttttctctttttagttttcaaaattaaggataattgtataatgaatatctttgtgttgatggctttttctttctggatttttttccccaagagtttaattctcaggaatggatttactaggtgaaagagtaagaacagttaatgtctctcttaagacacattgctaaactgttttccaaagagattgtggaaatgtataaggccagccaagcagtgcgccataaattggatggtataaggcattgcattttattaatatttttaaataaaaataattttttttagaaatttgcatgcatttgactattgttaagattgaacatttatttaaaagtttatttggctgtgaattgattattcaggtccttttcccgttttgttttgtttttttttttcccgagacggagtcttactcagtcacccaggctggagtgcagtggtgtgatctcgcctcactgcaacttccacctcccaggttcaagtgattctcctgcctcagcctccccagtagctgg

SEQ ID NO: 2451 - DNA, 18045 bp, Homo sapiens
gtgagtcccccaccaactcggagaccttgggtgaccagctgcccagcctcagtgtcctctgagatggggatggtgggggtccctgccttggagaaaacaaacccccctctctactcacctctcctttcctccccagcccatccttccccatccctgatcgatgtgagggcaattttgacgccatcgccaacatccgaggggaaactttcttcttcaaaggtgagtcatttcacttggcctcatatatgttggtttcctgcccacttccagtgacccactggggctgtgggcttaccctggaagcggaacttttttcttctttgagacagggtcttgctttgttgcctgggccgcagtgcagtggtgtgatcatggctcactgcagcctcaaaatactgggctcaagcgatcctcccacctcagcctccctggtagctgggaccacaggcacatgccaccacgccttgctagtaatttattttattattttgtagagatggagtctcactatattgcccaggctgggctcaatctcctggctcaggtgattctccggtgtcagcctcccaatgtgctggcattacaggtctgagccaccaggcaaggccctggcacttttagcgctaaaaagggaaaagtctcaggcgggccaggatgggctggtcaccctagatccattgcgcccttgatttccagatgggacccctccccacccagccacacaccctgggggaggagacctcctgctgtctcatgccttcctgcgaacccctttgtcccctgcaggcccctggttctggcgcctccagccctccggacagctggtgtccccgcgacccgcacggctgcaccgcttctgggaggggctgcccgcccaggtgagggtggtgcaggccgcctatgctcggcaccgagacggccgaatcctcctctttagcggtgagtggggccggcggcggggcgcgctggggccggcgcggggagcccacccctgacctcccggcctccaccctgcagggccccagttctgggtgttccaggaccggcagctggagggcggggcgcggccgctcacggagctggggctgcccccgggagaggaggtggacgccgtgttctcgtggccacagaacgggaagacctacctggtccgcggccggcagtactggcgctacgacgaggcggcggcgcgcccggaccccggctaccctcgcgacctgagcctctgggaaggcgcgcccccctcccctgacgatgtcaccgtcagcaacgcaggtggggagcgcggtgacctgcgggttactgggcctgggggtggggagagggatgtggggaatggggacatggaggccaccctgcggggatgggggtccttgggcatcagggagcggcggggcggggagggaccgggactcaagctctgctcctccaggtgacacctacttcttcaagggcgcccactactggcgcttccccaagaacagcatcaagaccgagccggacgccccccagcccatggggcccaactggctggactgccccgccccgagctctggtccccgcgcccccaggccccccaaagcgacccccgtgtccgaaacctgcgattgtcagtgcgagctcaaccaggccgcaggacgttggcctgctcccatcccgctgctcctcttgcccctgctggtggggggtgtagcctcccgctgatggggggagccatccagaccgaacagcgccctccacggccgagtcccccgccgctggacctggtcgggggttgtgaggcgctgcggaggccccttgtctgttcccacggacgggggctcgggcgcggactaagcaggggggatctcccgcgcaggggcggcggcggcggggaccggtcgcctggcgctgggctcagtctcctcagggtctgagaccccggcgctgccaccggaacccgccttcaggggcgcacgcgcgctgggaccatgcgtcggtcgtcgcccccgtcgttccctcccggctgccgccagggggcggtcggaccccgcctcccgagcccggggaggggcggggaggacaaggggcgggcccgcggcctcacccggagggacggcagccccggtcgcgcgctggccccgcaggaccttccttttccaggaagagccagcttttctcggagcgcagtcctgggactctccgcagccccgccccgcctggccactgcgtctggcattcctgggtcgttagaggacaggcctgactgcgaagctgtgccttgcccctctcccacccgcagtttctcaccccgttctgctcccacaaggcccccctacagtcactgccacactggtggggacctgggacccagacccggaaccagcccagatatcacccctgaggacccatgcgccacgtcctgggtggtggaatcagtggctggagggacgacccttgctctccaggctgttaaccttttccgttgctcccccgccacccacctcctcctccccaggccacccaacttgggcacctccctgggcccagaactgccttccattcaatggggaacccttctatccccaagaaccccttccctgcttgcaccctggagagaacagcttgactcccatcaactcaacgctggtggaaagacagggaccgaaccctggctcaggcctggtcattgcctcctcagcactccctcctgggaggccttagctctagagtgaggggtgggtggaacctgggggcacctcgttcaccctgtccccactccccacagttttaggatctaaatgattgcctctggaactattcttctagactatcccacatcagaatcactgggaaatttaagtttgcagatcccacactcaccctgaatcctcactcagggtggggtcaggaatctgcattttaactagtcgcggggattgtggggggcagtagctggctgtttcgtggcatttctgtggctctgcagtgttcctccaccccaggaccaatatgttcaggccacaccgatggcctgaaccccatgggtagagtcacttaggggccacttcctaagttgctgtccagcctcagtgaccccctagtgcttcctggagctgaggctgtgggcggctgtcccagcaaccatgcgaggggttgccccagttgctcatacaaacagatcagcatgaggacagaaggcaggagactttggtcagttacctgggaattctgggctgccaggaaacgatttgggcctctgtcagtttcttttccatgtatgaggagggggaaatttgtatattagaaacttattcatcccactcaggacaataaaaacgaatgtacaaaaagcccttccattcttctgagcattgatggacctggggagaagtgtggtggcaggaactggactgacctgaatctccctgcttcgcagaaggaatccatggttgatggggaatctaagaaggaagagtgggcccgggcgtggtggctcatgccttaatcccagcattttgcgaggcccaggcagacggatcatttgaggtcaggaatttgagaccagcctggccaacactgaaatcccatctccactaaaaatagaaaaaaaattagccaggcatggtggtgcatgtctgttatcccagctgctaaggaggctgggacaggataatcacttgaacccgggagagggaggttgcagtgagccaagatctcacgattgcactccagcctggccaaaagagcgagactccgtctcaaaaataaaaataaaaataataataataagaagaaagaagagtgggaggacgaagtagagaggaatcgaaaagttggttatggggcacccggaggacggacggccactgtggaattgagactgcctcatggctccatgtagacttccagagcctttaaaattttatgactgctacacaaaaatgtcatgtcaaagtgattatttttattttttaagtggtatcgtttaaaaatggcatggtctcataatcaaaatgtaaaacttttgtgcttcaaaggacatcatccagaaagttggaaagaggctgggcacagtggctcacgcctataatccgaatagtttgggaggccaaagtgggaggatggcttgatcgcagggtttcaagaccagcctgggcaacatagtgagaccttgtctctacaaaataatcaaaaaattagccgggcatggtggcaacccgtgtctgtattcccagctacttggaaggcgaagaggagagaatcacctgaagccgggaagtcttggcaacaatgagccatgatcacgccactgcactccaccctgggcaacaggtgtgtctcaaaaaaataaaaataaaaataaaattggctgggcacggttgcttatgcctgtaatcccgcatttcgggaggctgatgcagacgtttgagaggcagatgtcacttgagtttgagagttttagaccaactggccaacatggtgaaaccctgtctctactaaaaatacaaaaattagccaggcgtggtggcgcatgcctgtaatcccagctacttgagaggctgaggcaggaaaatcgcttgaacccagaagttggaggttgcagtgagccgagatcgtgcctctgcacaccagcctgggagaccaagcgagattgcatcaaataaaaaaaaaaaagaaacacaaaaattgtcacatggtaccatttcagcgcactaagatggctagaattaaaaagacacagagcataacaaatgtatctggggatgtggagaaacaggaacccccgggcactgctgctgggaatgtaaaatgacagacaatttgaaacatagtctggctgttcctcagaaggataaaaacacatttgccatgtaacccagctattcttctccttcatacgtatccaagagaagtgaaaacataagtctgcacagaaacttttgcgtgaatgttcacagcagcgttattcagaatagcaaaaaaggggaaagaaccccaacttcctttgaggggtgaatggagaaaccaaatgtggtctatccacacagtagaatatcattcagccagaagaaggaatgaaggactgatccgtgttacaacacagatgaacctcaagaacagcatgttccgtgaaagaagctagacacagaagatcacgtagtgtataattctacttataagaaatctctgggagagatgcatccattgagagagaaagtagataagcccagacgcagtggctcatgccagtaatctcagcattttgggaggccaaggcgggcagatcacttgaggtcaggagttcgagactccttggccaacatggtgaaatcccatctctcctaaaaatacagaaattaggccaggctgagtggcagaacaagactccacctcaaaaaaaaaaaaaaaaaaaattgtcacgtgataccatttcagcccattgggatggctggaattgaaaagacacagagaataacaagtattgctgaggttgtagagacacgggaaccctcgcacactgctgctgggaatgtaaaatgacagacattttgaaaaatagtctggctgttcctcaaaaggataaaaacacatttaccatgtaacccagctattcttctgcttcatacatatgaagtgaaaacatacgtctgcacagaaacttgtacgtgaatgttcatagcagcattattcggaattagccaaaaagtggaaagaacccaaatgtccttcgaggggtgaatggagaaaccaaatgtggtctatccacacagtagaatattattcagccagaaaaaggaatgaaggaataatgcgtgttacaacacggatgaacctcaagaatagcatgttcagtgaaagaagctagacacagaagatcacctagtgtataattctacttataggaaatgtctgggagagaggcatccattgagagagaaagtagatgaggccagacacagtggctcatgcctgtaatcccagcactttgggaggccaaggcgggcagatcacttgaggtcaggagttcgagactccttcatcaacatggtgaaaccccgtctctactaaaaatacaaaaattagctgggtgtggtggcacgtgcctgtaatcccagctactcgggaggctgagtcaggagaattgcttgaacccaggaggcagaggttgcagtgagccgagatcgtgccactgcccttcagcctagacaacagagcgagactctaagaaaaaaaaagaaaaagaaaaagtagatgagtggttatccagggaaatgaggactggcagtgatgtctcagaagggcagaatttctcttagaggtgataaaaatgttctaaaatgggttgtggtgatagctgcacagttctgtgctttgaattgtacagctcaatgagtgaattgcattgcctgtaaattgcatcaccataaagctataaaaacagggtacatacagtctgggtggatcccaagatgtcttcagatggtggcctttgagagtcatgaggggctagggttggagctgaagcctaaagcatgacttttagctggtgcaggagtggcttccttctgtctcccactacaattcagaggatactcagggaaagatctggacatcctgtatgtggaaaggcggttgcgcacagtggaatggactcctaagtggcaggcaggtgacaaccgttgtctacttcacccaagggaagatttctccatggagcgtgttttataggttctgtctctccgagtcccctttgagaatataatgggatacattgcatccatgctgaattcctaagccccaggacctcagaatatgcccttatttggaaacagggtctttatggaggtacttaaggtacaatgaggtcactggggtggatcctacttcttttttttttttttccgaggggaattttcattgttgtcccccagactggagtgcagtggcaccatctcagctcactgcaacattcgcctcccgggttcaagtgattctcctgcctcagcctcccgagtagctgggaatacaggtgccggccaccacgcaaggctaatttttgtatttttagtagagacaaggtttcaccatgttggccaggctggtctagaactcctgaccttaggtgatctgcccgcctcggcctcccaaagtgttgggattacaggcgtgacccactgcgcccggcctagggtggaccctatttcaatatgactggtgtcctttggaaaggggaaagggggacagtcacacccaggcagaacgtgatgaagatgaagatggccatctacaagggcaggagaaacctgaacagaatcccagctccgggccctcagaaggaccccacgctgcccacattgaccttggacctccagcctgcagatcgtgagggaagagacgtcttcgacttagggccccttgtcgtggtacttccttagtttggccccaggaaaccatcccaaaggcaagggcgtggttgtgctcagctgggggaagggggctgggggccgtgaggaggaggtgggaggcccagccaggctggagggtcagaacccgtggagctagaagagcccgtaggggagccccaagattgctgagaccagtgaccttcggccccagatggccttgccttggcccagaagggtcagaaggacctggtcagccaagctcagacagccggcaggatgccttccaccctgcagagggtcctatcttgtcccacaggtagatctacatcaccactagccacccctccaacgtgcacaggcccctgccctcacggcgcccctcttaggtccggcagttcctgcctccttctgatccagaagtttctctggcctctggagccggggcacacctcatgcaaggacagggtccaaattcctttgtccttggatcccacttggctgacgtcaccttcctgtactcagggagtttccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggtaagtctccatctctgtctgtctctgtctctgtctctgtctctgtctgtttttcacgcactcagcaaggcctcctgccctgagagaggctccgcccactaccccccactttccccataaaaccagctgagtatttgtgccaggaagactgcgtgcagaaggtgactgtctcagtggagctgggtcatctcaggtggggagttggggtccccgaaggtgaggaccctctggggaggagggtgcttctctgagacactttcttttcctcacacctgttcctcgccagcaggccttggctccttgaacttttggccgccatgtgcttcccgaaggtgagtgagaggctgcgtgtgcttttgtgggcatgtctgaaaacagaccgtaagggtgcgggtgccctcagtatttcccgaggtgcctgtgtgtcagggctcagtcaggggcacccagcggcaggaggatagtgatggggtgagagtgtcagtggaggcgctggaggtcatatgtgtcgggggcgctggagaacggcaggggtgtggatgagagggagcacctgtcccaggagcccttcacagcccggaaagcccggggcaggggtggggcagggctctgctggaaacgactcggagaatgcttctctcagaggccggctcagctgggtgggcccaagagcaaggcctgtgtgggtcctggtgtctcttcctcctttcctgggttccctccgacctcccatcctctaccactgccccaccgcaaatgctaggcccaccacaccctccagggagctcttcggcctgtgacaataggggtttccatgatgtggcctggctcaggttcaggacagtgacccggaggacacatggctcccgcatgtcggcacggtgctgctttcaccctggttcctgggaaatcaggctagcgggatgggaccatcgctgcctgaaagtgtgcagacagctgccctgcccagaatatgtccccaggccctgcgcactctgtgggtgactgtcaccactctatagtgggggaaaccaggcatgtcacccccgagactaggcccttgacgtgggggctcagcggggattctgtggggtgcctctggcctctgtggatgcagccacgtgtctgcaggcaggaatggcccgggacctgtgggtctgcatgttggcagtcgggaagagtggcaggttgtagggtggacctacctggcaccccaaatattaatcagctcatcagagaggaatggctgctgttaccttctcaattgtcatgtccctaaacattttttccttggccaactctcacctgggaccatagtggttgtgggaaacccagctgagccagcctgctccaggacagtgtccatcctcccgtgtgtgtacatgggggggtgtgtgtgtgcagggaggacaccccggcccacgcaggccctgctcttgtgaggaggggtcacctaggcccacgcaggccctgctcttgtgaggaggggtcacctaggcccacgcaggccctgctcttgtgaggaggggtcacctaggcccacgcaggccctgctcttgtgaggaggggtcacctaggcccacgcaggccctgctcttgtgaggaggggtcacctaggcccatgctggccctgctcttgggcctgcccagctgagccggctcctgagagaagcgctttctgagtcgtttcgaggacagccctggccggtctttccaggctgtgaggggctcctgggactgctgtctcctcttatcctgtacctctgccatgtgtctctgtgtgtgtgtgtgtgtgtgtgtgtgtgtgtgtgtgtgtataaattatcctggaggaaaggttaaggtgacacatggagactgagtgtcaccgttatttccgcaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgggtggatttcccctcaggcaccaggtcacatgtccccgcccccaggcactccaccctgtgtggggctcagggtgagaaggatgaagagggacccacaggctccctcaccccttaccgtgggcaaatgcttgcacctgggtggcagtgagtgggcgggtgggggatctggacgcccggggagactgagggaggcatccaagccccagggctccttgaggaaacaacaggggtgccagacgtggcccgggcccctggctgggcccagttcggggtgtgtgggagctgaggactcactgggcttgaggactgactgatgtggggtgcagaggaggcttgggcctggaaccgagtgctttgttcctaacaggtgatgtcgagcctggcagagctggaggtgagccgtggcctccccctccaccaagcttagtccctgggtcttaggctccacaggacactgggtctgggccccgggtccccttgggaatcacctggaccagtgggggccacagtgggaagggggcaggcaggagcagcatgaaccccctgtgccctcctctccccaggacgacttcaaagagggctacctggagacagtggcggcttattatgaggagcagcacccagtgagtatgacacacccatctgggcaccttgccttccttcacctctgccctgtcttttctttctttctttctttttgtttatttgagacagagtctcgctctgtcgcccaggctggagtgcagtggcatgatcttggctcactgcaacctccaaatctcgggtttaagtgattctcctgcctcagcctgacaagtagttgggactacaggcacccgccaccactccaggctgattttttttgtgtgtgtttttagtagagaccaggtttcaccatgtttgccaggctggtcttgaactcctaaccttgtgttccgtctgccttggcctcccaaagtgctgagattacaggcatgagccaccgggcccagccaacccctgccctgtcttgatgtggtgtgggcagggtgtgcccagcccctgagcttggggtggagggctgggagtgacagcctagctgggacctgcccatggcctcactcctcacacagtggcacagccctcaaggcacgatgagggccctgacctggtgaccaagcagacacacccatcctgtcactgccatggaggtgaatgcagaggagggggactctgggaaaagtccctcttgcccacggggctgtggttgggaaaccaacacctgtgggcctccgtctcccagggtcaggaaaaggctgagaggcctgggtgtggccagggcctggggctgacacccccacctacagaccctgaatggtgctcccattccacaggagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgatcgcggaggtgggtttcccagggcaaggctgatctgttgccgtattagtccgttttcacacagctataaagaatgcctgagactgggtgatgtataaagaaaagaagtttaactgactcacagttccacatggctggggaagcctgaggaagcttacaatcatgggggaaggcggaagagaagcaaggcacgtcctacatggcagcaggagaagcagggtggggggaactaccaaacacttttgtccgcgtgtttgtgtgttttttttatttgagatggagtttcgctcttgtcgcccaggctggagtgcaatggggtgatctcggctcactgcaacctctgtctctctggttcaagtgattctcctgcctcagcctgctgagtagctggggttacaggcatgcgccaccataccaggctaattttgtatttttagtacagatgcggcttcaccatgttggccaggctggtcttgaactcctgacctcaggtgatccgcccacctcggcctcccaaagtgctgggattacaggcatgagccaccacacccggctgccaaacacttttaacccaccagatcttgtgagaactcactcacttacaccagaagcgcatgggggaaaccgcccccatgatgcaatcatctccagcccggcccctccctcgacatgtggggattacagtttgagatgattggggtaaggacacagagaaaatcatctcattctgcccctggaccctcccaaacctcatgtccttctcacatttcaaaactcaatcatgccttcccaacagtcccccaaagtctaaactcattccaacatcaacccaaaaggccaatccaaagtctcacctgagacaaggcaagtctcttctgcctataagcctgtaaattcaaaagcaagttagttacttccaagacacattgtgggtacaggcattgggtaaatgttccctttccaaattggagaaattggccaaaaaagggggctacaggcctcaggcaagacccaaatccaccagggcagtcattaaatcttaaagctcccaagcgatctctttggctccatgtctcatgtccagggctcactgatgcaaggggtgggttcccagggcctggggcagctccgcccctgtggctctgcagggtgcagcccccgcagctgctttcatgggctggtgctgagtgcctgcggcttttccaggcacacagagcaagcgcttggtggatctaccattctggggtctggaggagagtggtcttctcacagctccactaggcagtgccccagtagagagtctgtgtgggggctccaaccccacatttcctctctgcattgccccagtagccgttctccatgacaacctgtgcgtggtcatccaggcatttccatccatcccctgaaatctaggcggaggcccccaaagcccagctcttgtcttctgcagacctgcaggcccaacaccatgtggaagctgccaaggcttgggacttgcaccttctggagcgacggcctgagctgtaccttggtcttctttagccacagctggagctggagtggctggggcacagggtgccatgtcccgaggctgcacagagcagcggggccctaggcctagcttgaattaatccccaggaaatgggttttcttttctaccacatggtcaggctgcaaattttccatcttttatgctctgcttcccttttaagtataagttctaattccaaagcatctctttgtgagtgcatgtaaccgtatgctttcaagaaaagacaggtgacttgctgaatgctttggtgcttagaaatttctactgctggcggagtgcagtggctcatgtctgtaatcccagcactttgggaggccgaggccggcagatcacgaagtcaggatgtcgagaccatcccggccaacatggtgaaacactatctggactaaaaatgcaaaaattagctaggcatggtggcacacgcctgtaatcccagctacttgggaggttgaggcaggagaaccacttgaaccagggagtccaaggttacagtgggccaagattgcgccactgtactccagcctggtgaaggaccaagactccatctcaaacaaacaaacaaaaaaaacaagggacaggttcttgctatgttgctgaggctgcagtgcagtggtgcaatcataggtcactgctatggatggatggacagatgcgtgcacagaggcagggatggatggacagatgcatgcacaaacacgctgagcgcctactagcacaagacaagacatacagggttctgctctccccaggtacacagggttgagatccaatgggaaagcagtgagccagctgagtcaggggtacgaggagacactgagcagagaaataacccgggacatctgaggccagaagccaaaactatggcatcagtagggagactgcagaaggcggcaggtcccggatcaccaagggccttgaaagcatgtggaagactttgatcaatgggggaatcattaaggcattttgcattccggaactatcatcagcttcagcagggggcagggggtaggatagaggcagggaggcaggaagttctcgcagggtccaggcaagagatggtggagtgtggtcctggggaagggggcagtggacggatctgagggaggttcagttaggatgggcaaggattgagatctggctggatcctggtgacaggggagatgaggctggggcccttggaggatggtgtcctggtgctgttaatgcaggtgtgagagtgggaggaggaggagcaggctggcagaaggcaggcatgagtacaggtctgggcgggagtctgcagcgctctgggctggccacacgggtggggcaagggaggtggaggatcctgccctagagcttggtctcctctgtctgaggtcaggttccccagaggtggggctccagagggaaattcttgtgcaagcagtttctcaggggccatgtgctgaggggaatggggagcaggaacagcctagaagctgagtgaggatgtggtctcagctggagaggaggctgatcgcatgggagctctgcagcagggatggcaatgccggggaggccgtcccgcctgaggccaggcccagctctttgcagccccatattaactacattggctgctggggagcctgagtgacgggggaagggggcagccagggagggtgcctaggccctgtggagggcttggtaaggcagaggctggggaggctgtgtgcctcaacattcacatatgggcttcggatgggcgtggtggcacatgcttgtagtcccagctactcaggaggctaaggcaggaggattgcttgagtcagggaggttgagactgcaatgagctgtgttcacaccactgcactgcggcctgggtgacaaagtgagaccctgtcacacacacagaaaaagagaatgtgggcttcaaagttgaattcaagtaagtcagggttcttccacttgtaatgaacaacttccttaacctcattgtctcaggttcctcccctgagaaatgcgaggagaacggcgcctgctggtggcgggggcttgccgatgaaatgagccattcacccatgcctctcagcacagggcctgccctgggccgcatactgtgcattgtcagctgctgtcggagctgggctagtggccgccttgagagccagcagtccacgggggttggcgagcttctgggaggaaagggtggaacgtgactgtcaggtacagagctacagagaaccccagcatgaaggagtaggtggcaggggagaaggactcaacagagatggagaaagactaagcccaaaggtgatcaacaacaagagtgaaggaggaagtggtcagctgtggctggggcaaaacaagcccagtaagttacattggcctgtgtttggtcatccagggacaaagtgacctttttagtgccggtaggcccagtgggttggggaagaatttaggcggcagtgggcttaggcatgagaggagcggaggaagagaagattgagttgagaccactggctggagaacttgaccaggaagggagggcagagagcggcgtggagtcgggggagggaataggtccaatgagcgtcttaggatgaaggagttgtgagcactcagcacaggataagctgatacaaagaaagggatggaggatggatagactgacagatgcatgcacagaggcagggttggatagcatgacagatgcatgcacagaggcagggatggatagatggacagaggcatgcacagagagagggatggatagatggacagatgcatgcacagaggcagggatggatggatggacagatgcatgcacagaggcaggaatggagagacagatgagtgcaaacaggtagggatggatggacaggtgcctacacagaggcagggatgaatggatagatggatgcacaggggcagggatggatggatggacagatgcatgcacagaggcagggatgtatggacggatgcatgggcagaggcaaggatgaatggatggatagatgcatgcacagaggcagggatggacagacagatgaatgcacagaggcagggatgtacagaaggatgcatgcacagaggcagggatggacggagggacagatgcaggcacagaggcagggatggatggacagacagatgcatacacagaggcagggatagatggacagatactggcacagaggcagggatggatggacagatgcaggcacagaggcagggacagacagacagatgcatgcacagaggcgtgtatgaatggttggaaggatgcatgcacagaggcagtgatggatgggtggggagattggatggatagatgccggtaggtcgttcttgtcctggaggaggtgatccaggctaagtcctcacaccgggaggggcaggaggcgagcatggggagatacagctgtgtgtcccagtgcactggaagttacagatgacatcgatgtcctgtcctgatgaaacaggaaacacaattgtcatttgaaagttagggctgagggccgggcgcggtggctcacacctgtaatcccagcattttgggaggctgaggcgggggggtcacctgaggtcaggagttcgagaccagcctggccaacatggtgaaatcccgtccctactaaaaatgcaaaaattagctgggtgtgttggtggggcgcctgtaatcccagatactcaggaggctgaggcaggagaatcacttgaacctgggaggcagaggttgcagtgagctgagatcacgccattgcactccagcctgggtgacagaggaagacaccgtctcaaaaaaaaaaaaaaaaagagacagaaaagaaagttgggggccggggctggatgaaagcttgaggggctgtgggcctggcatggggctgaggggagtgtgcaggagctgcctgccaaagcctggggcaaggatgataggaggtgctggggcccctgtggactgccctctgagaatctcgtgaggctgggtctgcacagctgtggttgtgtaacttcccccagatgcatggtgtgacaagggtgcaggaaggggtgcagggcccggaagctcagtgtggttaaagacatgcaaggcaggatagaaggtgagagatgaatgatatggccgtgatcaaaacaccaaacttcagtttctcagaaaaaggactcagagcaacaagagaacctacagtcaacaaggacattcatcagcgcacatgtgatttgagcaagaccattgaagcccctgctgaacggcaggctggcagagccagggtacctggccatctaccttgaagtctctgtgcctcagtttcctcctctgtaaaatggacataggggacaggtttggtgagaagtgaatgaaaacgtgtttg

SEQ ID NO: 2452 - DNA, 11992 bp, Homo sapiens
tgtggaggtcgggggtaccaagccccagccctgccacctggaaaccctgggaaagcagcgtcacctccctgtgcctcagtttcctcatctgtaaaggggagctgaggacaggacctgcctccgagcctggggagagacggcagtgcacagggactagctgtgcgtctcagtaatacggagagaactttgcaggccaatggcgtccctctgagaaagactctccctggattctgtttcagagagttgagcttttccccagagcagatgctttgaaactgtctcaggtggacagagggggctgcagggagggcacagaggacttcctgggagtgaggtttcctgggattgagtcccagccctgctgtagggctggagtgaaaggggcctccccagagagcctctcccagggctctgtccccaagtggccaagctaattcggttccgtgctccccttttgcccacccccaccagaggccacaggctggactgggcgccactgctcatgcttctgtcctgggatagcacagaccagtacaccagggtctggcacatgtccgttgtagtcactgcagccctcccagtctccccgttttgtagaggaagccacagctcggggcaaagccgcacctcgcagtggacaggtgagtctctgcctccccaccagctgcctcttccacagatggacccccaatcacactgtcatatcgcctgtctgagcctcactgtgctagtctgtaggagggggcacctcctcttgggccatccatataaggctggagacaaacagctccacccagttatgggagtcccatgccatccaggacacatccaagtggatctctcatagcctatcatggttcctccaagactcagttttctcatctgtccagtggaatgacaatggtacaggctgtgagaatcccttatctgaaatgactgggatcagaagtgtttcggatcttggctttaagttgtagaatatttgtatgcacataatgagatatcgtgaggatgggacccaagtctaaacacgaaatttataatacataagtttctggaggctccagggagaatgtgttccttgcctttcccagcttccagaggccgcctgcgttccttggctcgaggtccctcctccaccttcagagccagcggggcagcctctcctctcctctccgacctcctgcctccctcttacaaggacccttgtggttcggggtcatctgattatccacccagataatccagggtcatctctctctttcctgatccttaactcagtcatatctgcaaagtcccttttgccacataaggggacacattcacagacgggttctggggatcaaaacagggacatctttgagggctgtgtttctgctgaccacgctctcctctgggcctgccctttgcatctgcagatagcagtggactctctttagggggagcaaagcctcccgctctgagcatgggctggactttgggggtccaggactggggaggggtcgacattgtaggtcaccaccatgtgtgactgtccagggaggctgggggatgaaacagccgagggtctgactgggggagagccgagaacacaccccactttatccggaaggccagccatgtctgctcagagacgaagagtcacgggacagccctgtccaagagcaaagacccgtccaagagcagggtcagcacctcggagagttccccgcaggccgccacggggcggggagagaattcatggggcttcgacttagaaggggaacatacaatgctgtggttttcactgcctctgggtgcaactcagcatttccccaattacgaagccagggccttggcccccagcaggaagcctggggtatttcattgcctcacactcacgtcccatctgctgaggggcacgtacgccaccactactcctgagtggcagttgattttacgctcacagattcgtcctgttatttagtatgttaattcaggcggctatgcatggttgtctcacaaatttgatttttaaggaatttaacatttcaaaatacttggtttcccttgtaacccctcaccttttattttctgtacctacggtcatccctcaagagggatccgtaggcctcccctgcctgccctgggcacagggacatcccgaagcgccggtcccagagcctgggctctgctgctgtttctctgtgacttgaggcaagatatcctacgctgccgagatagcagcccctctgcctggggaggtgagtgtgaggaacccggtgtactctgtcgatgtttaagggtcagtgggcgccgaatgaatggtttctgtcagcagcacattctgcatctcccaaaaccaaaaccaaaaggacagccggattttcccctctgcctgacttcactaggctcgcgtctgattttttttttttagcaccgtcagcataagggcctgggtttattttgtggttgtttatagtggaattgggtgtagtgtcctgatttgttttccaggatgttcgttttggggtcaagggtctttggggtggatgaggcgggagaaccaggcttgagtgaggctctgccctcctttcctggccccctggtggcccctccagagtctgtcccggccatggaccccagtccccgctgagccatgcggagagtttgggagaagtgcatacctgccttgggggcttgactggcaggctgctttcctctggctcatcttgaagttaaaatgtagctcagaccctcctcagcccccacgcagggttgcaacctcttccgtctgtctccctgtgaaatccaccttccagggggcagcctgggacctgggatggccctccctacctgaaacctttcaggccttccactgcctgcagggaaaagcaccggctcctttcacggacttccagcaccccttcggggctgctgctgcctggttggtaagccctgagctcactaatctcagccgtcacatgctgttgggcaccagcctgtctctttggaccataaaaacgccatgttgggttggcaggataagtcggcaagttttgatccagggctacagatttcctggttgtattgtttcaaggttaatttctttctttttttttttgagatggagtcgcgccctgtcacccaggctggagtgcagtggcacaatctcggctcactgcaacttccgcctcccaggttcaagcaattctcctgcctcagcctcccaagtagttgggactacaggcctgtgccacgtgtccagctaatttttgtatctttagtagagacaaggcttcaccacgttggtcaggctggtctcaaactcctgacctcaagtgctccacctgccttggcctcccaaactactgggattataggcatgtgccactgtgcctggccaaggttaatttcttgatagagttggacagtcggttttgctacaaagcttgttttgaaaatgagagttggttccagcatgattgatatatcagggaacagtttcaagataacacaagtttcccgttttcctttgtgagatttcacccaccagaagcactgggtgaacacagccactgcccccagctggcctgatgcacctgtgttcacataggaacacataggatgcatacgcacctcacacagccccagccgccccagggaccccatcctcgtcagggcacaacttccccgtctccactgccccgtctctgccactctgcaccagctctccagcccacctccctcggtaaacttacagcgttttcaagcccaagtgccgtgttaatgtgtctctgaaccccttgacatgtgaagctgtgctgccgtttttattagggtttctgtctgttttgagtgccctttccctaaccccattccccaacaagccctgtggttttgactgtgcggttttgcatgcagtgatttctaggaatgcagacgtcgagttgtggtggaatcgactcttctgtgctcatgtgagggaatggccttgttttgaggaaatatgcgctgaagtactcaggggttaaaaatcatatggccagctgggcgcggtggctcacgcctgtaatcccagcactttgggaggccgaggcgggtggatcacgaggtcagcagattgatagcatcctggctaacacggtgaaacctcgtctctactaaaaatataaaaaattagctgggcgtggtggaaggcgcctgtagtcccagctacatgggaggctgaggcaggagaatggcgtgaacccgggaggcggagcttgcagtgagccgagattgcgccactgcacctccagcctgggcgacagaatgagactctgtctgaaaaaaaaaaaaaatcatatggcccgtcaggcgcggtggctcacgcagtttgggaggctgaggtgggtggatcacttgaggtcaggagttcgagaccagcctggccaacatggtgaaaccctgtctctactaaagatacaaaaattagccgggcgtggtggcatgcgcctgtaatcccagctactgaggagactgaggcaggagaattgcttgaacctgggaggcggaggttgcagtgagccgagatcgcgccattgcactccagcctgggcaacaagagtgaaactccgtcgcaaaaaatagtaataattcgtccgtctcctcggcgagtggaggctggggccagggtggaacaggagctccacggtgagccaccccggagtgaaggccactggccctccttatccttgctgcggtgtgggggtgtgggtgtatgacccacagctcacatgtggaaacatggaggccccggggcctgtgtgacttgcccagggtcccagctagcaggtggcagagcaagacctgtatgcagaggcccaaggaagcgtcatgaggacccaggtcaccagtgcatctccagggtgaacctggcccctgcccagcgcatttgcctgtcccctgaaaccgccaccacacaaaaccatgtgcatcttcagagcaggaggcgtctccaccatctgtttgctcccgtttgacaaatggtcggtgctccttgaacggataaacaggaaccatccggccctcttccttgccggagctcatccctttgactccagggagggaggtcatgagcaccacagtctttatgggggagatcactggcctgcccctgggcggagaagccaaactagaaccttctccccagggtgagctcacaggcttttcccatccgggacccctgagccgattggctgcccgggacctgctgttatatcgggggctcccattgcaaagcccctgcgtgggctggcttccccgggtttggtttctccccattgtgcagggtcttggggtagggtctgagccaggtcaccctggagaaccgacagcaccggcccagccccgctgtgacctgctgaccccggaccccgcactttgcttagtgctttaggtctgtaggagtaatctttggagaatcgtgattctgggacccgagctctgagggaacaacctcctctgagcctcccaaggccccccaacattgtggggtgagccccacctcacagatgctgagacaggcctagaggcgtggcgctcccagccccatgccccacatagctctaaggcctggcctcacttgcaggtgagggtcctaggaagctgggggtgggagcaggcctaggagaggcactcaacaaccacggctcagcatggtctagaactgccccctcttcctcccggctgccccgagtctggcttccgtcagacccagcctccttccccagcccatccctctccctctttgatgaggccgatggggcaaagacctttgcttcccagaatgttctgtccctggttggaacactggtccctgggacacagccctgtcctcagctttgaagtcagttcccatcgctgccccccaggtagctggctggcttctgccaacctcagcctggtcgcagctggcacctcctcaccaggtactaaaccagggtgtgcagaggcccgctcgatccatggggcagatcagcaaatggtagtgcaggatgccccatcatatgtgaatatcaggtaaataacaggtacttctttttttctcttttttttttttttgagacagagtttcgctcattgcccaggctggagtgcagcggcatggtcttggttcactgtagcctctgcctccctgatttaagcagttctcctgcctcaggctcccaagtatctgggattacaggcacctgccaccatgcccagctaatttttatatttttagtagagacagggtttcatcatgttggtcaggctggtctagaactcctgacctcaggtgatccgctcccctcgacctctcaaagtgcttatattacaggcatgagccaccgcgcctggcctatttttttttttttcccttggcaacagggtcttgctcttttgcccaggctggagtacagtggcgcagtcatggctcacttcagcctcaaattcctgggctcaagtgagcctctcaccttagcctcctaagcagctgcaactacaggtgtgcaccaccatgccttactaattttctttaaaatttttttgtagagataggggtctccctatgttggtcaggctggtctcaaactcctgggctcaagccagagaggggctggcctggtgctctgggttctccagaccccctcctgccttggtctcccacagtgctgggattacaggatgagccacggtgcatggccacctgatggataatgtctaatataagagaacccctaatttagctgtccctgtacccttgtgaggtgagcagtattgttgcctacattctatagatggggaaacagaggccacagaggcctagcagcctgcctcgtcaccgagtgggagcttggcagggctgggatctgaacccaggccgtcggctcctgggcctgtgtgccccctccatgaccatatcagcttcctacagcttccatgacaaagcaccacaaaaccggaggcttaaacacagaaacgcagtcccccagctccgggcagaagctcgagacgagggtgtggcagggccgtgccccctctgcagcctctggggagggtcccttccggcttctgggggctgccggcctccctggagtggccacgtcacttgttgctgctgtctccctcgtcacgtggcctctccttctctgtctcttagctccctctgccccgtcctgagcacagctgtgattgcattagggcccacctgtataaccgaggatgccctcttctcaagagccgtaccttgatctcatctgcagagatgcttttcccgacgtgaatggaatattctgaggattaggacgtggacctaccttgttaggggccaccattcagctgactgtctttgccaagcacaggcagtggagactgtgtcatgctctgatccgaacaatcgtccttctgtctgccgcccgacttccccagccctgttcagaaagacagaaggaactcctgccccaccctaagctgaagtcgggagcgtgaggaccctttatctggtctttgggggccaggtgggttcacgggcacaggacagcatgacaggcagggcctggcattgggacacctgggtcttagtcctcacctgtgacagcggggggtcttgggcaacgtcccacccctctctgggccttgaagatgaaggggttagatcctggcctcccggagcttcccctggtgtaggatcaacacactttttctgtcaaggactagagagtattttaggctttgctggccctgtagtctaagtcacatactcttctctgtctgtttttgtttgttttgttttgttttgttttgtttttgtttttcctacaacccctttaaaatgcaaaacccgttcctagctccaggccatggctgccattgggctgtgttgagcctgtggcgcgtgcacaggcccctgcccttggtggacactctgattccacctgcaaatcctgagcgcacaccggctctgaacaggctctgtggcttcagaaacttatcttctggcttcgtcgatctggctggtttgccctggggatcccgcatcctctgactaccgtgatgagcagagcgcagcgcccggctccgtgggccaacttttggtgtcttgccctgcctgagcctgttcctccttcctctccctgcccctccagccgctccgggtcctctgggaagctctggcctcttcaccagccctgcgcggctgctggatctggaggccggagccggcacatgcgtctgacagcagcgctgctgtctcttgtttttcgtggtccatgtttgggggttacatctgggcctgtcccttctctgtgtagcctgaaggcagttcccaggcttgtgtccctcacctctccgcagacgccctttccagatcctgttcaaatcctggccctactcacgggaacttgggtgagtcagttcccttcactgagccttcatgcctccctgttaaggagaagcttcactcggcatggcgtggcccgtcacactcatcctgcatctgttacaccaaatgcagtttcctcttctataaatgggagaaaatcacctgtccttgccaagggtccggtgggaattaaatgagctgagccagggcacgggtggagcttgctgagtgttaggtcgtgtgcctgctcttcttggcggagtctggccagatacctcatctggttccattgctgtcagtctctaaatggggcctttcctgcccagctcccagccctggtgctcacaccatcacaggccaaagaactggattccagacactgcctcctccactgtccccacagtgaaaatggggagggatgtccctgtggagccctaactgggacccagacagccctacccccagctcccaccccctccggctgtcccggaggccgtgctccgtggatctcctctccctcgcctccacgtgggctccaggtagctgcacacgcattacaaacatctcgttaatcttctcggaggtcctgcgaggcgaggcctgtggtagccctgcccttggagcactgagaattagtaaggaaatcgccgctgcatctcccggtggcacaggggcgtggaggcgtggcgggccttccctcttgcaccactttggatcctgggtcctcacagcagtgttctctgcaggggaggtgcaggcattggtctgctctagggccaggtggtctaaaaagtccctggtcagccccgagtcctgcaggaatctgcatgttagtgggatttggggttcaggatgcttgcctgctgggtaggatggggttgctgagtgaggctgaaatcccagatgggatgtctgggctcctccatgcctgacttgggaggggtgagaaaaggaaggagacttggccatctttaggctaaaagcctagtgctgtctcacaggagggaagagcaggtctctgcaacacacgcctggggttccgtcccctctggccacttgtctgtcaccttggacacgttgcctggcagcctctgagcctcagtgtgcttctgtgaattggggtgaccctagcacggtgctcacgacagaaagcatgggagtgcagacgtgggtcagtggcccgcggtgagagctccctgtctgccccatggtgagtttccacagcagtgagagaggcctggcgtgtggggtggaggccgggacagtgtgagggccgcctggtcagagcgggaggcaggaccccgtagggagatgaaagccaagctggacccaggcagaaaaagaggaacgaaggacaggaagtccaagagcagtcactgctgacgtgagtgcggcctgcaggcagccagtgtggatggactctcaggccctccgttgtgtgttaggggaccggaggagcagagaggttgcagcagccggccggcctctctcggtgagggccggactgcacatggggctcagaggccgtgggtgtgcctgcccgcctgtgtcagctccagccgtgggggcgggggtaatccgaggctgcgtcccgaggctgtgggagctctgccttcatccttccattcacaggtagggacacaggcgtggggattccacggtgcccttgaggcagctgtttcctagacccccaaggccctgacggagactcccccacccctcaggagcagagggtgaggcggggtctgcaccggccgatgtgggcaactgttgcaccctcggagcccagcagcgagggtgggggtctgtggggagtcagccgcagccaccagcattgctggaatgtgtcagaatggtggtgcctcctgcaaacaaccttagcctctgttcatcctgtcaccagggtcctgggagaagcaaacccacgtgtggcctctgcagggtgggtggggaggttctcccggccaggcctgactgacgcccctgctgctccctgtggtccagcctggacttgccaccgattattctatcaatggcactgcactgggcaccaggatccaagcagtggactgcgggacaggacctgtccctgtgagcggcctgtccctctccccaggcccagcctcctgttggttatccttccaagcccatgcctgggctgtgcgatccacctttcctccaggcactcttcaggcaaatctctggagcacccactgggtgccacacactgcggatgggacgcagggtaccgcacagccccggtcctcagggacccggcggggacagcactggtgaaaaaccacggaagtacattgatgtgtcacttcaacaggggcctacgcaggggcctgccctgtgccaggccctgtcgttggtttgtggggtgaagaccctgttcctatggtgtggacgtggtagagatccaggggctctggcagcttgtatgggggaatggggacgggaggggggtcaggaatgggcttctcgagagaagtgacatttggtcagaggcccaagagcgggaattgatcctggccctccctgaatcagtgtggtgtgacccctcccgccaaggtgagggtagcaaggtgcctggggctggaatcctggggctgtggcccgtacagtcgcccgggacccatgcccagcagggccctgcacccggagtttaacactgaggtccccaccttgaaattcctaatcattgagtctttgtaacttgtgttagggagtccagcgagacaatggggtatgtgcggggtctttggagcttcagcccatgcacagacacgtctctctgttcctcgactcctagcatgctctcacctgcctgccccagagaccaagccccacctggccccttcgtcaccccgaggtggcgactgggttgtgctgaaggagggaggcccacacgccaccactgccctctgacccgtcaggggccccgagggcctggttggtcagggctgggcactccacccaccccggatgacagcaccaggctcatgtgccaggtgactcagccagggccactcaccagcgccacctggtatgtcctgggtggcggccgctgtgcctgctcctatccaccatggttgggcactggctgggaagagaggtgaccaccaggccctaatagcaggagtcacccacacaacccttgtacccagccctggggtccaggccgcctgcaccggctcagttctgcgcctgagctcccagctctggggtccaggccacctgcaccggctcagccctgcacccgggctcccagtgctggggtcccccaccccttggtgttgccgcatcctccctgggcccaagattcctggagctggagaacccccttcctccctgaggcatggagactgggctggtcctgagcccactccaggcacaggggacacacctgcttccttcttaactgagtagagcagagttattttgaagatcggttttcagcaggacagtaaaaaggcgaactgggagattgttcatgcagcagcttctaaaaccagtttttagataaatgcaccttcgtctgtggggggtggccgcacccagcctcgcttcaggtgcctgacggggtacgtgctgcgttcagtc

SEQ ID NO: 2453 - DNA, 6290 bp, Homo sapiens
ttcttagaacgtgtggccatggaaatgtgctctttttatgtgtttacctttgtatcagccgtcttctcaatgagaccagaatccctatcagagcaaggaccttgtttgtgtctcccttttcctctatgtcctaatatacaacagtgtgtttagcttgtagcagacactcaatttaacaacatctttttgaacgagtggatccataaatgcattaagtggctctgtgacttcagactcttcttcaggtttacggtatataaatatatcatttacggtaccttcatttatggtatataggtgatattttagccggggtgcagtggttcacacctgtaatctcagcaccttgggaggcagacgcaggtggatcacgaggtcaagagatcgagatcatcttggccaacgtggtgaaaccccgtctctcctaaaaatacaaaaattagtcaggcatggtggtgcgcgcctgtaatcccagctacatgggtgcctgaggcagcagaatcccttgaacctgggaggcggagctcgcagtgagctgagatcacaccactgtactccagcttgggtgacagagcaagactccatctcaaaaaaaaaattgttatctcagccaggcacagtggctcacacctgtaatctcagcactttgggaggctgaggcaagtggatcacatgaggtcaggagttcaagtccagcctgaccaacatggcgaaaccccgtctctactaaaaatacaaaaattaggccaggcgcggtggcgcacgcctgtaatcccagcacttggggaggctgaagtgggcggatcacgaggtcaggagatcgaaaccatggtgaaaccccgtctctactaagaatacaaaaaattagccgggcgtggtggcgggcgcctgtagtcccagctactcgggaggctgaggcaggagaatggcgtgaacccgggaggtggagcttacagtgagctgagatcgtgccactgcaatccagcctaggcgacagagtgggactccattatacacacacacacgcactatatatatatacacacacacacacacacacacacacacacacacacacacaaaaaaaaaaattagccgggtgtggtgggcgcctgtaatcccagccacgtgggaggctgaggcagaagaattgcctgaacctgggaggcagagtttgcagtgagccgtgatcatgccactgtactgcagcctgggtgacagagcaaaattctgtctcaaaaaacaaacaaaataaatgatatctcaataaagctgctaaaaaaaactcgcccaccaggtacccatcaggtatcttatccagcataagaacagctgggctgtgtgctgtctgcacctcatcccatgaatctttgcaggggttctacaagggtcctccttactaaaccccctgcacaggtgaggaaactgaggcccagagattatgcagcctgcccaggtaaagcagctggtgaacgtggacagcgtggcccccgtcataccttctcgccagctgacggtgctgtccagggagtctggaaagcagagatccaaaggaattggctgggctggaaggctccttacagaagagctcgcttgcccattcactcattcatttgttcagctgaacacccacctacgagtgtgtaccaggcagacccgctcctgtctccacgaaccacaatcacagaattgtgtaaacgaggtaaagccggaggcctgagattgtggggatggggattgaggtcaggactgtcttaccaaggagtgacatttggcctgggattgaaaagtcacgaaggaactgaacattaagaccctgtatgtaaggctgggtgtggtggctcccactgtaatcccagcactttgggaggccaaggtggaggaatgcttgaggccatgagttcggaatcagcctgggcaacatagtgagaccccatctctacaaaaataaacaaaattagccaggcgtagtgtcttcctgcccacttgggtggctgaagtggaaggactgcttgagcccaggagttcaagactgtggtgagcagtgattgtgccactgcactccagcctgggtgacaaagggagaccctgtctctaaaaaataagattataaaccagccaggcgtggtggctcacatctgtaatcccagcactttgggaggctgaggcggttggatcacctgagggttttgagaccagcctggccaacatgacaaaaccctgtctctactaaaagtagaaaaattagccgggcttggtggcacatacctgtagtcccagctacttgggaggctgaggaaggagaatttcttgaacctgtgagaaagaggttgcagtgagccgagatcatgccactgcactccagtgtggacagcagagccagactccatcacacacacacacacaatatatatatatgtgtgtgtctgtgtatacacactcacatactcacactctctgtagtgggctgaatggtgtccccaaaagctaggtctgcctggcaactcacttccaacttcttggaataagggtctctgcaaatggaattagttaaggatctgcagatgagattctcctggatcaggctgggccccaatccaacgaagagtgccctcgtgaggcagaagaggagagagacacgtgccggagaaggccacatgagggcagaggccgagaggcgggagtaaggccaccacgagcctgggaacgccgagggcgccagcagccgccagcagctggagagaggatggatgggaggattttctaaagccttccgataggggtgtgacttcttgattttggactccgggactgcaggaccgtgagaaaaggagtgagtgttaagtccacctagttagtggtcattcattaccgtagcccgggacacttacgtgaacttcagacctcaaatcctccccatcttgcagccccaggcgcagacctgggcagtggggcccccgtgtgcccatcccccagctggccaggctcagctgagagctcctcgacctcctgcctgtccctgccacccttaggagtccgagaaactggacctgcccgtggcctggacaccacttcctttattgcttagggtttctctctttctttctttaaaaattttttaaatgaaaaatggggctgagggaagactcggtctaaagataagagaggggtcacctggatctggaatgttctctggctttccaggctgctctgatcgcagacctcctgtctttaacaacccagcctgggtcaggtctgatgaaatgcactttccagggaatggggctggtttgggctctgcagaagcttccctcttccatcctggcaccggcagaaaagcccattaaaataattgcagggagagactgttacctaagtttcctccccttgagctgttggagctcttctttgacctttatggtttttaaaaccctgccaatccttgccttgtcccccggacgcattcatccagtgggttgggaagctggtgttcgctgtccgggctgggtcgtgccggctctccgtgtgtgcacgtgtgggtctgggctgggtgttgacctgctcctgggccagggcccaccagagccttagtccgggtggccaccatctgggaggcccggccgtgtcctctcttaccccagttctccaggcactggccaggggccccctcagcacacatgtcatagttggtccctccctgcccatggcccttcagaggcccccagctggtcttgggaggagggtgcctgtgtgggccagctttcagcacagcccccgccctctgctccagccttgggtgcaccccaaccccacccagctgaccagcctgttggggggcctgtggaccccgcctctaagcctgggtcttcctctgggcacccgttggggacagggcagccacacacccagcccagggtgtggtctccccacccagctgcctcccttgcaaaggcagggttgccttggcaatgacacctgaggaggagacgcttgccctgggtgcgctgtttccctgtcttcagtaagggaggaggctggcttcctctggcggagggaggcagcagctctcctttgccttggaacccgctttgctccagtgatccctgagccaccacattggtaagactggctggagctgaaggtccgagtgtggcttcaggactggtgacgatggccagggatgaagggctgcggcgtgtggaggggctgcgcccggaaggaagcggtgtggacccagaaggaagcggagccctggtgggcagcctggctgtgctctggcccaggaaccgggccttttcttgcctcttgcctctgactcagagcggcttgtgggagcctcgcatgcagggccaggcagggcaagaacgatcgcgaccttttcctccagggaaggttgcaagaaaggcgggatctgtaacgtgactaggtggaggcactacggagccatggtgcaggggtggggggccccaggtgagctcagatgccctccctgcctgtgccaccgtggcctgaccctccacaggtgggagccataggcgtcaggagccattaccccttggagaactgggtgccaggccgagacctggtgtctcatttatgacaaaccgctgcagtgcgtttgggagtctcctcctccatgacgtgcttgtctggattggttttattttagtgcaggcaccacgtcgtctttttatatacgtgtgaacgtatatatgtaaacacacgtatgatgttggtgagttcatgttggtggtatttttactaagcaaagatgtgggaaccaaatgggcccatccggggagtttcccatttggtccctcgtgctgtgtgtggtggggggcattgtggtcgaggtctgaacagccggggaagtgaaagaccccgtcctctccgggagcttacgggagtgggagagacattgacgaaatattacccatcgcaggagtcaggtgcacacagtgatgatagttccgggaggtcaggtgcgcgcggtgatgacagttccggaaggtcaggtgcacgcggtgatgacagttccgggaggtcaggtgcacgcggtgatgacagttccgggaggtcaggtgcgcgcggtgatgacagttccagaaggtcacgtgcgcgcggtcgtgacagttccagaaggtcaggtgcgcacggtgatgacagttccgggaggtcaggtgcgcgcggtcgtgacagttccgggaggtcaggtgcgcgcggtggtgacagttccgggaggtcaggtgcgcgcggtcgtgacagtgccgggaggtcaggtgcgcgcggtggtgacagtgccgggaggtcaggtgcgcgcggtggtgacagtgccgggaggtcaggtgcgcgcggtggtgacagtgccgggaggtcaggtgcgcgcggtcgtgacagtgccgggaggtcaggtgcgcctggtgatgacagttccgggaggtcaggtgcgcgcggtgatgacagtgccgggaggtcaggtgcgcgcggtcgtgacagtgccgggaggtcaggtgcgcgcggtggtgacagttccgggaggtcaggtgcatgcggtgattgttccggaaggtcaagtgcatgtggtcatagttccagaaggtgtccccggggcaggatatgttttcctattttccttggcttccggggagcttggagcctgctttcctttgggtcctgggctgattttcgggcaggtgctgggatgcagtgtcctgggtgctgcagcatggctgagcctcggattctctgtccagggctagctgtgttcaggccgcgcatctttagttttggggcatcgcaaatcctcctggaatctgatgaaagctgtggaccctctgcttgtggcggggggtcatgcagaaaactttgagtacagtttcaggagatgcacggaccacccaagggcctggaatcggagcccccacaagacagggggtgtgctctctgggccagcgtttggagcactctctggctcttggagccctggtggggcattcccagcagcttgcttcatttcctggacacgtgttcttggctgtggtttatattactctctgtatgtaaatgtcataggttttttttcttctagtaaaattgttcctagttagcacagtggaatcttgaaacaagaaagccatctttcatgaacagtgtgtggtttccaggcttagcccatggagttggagtgacaggtatggcagagatggggggtcaggctgcgtagaaggtgtttgcgccccctaggtgcaggtgttaatcctcaccaccagggcgatggtgctaggatgtgg

SEQ ID NO: 2454 - DNA, 20115 bp, Homo sapiens
ctgaggtcgtgtctgacagtttctcttcagctctatgttctcacagatattgacacagacttcggccacgctactgtggtcgcaggggtagtgacacagacttcaggcatgctctgtgcctcatggatactgacacagacttcaggcacgctcagtgcctcgtggatattgacacaggctttgggcacgctctgtgtctcatggatattgacagactttgggcacattctaaggtcttgtggatatttatgcagactttgggtaggctctatgtctcgtagatattgacacagacttcaggtacgctctatgtctcgtggatactgacgtagactttgggtacacactatggtcttgtggatatttatgtagactttgggtacgcgctatgtctcgtggatattgacgtagactttgggtacacgctatggtcttgtggatattgacgtagactttgggtacgcgctatgtctcgtggatactgacatagactttgggtacacgctatggtcttgtagatattgacgtagactttgggtacacgctatggtcttgtggatattgacgtagactctgggtacgcgctatgtctcgtggatactgacgcagagttcggctatgctctatcactacccatctttgttgctcgggttgttcaacgacacacagctgccactaggagcctttacagctactcttgggtccctgtgacttgcaccatctttgtgggttcctttgagcacctccttaggctctggcaccacaagatgctcaattcctcctatatactccctgctcggccctacgattcgccatttctcaagggagccctggttccctttgttggagaatagtgttagaaaccaagaaaccaggggccgggcacggtggcttacacctgtaatcccagcacttcaggaggccgaggggggtagaccatgaggtcaggagatcaagactaatcctggctaacacgatgaaaccccatctctacgaaaaatacaaaaaaattagccaggcacagtggcaggcgcctgtagtcccagctactggggaggctgaggcaggagaatggcatgaacccaggaggcggagcttgcagtgagccgagatctcgccactgcactccagcctgggcgacagagcgagactccgtctcaaaaaaaagaaaagaaaagaaactaagataccaagatttgctgtaatcccagcactttgagagtccaaggtgggcagactgcttgagttcaggagttcaagaccagcctgggcaatggcaaaaacccatctctcccaaaaaatatgaaaatcagccaggcatggtggcatgcatctgtagtctcagctactcccaacgctgaggtgggaggactacttgagcctgaaaggcagaggctgcagtgagccaagatcatgccactgcactccagcctggacgacagagtgagacttctcaaaaattaaaaaaattaaagagaccaagatttgggcaatggatgtgtaaactgctaccgggtagtattgtttctaggccgtcccatctggtagagcaaggaaatatttgtttatggttatttttcttatagctaacatgtactgtatttactataatggaaaaaaaacattttccttttgaaacatgcaaatgatccactgtccacagagacttcatatttccacctgggcctgagtgtcctaaaactaagagggctccacattggccatatggagagtgacctgaatctcaggaagtgaaaactgagtctgggtctcttttgttctccttctggaaacatctgtgcaattccagtgatgcagtttctgcacattacagacagtgattgagactagtctctttttgtaacaggttgatagaaaatggctgtcatttccatgcctgcttttccaaacctaagggcctagcattattgtgaactgaattgacacccagagacttcatctgctggggggacaaggaaggaattcagtgacgtctctatttgtcatcagaaactcaaatcgctgcttagcttcggcaggtctctgtctccttgtagtaccctgcacctgtctatatgaaccgtcttgttttgctgacagcaacattgtcttcttagaattaacagcctatgggggaatgttttatgctacaatatttaagtacttcccctccagaccatgcaagccagagaggtggagcacttcacaaggcctgatctgctcacacgggtccacaggttccttccggcacacagctggctggccacaccctctaacagggcccatggttcgacctccccaacagcttctaactcctccttctacagcagtttcttttcttgaagtgttgtgacttttcccaaaatccaacctgtctgtcttcaaagaaagtaacagacaacggccttgttgccctctgtttttctggatcacctgtgctcaagctctattagcatacaccaaaccagctttacattcacgcagtctttccacaaaaaccgattcgctctcgctctccctctccctctccctccccctctccctccccctccctctccctccccctctcctccccctccccctccctctccctccacagtctccctctccctctccctctctctccacggtctccctctgatgccgagcggaggctggactgtactgccgccatctcggctcactgcaacctccctgcctgattctcctgcctcagcctgctgagtgcctgggattgcaggcacgcgccgccacgcctgactggtttttgctggagtgcagtggcgtgatctcggctcgctacaacccccacctcccagccacctgccttggcctcccaaagtgctgagattgcagcctctgcccggccgccacctcgtctgggaagtgaggagcgtctctgcctggccgcccatcgtctgggatgtgaggagcccctctgcccggctgcccagcctgggaagtgaggagcgcctcttcccggccgccatcctgtctgggaagtgacgagcgtctctgaccggccgcccatcgtctgagatgtggggagtgcctctgccccgccgccccgtctgggatgtgaggagtgcctctgtccggccgcgaccccgtctgggaactgaggagtgtctctgcccagccgccaccctgtctgggaggtgaggagcgtctctgcccggccgcccggtctgagaagtgaggagcccctccgcccggcagccgccccctccgggaagtgaggagcgtctccgcccagcagccaccccatccgggaggtggggggcagcccccgcccggccagccgccccgtctgggagggaggtggtggatgcctctgcccggctgccccgtctgggaagtgaggatcttcccggccgccaccccgtctgggaggagtacccaacagctcattgagaatgggccatgatgatgatggtggttttgtcaaatagaaaagggggaaatgtggggaaaagaaagagagatcagattgttactgtgtctgtgtgcaaagaggtagacatgggagactccattttgttctgtactaagaaaaattcttctgccttgggatgctgttaatctataaccttacccccaaccctgtgctctctgaaacatgtgctgtgtccactcagggttaaatggattaagggcggtgcaagatgtactttgttaaacagatgcttgaaggcagcatactcgttaagagtcatcaccactccctaatctcaactacccagggacacaaacacacggaaggccgcagggtcctctgcctaggaaaaccagagacctttgttcacatgtttatctgctgaccttccctccactgttgtcctatgacccagccaaatccccctctccgagaaacacccaagaatgatcaataaatactaaaaaaaaaaaacaaaaaactgattcggctacggtaaagtagtaaacagaatctgcatgaatttttggagaagttagacttcattctaatacattattgctggaatgcaaagacatctgagagagagatcaagtgtcaacatggagggtgagcgcaacagggctggctctggaattacttagcatccggctgagaccccagagcccagcagagctgtgcctgaacgtttggaggcgcatcggccgcacacgccaagtcccaacgggcccccacctcccgcacaatgtagtacaggccacctagcttagcctgcagccacatcccctgatgagaccccacctcccgcagaagtacaggccacttagcttagcctgcagtgagtcctcaatgcagctgctttggctcacccggctgtcggctcagacgccgacccatttcaatcatcaggagaggagaagacacacagggccgccccaaggaccccgtcaccagctcaggccaggtcacagaatgggccggcggtgcagtggtaggtagataaaggccggggagcgtttgtgggagaagacggccagacgactggtcctgggagaagacagtgctaacggcagcactgatgttcaccgaaatcacaatcaggcagggatagggtgtcggttccaagcggacgtgtgtgaacacagaaaccatgggggccgctccttcccacaccactgagactgtccatccaggcgcccgaagacgactcctaaaccacctttgccagacgcaggtccagcaacccatcaagagcacagctcgggcaagcagcgaccgcacgcaccgtgccctcctcaccacacaaccacaggtgatgagcccctgcggagacgccgcgcccctggggagacgccgcaccacatcagtgcacaggaggcatctcacgttttgcggggcttgggagagagggacccatgacgagaggacccccgcccaaccacgtgtcgcgagagcagcatgaagccgcgcgccccctccaggcagagctgctgctaaaatgacaccctgtcggttacggttagcatcacttccatcagcaccacttctagtcagcttccttttgaaaactgcttcagggaagctgctccagaagcccatgcatgtgccctgccacagccgcagcctctttggggacactgctgtcgcgatggtttctgcagagccagcccggggtccccaccgtgcctgcctctccagtcactcagtcctttctcctggaaccgggtcaagtccctctgcgtgtctgaaccgggacaaggccctgcctgcttccatacctgaagctgggccccagggcaccttcccatccacatccgagaccaccttcttaacggccaacggccactcaaccccccacagccaagacttctacctgtcgctttccaagactgaacattttcagcttcgccattaaaaaatacacccagaaggccgggcatagtggctcatgcctgtaatcccagcactttgggaggccgagacgggcggatcacaaggtcaggagatcgagaccatcctggctaacgcagtaaaaccccgtctctactaaaaatataaaaaattagccgggtgtggtggcaggcgcctgtagtcccacctactccggaggcaggagaatggcgtgaacccggtgggtggagcttgcagtgcgccgagattgccccactgcactccagcctgggggatagagcgagactctgtctctaaaaaaaaaaaaaaaaaaaaaaaaatacacccagaaacaggtgtggccacaggtctgcgtgtgctggaacatgagtagaagccactgtcgcgcccaattccccagcacgagacaagctgagacaacctgcagccggtgacctgggagagctgggcacggacctcaggggccaggtgagcacggagctctggctccgaggtcagccgggatctcccaagtcacacagtccacactcgcaacaactctgtctgcttctggtattccaggagctcagctcccaagtggcaaatgaaaggacgctctggcctctgccagcatgctccacggcctcgcggtaacagtggggcgtgcagagaacagccctctcctggttatgcatggacgttatctcctgacctccaggcgcacaatgacaactgaggtcaaaacgcaggcaggaaggagggccccgtcctcagcaggactccgcccctcgctgcccatgtgtccatggaaacagaccactaggtgataaaccttccaccgtcgcgcccccaccctccccatccaaacaccatttccaaagagctgtgctggttccctgactctctaaaggaacgagaactccccctctccagaagctcccacgacaccggaagcacatactaaggactgagtctttgacacgtgaatgttgctgggtctaaggactgagtctttgacacgtgaatgctgctgggtctgctgtcccacacgctgcatctctttcgttaggatacaagtcatcatagtcaaagcactagctggacccagactgactcggaatttataaaacgtggttacgatactgaccaaagctgccggttcttcgtggcagcgcagagcctggagggtgtttaaagtcctcccaaggctactcagatgcatctcctgagggagcctgggacgggatctggttacaggaggaggaaggagggcaggtgtctgtgagttcctcttaatctacaggcaggtccagccccaaggtcaaggctctgagcactactgtccacttcatgaacccgagctcttcacatgtcaaactctggagccttgccatgcagaaccacggtcagaatgccttcatctgatcaaacactgtcaagcacgccactgtccaggcaccaggcacgcaagtggacagaagactggccctgtgagactctcttctccgggctgagagacaatggccaagtctgtaaccagcagggaggatggtgagcagaaggacaaggacacgcagggggatggaaactggggccgccctgctgagacgaggaccatgggggttctgcatagaggagacctggcctggcttgcatctctgcaggtcactccagctgctgcactgtggtgtgatcctgagggccccggggaggcgccaggtctggcaggagagtgcagtgcatggcagtgggcaggggtcaggcactctccaagccacctctacttgctcagtgaaatgtgaggtgagggtgggtggcgggtggcaggacctcctgggagcatggacggggcctgcgtgggagagaggcgtgtgcccacagtgtgtggggtcttctctggcctgggccgcgcagcagcacagcacagctgggtcatgccaagaggacagagcatggcgggtgagggtgtaatggcgccagagcaaggacgagcttcccccagccccaagctcaggtacgggccatgtaccaaagtttctatcagttcgtgcacactgccgcttcagccatggcgcagctgaccacctgcttaggctactgacttttttttacactccaaaccattcacaactcaaatctctcgctaattctgataaatctctcatgaatccaaacagacaagcttttcactgcaattccaaatgccacaggctcagagccaagagctactgaactaagtggattgagatcacccaccgtcagactgagggcgggtgcacgtggctgcagacagcagctgctgagaatgacacgcgactctgatgaaagcgatacagcttagccggtctggctgttcaccgtcctgctgcactctacgacacatctgctgggagaaagcactagaccggggcatcctgcctggctttcagccaagtcagcctgttctcagtgccctcccacatgccagaatatctagacaagcctgaccgatgccagccactactccagaaaatagggtgattttctctgtgcagaacaaaagatgaccaagaaaaaaatcgggtcattccgatcaactcggtacaatctctgaccaactgccattaaaaggctgaaatcctttattgccaaggcagcagaatgaacgtggatcagaatggagaaacagacctatgttcctgcaggcatgtgattttcaacaaaggttcctaaggtattcaatggagaataaaaagccttttcttttttcttttttttgagatgagtcttgctctattgcccaggctggaatgtagcagcacaatcttggctcactgcaacctccgcctcccgggttcaagtgattctcctatctcagcctcccgagtagctgggattacaggcacgccccaccacgcctggctaatttttgtatttttcagtagacatggggtttcaccatgttggccaggctgatctcgaactcctgacctcgagtgatccgcccgactcagcctcccaaagtgctgggattacaggcgtgagccactgtgctcggcctaaaaagcctttccaacagatgctgctgagacaagtgagtatctacatgggggaaacagcctcaacactcacctaatgctgctcttgagaattagtcccgggcagatcacagggctaactgtgaaaccatatcatttttagagaaaaataaaagaaaatctttgttactgaagctaaacaaggtcttcctgtatcacagaccgcaataatcacaaaagaaaaacgtaataaattagattttatcaaaaactcaaagcttctcatcaacaaacacttcggaaggtgaccagccaagccactactgggagggtatttgtaatccacacacctgaaaagaactggtgtccagaatgtcaccttctgcaactcactaacaaaaactacagcccattaaaaatagcagaagacatgaacacacacttcaggaaagacaagctcatgaaaagcactcaacaccagcagtcatgagagaaatgagaattaaaaccacgaggtaccacacatccaccagagcagctaaaaacagaaagactgacgccattggggctggtatgaacagggggcaactggaactccccaacatttccagcacaagtggaaccggccactgcttcgggaagagagctgaccattccttattaaataacacccacacccacacccaccccagggcccagcagctccactccagatatctatttacccaagagaaaccaacacacgcagccactcaaaagattattatggacgtgctcatagcagcttcagtcacagctgcttccaaaggctgtgtcttctgaagaacggaaacagcccaggtgtccaacgaaaaacagaaccacaaactgtgggacagtcatataatggaacacttcagcacgaagcagcaatgaacagaaacatgcaacacgtgggtctgaaaagctgagggaaagaagactggccccacacatctgggtgacttgtttagcagaagctccaggacaggcagatctattacggtgggaaaatcagagcagcgtcacctctgggcggaggggagggtgggcagcggggccgagtgggaagggcacggcaggatcagggtgtgagtcacacggtgcccgcacttgtaaaaatgtgtcccctcactgtgggtcaatgacgcataggaaattaccaccgactacaggcgcccgccaccacgcccggctaattttttgtatttttagtagagacggggtttcacagtgttagccaggatggtctcgatctcttgacctcgtgagccgcccgcctcggcctcccaaagtgctgggattacaggcgtgagccaccgcgcccagcctaagcatagcaaaatcttaatagcaggatctaggaggagtatacaggtgttccccgtaaaattctttcaaaagttagctgtggttgaaaattttcaaaatacaaaggattttttaaacccctacagtgagatactacttcatacctctcagattcacagaaatgtaaaggttggcagagtgtgaaatgggagtgaagcaacaggaacacttgagttccgaggacagagcctgtgccagccgcctctgtgaagcacacgccccacgagcagcaggcacatgtgaggagcacacactccacgagcagatgccagtacacgtgcagagcacacgccccaagagcaggaggctccggggtgggcgcgagaacattcctgtcagcactgttctcaggttaccaaagaaacaagcccgttaacaggagcgaggagaatttcattccacagagactactacacagtagtgagcgtccatggtgcaggaaggagaccctcagaacacagaatcgctcacactgcactgctgacaggggtgtggagaacagaacagggccctaacacggcaccaagttcacagaggagccgattaacactatctctatttctaattctatacaaagaactgtttatattcaaccaatgagtaatcccatgtgaaagcttcaatgttcatgaaactgaagagaccacagacagcagcgcctattttcccacgccgcaactcacccgtctccccaccccgcgcctcgcccgtctccccacgccgcgcctcgcccgtctccccacgccgcgcctcggcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccaccccgcgcctcgcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccaccccgcgcctcgcccgtctccccaccccgcgcctcgcctgtttcccggtccaacgccttgcctgtttccccaccccccgccttacctgtttcgagtagcccccatagacgacgatgccgccctggggagtgacggacatctggcagcctgatctgggtgtgggccccgtccctgacggggacagcttgctccatgtgaaggtgtccagattaaaggcatacacgtcgttgtagtagatgtaatccctggttagaagaacagcagctgtcagggtccgtaacattgggaaaagccctgacattaaaaactgaactgatttaaattaaaggtaaatttcctactgtttggggaaaaactcaaaccatttttctcctctgctcttacaccaacacaacaatcaacacagaaacgtggccgctttccctgcaacgagccagagacgccagtcaggtctcctcaaactcaatcttgacgcaatctacctggagacagggcaacattttcacctgtttaattcaagtttgaattgatatgaaaggaccacaagcacgtatgagtttgcatttgaaaaccggaaataatgctggcccacagaggcagaggaatttaatctgaaagccatactgcgttttcttacacagttaacacaatcagagacaattccattaggttattaggtgtgcaaccgtaagggcagcagtgaatggcgcctccaaagggatgatcagaacggaggtgtgagcagcctggcagcaagggtggtaaggccccacagtggactggaggggtgagcgaggggactgggcgctccagggaaactgaagaccacagaagccgaccctctgtgcccgaaatcacagcgcggcaaggaggccccgcagccttgccctgctcagtgcctgccggacccagcacgcagactgggctgaacagggaagtggcagctttgctggaggcatggggagactcggaggcgcacccagaaagtcctgtcctaatgtggaactttgacacaattatcgtgaaagcgtaaggggctgctctccagctactcaaaaaggagagccaaactcattttttaaggaaagcatggaagagcaagcagctctagcccaagtctcaagtgcccggttttctcctgtttgttcctgttttgtgtgaagcaggaaaagtcacagggcgtttacccagcaccagctgccacatctggtcttaagataaacagcctgggcacagtggctcacacctgcaatcccagcactttgggagtctcaggcaggtagatcacttgaggcgaggagttcaaaaacagcctggacaatatggtgaaaccttgtctctactaaaaacacaaaaaattagccaagcatgggggcgggtgcctataatcccagctactcaggaggctgaggcacgagaatagtttgaacctacgaggtggaggctacagtgagctgatcacgccactgcactccagcctgggcgatcgagtgagaatctgtctcaaaaaaagaagaaagaaaagataacctgaccttgctgactgcaactcagactgaccacatccttcgcaggacgatggctcttaatatagatagaatctgaggaatgtggaaatgtggaagcgtgtaatctttaaaagactgctacagaccactgtttttttcagatttcacgtcgcagatttttagtacaaagattctactttgcacgtaagataaatacagaatattttctctataaatgcagaatagagtttaaggaaaactcccaagttggtatttgaataattttaaacaagataacaacagctttgaaaaaagttctgattttaaaatggttgcaagttaaaacaaacatgaagcatgatttgatttataacctgtaagttcaaaggaggaaggggctgtacaatctcactgtcctacacatagtaggtaatgaattaatgctctgacaaacttatgtgtgcattctgacaattatttgttttaaaataaattttaagaatgaacataaggctaggcgcgggggctcaagcctataatcacagcactttgggaggccgaggcatgtggatcatgaggtcaggagttcgagaccagcctggcgaacatagtgaaaccccgtctctactaaaaatacaaaaattagctgggcatgcggctcacttcaacatccgcctccccagttcaagcgattctcttgtatcagcctcccgagtgcctgggattaaaggtgtgcaccaccacacctggctaattttttgtattttttagtagagatgagtttttgccatgttggccaggctggtctcaaacttctggcctcaagtgatccacccacctcagcctcccaaagtgctgagattacacatgtgagccactgtacccagccttaaatactttttagtttgaattacatttttaaatctttcccccttgaaaagtatttaagaatttggatcccttttccccccgaattcacaaaattaatgagactatatcagtgaagaaaatctgaaacccggctgggcgcggtggcttacgcctgtaatcccagcactctgggaggctgtacagacttatcacgatggatcaagaatcacgagagggtgcgactggactcaccatgtgacaaaggtgtgagtggcaccttcacatcaatcaattgccatgctggttcctgagggaccagtagagaaagagggcttcaaatgaggccccggagatacagacagccactgtctctgacaccacgatgccagcagagagccttcaaagatgaccttcaccagggttgcagagtctgcgacacttcactcagaacacaactgcacttatgacagaaacagggataaccagctcccctgtgtcttgcttttctggactgaactaagtaagctcaagaagataacgtgagcagataacaggcctaaaacaatgagagagcccgcagctcaccctgggcagccatgccagctgcacgaacacccacgtgacatcaaaagagaaccgcaggcctcttccggcatcgctgtggagagtgtgctatcactgctctcccggacaggagtgttttgaagtgattacagacccgtggctctcaaagtgaagtcccctggccagcaacgtcaacatcacctgggagcttgttaaaatgcagattcctgggcctcactccaggcctctgactcagagctgcgatcagcactctaaccagccctctagggtattctgaaccaggctaaggtttgagaatcccattttatttttttatttatttattttttcaaacgaagtctcgctttgtcacccaggctggagttcagtggcatgatctcaactcactgcaacctccatctcctgggttcaagcgattctcctgcctcagcctcctgagtagctgagattacaggcacctgccaccacgcctggccaatttttgtatttttagtagagacagcgtttcactatgttggccacgctggtttcgaactcttgagctcaagtgatccacccgcctcagcctcccaaagtgctgggattataggcgtgaggcaccatgcccagccaaaaccccattttagatagaactagccacatcatttgcaggacctggtgtaaaattaaaatgtggggtcccttgttcaacaatggttaagaatttcaataggaatacagcatgaagccagtgtgaggcccggtgtgaggccctttggagggcaaggccctgtgtggctgcccaaagctcatgaagctggatttgggaggatgggtgcgtctttcttgtgtattcagaatgctctttctataaaaagcccactccttaatgcttcaggagagaaagatttttccgttcttggtaccaaccgtgtactttcatggaagccaccaaacaggatcaattgtctcttccaggccaccatccgatgtccactccgacccgaaggaccgcctgttgatctaaaatgaaataaacaaaaagacactatcaacctgcttaatttctggttgttctaaagacgacaacaacaaacaaaatccaatttttacactgatttctgttttgtgagcacttactgctcacaaattaaataccatttaatctgatctatcaactaccaaaaccatcctgctaagagcccagctagctaagctcaaacctcaagaataaaacaggagaacatctccaagaccttggactgcataaagatttcctaggtagaacattataaactggactccgccaacataaaaaacttcaaaaatacaccattagaaaataaaaagacaagcaacagacagagaaatatcttgaaacacatgactgacaaatgacttgtatccagaatacatacagaattctttttttttttttttttttttttttttttttttttgagatggactctccctctgtctcccatgctggagttcagtggccagatctcggctcactgcaaccttcgcctccaaagttcaagcggttctcctgcctcagcctcctgagtagctggaattacaagcgtgcaccaccacacctggctgattttttgtatttctagtacagatggggtttcaccatgttggccaggctggtctcgaactcctgacctcaaacctcaagtgatctgcctgactcagactcccaaagtgctgagattacaggcatgagccactgtgcccggcccagaattctatcttaatagtaagataaatgacccaataaaaatataggcaaaagatttgatcagaaagttcgtaagatagaaaaatggggggaaaaaagatggaaaaaggccaatgaaaaaaggaaagatgcccaacatcacgagcggtcagggaaacatatgccaagtccacagtgacttcctaccacacatggctgggcacccgagatcaagacaacatcaagtgctggcgaggacatggggctgctggagccatggcaccggtgaaaacgtaacacagtgaaacaacggtgaaacataaacttagcgcacagcttagcaatctgacataagacatggactcaagagaaaggaaaacaccagtccacacagacggacatgcacaagtttatacacgctcttgtgtcaccaccagcagccgagctgtccctcagtgggtgaatgaacagcatgtggtgctccccacatgggggaggacttctcagaaacaaaaaggaattgtttactgatgcacacagcaatgtgaatgaatcttaaaaacatctcgctgaaggaaggcaggttctgctggactccatgcacacgagcgtcttaaaggtgagatccgtcttcggcccaggatagctgctcggggcaggagctgggaggggaccaactacagctctctggggtgacaagggcctacatcttgtctgtggtgctaattacataagtgtgcatatttcttttttttttttttttttgagacagcgtttcattcttgcccaggccggagtgcagtggtgcaatctcggctccctgcaacctccgcctccagggttcaagtgaatctcctgtctcagcctcccaagtacctgggattacaggtgcctgccaccacgaccagctaatttttgtatttttagtagagatggggtttcatcatattggtcaggctggtctcgaactcctgacctcaggtgatttgcctgcctcggcctcccaaagtgctgggattacaggcatgagccaccgcctctggtcaggtgtgtatatttcttaacactcatctaagtgtacatctaaaaggcatgcattttattgaattttattgtaattatgtctcaataaaactgatataaaaatacatggcaataaaaaaatacaaaaagcaaatttaaaaccttaaaaatacacacaaataatacaatcacacacaaataacacataaataactacaatcaacctccctagtaatcaaagaatttcaaataaagcagagataccattttattctatcaacttgacaaagatgtttaagaattagattctttaaaatactgcatgtcacgggacaatgctcgaaaaacagcacgtgaaaaggcaggtccaaagcaaatcctatcccagcttctacaggtaaaaaggcaggtgcaaagcaaatcctatcccagcttctacaggtgaaaaggcaggtgcaaagcaaatcctatcccagcttctacaggtgaaaaggcaggtgcaaagcaaatcctatcccagcttctataggtgaaaaggcaggtgcaaagcaaatcctatcccagcttctataggtgaaaaggcaggtgcaaagcaaatcctatcccagcttctataggtgaaaaggcaggtgcaaagcaaatcctatcccagcttctatcggtgaaaaggcaggtgcaaagcaaatcctatcccagcttttatcggtgaaaaggcaggtgcaaagcaaatcctatcccagcttctatcggtgaaaaggcaggtgcaaagcaaatcctatcccagcttctacaggtgaaaaggcaggtgcaaagcaaatcctaacccagcttctacatgggtggttctcagtggttttcttgtcttaatcgtttcctgcatctcccagcagtcctccagtgagcaggcgtgactttcacaaccagagagaggagcaacaaaacagacaggggtggtgaggaggcgctcgggcagcaggtgctcagaaagctcgcagaggtgcttacgccggccacagatgtgcagggcgcccaggcacagaggaggcggggcacacaggaatggctttgggctgcaacatcaggctgaacagggtgcgtgtgctgggactacccagggaatctcctagagccgcaggcaccagggcagggccttaaggagggttgctgggcacagtcactgcagccactccctgggatcctcactgatgacctgcctcgcctcctacttaggaatccactccctgggatcctcactgatgacctgcctcgcctcctacttaggaatccactccctgggatcctcactgatgacctgcctcgcctcctacttaggaatccactccctgggatcctcactgatgacctgcctctcctcctacttaggaatccactccctgggatcctcactgatgacctgcctcgcctcctacttaggaatccactccctgggatcctccgtggctttcacacccactctctgcctggccctcccacctctccacacaggtcacagcaactctgggctgcaaaggatggttacagcttcaatcacgcaagtcagtgcctatttagataatgcattcttcctccatttattttttgtgcatgttacacagctgtccccaaaacccacttacagggttttatgtaaaagcccagaaatgggcaggtaccctaaaaaacacaagagggccgggcgcggtggctcacgcctgtcatccccagcactttgagaggccaaggtgggcggatcacgaggtcaggagctcaagaccagcctcaccaacatggtgaaaccctgtctatactaaaaatacagtaattagcttggcgtcgtggaggcacctgtaatgccagctactcaggaggctgaggcaggagaattgcttgaacccaggaggtgggagctgcagtgagccgacactgcgccactgcactccagtctgggcgatagagcaagactccgtctcaagaaaaaaaaaacacaagacatcaagacatggaatctcaaacgtaaaaggaagcttgagtgatctaatccaagtttactgaagttcagagataattcaccacatcatcagggtgactgccaggagtcttcgcttgctccaagctggagcgaattcggttctcactgctcaaacgcgggatcccaccagcttctctcctctagcaccctccatcatatcagcacccctttcaatgtatcactgaaaatgacaaccacacccctccatggaatgtcaaccagaagcaatcagttcctttttctagacaccaattctattaatccaacccggagttggcatgagcctttggggtggcctcttcacatagggatacccagcaggatctcagctcactaagtttctttggagtcctgcaagctggcctcacttcacagttccacagactccacagcagctccatcccctccgggcttggcaccgcaggggacagcaccatccagcggacacactacacatgagagtcaattgagaagaaaaccccacacatgcggagcaagaaaagaacgcccctccccctcctggcaaatttcccgatgccccctcccactcctgacgaattgcctgacgcccctccccctcctgacgaattgcctgacgcccctccccctcctgacgaattgcccgacgccccctcccccccagacgaatttcctgatggattactttataagaacaatctgaggatcagaccttcattcaaaactaaaccagtgctgaaaccccgtctctactaaaaatacaaaaaaattagccaggcatggtggcgggcgcctgtagtcccagctactcaggaggctgaggcaggagaatggcgtgaacccgggaggcggagcttgcagtgagcagagatcgcaccactgcactccagcctgggcaacacagcgagactccgtctcaaaaaaaaaaaaaagaaaaaaaaaaaactaaaccagtgtgtctgcatccaagtccgcttcaaaaaatgacagaggagaaccgagcgctgccactgccgtccccaaccagcgagggaacacaggcctggggcctgctgcagccccatagatggggcgccccccgctgccctaactgcgctggggcggggcctcctttcactgcctgcatgggaaccccaccagagtctcatcctctggctgacacaacggactcaattaactttttgtggcagtagccaaatatcaccgttttctacctaaaaggggaaaattttctataaaaagattccacgtccctctttagaaaaataaagctactttaaaaagcccatttatatttgaaaccccaacaggcttctcaaaactgctgtcattcctaaatacgaagtcttaaaaaatccacatgtcctcctcagccagaggcctatggacagcacaaaatacaggggaatgtcgtggtggcggctgcctcgaggctcagcagctgcgtgcaggatggagctccaagcagggcaagctgccaggcagtgtcaccaccaggcccctcga

SEQ ID NO: 2455 - DNA, 17969 bp, Homo sapiens
tcctgacctcaggtgatctgcccacctcggcctcccaaagtgctgggattacaggcatgagccactgtacccagtcaagcctagtttctaaatgcacgaaaactgagagacgaagatggacaaatgcagtcaaacccccaaggcccatcccgggctgcagggaaggtgagctcctgcttttgtgtgtcacacacaattgtgaaacacaggtcttactggcctgctcaaaaataaaaattagccctaaaatttatcagcactttccgtgtttaagacaacctgaaagctgagtgtgaaacctggaaacccgctgggaggaagaacagcacagacaaccacaaagaggggtgcgcccgccaagagtgatgacggcagagctgggcctcagcctaagtcccaggaatagagaccccaggaccactgaagtcatcaacagtcatgccagggcctggagcatcctggcgacgtctcacatcaggcctgacggctcaagcgcgtgatacaaggggtgaaggggctaacgcatatttgatgtcactgccttaagttaactttctgtcaaatgatactcacgcaacatgggaagaaaagaaaaaaatatatactttactttttggccgttgaaatattcacctccaaaaaggattaactcatctttctcaggatgaaccgagagggaggcatttaacctacaagacacacaagcggcaggtcagcaagatcacccccgatacccacctgagcgctgtccccttcctcacagaatcctctgtcaccacaaactggctgcctctacacttcctgaaaggagagcctggcatcgagaaaggaagcaaaggtgccacttgaacaccaacccctctaccagtgcccagggccacactccaaggacaaccatggagctggactgacacagtgtctggttgtattaacaaaaaaaaaaaaaaaaaaaaaattccccaggcaggaataagtccagatgcccctactgatgtatcaaatgttccagaactgtttttttgatttgttttttttcatttttgagatggagtttccctcttgtcacccaggctggagtgcaatggcacaatctcagctcaccacaacctccaactcctgggttcaagcaattctcctgcctcagccctccgagtggctgggattgcaggtgcccaccaccacacccagctagtttttgtattttttagtagagatggggtttcactgcattggccaggctggtctcaaactccggacctcaagtgatctgcccacctcggcctcccacagtgctgggattacaggtgtgagccaccgtgcctggacctcagaactgtcctcttttaagagcctatcctgtcaaatcacctcaaaaccattctaaaaagtccagtaactaggccaggagcagtggctcctgcctgtaatcccagcactttgggaggccgaggcaggcagatcacgaggtgaagagatcgagaccatcctagccaacatggcgaaaccccgtctcaactaaaaatagaaaaattagctgggcatggtggtgcgtgcctatggtcccagctactcgggaggctgaggcaggagaaccacttgaacctgggagttgggggttgcagtgagctgagatcatgccattgcactccagcctggcgacagagcaagattccatctgaaaaaaaaaaaaaaaagtccatatgtaagtacttcaatatacatgccagatatcttccatctagaaaatacaaacaactttctatttatttcacatgagaacaaaagaagagctacaaggaaattacataataatattatgggccaggcccggtggctcacacttgtaatcccagcactttgggaggctgaggcgggcagatcacctgaggtgaggagttcaagaccagcctggcaaacacggtgaaaccccccgtctctactaaaaatacaaaaagtagccaggcatggtggtgggcacctgtaatcccagctactcaggaggctgaggcaggaggatcacttgaacccgggaggcagaggctgcagtgagccaggattgcatcattgcactccatcctgggagacagagcaagactgtcttaaaaaaacaaaaaataaataaataaatacatagggccacttcagttgaaagtaatgaaagacacagtgactatctggcgaatcactgggaaagatcctcccttcagagtcctctaagacggcgttccccaaggcgtgctccataatgccaactccaaaagatgtttctcaaaggaaaaacaggtttcaaggtcaagtgagtttgggaaatctgagaactctattttctattggggatttatttgcatagaaacatgtcataggctgggaatttctgcaggaaagaaaccagtattaaaagctaaacacagaatcaccacataatccagcagttcgttcccaggcattagctcaaacagatacctgtatgcaatgctcgttacggcctcacaaaagccaaacagtagaaataacctaagtgttggtctgcagatgagtggacaaacacaatgtggcatacccacagacggaacaggatttagccataagaagaaataaagttctcacacatgccacagaactgatgaacttggacataccaggtgaaggaagtcagtcacaaaaagacacttctatgactccacttacgcaaaatacctagaataggccaattcacagtgacagaaagttgaccagaagtcaccagggggctgggggaggggaaacagggagcaaccattgaagggtctagacacttctcccatcttttggcttccctgggctacaatggaagaagaattgtctcgggccacgcataaaatacactaacactaacaatagctgatgagctttaaaaaaaaatctcatcatgttttaagaaagtttacaaatacgtgtcacgctgcattcgaagctgtcctgggccaccagttagacaaggttggtctagagtttctatttggggtgataaaacaatgttgcaactggttagtgctaatggttgcacagcgacatgaagtaattccactgaactgcacagttttaatgattaaaatggcaaattttggccaggcgcattggctcatgcctgtaatcccagcactttcggaggccgaggcgggcggatcacctgaggtggggagttcgagaccagtctggccagcatgaggaaaccccatctctactaaaaatacaaaattagccaggcatggtggcgcatgcctgtaatcccagctacttgggaggctgaggaagaattgcttgaacctgggaggtggaggttgcggtgagccgatatcataccattgcactccagcctgggcaacaagagcaaaactctgtctcaaaaaaaccaaaaccaaacaaaaataaaataaaatggcaaattttgttaaacattttaccacaataaaaaaaactttttaggtcgggtgcagtggctcacacctgtaatcacagcattttgggaggccaaggcagttggatcatctgaggtcaggaatttgaggccagcctgactccagaggttgcagtgagctgagatcgcgccatagcactccagcctgggcaacaaaagcaaaactccgtctcagaaaagaaaaaaagaaaaaaaaaaactttttaaaaataataaataggccgggtacagtggctcacgcctgtaatcccagcactttgggaggccgaggtgggtggatcacctaaggtcgggagttcaagaccagcctgaccaacacggagaaactccgtctctactaaaaatacaaaattagccgggcgtggtggtgcatgcctattgtcccagctactccggaggctgaggcaggagaatcacttgaacctaggaggctacagtgagccgagatcgtgccattgcactccagcctgggcaacaagagctacactccgtctcagaaaaaaaaataaagagtgtttcccaaattcctctgaccctgaatcttttctcactgaatacctattgattttctgcagaaaagcaccaaacacaacttcagaaacgatctacacggggcccaaactgaggtccccacccagccaccagcggcaccagcccaggtgttgccgccgcacaggcaggtgaggtactgaggcagctggtgtcatgcccccattttccaggtaggtcacatcagagccaatcctgacgatatgctcatttagaaactggtcattctcacaaggttttaaagtaatatgattaagaaataggaagttggaagatattaaggttaccaagcaaaagatcttaatctcaggataactgctccctcctattaggaagcatttccagctgacccagggaactgccaacaccttaaattatatcctgacatgaaatctgactttcaggcaacattacttatggaaaaattctaaaatatcattaaaaaaaaaaaaaaagaaaaaggccaggtacggtgacttgagcccaggaactcgagaccagcctggacaacataaaaaaaagtctctacagggccgggcacggtggctcacgcctgtaatcctagcactctgggaggctgaggcgggcggatcacgaggtcagaagatcaagaccatcctggccaacatggtgaaaccccgtctctactaaaaacacaaaaaattagccaggcttggtggcgggtgcctgtagtcccagctacttggcaggctgaggcaggagaatggcgtgaacccgggaggcagagcttgcagtgaaccaagatggcgccactgtactccagcctgggtgacagagtgagactccgtcccaaaaaaaaaaaaaaaaaaaagtctctacaaaaaaaataaaactaatccccattcaaagtggctttcctcaggagtgctatatatcagaagcctaagatcaaggatttatttgctccaataactcaaatgaaaatgtacatttacagccaggcacagcgactcacgcctgtaatcccagcactttgggaggccaaggcaggtggattacctaaggtcaggagttcacgaccagccaggccaacatggcaaaaccccatctctactaaaaatacaaaaattagctgggtatggtggctggcgcctgtaatcccagctacttggaaggctgaggcaggagaatcacttgaacctgggaggcagaggttgtagtgagccaagatcatgccactgtactccagcctggatgacagagtgagactccatctcaaaaagaaaaaaaaaagtacatttaccacatgtaacttacatttggccctgagggcaacatgcaaactaaagggaaaaagaaaactaaaatcctaatggacatgaagtgaaaaccaggaaggacactggcctttgggagtggctccaacaccactcactctgctcaggggctgatcaccgtgctcctcccacctctgggcaggtgatgataaccctgcctctgaggccggtgggtgggactcgggcaccagagccatcacatgcgcctcattaatgcaaacgcagcacaatcgtgaccctccactcccgatgggctgaaccccggcttccactagggcctgcagcagctttattaaaagggtaaatcctgcaaggttaatctcctactgagggaaataaaccatttctcattccagctcatcccacacgtgtatgaaatcctacagactcggaacgtttttacgtaattttcaaatccatttaaaatggcttatactcaatttatgtttaacaaacttttcacatgagaatttgaaagcattacaaacacatcaaaaggccacagtgattttcagctttctgcctacagtacgcacttttaaaataccttaagaaccaaagaaaagctcactggggcaaaactttcatccccacgtcacgaccagtggaggagctttcaaagttggcaccggagcccagaggcagcagctgtgctgtaggccctgctcccaggttccatgacagtaaagcttacagcctcattccagttcttcagcagaaagtgaccaagaacaggttttaataatgaaaatgtcccaagtgcctggtcatttacgaaacctggtgctatttaaagcagtttttcaatgtatagaagaaaaggaaacatacaatatgaaaaatgctacttgctcaccttggtgagggtggggggcacggaagttccacagtctgagtcctcttggcatcgagtgtctggaaatgggctatgagcgcttccaggtcttcctagggcaagcaagcaggcacacgtgagacttattcccaggacccgccgcggagccacagcccgctcagctttcctccaatcagtgtgattcgactgggctcagtcacatctgtgaattgcaacatactgtgcctgtttgaaatgcagagtttgacacattcgaaagtaaccagagcttgacctcaaaggcagtctgcttaaagggtagatgtgtgcaccaagtattatctccacacccttaacgctccctctgcaagaccttccacttagacaagcccgttgtgacttcactgcagacactctcagcacctctcataacccagactcgagccgtcgcacctgccagccttcctgtctgcagagcagtgtctgacaagaacttccacttagacaagcccatcgtgacttcactgcagacaccctcagcacctctcagagcccaggcctgggccgtcacgcctgcctgccttcctgtctgctgagcagtgtctgatatatttctcttgcttatttgtttcctccaccccaacaaaataataaaatatgagctccaccagagcaagacttgtgtctagttaaaacactgcctgcacagcaagagctcagcaaataccagctgcagtctatccaagtaagaaggtctcaacttttactaccatcgagagtgactcaaggtactgatgtgccagcacagagggcagcactggaacccagtgttcccgcctcagtcccagtgcccatttcccaacatttacgagacactcccatgcacacccgagcctggcatttcaagttccttctagccttcagtgtcctgcttgcaactacacacacctgcagaccatcttccctcccccacacccacctctccaacctcacctcccacctggcctcactctccaagatacaccagcgtcctctccgttccttcaatgaaaacgccaggttccctcagcctgccacgccccacctcgtgcttccttcagtctacctctcatctcagggtgaatgtcagcagggtacactgcttagtattctaaacgatgcaatatttaaaacacacaagttaacagaactttatccaagacattcctgtatacggttcccagggtaaggaataaagtgtcacccacatgtacccacccacacattccctcaagtaaccactatctggaactcgatgcttattagtctcacgcttttcttcaatcttttattacacatgtgtatccctaagcaacatatagtattgttttacatttttaaatgtcattaaatggactgggcacagtggctcacgcctgtaatccccgaactttgggaggccgaggcaggtggataatttgaggtcaggagttcgagaccagcctgaccaacacggtgaaaccccgtctctactaaaaaatacaaaaattagccggccacagtggcgcacacctgtagtcccaaactactcgggaggctgaggcaggagaattgcttgagcctgggaggcagaggttgcaatgagctgagatcatgccactgcgacacttgctctgggtgacagagcaggactccatctcaaaaaaaataaaaaataaaatgtcattaaatggtatcatactgtatattctttcaacttgctttttttgctcaacgaggttaaacaaacagttcaaatactaacgtctatgtaccgcgaaagctttgctgctgctacttagagcggtctttgaccttggctgaacctcatcatcattgggtgactgaaggagagcaaggtggtagggtctgggtgacgccagtggcctagccagtgacagcctctccaaagtgacaataagctgaatgctgaaaagacgactcagacggagtatggttggggtataggtaagaccacagacacaacttgccatgtttgagacactaaaagacactgtggctggagtgagcccagggagacagctggaaagacaggcagaggccaggactaagtgaaggtgcgaaccaggtgacctgatacatgagttctgtgggagcagaattccaaactgtccccaatccttcccccaataattgccaggactgtgaaagaatgggataccactcttgtgattaggttgtattacagacacagctgaatttaagaaagagatgatcctctgtgggtctagcctaatcagacgcccacttattttaaaagtttgttttgagggttcattcagataacatacaaaccccaggcctgacaggctctctctcttaagggaagctactgttacaatcaccttagtattgggtactggagggagacatggagatgagtaaaaatgacaggtaactggcggggcaaggtggcttacggcttgtaatcccagcactttgggaggccgaggcgagcgcatcacctgaggtcaggagtcccagaccagcctgaccaaaacggtgaaacccggtctctattaaaaatacaaaattagctgggtgtggtggtgcatgcctgtaatctcagctacttgggaggctgaggcaggagaaccacttgaacctgggaggcggaggtgcagtgagctgagatcgcaccattgcactccaccctgggcaacaagagtgaaactccttcaaaaaaaaaaaaaaaaaaaaaaaaaaaaagcagaaagcagctaacagctggttactgagtgcttactttctgccaagcaccattctgaagataccacacagatgaactgacttcctgtgccacaaccctagccagcaggtcatgccactgcagcccagcctaggtgacagagcaagactctgtcaaaaaaaaaaaaaaaaaaaagaaagagcctaagaggagtgtgagggaaaagtccaactccattatttaagagatgaggacatggagagatcaatgacttaggaagaaaagggacaaaggactgtggtcaagagctcctgattcaggacatctggtcacatcccagttccataccacttcatggttcacctgttggtcttcctgtcaaatgggaataccagtgctacggaactgacctgctcgtgaggagtaaagcccagggagctgtgcctggcgcacggcaggccataaaactggccccggttagggaatccatgagcagcagccgcagaacactcaaccccaaggtcaggacggatcctcctgcagaccccgggctgaggaccagagggaaggagacaaccgtgatggccgccatcagctgctacgggataccccgtggctccagtgccttcttcacttaaccatctgctgctcactgctcagggctgctgtgatgattatttgccctcttttgaaagaaaagtaaggttcagaaaagttaagagtcttactcccagaccacacatcatgcagaggcagcccccggctcaacctcaggtcttcctgtgccaaacccctccctcttctcaccacccagcctcccttcagagggagggtggagggagaagggaggagggggaggaaacgcagaaaaacgcccgtgacaccacactaagaaaagcaagcacgttaaagggggcagctccgagaagcggacagacacacgtggagactcaggagggggcgggccccgtctgggctgcccggacgcggcgccggggcagttcctacggcctccagctctcccgcagggccggcgcggctcccacggccgacccgtaaccccggggggcgcagggagtcggccgaggctgcacggccgcgacgtcgggccgctaagcccggtctgacccgctcacctcctccttccgcgagcgcttagacaccttcttctccatcttggcggccgtcttctccgcgccgcggcccttcttctccttcttgcccttcttgcccatcttgccgggtcccaagccgcgacgggacaccaggaaagaaaacggcccgcgctctccgctcggaaacaggtgctcgtggggcggagctcggcgcacagaaatggagtcacttccggccccgagttcgagccgcttccgggtagaggtgcggctgggccctttacgaggttcggtcttggagctccgtcttcggcagcgggctcgggggcctcggactctgcataaggccccggaaaagatgaccggccccgggctgggcgcggtggctcatgcctgtaaccctggagctttgggaggccttggcgggcggatcgcttgagtccaggagttcgagatcagcctgggcaacaaagcgagacaccaccccccacccccagtcgctacagaagaaaaaaaaaaaaattaaccgggcgtggtgtctcgcgcccagtggtcctagctcctcgggaaggtgaggcgggaagatcgcttgagtcaaggagttccaggcagcaatgcgcccctgcaccccaacctgggcgacagagcgagatcctgtttcaaaaaacaaaaaagatggcagccccggcctgacataccccggccatgctcgccaattctcacgccctgtgcccccacctagcctgtccccgtgtcctaggagacgtgccctctgagttttattttttatttctatttttttgaggcagggtcttgctctgtcgcccaggctggagtgcggtagcgcgatctcggctcgctgtaacctccgcctctggagtagctgggaccacaggagcccaccacgcccggctcattttctcttgagttttccggggtgcacgtgccccccgttaaggcacattgcttcgccctgggtagaactaagtgggcgactcttgggctagccccattttttcccctcagaccaaacaaatgagtgcttttttcccagaaaaaaaatttcacacagttataagattttgcagatcctgagtaagacagtccctgccgggcgcggtggctcacgcctgtaatcccagcactttgggaggccgaggtgagtggatcacgaggtcaggagttcgagaccagcctagccaacatggtgaaacccccgtctctactaaaactacaaaaattagccaggcgtggtggtgggcacctgtaatcccagctacttgggaggctgaggcaggagaattgcttgaacccagggggcagaggttgcaatgagctgagatcaagccacttcactccagcttgggcaaaagagcaaaattccatcttaaaaaaaaaaaaaaatgggggggcccttccaccttcccatttaaaatgtgccagacactgttaggtactaagggcatgtcctcaaatgtcctaacatggaggacttttgtttcttcataggtaggctagagctaatgatagcaccctgaaagggtactcaatttgtggagcctgagaaataaagataggtaatatccaaatgcctgctaggaaattgtactctaggatttgcctcaaattacgtaagaaatggcaaaatcatctgcagtgcatggaatgttatgatttgaaagagcagagtaaaaatgcttatcactacttagaagatgtcatctttggatgggtaatcaaggaataaggcaaattaaggacaaggacaagccaaaatttggcaaagggaaagcataaatcaggaaataatctagtttattactttgtgtgtgagtcagcctttaaaagttctcttaggccaggcgtggtggttcattcctgtaatcccagcactttgggaggctgaagcgggctgatcacgaggtcaggagttcaagaccagcctggccaatatggtgaaaccctgtctccactaaaaatacaaaaaaaaaaaaaaaaattagccaggtgtggtggcacccacctgtagtcccaactattcaggaggctgaggcaaaagaatcatttgaacctaggcggcagaggttgcagtgagcggagattgcaccactgcactccagcctgggcgacaaagcaagactccatctcaaaaaaaaaaaaaaaaaaagatgttatcttagatccagccaggtgtgatggctcacgcctgtaatcctagcactttgagaggcagaggcaggcagatcacctgaggtcaggagtttgagaccagcctgatcaacatggtgaaaccccatctccactaaaaatacaaaattagacaggcatggtggtgcgcacctgtaatcccagctactcgggaggctgagtcaggagaatggcttgagcctgggagacagaggttgcagtgagccgagactgaaccactgcactccagcctgggcaacagagctagactccgtctcaaaaaaaaaaaaaaaaagaagaagttaactcggccaggcgtagtggctcacatctgtaatcccagcactttgggaggccaaggtgggcagatcacgaggtcaggagttcaaaaccagcctggccaacatggtgaaaccccgtctctacaaaaatacaaaaaaattagccaggtgtggtggtgtgcacctttaatcccagctactcaggaggctgaggtaggagaattgcttgaaccgggaggaaaggttgcggtgagcccagatcacgccattgcactccagcctgggcagcaaaagcgaaactctgtctcaaaaacaaaaaaagttaccttagatccaatcaatgactagtcactgagcagctgaggaggaatgattttccaacccactccaagccttatccataaacctagctctttaagaagaaaaatgaaatttggggaaataatgagaagaaaagatagcactggttgaagaccaccatggtctccagcactgcttgtaggaaacctatgtggtggtagaaaaaaaaaaccggttaggagctgagcagaaaggagctggagaatttcacagaaacccagcctgggcatccaggcatgtttatcttccatgacgaactacaaaaggctaaatcctcactattgccctcgggaaatagttctgtcccctctagtgtactatgactttaagaacatacgtaatcctttaatatttttctaaaaatcctgggtaaacctgaggcaatgcacttgaagccaaaaggctcttcattcacagcacatctggctgcagtacattacagtggtgcccacttcaggccggagacagggagagcgtatgacctattgaagatttaggaggatctggtggatgcggggtttaatacttttattatctgaaagaagcttgaagctaaattagaaggctcttggattataggtgtcatggtgatttacgtgagactgaaattctcatactgagaaagacggaatagaacatctaaaatgagatcagatcctaaaatagtcaaaagattaagtacaaggctctattttagtaaaattcacattgttgaaactttcatggattatctttaatctgtcgctgacttttagagtgtatcttttgtgtgatcaggcgccctctgctgccttcaagttgaagtgcagaagagaaaaaaaatctattaataatagattaaattttaggaaaatatgctaacttctaattatcctcaccacaagtaatcaatgtgattggaaggttctgccaagtgtggtatggattacgtggctctttgcacgtttcccagcaggaaagtgggaataatgaactagttcacctattacacaggattcttgggaaaatcaagtgaaacaataataaagcttaggaaagaggccaggcgcggtggctcacgcctgtaatcccagcactttgggaggctgaggcgggtggatcacgaggtcaggagatcaagaccatcctggctaacacggtgaaaccccgtctctactaaaaatacaaaaaattagccgggcgcggtggcgggcgcctgtagtcccagtactcgggaagctgaggcaggagaatggcgtgaacccgggaggcggagcttgcagtgagccaagatcgcaccattgcactccagcctgggcgacagagtgagactccgtctcaaaaaataaaaattaaaaataaataaaataaagcttagggaagtaaaaaagcaaaacacaaaggctttttttttttttttttgagacagagtctcactctgtcacccaggctggagtgcagtggcactatctcagctcactgcaacctccggctcccaagttcttacctcagcctcccaggtagctgggattacaggcatctgccaccacacccagctaatttttgtatgttttatagagacaaggtttcaccatgtaggccaagctggtctcaaactcctgacctcacgtgatccacccgactgggcatcttaaagtgctgggattacaggcgtgagccaccatgctggccttactgaatttttcccacttctttgaatccattccagagagaggaataataagatttccaactataatcagggatttatctatgtgttgcttatatacaataaactgtatatatttcaagtgtgcacaggtggctggggtgaggcaggtggctgctgaggagcaagagggatctacagttgtcccctgccctatgagaagggccacccactcaggaggggcctcaagggatgatgagaaatgagtatggaatttgtcagccttgaagttccaaattggaaacctggaaacatgtgtcccgtcttcttcatcaagattgtccaattttttttctttttttttttttttttttttgagacggagtctcactctgtctcccaggctggagggcagtggcgctatctcggctcactgcaagctccgccttccgggttcacgccattctcctgcctcagccttccaagtagttgggaaaacaggcgcccgccaccatgcccggctaatttttttttgtatttttagtagagacggggtttcaccatgttagccaggatggtctcgatctcctgacctcgtgatccgcccgcctcagcctcccaaagtgctgggattacagatatgagccaccgcgcccggccgattttccagtgtcatagcataaagcaataagtgatgttcttctaattaaaacaataaattaaagtgtagaatttaatatgtattaatactatcaaggtctggccaggcacagtggctcacgcctgtaatctcagcactttgggaggccgaggcaggcagatcacaagatcgggagatcgagaccatcctcgctaacacagtgaaaccccgtctctactaaaaatagaaaaattagccaggcgtggcggcatgtgcctgtagtcccagctgctggagaggctgaggcaggagaatggcgtgaacccgggaggcagagcttgcagtgagctgagatcgcgccactgcaccccagcctgggcgacagagtgagattccatctcaaaaaaaaaaaaaatactatcaaggtcaaataaaaatatagagatggatctctaaacaaaacaccttgtatgggaatcatagaattatattttgaggcatatccacaggctggggtgaacttcaatatgtccaaagaacaaagagaaggttgggggttttattaaaaagagaaatgtggccaggcgcggtggctcatgcctgtaattccaacactttgggaggtcaaggtgggtggatcatttgagatcaggagttcaagaccagcctggccaacatggtgaaaccccatctctactaaaaatacaaaagttagctggacgtggtgacatatgcctgtaatcccagctactcgggaggctgaggcaggagaactgcttgaacctgggaggcagaggttgtagtgagccaagactgtgccactgcactccaacctgggcaacagagtgagactccgtctcaaaaaaaaaaaaaaaaaaaaaaaaaagaaatgtggctgggcatgatggctcacacctgtaatcctagcaccttgggaggccaaggtgggcagatcatttgaggtcaggagttcaagacaagccttgccaatatggtgaaacccgtctctactacaaacacaaaaattagctgggcgtggtggcacacacctgtaatcccagctactcgggaggctgaggcaggagaatcacttgaacccgcgagatggaagttgcagtgagctgagatcgcaccgagatcacctgggtgacagagcgagactcaggctcaaataaataaataaataaataaataaataaataaaataaaaagaaactcttgattagtttccatttttctagggttttacaaaatggaatcctacagccagggacagtggctcccacctgtaatcccagcactttggaagtctgaagtgagtagatcacctgaggtcaggagttcaagaccagcctggccaacatggcaaaaccccatcactactaaaaatataaaaattggccaggctgtgagatcgtctcccatagcattgagctgatttctgtggttccttaggtcatgggggtagggtgaggcctgcttcaatcttacccttttggggcagaactcttgaaatcttggcttaatctggggagttctctcttagatcccaccttggacacccttggatttgattatgtttttcttgcccttggaggctgtcaaaaccaaaggtaagtatggcaagatcggctcatgcgtgaaactaaaagctgtctcagagcccagtggcctgtttttgttgctactttccattaaggtctgacttggtaattccttattagctttcggatgcctttctgatgttatttgtgtctaccatattccttaaaaggcagcattgcttcgtttttaaatggtgggtttttgggaggtttttctgagacggagtcttgctctgtagccccggctggagtgccagcagcatgatcttggctcactgcaacctctgcctcctgggttcaagcaatcctcctgcctcagccttccaagtagctgggattacagatctgcaccaccacgctcaactaatttttgtttttttagtagagacagggtttcaccatgttggccagactggtcttgaattcctgacctcaagtgatctgtctgcctcggcctcccaaagcactgggattacaggcgtgaagcatcacacccaggtaaatgaagtctgttattgttgttgttattgttgttttgagatgaagtctcaccctatcaccaggctggagtgcagtggtgtgatctcggctcactgcaacctccacctccctggttcaagcaattctcatgcctcagcctcctgagtagctgggactacaggcgcccaccaccacgcctggctatttttttgtattttcagtaaagacaaggttttaccatgttggccaggctggtctcgaactcctgacctcaagtgatccgcccgcccaccttggcctcccaaagtgctgggattacagatgtaaatgatgttttttagtgtgtaattaatatatactcattttcaaaatttggaaaatgcagatgagtataatgaaggaaacctcacagtcacttacagccttctctgctgcatgccagcactctcggcacttggggggtatttcctgctgacggatcttgagcaaaggtccgtgctgtggcgtcactcatcttagtgtcgtgcacagggcctccttccttcttgctgtatccgtgtcttctttatcactgatctcagaagaagcacgtgaagattaagaacattctgtaagatacctgatgcaaagatagggaagaagaaactaccaaaacttagaaaatagcacagaaaatggaacagaagatagaagctatgctggaaatgctaactgcaaactagaaaacagcattatttatttatttttttttatttatttatttttgagacggagtctcgcactgtcg

SEQ ID NO: 2456 - DNA, 24812 bp, Homo sapiens
cgccaccacgcccggctaatttttgtatttttagtagagacagggttttgccatgttggccaggctggtctccatctcctgacctcaggtgatccgcccacctcggcctcccaaagtgctgggattatgggcgtgagccaccgcgcccggccactagaagagttttactacacgtgttacggagtaatgaaatggttcactcgtttcagcatcaaatcatcttttcaaagtaaactgcatttctaaccgcttcttcttgaggcaataaaaaacacagtgccatctcatctttattttgtgctactagaagatgctatccgttaaaaatgactgtgttccccaagaatgtgttcatataattttggatgcaatgcaaaatactttttatggtggtcttctaccaaacacaaaaagcagtaccgaacctgtgaatgccgcaagctacacacaccctaggagagagcgcccccttgtgggaatcagtcacatcaacagattcagacacaccaacagctggctccaacgcggggagcactcaacaagtcttgacccttctgtgttctgatttcaacagctttgattgattgattgattgactgactgagacggagtctcactctgtccctcaggctggagtgctgtggtgcgatatcggttcactgcaacgtccgcttcccgggttcaagtgattctcctgcctcagcctcctgagtagctgggactacaggcgaccccccaccaagcctggctaattttttgaatttttagtagagacggggtttcaccgtgttagccaggctggtctcgaacccctgacctcgtgatccgcccgcctcggcctcccaaagtgctgggattacaggtgtgagccaccgtgcccggccctgcaattccttttctaatgaaaaaagtcattaggagaataaaatgaatttgcatggataaagcactttctatgaaaacataaaacatttgctacacaagtcaatgaattaataaacatggaaaaccacataacacacatatattcaataacacctgctttcaaaggtggtcacgttctttcaaaaatagttcagtccttccgttctttgctccagacccacttttatatgacccaggacaaaacagaaaatttaaaaacatttttggcagagaatacaaaatcagattaagtgacagaccatagtgatactgaaaatacataacttgagccacttcacagttttgaatgaacagagtgtgtaatccttttcatttccccctaaaaatgatatctatttaaaatagataaatattaatgcctctctatttggggcctaactatttactgtttttcacccaaataactcaacattctgaaacaaacaaacaaaggatcttacttttcctttgtctattatccctgatatcttcattttctccaagtagaagtattttctccaagtggaagcaatttagcatctggcacatggggtgggaaagctattgaaatggaatgtttttccctcgcaatagtacatgcagtcaaccaaccaaagtctgaagaacactgaaatcgagccaacaagtttctttttttttttttttttgtttttaagacagggtctcactttgtcacccgggctggagtgcagtggcacagtctcggctcactgcagcctcctcaacctcccaggttcaagtgatcctcctgcctcagccccacaagtagctgggactacgggcgcccgccaccacacctgactaatttttggtattttttatagagacagtgtttctccatgttgcctaagttggtcttgacctcctgagctcaagcagcacttcccaaagtgctgggattacaggcgtgagccaccatgcctggcccaaaatacttaaaattcaagttagctgcacaaatactacagtaagacaaaagaggccgggcgcattggcccggggtcacgaggtcaggagttcaagaccagtctggccaatatggtgaaaccccatctctactaaaaatacaaaaattagccgggcatggtggcgggcacctgtaatcccagctccttgggacgctgagacaggagaatcgcttgaacccgggaggtggaggtcgcagtgagctgagatcatgtcattgcactcaaacctgggcggcagagcaagactccgtctcaacaacaaaaaaaaaaagacaaaagacagtcgtgctgttaaaacggaaatactgggtgacaggcagtgccactgtgtgaagcagaagcaccagcaaggaaagcagaatggtctcaccaagaacacactggactcgggagactgatgacctgatgacctggatttaaatctattccgcatcatttcacacccacttcaccttcgacaagcgtctcaatacttaattttgtaaaatgagactgataatttctatcttaaccaaaagattattatgaagccaaaaaacagataatacatgaaaaaatactgtgtaagttactatagatctgttatccatatacaatgttacgtgttatgactgcacctcatctcactaatcatattctgccttgtatcatactaacctgagtatctgccttaattccctcgagcaccgagattagaaactcgtatggggccatgttggtctttttgaggcaggaaaatagggtctggagtcagggaacataaggcacattcacacttcagctatgacaggaaacatcccctccgtggggcgtaagccaagtaaatgactttgtaactttcctacctcctctcctttcacatacggcgtaccccaagtagagggtattcaaactcacaaaaactctgcaaggcggcctctgagcccctgtgcccgggctgcccccacactgtggagtgtgctttcatttccaataaatccctcactgctcccttgcttgctttgtgcgttttgtccagttccttgttcaagacgccaagaacggctgggcacaggggctgtcacctgtaatcccagcactttgggagaccaaggcaggtgggtcacctgaggtcaggagttcgagaccagcctggacaacatgatgaaaccctgtctctactagaaacacaaaattatccagctgtggtggcgggcacctgtaatctcagctactcgggaggctgaggtgggagaatcgcttgaacccaggaggtggaggttgcagtgagcccagattgcgccactgcactccagcctgggcaacaagagtgaaactccatctcaaacaaacaaaaaaagtgggcaaaggacatgaatagatatttctagaagaagatacacaaacaggcaacacatatgaaaaaaatgctcaaaatcactaatcatcaaggaaatgcaaattaaattaccagaaggagagaccaccttactcctacaagaatggttgtaatttaaaagtcaaaaagcaataaatgttggcttagatatggtgaaaagagaacacttggccgggtgcagtggctcacacctgtaatccccacacgttgggaggccaaggtgggtgggtcacttgaggtgaggtcaggagtttaagaccagcctagctaatctggtgaaaccccatctctactaaaaatagaaaaattagccaggtgtggtggcacacgcctgcagtcgcagctactagcgaggctgaggcaggagaatctattgaacctgggagccggaggctgcagtgcgccgagatcgcgccactgcactccagcctgggagacagcgagactccgtctcaaaaaaaaaaaaaaaaaaaaaaaaaaaaaaagagttcgagaccagtctggccaatatggtgaaaccccgtctctaataaaatacaaaaattagccgggcatggtggtgtgcacctgtagtcccagctactcaggaggctgaggcaggtgatccacccgccttgagcacccatgtccagcccagaaaaacaaattttaaaaagaatcagggccaggcacagtggcttgtgcctgtaatctcaacactttgggagactgaggcgggaggatcgtttcagcccaggagttcgagactagcctgggagaaactccatctcaacgtggagaaactccgtctctacaaaaaatacaaaaattagctgggcctggtggcacgcatgtagtcccagctactcgagaggctgacgtgggaggatcactttaaccggggaggcagaggttgcaggagctgagattgtgccactgcactccagcctgaataacagcgtgagaatccgcctcaaaacaaagaaacaaaaaccacacacacacacacacacacaagttgtactagtggttccagccagtgcaagtgggcaagataaacgcataaaagaattaaaactgtatagattcatagacatgattatgtagaaaacctgaaggaatttacaagcaaaagaaagcagcccactagaactaatacgtccgtttagcagggttgcagactaaaatattaatagacaaaaataaattatatttctttaaagtagcaacgagcaatcaaaagaaagctttgaaatgtaaaaagcaagcatttgcagtcccatcaaacattattaaatgctcaggggaagatgtgagacaatcattgacagacctgtacacactgaacagcacaaaacattacttaagttaaagaaggcccaaacaggccgggcgcggtggctcacgcctgtaatcccagcactttgggaggccgaggcgggcggatcacgaggtcaggagatcgagaccaacctggctaacgcggtgaaaccccatctgtactaaaaatagaaaaaattagccgggcgtggtggtgcgctcctgtagtcccagctacttgggaggctgaggcaggaaaatcgcttgaacccaggaggcggaggttgcagtgagccgagatcgcaccactgcactccaggctgggcaacagagcgagattccgtctcaaaaaaaaaaaaaaaaaagaaaaagaaaatatagagatggcaaatggcacataacaagatggtcaatatcaattcctagtcactagaaaataggcattaaaagtgcaagataccaccataaacctatcggagaggcaagatgtcaatgccggactatgctgagtgctggagatgatgtggaggaatgggagcgttcatatgcactggtgaaaacgtcaaatggtaccaccttgtaaaactactggatagtttccaaaaaagttaaatatactcctgccatgccatccaaccattccgccatttatccacaagaaaggaacgacatgcccatataaagacttatacgcaaacacttacaggtgctttatttgtcatggacaaaaactggaaacacccaaatgtccatcaaataggtgaataaacaaattgaggtatatcaaacaatggaatacgtctcagcaataaaaggaatgaaaggaataaaaggaataaactactgatacgcacagcttgcagtgagccgagatcacgccactgcactccagcctgggagacagggtgagattccatctcaaaaaaaaaaaaaatgttaatagctccccagatcgatttatagatttaataaaatcataagcaaaatcccagcaggtttctgttgttgctggtctgttactgaaatcgacaaactgattcttaaatgtatgcggaaatgcaaaaaccaataaaatcttgaacagcaaacctggaggcctcacgttaccgaatattgaattattttaaatctagtgtggcactggcattaggacaaatagaccgatgaggaaatacattgtgctaggaccattggatctctatatggaaaaaattttaaccatctccctcataccatgcacgaaatagattctagatgattctacatctagccatgacaggcaaaccattcctagaaaataacataaaagattcatgacctggccgggcgtggtggctcacgcctgtaatcccagcactttgggaggccaaggcaggcagatcacctaaggtcaggagttcgagaccagcctggccaacatgatgaaaccctgtctctactaaaaatacaaaattagccaggcgtggtggtgcatgcctgtaatcccagctactcaggaggctgaggcaggagaatcgcttgaacctgggaggtagaggttgcggtgagccgagatcttgccattgcactccagcctaggcaacgagagcgaaactccgtctcaaaaaaaaaaaaaaaaaaattagcctggcgtggtggagcgcacctgtaatcccagctacttgggaggctgaggcaggagaatcgcttgaacctgagaggtggaggttacagtgagccaagatggcgccactgccctccagcctgggcataagattgagactccgtctcaaaaaaaaaaaaaagatttatgatcttagaatagacaagtattttttaaataggacatagaaagtgcttaccttaaaggaaaagatggataaactggactgtattaaaattaagggcttctgttcctcaaaagacatcattaagagaatgaaaaagcaaggcacggcatggaagaagacagtaacaaaaacaactccaaaaacatactaaataaagacgcttagaaatcggtatcaaaacgacatcccaacagaaaaccgggcaaaaagtgtgcatgtaacaacagagatatccaaatgttcaatatattacaaagtgcttaacctcattagtaatcagagaaatgcaaactcaagccagaattaaacctcctacatacccacctacatacccaccagcatcactgtaactaaacaatgatcaggctgatatagtggctcatgcctgtaatctcagtgctcagagaggctgaggctggaggatcgcctgagaccaggagttcctgaccagcctgggccatgtagtgagactccatctctaccaaaaaataataataaataaattaaattacccaggcatggtgacacacacttacagtcctagctactcaagaggctgaggtggggctggtggctcacgcctgtaatcccagcactttgggaggccaaggcaaagttgggaggcaagatgaactgaggtcagcagttcgagaccagcctggccatcatggccaaccccgtctctcctaaaacacaaaattagccaggtgtggtggtgggcgcctgtaatcccagctactcgggaggctgaggcaggagaatcacttcaacccgggaggcagaggttgcagtgagctgagatcgcgccactacactccagcctgggcaacaagagtgaaactccatctcgaaaaaaaaaaaaaaaaagaggctgagatgggaggatcatttgagcccaggagtttaagaatgcaatgaactattaccatgctactgcatgctcaccagagtgatagagtgagaccctgtctctctaggaaaaaaaaaaaaagtgatcttatccaacgtcagtgaggatgtggagtagctggaactctcaaacccagctgataggactgtaaaatagtacaactcatttaaaaaacttttatagtttatctactgttcatctctaatgacccagttaattacttataaatgcacacatgtatatgccaaaatacatgtccaagaatattcgtaacattatttgtaacatccaaaacatgaaaatactccaatgtccatccacagaacagtggtatacaattgccacagaatactacatagctatgaaaacacgctattatcacaatgacatggattcataccacaaacacgctgacagataaaactccagaaaatactgtatgattccatttctatcaaattcagaaactaccaagactaactgaagttgataaaacactagtttccattttgggggtaagagagtaaacactgggagggggtcataacggggtcttataggatgctggtcctgttctatttcttgatgtgggcggtggttaaatggtgcattccctttgtgaaaatgcatgaagctatacacctttggtttggtttatgtttctacgttacacttgagtaaaagtttactttaaaaatacaggaacagcatacaagaacacttccaggccgggcgcggcggctcacgcctgtaatcccagcactttgggaggctgaggtggacggattgcttaaacccaggagttcgagaccagcctgggaaacatggtgaaactccatctccacaaaaaatacaaaaattagccaaacgcggtggtgcacgcctgtggtgctagcgactcgggaggctgaagcaggaggatccctggagcccaggatgctgaggtcagtgagccatgatcgtgccactgcattgcagcctgggcgatagagcaagaccctgtctcacataaaaatgaaaaaataactttctgtctccccttatacacagcaggccggctacctccagtccagcacagtgaactggtgctacaagggccaacccaggctctgccccaaagcaggagctgagaccgtttcctagaaggcaggcccactggaaatgtctccaccaaaagcagctacaaacgaatatgaccttcaggtattaaggctttggttctctagaaaactgtcacggcactgaggtaacttgacaacccataatcgctgttctccatgtaaactgtggctctatttgtccaaggtgaagtatcgtaaattgaaatgaagtactcaattgtaaattttttttttaaatttccaaattaagctaaattaaaaaaacaaaaattgccaaaaccttaacctacaaaataaactttttggacagtagccacctgagctctaaataattgtatcatttatatttcaaatctaatacactggtgaatatgcgtattgcagcttttccaagacacgtattaatcatgaaacatgtactgacctcgaaaatgtggccgcgcgcggtagctcacacctgtaatcccagcactttgggaggccgaggcaggcggatcacgaggtcaggagatcgagaccatcctggctaacacggtgaaacccggtctctactaaaaatacaaaaaattagccgggcctggtggcgggcgcctgtagtctcagctactctggaggctgaggcaggacaatggtgtgaacccgggaggcggagcttgcagtgagccgaggttgcaccactgcactccagcctgggtgacagagagagactctgtctccaaaaaaaaaaaaaaaaaaaaaagtttaaatactttaaatgatcactttagaatatattaataagggggaatatagtatttcaagaaaatagttttaatgaagagcaaaaggtagtatggcctaatgagactcttcagtgacacagatgaactgaattctgtatttgaattattagccatgcagctttcagcaagttccttaactacttcccattcagcttttcccatctgcacaatgcaggctcacctgattattattgagcgcttacgtgtgagattccagacattgcttagtaacgagcacagtgcctggtgcaaagctggtacgcaatgttagcaaaactattattattttttttttgagacaagaatctcgctctgtcgctcaggctggagtgcagtgctgcgatctcggctcactgcaagctccgcctcccgggttcacgccattctccggcctcagcctcccgagtagctgggactacaggcgcccgccaccacacccggctaattttttgtattttttagtagagacgggatttcaccgtgtcagccaggatggtctcgatctcctgacctcgtgatccgcccacgtcggcctcccaaagtgctgggattacaggcgtgagccaccgcgcccggccaatgttagctaaatattaacagtatctattacaatcctacgaactcaaagaaacaggataaaacaacacagggcttggttttcctgatccaggttggatctgggagcattcccatttcctctcacagtgctcacaaaggcttcctttaatgacacactctaggatttcaccagttttccatgaactattacttgttacaattttcaaaagaacacaggggtcacacctttatcccgctttttcagcaagcctcactctcctctattgtcctaggatcaggaagcagctaatttggggtctcatttataaggctcaaggcatttgtctgggacagaagccaattaatgtctccatttatcccaccagtttcccctttcagtgatggaagttcatccccatcttcctataggaccgaaatttaactttgcagacgtgctgttctgaggacccacccggaacagagcatgtacacaaacccacttactgtcgcttctaacattgtaggaagcctttgggttttccaaggcagcaaagtactgagatttgtaattaaaaacacatattagctacattcaagttgtaactaactaaaaacttctacttaagtcgactgatcctcaaagtaagactcaaatcaaaaccagaaaagtttgggggcaattccctttccagcccacaaatacaggaactgggagtgacaccgtcctcacagggctacggcacctttctgcagcttccctggctccctttcaattttttttttttttttttttttttgagacggagttctgctcttattgcccagattagagtgcagtggcgcgatcttggctcactgcaagctccgccttccagtttccagcgattgtcctgcctcaggcctcccaagtcactggatgttaattacacccagcaaggtcgcccgccaccacgcctggctaatttttttgtatttttagtagagacagggtttccccatgttgtccaggctggtctcttaactgctgacctcgtgatccacccaccacggcctccgaaagtgctgggattacaggcgtgagccaccgcacccggcctttcaatttttgataaggatctttccttttttttttttttgagacagtctcactctgtcgcccaggctggagtgcagtagcgtgatctcggctcactgcaacctctgcctcccgggttcaagcgattctcctgcctcagcctcccgagtagctgggagtacaggcgtgcgccaccatgcctggctaattttttgtacttttagtagagacggagtttcaccgtgttagccaggatggtctcaatctcctgacctcgtgatccgcccgcctcggcctctcaaattgcagggattacaggtgtgagccaccgcacccagccgagtggtttctttaaactctgcaacagacttgacgaattccttggattttgacctttaagtgtagcaggtgtgctggaaacagagcaaatcaacttgaaagcttcttggaggttgctccaaacagcagcatataattatattcaatggtctccctatctctcggaaaagcaactcacaaaaacatgtttattctcattgccagcactcactaaacgctactaggatatcgctgatctgttcatttcctaaatctctgctactaacactttaaaccgagagtaaacttgcagtctcaacatccaattttagaagacaagtgtgacgaggaaggatttatcaactgaaaaatgtttactgacacagggaatctagaaatgtaccttccagatacatacaaatatttaagcaaaaactgttccaagggtatttcctgcagcacctgcccaaaaggagcaaactggtcttaacaaaatcaggtgtacatcaatgttacgcagtcagaatgagacacatctgaatgcctaacataaaaagatctacagtaactaggtatctatacacattgatgtataaactgtttatggaaagaagcttcttatacagtgtttctggaaagggagactgctatcctgctgtctataatgtgtgtatggattactaagaaaggattgagtaattctccactactgccactagcctctggaggaagagggcacacagtttttacctctaagaattattataagacattcagccttatttggttgtatgaaatactatgctagaaaatgatccataattacaccttgtactactcatgttgtactttaatgattaaaataaataccatgttgctgcctggtctggaggacaagacacaccatcaactgactcagtgttcttcacaaccagactacaggcaatttttttccaaaacatacatctttgggaagcaaacaaattatttatggaagaaaaaaggaggaatgtttcacattcaggcaaacataatactgtcagtgtgtttggactagagattttattttagaagtataaaggatggaggcgcgatatttggcatttttaatttaggtttgttttatttaagtttaatgttaattccatgctgtgtttcagtaagaacaatacagattctgtatctgtggctccagtcagatatccagtagtacaaattagcttcaagttacacatactgaacaaaagaggttgagcgagcgaaggaggggaggagtgaggggaaggaggtagggggagggggaaggagaagaaacaaaagaattgaacaggcatgcaggcttttccataccaccttcaacgctaacctgcttcagtgggagagtaaagtaggcaagaatgagcagccacggattgttgaactgttaccagcaccatgcttttcagcaacatttcagcggagttggaaacattttttacagcaaaaccattacaacgaagtccctccccaaaccacctttaaccatctcaagctaacacccaattacttgcaaacactggtataaaacacagtttaaacaattagaaaaatgaaaactgataccacttatgcctctatagtgtgattaacctctctcttagatgcttgcatcacctataagtctaatggctttcaaatgtaatttccatttgctaatggtgatcttgccacatctggcacggagacgacacagtaatgctgaaaaagcctctatgtagtcctgttagtgtcttaaagaacctaaaagctgggaccagtaaaatccacagaaattcactcttgcctttaagaacttttgaaaactgtttaaaaaaaaaaaaaaaaaaccaacagggcaggaacctaaattctgagaccaaatgtaaaagtcagatttggtggttctcagtgacaatggggagtttccaaagggtgggatggggaggagggggtggtcagagatggtttctcttgttggcttatgtctcactgattttcgtcttccacgtcctgcagcgcttctttattctgctcttcacctgttaaaaaagaaaaaaagtcaattatttcgtattgactacattaggctatggcagccacaaacaaaggtgtcattccaagcataaagactcttctacttgctacaattggtattaaacgcaggcaaaggacttctatcatccttgacacctgagatgcctaagccaagaagggattatggtcctgaaagtatttattggtcaacagaatgaaaaaaactgatgcgcagtacaactcaatgtttttacgctaaataagctcttgacgtagacagccaaggaaaccatcttactaaaatgacattcaagctttcacataaatcttgggtcaaaatactctttctcaataacctcacctcttcaagaatcaagagtattttgcaaactttttgcaaaatctaatttacccacaagctaattatcagaaatgcttcaaaatagttaactgagcaataaactgttgccaagaagttctatcgtattttattgtggggttctgctgttataaatatttcagcttttgtatcttggccagatacaccaaactataatcagattttacttcagagtgaaacacagcatgctcaaagtaaatcagaccactgaggttattaaagaatggcatttggaccacttcactcatgctatttgtcttttgcctttaaagagggtgattaccctaaggagtttcaactgcactatgacatgcaacagaaagccacctattggttggagggtcatctacctattagtatgcattaaacaagtcagccaaaataaagaagcatgcaggcttttcccttaaaaatgatgtaacaggtaaaagttacattcacttgtacttttttaaaaaaaccacttacaattactacacagttaactagtttgaaacaaaataaatgaaaaatcaacccaagaatcataaatgttcaaatgactatccattcataatgcttgttaaattatttaattaggatggacaaataacaccaaactagctgcctacacacatgaagcatttacactgagtacagctttgaaacagcctaaatgatctcaaaatgacaaatgtcacagcatcaaggtttcagtagttttcaaatctcttctgcggcggaaacgcttgacattgctgtgtgacttcaaaacccacttacagcctcagcaacacagtgaagccctgtctctacaaaaaatgaacataacgccgggcacggtggctcacgcctgtaatcccagcactttgggaagcaaaggcgggcggatcacgaggtcagaagatcaagaccatcctggctaacacagtaaatccccatctctactgaaaaaataatacaaaaaattagcctggcgtggtggcacatgcctgtaatcccagctacctgggaagctgaggcatgagaattgcttgaacccaggagacggaggttgcagcgagccaagaacatgccactacactccagcctgggtaacagagtgagactccgtctcaaaaaaaaaaaaaaaagaataaataaaactaaaagtaaaaaactatgtatgctggagccaggcatggtggctcacgcctgtaataccagcactttgggaggccaagagaggtggatcatgaggtcaggagatcgagaccatcctggctaacacagtgaaaccctgtctctactaaaaatacaaaaaaaaaaaaaaaaaattagccaggcatggtggcaggcgcctgtagtcccagctactcgggaggcaggagaatggcgtgaacccaggaggcggagctttcagtgagccaagattctgccgctgcactccagcctgggcgacaatcgagactccgtctcaaaaaaaaaaaaaactacatacgctgggcatggggccacatgtctatagtcccagctacttggggggctgaggtgggggagttctatttctgcagtgagctttgaacgccactgcactccaggcggggcaacaagagcaaaactccgtctcaaaaaaatgtataaaattttaaaactacttaaaatacatgaagatctttaattcataagacagaaaaaaaatatgcaaaggcaaaaaaaaattgcttagggatgaaagaactgatgggcacccaactgttctccaaaggacaataacgtattcaaacgtaggaaacatgataggaacattcactctaacagcaaatcactgccaaagtatcattaacacaaacactagaacacaactcgcttgtaagcaaccatgagatgtgccagaagttccaagtaactttggcataaaaatgtcactgtcatatacatcacatccaaccacagtaggcaggaggagcaggccggaaaaggcttaggtcagcgccctggaaggtggaacaggcagagtctgtaagcaacaggacgatcatacgcaggcatgattagtgaagaaccaaaactgaaagcggaattcactgtgccatgaacgtgacttacaaagtagagtttttaggaaaggaagagttgggttttcctttaggaatctatattgcaaggaaaaagggagggagaacaatcatatgaaagcaacattacaagaaaaataaaccaacagagcaggacaaaggaaaacaatgatacaggagccggactttggtcttacttcgtgtaaacttcactctaagcaacaatctgtctactcctcctcccttctactctgagaaggaagtaatatcctcttgaaagacatacagatattaggggaaaaaggattccttggctatgtttctttgcccagtgtatctacattttggagagaggggaacaggcagggagaacatgtatttcctacctatggattcgtatatgaaacaatcctcttaccacagggtgaagagactaaaatcacttgagaaaaagcaatgatccctccctttaaagaaattatgttccaacatgctgggacagacattaacatattctaaaattaaaagacataaataccgtctctttaaaaaacaaaaaaatctaaataatccttaaactaaatgcaaagtcacatcctagtaaactgccactttcatgacgattctcctatattcaccacggaacccaagtcacaaaagtagtattttattttgtgagatgaagttttatcttgcccaagctggtgtcaaactcctgggctcaagtgatccttctgcctcaccttgctgaacagccgagattacaggcaggcaccattgcagtttcaaaaccaatttattaaaaaatgtaggccgggaacagtggctcacgcctgtaatcccagcattttgggaggccgaggcaggcggatcacgaggttaggagattgagaccatccgggttaacacggggaaaccccgcctctactaaaaatacaaaaaaaaattagccgggcatggtggcgggcacctgtagtcccagctaccaggaaggctgagacaggagaatggcgtgaacccgggaggcggagtttgcagtgagccaagatagcaccactgcactccagcctgggtgacaaagcaagactctgtctcacgaaaaaaggaaaaaaaaaaaagatgtaatactaggccaggtgcggtgactcgggcctgtaatcccagcactttgggaggctgaggcaggtggatcacgaggttaggagattgagaccatccgggctaacacggggaaaccctgtctctactgaaaatacgaattattgccaggcgtggtggtgggcacctgtagtcccagcaactcagagaggacgaggcagaagaatcgcttgaacccgggaggtggaagctgcagtgagcagagattgcgccactatactccaccctgggcaacagagtgatactccatctcaaaaactctaatttttgacaaattcaacttctcaaactgatgaacaatttctttgtacccacaattatttgtgtattcagagtttgttagttgtaccggaatgtcaacagaccacctgaatttttcactgttgaactatttcatgactggaagcattatataaataaaaagtatttcacctaataaaaattaagtgaaaattactcttcttaaccaaatttaatcaactgatttacagactcaataaggaattgaacacaaatgaatttcactagattttttttttttttgagacggagtcttgctctgtcgcccaggctggagtgcagtggtgctatctcggctcactgcaagctccgcctctgggttcaccccattctcctgcctcagcctcccaagtaaatgggactacaggcgcccaccaccacgcccgggtaattttttttgtatttttagtagagacggggtttcactgtgttagccaggatggtctcaatcttctgacctcgtgatccgcccgcctcagcctcccaaagtgctgggattaaccggcgtgagccactgcgcccagccgaatttcactagatttttaaaaactgcgaaagtattaccctgtattttttttttttggacgaagtttctctcttgttgcccaggctggagtgcaacggcgcgatctcagttgatcacaacctccaactcccaggttcaagcgattctcctgcctcagcctccccagtagctaggattacagacatgtgacacgacgcctggctaattttgtatttttagtagagatggggtttctccatgttggtcaggctggtctcgaactcctgacctcaggtgatccacccgcttcggcctcccaaagtgctgggattataggcgtgagccactgcaccaggccgtattaccctattttaagatgatccatttcctaaaactgtactcgacaaccaagaataaggattatctttagttctgtacatagactgacaggtagtctactttgattaatcaactcttggttatcagtgataatgagctacagaagtaatccagacttggttatgagttggtatcaaatgtgttttcttgttttgtttcgtttctttgagacagagttttgctcttgttgcccaggctggagtgcaatggagtgatcttggctcactgcacctctgcctcccgggttcaagtgattctcctgtctcagcctcctgagtagcagggattacaggtgcccgccaccacacctggctaatttttgtatttgtagtagagacggggtttctccatgttggtcaggctggtctcaaactcctgacctcaggtgatccgtccacttcggcctcccaaactgctgggattacaggcatgagccactgtgcccagcatatgtttttattaaaataataataataaaaaaaaatggccaggcgcagtggctcacgcctgtaatccaagcattttgggaggccgaggcaggtggaccacgaggtcaggagttagagaccagcctggccaacatggtgaaaccctgcctctactaaacaaacaaaaaactagctgggtatggtggcgcacgcctgtaatcccagctactcaggaggctgaggcaggagaatcctttgaacccaggaggcagaggttgcagtgagccgagatcgcaccattgcattccaatctgggcaacagggagagactccgtctcacaaaacaaaacaaaaaatcagccaggcgcggtggctcacacctgtaatcccagcgctttgggaggccgagatgggcagatcacaaggtcaggagttggagaccagcctggccaacatagtggaaccccgtctctattaaaaatacaaaaaattagctaggagtggtggtggcagacacctgtagtcccagctactagggaggataaggcaggagaatcagaggcaggagaatcacttgaacccaggagatgtaggttgcagtcagctgagagagcaccactgcactccagcctgggtaacaagagcaaaactccatctcaaaaaaaaaaaataaaacacacacacagaaaaaactttcaagtcaggtcactttcattacttattacttttactctcaaaaacatgtccccagaggtgagaggtgtatcatttcctgaagtcaatcccgcgccccaaactctccgcatgctttccctccatcaacaggcagagagatactagcatctgagctggggatgaccattacgagtccacagctgtttgaccattcttcttcataattgttgttacaactttttttcttccctgaagagatggcatctcgttcagtcatccaggttagaatacagtggcgcaatcgaagctcactgcagcctcaagatcccccaacctcagccgtctgagaagcatgcgttgtcacacctggctgttgtttttgttttttgttttgagacaaagtcctgctctatgaagcctcgctctgccacccaggctagagtgcagtggggcgtgatctcagctcactgcaacctccacctcctgggttcaagcaattctcctgcctcagccttgcaagtagctgagattacaggcacataccactgcacccggcattttttttttttttaaagacagggtcttactatgttgcccaggctggtcttgaactcctaggctcaagcatcttcccaccttggcctcccaaagtgctgggattacaggcacaagccactgcaaccggcataggacagattttccagctggaagccacttgttcacagttggtaaattatttctgagtcccaagggctgggagtagctgcctgaaatgctgcgctgggaagtgttctgtggctccatctggcactgttgcaagtgtgtaagtaagtcctacgtatgtgaatatctcatgccaatcctgatctagtcaaatcctaaacatatcataaagctagtaaatgttaaaagctgagtcacctaattctcactttagtaccataacccaaaagtcacaaatctgatttgatccttccagagaaaagacacatacgtgcccactttcagaagcattttcaaaaagtataacacttccaaagacaatacagcaggtccgtttccccaaaagaaactacagatagcctcaagcaacgcgacatatgttttatgtttcagcctaagaaacgttatctcttttttttttttttagatggagtcttcctctgtagcccaggttggagtgcaatggcgtatctctcagctcactgcaacctccgcctcctgggtttaagcaattctccggcctcagcctcctgagtagctgggactacaggagcccgccaccacgcccagccaattttttgtatacttagtagggacggggtttccccgtgttagccaggatggtctcgatctcctgaccgcgtgatccacccgccatggcgtcccaaagtgctgggattataggcatgagccaccgcgcccggcacagccttagaaacattcttaaaggaaccgcagctaaaactgacatcagactttgtttacaacctcctaccagcaccaccaccaccaaatgtaaaactatcctgtaatactcctatcacactaatttgtcctcttctccatccctgttcaacaatctaccatggatcaaaatgattctctagacagagaataaaatttcctttaaaatcaacaaacataacaaatttgggctcctgtatttaaagtaaacattaacacacactcaacatcacaattaagtttactaaaatactctgaagcgtttgcaatgaaaacctcttaagaataaaaacaggccgggcacggtggcttgcgcctgtaatcccagcactttgggaggccgaggcgggtggatcacaaggttaggagatcgaggccaacctggctaacacagtgaaactccatctttactaaaaatacaaaaaactagccaggcgtggtggcaggcacctgtagtcccagctactcgggagactgaggtgggagaatggtgtaaacccaggagacggagcttgcagtgagccaagatcgcgccactgcactccagcccggtcaacagagcgagactccatctcaaaaaaaaaaaaagaaaagaaaagaaaagaaaagaataaaaacagcagggcgcagtggctaacgcctgtaatccctgcactttgggaggctgaggcgggcagaacacctgaggtcaggagttcaagaccagcctgaccaacatggagaaatcccgtctctactaaaaatacaaaaactaggtagtcgtgataacgggtgcctgcaaccccagctaccctgggaagctgaggcaggagaatcgcttgaacccgggaggcagagtttgcagtaagccgagattgagccaccgcactccagcctgggtgtcgcagcaagactccgtctcaaaaaaaaaaaaaagagacccaagggccaacattcaatttctctacagaatcccagagggaaatgggaaaccagttcccttttagataaaatatttcaacaaagagaaaaacttcataaatacctactgataccatctggatttaaatacacttaacttcagccccctaaaattgaattgaatgaagataaaataaactgcttgctctccactcctcctgtcctcaacctttgaaacagtgtaaaggaagagctaaactaagttcccaaaatggaactccgtactgtagcaccatttcctataaaggcagcaattacaatttcatagagggcaggcggtgaatctaaattctagcttgatataacgacaagccaaggaatgtctaaagagagtacaaacaaatcctgcaactgaaagaggtgcctgtttcactccgtgcttgcttaccgtcaccctgcatgtctgaagtccatagtgtcagattatcacgtaacaactgcatgataagtgtagagtccttatagctttcttcactcagcgtatccagttctgcaattgcatcatcaaaagctgcttttgccaacctaaaggtatttcaatagaagtgttataaaaattaagtccaaaatcagaattagaaatgacatgctagacagcaatcttttcttcagttattccagtttgtaatagtcacaatgataatgcaaagaaaaagcaaatacaataaaaattaacttaaaggtatgtggaacactacttcttactatgctttaagcctgctactgatatgctataatatacatatcgactaataaaatacatagaacaacttccatcctaaaccatcaccaaaaaatatacctccaagttctaggcaatagttcacttatttcaaaaagttttgtttgtttgtttttaagacggagtctggctctgtcgcccaggctggagtgcagtggcgtgatctcggctcactgcaagcttcgcctctcaggttcatgccattctcctgcctcagcctcccgaatggctgggactacaggcgcccgccaccacacccggctaattttttgtatttttagtagagatggggtttcaccgtgttagccaggatggtctcgatctcctgacctcgtgatccaccagcctcagcatcccaaagtgctgggattacaggcgtgagccaccgcgcccagcctagtttttttttttttttttttttttttttttttttaagggattcgttatgttgcccaggctggacttgaactcctgcgttcaagcaatcttccgaaccttagcctcttgagtggctgggacaaacggtacacactaccacccccaagattttttaaaaaaaaaaaaaaaaaaaaaaaaaaaaaaaattttttttttttttttttttttttgggggacggggtctcgctctatcacccaggctggagtgcagtggcgggatgtaggctaaatgcaagctccgcctcctgggttcacaccattatcctgcctcagcctcccgagtagccgggactacaggcgcccgccaccacacccggctgatttgtttttatatttttagcagaggcagggtttcaccgtgttagccaggatggtcttgatcttctgacctcgtgatgtgcccgcctcagcctcccaaagtgctggattacaaggttgagatatttaacaaagtattaatgcaaaaagaaaatcttggacaatacctcaaagtttaaaaaaatttaatttcacgttaatggaggcagggaagcaaagaaaataaaaggcaacacagacgccatggaaatgtgattatgtaagccatttacagttttaaaagaaaatccacacttactgagtactgtgtactatgtccaacaaacgatacgatataccaatagaaaaaaaagagacataatctaagtccacatcaacttaaaaatttagaaatggagggtagacaaatacataactattttacaaggaggaggctggctgtggtggctcatgcctgtaatcagcacactttgggtggctgatgcgtgcgcgcagatcacttgaggccaggagttcaagaccagccgggccaccatggcaaaacctattaaaaacacaaaaaattaggccgggtgcagtggctcaagcctgtaatcccagcactttgggaggcagaagcgggcggatcacgtggttaggagatcgagaccatcctggctaacacagtgaaaccccgtctctactaaaaatacaaaaaaattagccgggagcagtggcaggtgcctgtagtcccagctacttgggaggatgaggcaggagaatggtgtgaacccaggaggcggagcctgcagtgagccgagatcacgccactgcagtccagcctgggcaacagagcaagactccgtctaaaaacacacacacacacacacacacacacacacacacacacacacacaaaattagccgggcatggtggcgtatgcctgtaatcccagctactcaggaggctgaggcagaagaatcccttgaacctgggaggcggaggttgcagtgaggtgaaactgtgccaatgcactccagcctgggcaagagagcacaaaaacaaaagaagaagaagaatgaagtgctattccaaataaagtatttcagggacccagaaggaggagcaattaaagggaaagtcaaatttgaactaatctcaatggataaggagaaaacaaaacacacttcaggtttaagcagaagcatgagcaaaggcatgcgagtgactttaaactggagctacacgtgggacagctagactggagtctgacaaggaaaggtgcaaccaccagtattagctaaatagccacagcttcttcagttacgatccctatctggacaaactcaactagccatttagaatgtttttacattggctgggcgcagtggctcacgcctgtaatcccagcactctgggaggctgaggcaggtggatcacctgaggtcaggagttcgagaccagcctgaccaagatggtgaaaacctgtctctactaaaaatgcaaaaaaaaaaaaaaattcagtcaagcgcagtgaagcatgcctataatagtcaacattaaagttccaatgtatcagttaatcccctttcctcaaactttgaaaggctttcacttaaaaaccctactttgcttaagcagttgtcctcaaacaaaccaaaaaaaaacacatacaaaaaccaaaaggggccgggcgcggtggctcacgcctgtaatcccagcactttgggaggccgaggagggcagatcacgaggtcaggagatcgagacc

SEQ ID NO: 2457 - DNA, 12353 bp, Homo sapiens
cacttgtctaatttttgtattttttgtgaagatggggtttcgccatgttggccaggctggtctcaaactcctgacctcaggtgattcaccgagcttggcctcccaaagtgctgggattacaggcgtgagccaccgcgcccggccagccttttctttcttaagttattctgttcctagttccaggagaattctagtgatgtcatcaaaaatcttcctggaaatctcttccaaatcctatagtaaatgttcctccagaggattctgtttctttcagtcttcaggttgatttgcccttccctggttttgagaaaatttttcagaatccctataatgttttgttaacattattaacattatttcattcatccagaattgtataaaaataatgtaatgaatgcctgtggaccaccccacccacacaactattttttttctctttattcatcctcaaaacagacaccatttggctggccgcagtggctcacacctgtaatcccagcattttgggagaccgaggtgggtggatcacctgagatcaggagttcgagagcagcctggccaacatggagaaaccctgtcttcatctccacaaaaaatacaaaaatgagccaagcgtggtggcgggcacctgtaatcccaactacttgagtctcctgaacccgggaggcggaggtggcggtgagccgagatcacgccactgcactgcagcctgggcaataagagtgaaactctgtttaaaaaaaaataaaaaagaggcaccatctctcagaatcagcttgagcaacttgtagacaaataggtggccagctcttggccctgctctctgtccatcagatcaatggctgaatcccctcttcaggtccacggttggaagggccactattcgggatatgacagttgctctggtagttcaacattagtgctggtgacaacctctcatcggccacctcctgaggaaccagagttttccagtgcctgtgcttctccctctggcgctgtttcagagtaactattctccatacacttctcttgctgtgacttctgcttatttctggtgtcagttgcctctggcttttgattgcttctttcttgcatacaactctcagtttgaagccaccccactctctgatgactgtctcagcttgtctcacagacacatttcccaatcatgaagatccagtcggtggattggtcattatccagtcagtgtacctctgttggatggagttctcacctcgagagacctcacaggtcgctggctacatgtctgcctttgggtcagctacttgttcctcaatcaaccagccctggcctagataagggggtctgtgttaggaacttgttactgggcaacaaaccatccccctcgacgaagtcttagtgtcaaataaatataagcatttatttcactgatacacacataggagttggctgggggtcaggtgatctagggtgggatccaatgtgacccttttccttgtatcttttttttttttttctagatggagtcttcctctgtcacccaggctggagtccagtggtgcaatctcggctcactgcaacctccatctcccgggttcaagcaattctcctgcctcagcctcccgactagctgggattacaggtgcctgccaccacacccagctaattttttttgtatttttagtagagacagggtttcaccacggtagccaggatggtctcgatctcctgacctcatgatctgcccaccttgtcctcccaaagtgctgggattacaggcgtgagctactgcgcccggccaaaagaaattttttaaattagttgagtgtggtggtgtgggcctgtaatcctggctactaaggaagctgaagtgggaagacagcttgagctaggaggtcatagctgcagcgagccatgattatcttaccatggcactctagtctgagtgacagagaccctgtctcaaaaaaaaaaaaaaaaggataatgtaaaatctttaaagaaaagggacagaggctgggcgcagtggttcatgcctgtaatcccagcgttttcggaggccgaggcggggatcatctgaggtcgggagttcgagactagcctggccaacatggagaaaccccgtctctactaaaaatacaaaattagctgggcgtggtgtcgcatgcctataatcccagctactcgggaggctgaggcaggagaattgcttgaacttgggaggtggaggttgcagtgagccatgatcgcaccactgcactccagcctgggcaacaagagcaaaactctgtctcaaaaaacaaaaaagaagaggaacagaaaacatcagaagcaatatggaaatgttgtttaaagcattaaacatgccaacagaagcaaaaccaaatgtatcagtcatcataattacctatgagtcagagacaaatagttggggaggttcaaagtattttctttttcaggcatcctctgattcaagaggtaaattctccatgtatttttctcaatccagttcctctgtcttataaatagcagagattctggcttttctccattttccacatttctgtagtggtctgagtgggccgcaaggaggggctgcatcaggggccactggctggtgacactttccaggtgacagcctcattgcataccctctgaagccctgcagcccttcctgctaccctcatctcttcatggcactcccacatcctacttgagctagggctcattctgtgggggccttcactctcctgtttgcttctgagacccaggaggcagaggttgcagtgagccgagatcacaccactaaactccagcctgggtgacagagcaagactccatctcaaaaaaaaaacaacaaaaaaccattagccaggtgtggtggcacacacctatagtcctagctactcgggaggctgaggtgggaggatcacttgagcccaggtggtcagggctgcagggagccatgatccactccacaccagcctgggcaacaaagggagaccctggtctcaaaaacatttttttaattaaaaaaaaaagaagtcgactgggtggcttggctcatgcttgtaatcccagcactttgggaggctgaggcaggtggatcatttgaggtgaggagtttgagaccagcctggccaacatggtgaaaccccgtctctactaaaaatacaaaaattagctgggtgtggtggtgggcgcctgtaatcccagctacttgggaggctgaggcaggagaatcgcttgaacccaggaggcggaggttgcagtgagccaagatcacgccactgctctccagcctgggcggcagagtgagactccgtctcaaaaaaaaaagaagttatcaaggaaactgcagcaccccaacaaaaacagaacttctttgacctcagaatggaaaaatggcagaagctgattctcacagagttggctcagatcgcatggctgttgctaaatcaaacaccgaggctagcaggatagaacgctctcatcaatgaggcctaggtcccgagcccaccctgagagacaggcagtggcctcaagaggaggagacatcaataatcaaataccaggaagacgaaatgcaaggacaataagagcccacaatcacctctttaatttctccctgggaagaatgctgcctgagaggctggcagaaacgaagaggccaccacacatctgctctgtgcttcctagtttacaaaatacttctcaggttgtcccatttaatcctcacaagtagcccacaaggcaagtggcatcacttatttatttatctatttatttatttatttatttatttactttttgagacagagtttcattcttgtcactttatttacttatttatttatttttcgagacagagtttcactcttgtcacccaggctggagtgcaatggcacaatctcagctcactgcaacctccaccttccaggttcaagtgatcctcctgcttcagcctctcgaatagctgggattacaggtgcccgccaccatgcacagataacttttgcatttttagtagtgacggggtttcaccacgttggccaggctggtctcaaactcctgacctcaggtgatccaccctcctcggcctcccaaagtgctgggattacaggtgtgagccaccgtgcccagacacaagtggcaactgagacttaagagacatgaaggggcttggctaagttgcaaagcaggtatggaaccaacagaggggctgtggagctgtgcagaaaaaacaggaaggcactaacccagggtaatgtgtccatagcccccaccttgtccagcaccacatcctcccttcacctcagggctgcagctcctccgcctctgcctcctcagggcccacatcctgtgcctctctcccttatcattctgatcctgccagtttctgccacgcctctgtctgaactttgctccgtgctccaggcttgttttcctctggacctgggaaccactggcttactttcactcaccgcctgtccttcctgacacctcaccatgtgtacgggaaaatgtgcccgctgtgtggggctctccctcattaccctctgcctcgtctgcattgtggccaacgccctcctgctggtacctaatggggagacctcctggaccaacaccaaccatctcagcttgcaagtctggctcatgggcggcttcattggcgggggcctaatggtgagaaggctggcaggggagcccgggccagctggctgggtgccacctaaggggttctgaacaggagggagagggagagaggaataagaatggttgcttgggagaggatggcaatggcttcgtgggggctagcagccctctggagtcagtcctggaggagccccagggtcccaagctgaatgtctgtggggcacagaaaggacgagagcctcactgctctaaagagctcccctaccgggtagggagcatgtcctgcctgtcctccctgtccccactgttgagcagatgctgggaaaacctcactacaatggtcgaggcagaaggagcagctggttgtcagagacgtcatcggggcaggataataacaggcatgagggtggggcgcagtgaaattacccagagccagggactgccctcacggatcagtcaccctcgcttgcctccacgtccattcactctcaccccacatttctggaagcccaatctgtgcggactgctaaggataaactcagaacttaggtcagtatggcagggaggatgccctcaagtcgtcttccgggagatgagaatctatttgccaggggcggaggtgggggttggtttttgtgtttgttttttgtttttttttttttttgagacagggtctctctctgttgcccaggctggagtgtggtggtgcgaacatggctcactgtagccccaacctcctgggcccaagcagtcctcccacctcagcctccgagcagctggaaccacaggtgggcatcaccacacccagctaacttttaaatattttatttatttttattattattatttttttgagacggagtctcgctctgtcgcccaggctggagtgcagtggcgccatctccgttcactgcaacctctgtctcctgggtttaagcaattctcctgcctcagcctcctgagtagctgggattacggtcacgtgccaccacacccagctaatttttgcattttcagtagagacagggtttcgccacgttggctaggctggtctcgaactcctgacctcaggtgatccgcccccctcggcctcccaaagtgctgggattacagatgtgagccaccgccccagcttacattttttgtagagacggagtatctctgtgttgcccagactggtctcaaactcctggattcaagtgatcctcctgcctcagcctcccaaagtgctagaattatagatgtgagccaccacgcctggccaagactaggatctgtcagaagtggaggaaaaggagacacagatttccccaatttactaacccccatcttccaactctccacccattcagggaaactttgggatggtcaacctcgtttaatatcttcatgcgataaagacaaaagatctacccagcacagttccccacttctcaggacagttggctaatgacattctccaggggagagctccccttggtcccttttgctggtcacacctcgctggtcacacctctatttgctaaaagaggatacctctcctttaaccaacaatcccctcttactctctagtatcttttcttctactccctcctcctgcatggattcttggctgctgtactctactctatcgctctaaactcaactctctttgagagtcacactcctctcaggctgacacacttagccattgtcacggggtgctccctctgcaacctgaaccacccctgtctccccacactcctctgccccatctaaccagcttgcttcagcggagctccctgagtctgccttccccaaatatgcattcacagctgccttccctccacctctgtgcccagagtcactctcaagaagcaccacccggtgggcatggtggcttacgcctgtaatcccaacactttgggaggccgaggcgggccaatcacctgaggtcaggagttcaagaccagcctggccaacatggtgaaaccccgtctctacttaaagaaatatacaaaaattagccaggcatagtggcgggcgcctgtaatcccagctactcgggagactgaggcaggagaacccgggaggcagaggttgcagtgaggcgagattgcgccattgtgctccagcctgggcgacagagcaagactccatctcatacataaataaacaaataaataagcactgctgtatatcacagggacacagacaggttcctgctctccctgaagcttgtgttccctttggtaaggccaccagtctcacggaagcaaggctggaagtcccacgagagcaagcactgcctgctttgttggccactatgtacccagtgctagaccagcaccttgcactaaacagacacccaattaatagtcatggaatggcagcgtgtgcctgtagtcctagtttgggcccagaaatgaaagattgcagtgagctatgaccacgcgccactgcactccagcctgggcaacagagcaagaccttgtctcaagaaaataaaaaataaaaaagtcattgaatgaagtatagaactaggcaaggcaatttcagatagaagtaggtaccatcggccgggcgcagtggctcatgcctgtaatcccagcactttgggaggctgaggcaggcggatcaccgaggtcaggagttcacgaccagcctgaccaacatgcagaaatcctgtctctactaaaaatacaaaaattagccaggcgtggtggcgcatgcctgtagtcccagctactcaggaagctgaggcaggagaattgcttgaacccgagaggcggaggttgcagtgaaccaagattgcaccattgtactccagcctgggcaacaagagtgaaactctgtctcaaaagtaaaaaataaaaataaaatgaaatggtgctggcatgaagagctcctaggcaaagcagatgccactttttataggattttcagggacaggctctatgaggtgatgtctgaactgagacccaaatgacaagaagaaggtgtgagtgttgcagacactaggggctggtagtacaaagcctaaggtgggaacaagctctacacttctgaggatcagacaggtggccggtgaggtgagatgtaatgagatgaggtctgaggagggcagaggctaggcctggaacaccctgaaaagccacagtggagtcatttgaatttttattattataagtacaacagaaaactattgaaggacttttttttttttttgagacggaatctcactgtgtcgcccgggctgcagtgcagtggtgcgatctcggttcactacaagctccacctcttgggttcacgccattctcctgcctcagcctcccgagtagctgggactacaggcgcccgccaccacgcacagcaaattttttttttttgtatttttagtagagatggggtttcaccgtgttagccaggatggtctcgatctcctgaccttgtgatccacccgcctcggcctcctaaagtgctgggattacaggagtgagccaccgcgccatgccctattgaaggacttttggcactttgttttttgacggtttaaaactttttatttaagtcacacagacaagtacccagatccttagtacacagctcaacaaacttttacaaagtgagcacatctgagcccaggtcaagaaacagatcattaccagaagcccagacatgcttctcaccacacacggaaccccagaatcacttcaccaacaagcgtaaccactattctgtcttctaaccccatagacgagtttggcttattttgcactttacacaaatggaatgatagagtatgtgtctggcttttttttgagacggagctgttgcccaggctggagtgcagtggcgctatctcagctcactgcaacctccgcctcccaggttcaaatgattctcatgcctcagcctccagagtagctggggttacaggcatgagccaccacgcctggctaatttttgtatttactttagtagagatgggggtttcgccatgttggtcaggctggtctcgcactcccgacctcaggtgatccacccacctcggcctccccaagtgctgggattacgagcgtgagccaccgcgcctggcctgtgtctggcttctttagctccatattacgtttgtgagagccacccatattatcaggtgtagctgtagttttctttttttcttatacattctattatgtgactatacctcatttatacattctactgtttgtttgtttgtttttttgcttttttgcttttttgttttttttgaaacagagtctcgctctgtcacccaggctggagtacaatggcgccatctcggctcactgcaacctctgactcccaggttcacatgattctcctgcctcagcctcctgagtagctgggattacaggcatgtgccaccgtgcccagttaatttttgtatttttagtagagacggggtttcgcgatattggtcaggctggttttgaactcccaaccttaggtgatccgcctgcctcggcctcccagagtactgggattacaggcataagccactgtgcccggcccattctactgttgaaggagatctggatcattcccagtttggtttttttgcaaataatgctgctataaatattcttgtagatgtatttaggtacaaatacgtgtgcatttctattggataaaaacctagcagtaaaactgctgattcttaagacatgcaagtattcagcgctaatagatattgccagttttctgtagttcttagtgtgagaggtctggttgctccacacgccactggaatgaagaagactcctttgaccactgtgtggagaatgggtagtagaaggtctgcaatatatacagaaaaagaccaaactgagctgggcgtggggcctcaagcctgtaatcccagcacttttggaggccgaggccagcggatcatgaggtcaggagttcgagaccagcctgaccaacatggcgaaaccccgtctctactaaaaatacaaagttagcagggcatggtggtgcatgcctgtaatcccagctactcggaaggctgaggcaggagaatctcctgaacccagcagacagaggttacagtgagccgagatcatgccactgcaatccagcctgggtgacagagcaagactccatctcaaaaaaaaaaaaaaagaaaaagaaaagaccaaactgaggtcacggaagacatccaggagagatgagagtggcttggactaggccagtggctatggaaatggagaaatatgagctgattcaggctataagcacagtgttttcttcttcatttatgatgacacttttcactaagacaaaaagatggtgaagaatgagacagagaagcacatactacaaagggaagcaaacactttaatcaaaagagtaaaaatctcaaatagggccaggtgtggtggctcatgcctgtaaaatcccaacactttgggaggtggaggcaggagaatcgcttgagtcccagcattcaagaccagcctgggcaacatagtgagactctatctcaacaaaaattttaaaattagctgggtctggccaggtgcggtggctcacacctgtaatcccagcactttgggaggccgaagcaggctgatcagctgaggtcaggagtttgagaccagcctgaccaacatggagaaactttgtctctactaaaaatacaaagttagcagggcgtggtggcgcatgcatgtaatcccagctactcgggaggctgaggcaggagaatcacctgaacacgggaggcagaggttacagcgagccaagatcgcgccattgcactccagcctgggcaacaagagcaaaacttcgtctcaaaaaagaaaaaattagctgagtgtggtggtacaagcctgtaatcccagctactctaatgctaaggtgagaggatcacttgagcccaggaggtcgaggctgcagtgagccatgatcatgccactgcactccagtctgggcaacagtgtgagaccctctctcaaacaaaagcagaaacctcagacaagtagatcattcaaaattggtaaatccaaaaggcaattctaggtgtgtttggatccacaagcctccagtaagtgacctaaccagggaggtaaagtaaggtgtcagcatgggtcctggccctgccatgagacaggaagaagagagagcaggtgtttctctgaggttgctggggatgatataatagaactgaaactctcagccctttccctggagaagcacaaaatgctgccttggatggtatgtgccagataagacacatgaggagccaggcacagtggctcatgcctgtaatcccagcaatttgggaggctgaagcaggaggattgcttgagcccaggagttcgagatcagctaggcaacatggtaagacatgaactctccaaaaaaattagccaggcatgttgttccgcacctttagtcccagctactcgggaggccgaggtgagaagatcatttgagcccaggaggttgaggatgcagtgagccatgattgcaccactgcattccagcctggatgacagagtgagatcctgtctcaaaaagcaaacacacacacacacgaaagcaagaagcaagacagctgtggaattccagagataggagacaggcaaagaacctgacctggtgcaacgaagataaaggtaacggagccagatgaggaggcttaaatgccttacaagagttaggcgttcaagttacaagtcttggccaggcgcggtggctcacgcttgtaatcccagcactttgggaggctgaggcaggcggatcacgaggtcaggagatcaagaccattctggccaacatgatgaaaccccgtctctactaaaaatacaaaaaattagcccggcgtggtggcatgtgcatgtagtcccagctactcaggaggctgaggcaggagaatcacttgaacctgggaggtggaggttgcagtgagccaagatcacaccactgtactccaacctggtgacagagtgagactccgtctcaaaaaaaaaaaaaaaaaaagagttcagtcttgatgggcttctctgtgaagagaccctaaaggatttgagcagagaaaagaccagttgaaagctatgtttaggccagatgcagtgacttacacctgtaatcccagcaatttggtaggccagggcaggaggagcccaggagttcaagaccagcctgagcaaatagcaagaccccatgtctacaaaattttttttaattagctgggaatgatgacgcatgcctgcgataccagctactcaggaggctgaggcaggaggatcacttgagcccaggaggtcaaggctaaagtcagccacgatcaagccactgcattccagcctgggtggcagagtgagaccctgtttcaaaaagaaagaaagaaaaaaaaaagctatgtttaacctgatagaggatagagtgtagggtggcatggggcaagagctatgagagtgtaatagggaggctgagaacaccctcatgggaggtgatgagggattcaatgtggggaggaactcacagattcaggagccacttaagtaaaagttgagaaaatttgatgtctttctgggtgcaagattaaagctttccagcctggctgacctagtagatgttattttttccactgatggagacaagaaagtcaaagggagatgaatttgaggaatattgtgagatgagcgtgaggctggttgaatttgagctaaaaccaagatattcaagtg

SEQ ID NO: 2458 - DNA, 9003 bp, Homo sapiens
taaactttaggccccaaaaaacctggatgtgcatctgaacctttcatttccactgtggagatactcacagcctcttcagcttgtctcttgtaagctttgactttggtttgcaatttgtccaccaagtcctgcagcctgagaatattcttgcggtcctcctcagtctgaaagaggtgcaagtagatggtgccattattttaaaacaactcatgattttcttgaaaactataggcctggaagatatgaaaacactggtcacctggtaagtgagttccttcactcttctctcatgtttgcgaagacccttgacagcctcaacattgtgcttctgttcactttccacctcactttcaagctctctcacctggaagggaacaaagacgtttaccagtttggctgtaactggccacaaggaattgagtgaagttgtggagacctaccctggcctccagtttctggatctgcttcttcccacccttcagcgccagctgctcagcctcatccagacggagctgcagatccttcacggtctgctccatgttcttcttcatccgctccaggtgggcgctggtgtcctgttccttcttcagctcctcagccatcatggcagcctagttagcaaataaattttgaaaataatgaattctgatgatagcaggcagcatgcatgtgtcagtaagacaaatgctcatcttgcttacatcagtgatggccttcttggccttctcctctgcattgcgggcttcctggacgatgtcctccatctctccctggatttgggaaatgtctgtttccagcttcttcttggtgttgatcaggctggtgttctgtttcaaattaatgaaagagaagagaagcacatttacttataacaactcacattgtcattttacctagtgtacacaggcaaaaattattgatcataagaaatgtttagaataaaaaccaaattagaagataattctaagtttatgccttttctcctttctatatatagctctttaatcaaacttctaaatttaatttttgatgtcaaacatattcaactattaccattgccatttgtaagcatgaaacacagcccacaaaactcaaagtgctgtaccatggagcaccacaccacagctcatttaaaatgaatcagtaatttttagctattaactcatgttggttgactccatatttataaatgcataaatagttgtcttgttggctgggcgcagtggctcatgcctgtaatcccagcactttgggaggccgaggtgggcagatcacggggtcaggagatcgagaccatcctggctaacacggtgaaaccccgtctctactaaaaatacaaaaaattagtcgagtgtggtggtgggcgcctgtagtcccagctactcgggaggctgaggcaggagaatggcgtgaacatgggagtcggagcttgctgtgagccgagatcgcaccactgcactccagcctgggtgacagagtgagaccccttctcaaaaaaaaaaaaaaaaaaaaaaaaatagtagtcttgttgggataaaaatgagccaagaatcccttctgtttttggcaagttgatggtgtttggaatagtcaacttcagatactgttaataagaaaaatgttgcatattaatttgattttaaaattatataaagcatgcaattttaacacttctataatagttatgtttatatagtgcaactttctgaagtatacagtactatatatttattgtaaaagatagtagaacatacaaattagcagacaagaaacaaaaaataattactgtgctctcaccagagataaaggataaacttttatttatctttctggatgtttcctatatgtttatacgggaaaaaagatcacacagcctatattatttttaagttgcttttttaacttactataatataaacatcttcccatggcaataaattcatactacagtggttacatattagccattgtgaggatataccaccatttatttaacaaattcactatatacaacaaatgctaactagtattaataatggcctccatgaatttgaactaaagagcttctctttgtatcccatgaggttagcattctgtgcatatgtgatacgtaaatattatttagtggctttttgtttttctcctctattttatttgcctatctttttgtagcttagagttgcataagacaagacagctacaaatgttgtgtgtatgtttatttgtagatggtcttctgtgctttttaaataaaagtttctagaattccagattatttcaactcaacatgattatgccagcccataaatatactcgtgaaccagctaggtcccagtaaatccttacagcaccctgtacattttccagagctccaggaagggacgaagattactttttactttataaacaagcttatcttctcaaattatcttcagcttcagggagtacattttctaaaccatagtcttgaacctcacctgagtgtgcagaagttgcacacgttcactggcatccagaagctcttgctctgccattttcctgcctctctcagtccgttccagggatgccctgagctcttcaacttcagcctgcatcaggttagctctgcgctcaaccattgccagttgttccttaaggtcatcttggcctctgatggcatcatccaaatgtagctgagtgtcctacacagaaagagaaaaagcctcttactcatgctgcacttaaagcaaatgcaaacttatggtcatgtacactctttgatcttaatgacttagagtatgattagataggagcaatcggcaagtacctttaataataaattctttgtagctgagggttgcagttctactcaaaagaacatgatgttttattattttagaccctgaatcattaaaaaataccatggctagctctacaaaattttggatcaggaaagtatccttagacttcagcgagtccagtggtgctattttacatattaagcaaatgaagtccagattaatgaagtgatttaagcagtggcatgtagccaaactctttcatcacttcctctatctccctacccctcaccacagtgcttctctgcagataacaaagcaaactctgtcctgggccttccagaattaagctctttttcagttgtgtgtgtataactttgaactttgaactgattaccatgttgcttaggtgatttatgacacatagtcctcgtaaaacattaaaatttgagttacacagtagcactgagactgtacaacactatgtgtatttaccccagcataccttcagtattccttgtgtgtttctaagattccttagtgcctcagcagcctggcggttggcatggttcagctggatttccatttcattaagatctccctccatcttcttcttgatcctcagagcatcatttctgctcctgatctcagcatccagtgtactctgcattgactccacaactctgagatggttcctctttagctgatcgagttcttcatctttttcagcaatttttcggtcaatctcagatttcacctgatttagctcaagttgaatgcgaagaattttgccttcttcatgctcaagagatgccttaataaaagcaacatttatttaggttacctaaagagctttttatttctttcacattatgataatttccccaagaaggcattaaaaaacccataaactatcatacgtcttaatgtagcctattagctctgcattctcaaggtacaattcagtatttttcactgaattacttgtgttattccctaaagatttgcaacatgatagagatctcagttgctattaattttcaatttatttataatgcagagctaagcaaatgaaaaatgtacctctgcttcctctagggaagtctgtagttcactcttctcatgatcaagttgtttctttactttctccagttcatggatatgctttccaccctctgcaatttgctctgtcaggtcagaaatctcctctgtaataataaagtaccaaatttcagttaagtagaaagaaaaattgaaaagatgtctccctaccatttttgaaatagaatgattacagtgactcacgttgtaagttcttattctctcgctttagagtttcaagatgatccagggattcctcgtaggcattcttcaccttgaacagctcagtgctgagagaacgcgactccttctgggaggcctcaagttcagcctgagtttcctcatacttctgtttccattctgccagaacctggaagtatatagaaaataagcctttgaaaccaagaatgatgtcagtttcccccaaggggagctggtactgtggaccaccttgtcaaagtttctttgcttcttatcgagagctatgcaggcagcattagatcgttccacatcaatcatgaggtcctctacttcattctgtagcctctgctttgtcttttcaagagaagcacatttggaattcacagcttctacatgttcttctgcatcctgcagacgctgggctagcttcttcctgaaaattgggtcagtatgagtgaccaagagcagactcagagtcaccacagtgccctttataaagctgctgactaggaaagcatatttccccaagagttgtctacaagttgttgaatttttctaaacattttcactctcttagaattctgttttccctgttgagttcttatttttatccatctcaggtattgccaaacatatttacgaagcacctgtgtgtgtgtatgtgtgtgtatgagagaaagagaatataagttagcactagagctgagtgagcaatgtgaaaatttgctcctctttctttgtttttatttcactaagctggccctctatagtgtggcacattttcttgaactttgcctggggtgagaagtagaaaacaggaagagacagtacatttctcttttgaaacctgggatttagagatctgtaactacttgtggaaaagggctgagttttatttactttgaggaagaaatggcaaccatgaacaggaagcatatcaccaaggaatggtagcattgagtagtatctttaagcattttctagtatggttctgtttattttgcaaatgaggaaactgcggcccagagtgatatgttcaaggtcatacaatgaatcagtaactttctggatttggtggcctttgataataaatattactgcattattgcatttcccaaatttcctctaaaatcttgtctactactcttcaccaacctatgtaattcatgacctttcccagcccacactcttatctagaactctctctggaaatgcttgctacaaactctttcatcctgtttaattctaacaactactgagataaattaaatttagaaaggcttctttcactaggagtataatgctttttttccttctatgtgtaaatctgtaaatctcatgacttgtagtccgcaaacagtacgtgtaattagtgaatacatccattgatataggttgttagttgaaataatgacagcatatgacaaccttaatataaacattcaatactccatctgaggaaaaactgattattgttaattgtaatactcataataatttaccagagagtctcaatgtctcaatttttccttctattaaaagatactaattctatttaattcataaataatattctgataattaataatccatcttggtggaaagaaatttaagatgcttctggacaagaatgggtggagggatctggtctcattccattctccagtggacatacactgggctttaagaagaagaatatggtggaatccaccaacctataataaaataagctgaagtctttcatgtgtccccaagcccggaatattctctttcttctatttttccttcactgcctttacttttatttcttcctgctcccctgcactaaaagcacatacttggcctcctccagctcctctgtgcgctggatggcgtccgtctcgtacttggtcctccactgggcaacctcactgttggccttggacattcccctctgcagctcagccttggcttcctgctcctcctcatactgttcccgcagcaggtcacagtcatggcgggctgactgcagggcatgggccagagtgctcttggcctagaccaaccaaaaactatgtgatataagtttatcttctgatcattgaaattctctatgcaaagttcaatagtgtgttatgttgcacggttcaagtgattgaaagtatcagctggagaattctcaccttagtctcctcttctagctgcctctttaattcttcaatctgttgtgtaaatgcttgtttgcctcgggatagctgagaaaccatagcatctttttcatctagctgtcgtgaaaactcacctgtggaagacaaaacatcaatgatttagttctgttgtctaggtaaacaataatttaaagaatggaataacattgtaaccctcttatttcatatgatgaaaaaacccctcaagattttcagtgatgttgagaaggttatttcttgctttttaaaaaatgtatgagttttctttgatattttagaattcgagaacttttgagtaatgctgagtcacaaaaaatctcctgagcccagggagcttaattcttttccccaattgtcgcttagaatcattgcattttactgtctcataataaaaagatggaggaataagtaagacatgataaatgaatgtacagagcttgagaaattacttgtatttgataggtaggtaaaggcttgtctttcattcgtcacctctccgaaggttgatgctatttatttactgacctgattctgtgtgtaaacgtgccttctgggctgacaactcatttattaagcgttgttgctcttcttcctttgtttttatttcactaagctggtcctctagggtgcggcacattttctcaaagtttgcctggggtgagaggtagaaaacaggaagagacaatacatttttattctagaggctgggatttagagatctgtaactacctgtggaaaggggctgatttttatttacttttctatcaatcttgcatggtggctataaagtagtagaggcatttaatttggctaaataatgaacacatgattatcaaaattatattctctttgaaagtgtgaacatcatttaaattctgcatcatttagagtatggtttttagataaaccttttttgtaattacattttttttcatggtaatagtatcaaaggttaaagtgttttctacaaagaagttaagagaacttaagtgattcaatacaataatgtgtactaggagtaagtttaagcttcagatgccatctaatgtttgtgtaatttggctaaaaatagtcatatataaacttggtcattttgaattgttgcaaataaagatgaaaagggcacaagttaatgaagaccttggctttggagacagtctccatgttactagcaaggtcattgatctccatcttcagctcactcttttccttctccagcttctgcttgacccgctgaaggctgtcaatctgctccccaagctcagccacactatctgcgtgcttcttccgaagagcagctgccgtggcttcgtgctgcagggtggactcttccaggtccctgcgcattttctggaactcagcctcccgcttcttgttcatctcaatctgggctgaagtggccccaccggcttcttccagcctctcactgatctcctccagctcccgggagaggtcagagcgctgcttctctgctttggcccgggaggcccgctctgcctcgatttcctcctccagctcctcaatgcgggcctggttgtgatatgtcaacattaatgtgaatttatgtcagttttgtttcctgtaatgcccagaaaaggtggaggttataacttacctgtaattctttgatcttcttttgtagctgtattgcaagggcttgttcatcttcaatcttgccttgcagattgctcatttcaaactctttcctattagaagagcaacacattagcttataatcacttctcttaccaatcttcttttctatgtataatctaagactttttttatactgctggtgttgaaggagtgagtagtacaatgttttacagattaataattgtattagtttaattaaataaaaaggtcaaagatgtcattatttttttccatatgtcatgatgtaacattttggagatctttttagcgtatgtttcatttgcattgacatacaacaagcaggttatagctgaattataccatacttactttttgagtttctcattaagttgctgtttgtcattttctgtatccattgtggattcttgggccaattttaggtcaccctccagttttctcttggctctttctaagtccatgcaaagtttcttttcttgttccagagatccttcaagctaaatttatgatgcattttatttatttcagctcttaagcactgaaccctatgctagtagccttcaaagatacataagaaaaaaatttaaagatacaacaaatagcacaagaactttattcacagaccaagcgttaaaggcttatgactatcagtgctggtttcatgtcacaattgtttatttcattgcaaggggaaacattttctttttcacacttacatcgtccacttgctgttctagcttggttttagctttggtcagggtgttgactttgtcctcctccatctgcaggtcatccagggtctgctggtgggcctcctggagagccttcttctccttggtcagcttagcaatggtttcatccagacctgccatctcttctgtgaggtttttcacctttagattagaacagatgaccagaatgtcaatgacaacgtattatcttgatgaaaaacatgatgctgtagtatcttaggataatgtcagcgtaagatggaaaatgagaaccaggagctaacccaggcctataatggctgaaaaaataggaggtaaaggtcaagtaagtacattgaggtggtgaagactaaagagatgaaatagttatga

SEQ ID NO: 2459 - DNA, 9832 bp, Homo sapiens
caccacacccaaccctaaaaagcttttttgtcatgttagtactttaggtaacttgtcgtacacagagatttattggtgtaaaagatagacctcttgatacgaatttttgataatttgtttggaaaatagttgtatctaagctgtgttgcagagcttcctattataaattatatcacagctttcttccttctaatttccaggctgaggtcctttttatccttctttgagttatggctaacatagccttacattttttgacatattttcctaagttaattgtagaatatctgtagatattttgttagatgtacatacagatatttaaattttgacgctttaaagtaatttgccaccatggttctgttttattttttgtcttttttgccatctttttttttgagatggagtctcactctgtcccccaggctggagtgcagtggcaccatctcggctcactgcagcctccaactactgggttcaagcgattcttgtgccccagcctctggagtaggttggggttacaggtgcgtgccaccatgcctggctaatttttgtatttttagtagagatggggtctcaccatgttggctaggctggtctcgaactcctgacctcaagtgatccccccgcctcagcctcccaaagtactgggattacaggtgtgagccgctacgcccagcttttttttccttttttttttgccatctttctcaaagaaagaattttccagctggccatggtggttcacacctgtaatcccagcacttacagaggacaaggtagaaggatcacttgagattaggagtttgagaccagcctggccaacgtggtgaaactgcatctctactaaaaatacaaaaattagccaggcatgttggtgcatgcctgtagtctctattactcgggaggctgaggcacgagaatctcttgaagtcaggaggcagaggtttcagtgagctatgattgtgccactgtactccagcctggatgacagagtgagaccttttctttcttctccttcttgtttttcttcttcatcctagactgccttatacttactcagatcacatttcttcttattgtttttgtcttatttccatgttttttcctctaccccttaaaacaaattttaaaagacatttttataaaaatgaattttacaattatgtgtatttctttacctatttttcataattccattttttcctacgttagttaataacagttgctatgtgcttctagacctatttctaggtgtgaatttcattttattctgctggagacttaccaagctttctggttctttcttttataattctggaaaattctctgtcatttatctctttgaatatcatgttttaaattcttcctgtcttctgtcattgtcctcaccatcctccacctagaaattcagcacaccagatgaacaactgagctagaaatcagattaactttcacaaaagcaaaagaaacctatacctgctacatagccattttaccttgaagactgaaaattaaggatgaccacatatgaggagtccagttattactgaggagatatgactttaaaaactacttttgtttatctgttgcattctttcaaatagcttgcagcacagtgtgagacctaataatggttgcttaataattgcctgctgtattgagtttataaagattttatgttattttaccaacttttaaacatcactttaagaattccttcattttatcttagtttatgataacagccactattttttgaggacttagtatgcttgaggtaggtagcatctccagtttgcagatgtggcagttgaccttcagaatgtagattacaaaccaattaattatgaaagccagtttggaaatccatgcctatctgatttaaaattccatgccctttctattttctatgttacttctgttcagatcaaatgttgtgaccagaaaacatgttagttggtctttataagttattattattattattattattattattattattattattttgagatggagtcttgctctgtcgccagactggagtgcagtggtgtgatcttggctcactgcagcctctgcctctcaggttctagcaattcacctgtctcagcctccagagtagctggggctacaggtacgcaccaccgcacacagctaatttttttttatttttagtagagatggggcttcaccatgttggccaggatggtcttgatctcttgacctcaggtgatctgcctggcttggcctcccaaagtgctgggaatacaggcatgagccaccgcacccagccagtctttagaaattctaaattaaggcttactctgtcatgccaattaaatttggggccccaaatgcatgcatacgtatatttacatatttgtgtacataaatataggtctttctagggactggaagggatgaatagccagagcacacaggatttttcgggcagtgaaaatatttgatatgctgatacatgtcattatatatttgttcaaacccacagaatgtatgcaactgcaagaatgaaccctaaactatggactttgggtgatgatgtgttaatgtaggttcatcagtttttcaatcaacagtttgtttgtttgtttatttatttacttatttttgagacagtcttgctcttttgcccaggttggagtgcagtggtgcaatcatagctcactgcagccttgaactccctggctcaagcgatcctcccacctcagtctgctgagtagctgggactacaggtgcacaccaccacatcaggttaatttttgtattttgtatagagatggggtttcgtcatgttgcccaggctggtctcaaactcctgggctcaggcagtctgcctgccttgggctcccaaactgctgggattataggcacgagccactgcgcctgacaatcaacaaatactgataatgtggtagactatgtctgtgtgtggcaggggctatgtgagagatctctgtactttcctctttattttgctgtgaacctaaaactgccctgatgaaaataaattctttaaaaacaaacaaacaaaaacatctattttaagcatcttaacatttttcataatacagtattcctcataatagctacataacagttttcccatcattaacttcttatttgcctttttttcctgggcatatttgttctaaatgaaatgtactccacctcacagttatatacagagtttccacattagtataaactatgagataatgctacaggtttgatttgagactctttttgtttgtttctcatgttgtaatattctctttgacttctctggagttctttatgggcagctgtagtgaacaatgagaattggccacataaagtttccttaaatatgggaaggtaaatgagatgtggctggccaaacatagaaatgaagtataatataaagcagcactccattgtagaactgctgccaggaaagtatctaaacatctggaatatggtcagaattctatattaaataatgcagtccaagcatgtactgtatctaagttaaaaaactcttatattgaagatgttaggcatcttatctaaaggagtgcagcatttatactttgggaatacgcaggaaagaaagggtctatatgtaaaattaccaaattgaaaaaaaaaaggtgaaaatacttagtgatgatggcgtgtgttctttctaaaaaaatgaaacaaatttttttttttttttttttttttgagacggagtctcactctgtcgcccaggagggcagtgacacaatctcggctcactggaagctccacctcccaggttcatgccattctcctgcctcagcctccctagtagctgggactacaggtgcccgccaccatgcccggataatttttttttttgtatttttagtagagacggggttttaccatgttagccaggatggtctcgatctcttgactttgtaatctgctcacctcagcctcccaaagtgctgggattacaggcgtgagccactgcgcccagccaacaaaaaatgtttttaaatgaggtggagtctcactgtgttgctcaggctggtcttgaactcctgggcttgcaatcctcccacctcattctttcaagtaactgggattacagatacatgctactgtgcctggttatgagaggaatgtttattttaaaagcgtttctggaaagtaactcagcaagcaatatttagtaaattaaatgtagctaggccaggcgcagtggctcacgcctgtaatcccagtactttgggaggctgacgtggatggagcacctgaggtgaggagtttgagaccagcctggccaacatggcaaaacccagtctctactaaaaatacaaaaagttagctgggcgtggtggcaggcgcctgtaatcccagctgcttgggaggccaaggcagaggcaattgcttgaacctggggaggcagaggtttcagtgagctgagatcgtgccattgcactccagcctgggcaacagagcgagactccgtctcaaaaaaaaagtatctagcaatcccaaacatgcccttttaacttaggagtttttactttttttcttagttttttattttttgagacagagtctcattgtcacccaggctggagtgcagtggtgcgatctcggctcactgaagcctccacctcccagggtcaagtgattcttgtgctccatcctcctgagtggctgggattacaggtgtgtgccaccatgcccagctaatttttgtaattttagtagaaatcgggtttcaccatgttggtcaggctggtctctaacccctggccttaagcaatccacctaccttggcctcccaaagtgctgggattacaggaatgagccactgcgcccagccagtagtttcccttttgaaagtctgtttcatatgaacagaagtactcgtacattaccagaatagagtatttttaccaggatgtttatagtcagacagcctgaatgtacatcagtaggaatggtcaaataaattgttacagccatattatgcaatattatgaagcgattaaatactgagttaggtgtatatttgttgacctgaaggaatttacatgaagtattgagtgagaataataagatacagagcaatgtgtacactgtgatcccattttgtaaaacagttatctaaaaaataaaaaatctctgctgtatttaacagcagtcagctctcagtatctgtagtttccacatctgtggattcaaccaactatggatcaaagatacttagagaaaaagttgtgtctgaactaagcatgtacagactttcccccttttcattattgcctatacaatacagtgtaataaccatttacatagcattcaccttgtattagatattataaataacctagagatgatttaaagtacacaggaggatgtgcataggttgtatacaagtatgatgcaattttatgccagagacttgagcatctgcagattttggtatctgagggaggtcctggaaccaatcccgcacagataccaagagacaactgtttatgttttattcaggattgaattaccacggataaaattatgtcagtaatttcagggtattaatattgtttacttggacatattggtagaatgtgagaatatatatagtatgagggagcccggatagttcagttggtagagcatcagacttaatcagagggtccagggttcaagtccctgtttgggtgtgtccttcggcttttagcacctaattctgattccacctttgaaaaagaaagaaagaaaaaaagtattgttttagctgggcatggtggtgcacatctgtagtcccagatactcaggaggctaaggtaggaggatcgcttgagcctgggaggttgaggctacagtgagccaagattgtgcctctgcactccagcctaagtgacagagcaagactctatctcaacattccccactgcctgcaaatgtgtatatatatatatatatatatataaaatgtgtcagtggaaatctgaagtataaaatctatgtatattactataaatatgtaaacattttagtatgcttattggcaagactcatgaacgttaattgactttggtatgggagcctgcatgattgtgcccatgtttgcagttcagcaattgaaatgaaaaagagatcagttgttccaagtgcttattctgaggttacttgtttttcagttaacatttctctggaaagaccagactacaaatggtaaaagctctatgttttattatcgacaatcccttttaaagttgaagtaattaacatttggagtgaattggattactttttattctaatgtgtgtgttttccaactttttattttcaaaaagttcaagccttcataaaggtagaaagcataggataataaacacctacatatccttcacctaaactgattattaatattttgttttattttggataaaaaggaacaaaagctcacctttttttctcactaccctaatcagccactgttaatgtcatgcaaacagtttatattatttgccactaaacatatttcttatttgcttaaattttttaaatgaaagcataatttatggtagataaatacacagaattatgtgttgtagtttgagttttgacaaatgtgtatacagttgtaatctatacccctgtaaagatagcatttctgtcacctcaggaagttctcacatgtactttcccagtcaccctcatctctaccagtagcttctactgctctgttttcttttgtttcagagagttttccctgcttttgatgttgttgcatacatcaatatatctttcctttttattgctaagtatatttcattatatgaatataacaagttatcagtttttctgctgatggaatttgggttggatattgctttgagttattatgagtaaagctgttatgaacattctcatgcaagtctttttgcatcatagagttaacatttgagtatgctgagcaaataagtaaatcaacagtatataatgtgcacaatatgaggttctgttaagtgctgtgaagaaacaaatcagggtaaggagatagagtaggagggaggatggtttccagaaacaacttcctgattaagagatactttagtaaagacccagaaaagtatacaagtggactatgcagatcactaggagaaactgtgtatttccaaccagagaggaggaagtgcagcattactgaggcaggggtgtgtttgacatactccagtatgggtgcagagtgagcagtgtggggaaatgttaaggagatattggcaccatggtaagaagagcaagacaggagtcaaggacatgaatagtacctttttttttttttaactagaaaagttaaaaaaaaagatgaatggtttcaccatagtagagttgccagaaacaacaaaatttatataaagtttgagttctcatatgttgcagcaccatgctcagtgctttgcgtatattatctttttacaacagtactatgtggcgtattggtacttatccccattttacagatgaaaggattaaaacactaagggattaaatgcagacgcctttatcaataattttgtttacaattttcagcagatgagttgatcattaattttttttgacagtagctttttcagtgagtaagggtaacagaaaagaattcttgtctagctttaaggttcatacatggcatttagtactacaagaatttggacaagttatttaacctctcaagatcactttactcctctataaaatggaagatttgtgtttggtgctttttaaggtctgatgagtctaatctgtgaaagagcacagggagctgattatcaaagtgaaatagaaggtaccattaaaggttaagggatacctcatatatttaaccttcaaaaaatactgtctttaatatagtttaataaactttttgaagtcactgtggaggctaaaatgtgcacacatattttagatatttgagggaaatggcaaagatgtctttggtgatcatatttagttgaaacaattcaaggtaatatgatttatgtcttgtttttccttttttgtgggtttgttgatggtgcctggagcctctctattttcctatttctccctctttatctcatcttccacttcatctctcttctctgtctcaaaaaattgctcacaagttcctgtttagataaatgagagtattattcaattcataatgattatttatagaaaatttggtaagaaaatagaattttgtagcgcacaacaaccttgacagaatctaaaaatttacatataaaatgtattggcaatagaataaaactttatggataaaatttagatttgcaaaatttgactataccttgaaagctcacattgagtgaatatataagttaatctcaacaaggacaaactaactgaatcaaatctatcttaaaaatgatttcagtaaaataaaaaatgaagcagaagacttggaaatggtttaaatgataaatttagttgttcaatggaatccttctagaaaatatttttctcagtgaaaattgattagtttcagcatacttttgcataaaatcttcacattgaagacataatccttaacatcaaaagagaagagttgagatatttcattatcagttggatttttatttgcctctgggtctatttttggacccaggcagaagctgtttctattttatgtcttgaaaaatccttaaggctgatttctgagcttaaatcctttggtttaaatgagtttacaatggtgtgtgtggtgggggatattatttaacattttctgacaaggaaacgcttttgaattttgttgcgtgggagaggagttggtgacttggtgggcaagcccattttcattactttaattgtgcgatttattaggattttaagctttttataaatgttttagtgttataggacagaattaaaaggatttagcataaaaggagtttaacaaaaggactttgcaacaggattgcaatagtttttatatttgatggatttggctagccgcttttcatttcaatcatcatggtacattctgttaaatgctgtagaacaggtgtgtgtaacgtcattctctctattgtacatgcaaataaacacacaattttatatataaaaagttaatccactgcaatttggaggattatgttatgggagggtgatgactccattaggcatcatgaagaatgaagagtacatgctatttatactgcaggaaaaaacaagttaatagctacaatgttcatgagatgtagaatttttatgtggacacttttattcaagatatccacaataaaattatttaaatgaaaattaagattttgttacattgttttctaaccttgaaatgagaatattttttttttctggatggtctgccttatataaagttggaagtttagttagtatttgtttattgtagattgtggtgttttctacttgcatggactttctagtaaatgtgttgggagttattgccattctcagtatagggcttttattttgtagtttaaaattttagcttctttgattatccataaactttataaatttttagtaagtattatgtgcctgatctagagagcaaagtttgctggactgatatacttcagtaggttagtgaaaactactggagttcttcaattcaggtttgagaaaaacaatcacaacattcttgccagtattatttgcattttaaaaacttgatgtttcattgatcaaaatatcaaattgatatgcataatacaggtacaaactgtaaagaccttggaaagaccaggaagtagaaggaaaatagccattgttaaaggtgaaggcaaaatat

SEQ ID NO: 2460 - DNA, 17268 bp, Homo sapiens
atctcaaaaaaaaaaaaaaatagccaggcctggtggctcacacctgtaatcctagctactcgggaggctgaggcatgagaatcacttgaacctgggaggctgcagtgagctgagatcatgccactgcactccagcctgggcgacagagcaagaccttatctcaaaaaataaccatccaaggaaccaaaaaaaattaaaaacccacatatgggtctctcctttactttttaaaattaattttattgtcaggcttgacatccattaagcaaatcacctttttttttttttttttcagacagggtctcactctgtcacccagactggagtgcagtgaggtgacatcacagctcactgcaacctctgcctccagggctcaagcgatcctcccaccccagcctcccgagtgtctggaactacaggcacaagccacaacactcagctaattttctatatttttagtagagacagcttttcactatgttacccaggctggtctcaaactcctggactcaagcaatccgcctgccttggcctcccagagtgctgggattgcaggcatgagccaccgtgcccaccctcaattcacttcgtaaaaatttttttatttattttttgagacagggtcttgttctgtcacccaggctggagtgcagtaatgtgatcacagctcactgcaacctccatttccagggctcaggcgatcctccctgctcagcctcccgaatagctgggacaacaggtgcgagccacgagccagcatgcgtggtaaatttttgtattttttttttttttttttgcagagatggggttttgccatgttgcccaggctgttcttgaactcctggcttcaaatgacctacctccatcagcctcccaaagtgctgggatggatgacagatctgagccaccacctggccaagcaattcacttttattgcatgtattgttcttaggtttattttatagttttacagtttacacttttataatcttcaacatctaaagataacataagcctgtttgactagtcttaatttacataagcaaatgtggttttctaaagtcaatgaaatagagctcctttacaagttaatctttaggaattccatcaagagggagaaagtgttacatacctataacatatatatatataaacataaataggtgcagtcagaaatcttatagctttcattttaaaattatagctgtgagacaggtgtgataatacaaaactcactagtttttaaaaaaatggtggagccgggcacagtggctcacgcctgtaatcctagcactttgagaggccgaggcaggcagatcatttgaggccagggagttcaagaccagcctgggcaacatggagaagccccatctctactaaaaatacaaaaattagccaggcgcagtgactcacgcccataatcccagtactttgggaggccgaagtgggctgatcacctcaggttgggagttcaagaccagcctgaccaacatggagaaaccctgtcgctaccaaaaatacaaaattggccaggtgtggtggcacatgcctgtagtcccagctactcgggaggctgaggcaggagaatcacttgaacccaggagacagaggttgcagtgagctgagatcgtgcctctgcactccagtctgggtgacagagccagactcaatctcaaaaaatataaataaataaataagtgagatccaatttgcatctgcagaggcagatgaaatgagttaagattacctactcagatcatgaaagctttgtgctaacatttgtaaagactgttaaaatttttcacttgccagttggtttccaaattgccctctgagaacacagttctgatccattgcaggggagccccaaattttgggcttagcccaggagggctcttggcttcttctaggaaagtatccaagggtgacctggtggtgttatacagcacctttttttttttccctgaaagagtcttgctctgttgcccagcctggaatgcagtgatgtgatcacagctcactgcagtctccaaatcctgggctctagaatcccctttgcctcaaacttctgagtagctgggactacaggcatgcaccacctatccgagctaattttttaaatttttgtggagatggggtcttgctatgttccccaggctggtctcaaactcctgagctcaagtgatcctcctgcttcagcctcccaaagtgctgggatcacaggtgtgagccataatcccagcctgataagaattcgtccttttcttttttttttttgagacggagtctggctctgttgcccaggctggagtgcagtggtactttctcggctcactgcaacctccatttcccgggttcaagcggttcttctgcctcagcctcccgattagctgggattacaggtgcctgccactacgcctggataatttttttgtatttttagtagagacggggtttcaccatgttggccaggctggtcttgaactcctgacctcaggtgatccacccacctcggcctcccaaagtgctgggattactggtgtgagtcaccgtgccagcctttttttttttttttttttttttctgagacaaagtctcactctgttgcccaggctggaattcagtggtgctatctcagctcactgaaaccccagcttcccaggtttcagtgattctcctgcctcagactcccgagtaactgggactacaggcacacaccaccacactcagctaattttgctattttttggtagagatggggtttcaccgtgttggccagactggtcttgatctcctgacctcaagtaatccacccacctcagcctctcaaaaagctgggattacaggcatgagccaccgcgtccggctgaattcttactttgcattggcttgtcaggtcccagcatttctcccctgcagaccccagagggagcagatattcccagccaattgtagcccatcctcatcaccagaaactagcagggctagagctttcctcctctctctggtgtctggctcagactgacagacagattaacaaaacaatagcacacaaagcttattcattgtagatgggagccctcacgagaaaaatggagaccgaaaaaagtaactagacctaagtgtttgttttgagacagggtcttgctgtgtcatccagactggagtgcagtagcgggatcacagctcactgaagccttgacctctcaggcccaagcaatcctcctgtctcagcctcccaagtagttgggactagagttgcacaccaccacacctggctaattttttaaaaattttggccgggcacggtagctcatgcctgtaatcccagtactttgtgaggcagaggctgggggatcacctgaggtcaggagttcaagaccagcctggccaacatgataaaacccgtctctagtaaaaatacaaaaattagccaggcgtggtggcgggcgcccataatcctagctacttgggaggctgaggcaggagaatcacttgaacctgggtggcggaggttgcagtgagctgagatcgcgccactgcactccagcctgggcaacagagtgagactccttctcaaaaataaagaaaaaataaaaagatagatcacagagcccttctgggctggctgcggtggttcgtgcctgtaatcctagaattttgggaggctgagatgggcagataactgaggtcaggggatcaagaccagccagaccaacatggcaaaaccccgtctctactagacatacaaaaattagccggccatggtggtacatgcctgtaatcccagatacttggaaggctgagataagagaatcacttgaacccgggaggtggaggttgcagtgagccaagatcatgccactgcactccagactgggcaacagagtgagactccctctcaaaaaaataaaaagaagagcccttcttgcatccactgtttgcaagtgtgtttaactcaaaattctcaatatcaatatgccaaagttgtatgctggtatgttatgggtgacatgtcctgaacactatcaacagaaacatacaaaaattactgccaggtatcaaaagctgctcttcctgggaagcaataaagtatcttttgtttttctgtttttgagacagagcctggctctgtcgcccaggctggagtgcaatgacaagatctcggctcactgcaacctttgcctcccgggttcaagtgattctcccgcctcagcctcccatgtagctgggattacaggcacccgccatcatgcctggctgatttttgtatttttagtagagacggggtttcactatgttggccaggctggtcttgaactcccgacatcaggtgatccgcctgcctcggcctcccaaagtgatggaattacagccatgacccaccgcacccagccccataaattctcttaattttattttttattttactttttgaggcagggtctcgctgtgtcatccaggccagagtgtagtgtcaccatctcagccagctgaagactcagcctctgggactcaagcgatcctcccacgtcagcctctcaagtagctgggactacaggtgtgcactaccgtacccggataattttgttatccggtcttaccatgttacctggtcttaccatgttgcccaggcatctgggcaactccaactcctgacctcaagcgatcctcctgcatccaggtcccaaatggtaggattacaggcataagccaccgagcccggccaagcaacaatttttttttttttttttgagacaaaatctcgctctgtcgcccaggctggagtgcaatggcatgatctcagctcactgcaaactccgcctcccaggttcaagcgattctcctgcctcagcctccaagtagctcagattacagacatgcaccaccacacctagctaatttttgtatttttagtagagatggggttttgccatgttggcctgactggccttgaactcctgacctcaagtgatccacccgccccagcctcccaaagtgctcggattacaggcatgagccaccgtgcctggccaataaattcttaatttatccaccattgtctctcagcaaccagtaatccatttgtagattaccaaatggtcagctcaatgtcaaacaaaactatgggagaccactgttttggactgagctcctgcactaggcaccaacagaccagatgaaaccagaatggagtcactcgtgctaaatgccacataatcaaactgaaactttgaggaagcagacatatcccaaacagatcagtttcttattttttttttttttaaatttgttttgtagagatgaggttctggccaagttgcccaggctggtcttgaactcctggcctcaagcgatcctcctgcctcagcctcccaaggtgctggtattataggcatggtccactgtgcccagctgtctttcctaaaaatagattttagtctacctgggccgggcacggtggctcatgcctgtaatcccagcactttgggaggccgaggtgggcggatcacaaggtcaggagatcgagaccatcctggctaacatggtgaaaccccctctctactaaaaatacaaaaaattagccaggcgtggtggctggtgcctgtggtcccagctactggggaggctgaggcaggagaatggcgtgagcccgggaggcggagcttgcagcgagccgagatcgcgccactgcactccagcctgggcgacagagcgagactctgtctcaaaaaaaaaagattttagtctacctgaattagcccgataaggaagtcccctctgctttaacacttaccaaaaaaagtaacctgaagttaatcaggtttttctttttctttctttctttctttctttttttttttttttttttttgagatagagtctagctctgtcgccaggctggagtgcaagtggcacgatcttggctcactgcaacctccacctccccgggttcacgccattctcctgcctcagcctctctgagtaactgggactacgggcgcccgccaccacacccgtctaattttttgtatttttagtagagacggggtttcactgtggtctcgatctcctgacctcatgatccgcccacctcggcctcccaaagtgctgggattacaggcgtgagccaccgcaccggccttattattattattattttttaagatattctgtagttatggattggaaaaatccatattgtcaaaatgtccatactacacaaagcaacctacagattcaatgcaatttccatcaaaatacaataccaatgacattcttcacacaaaacagaaagaacagttctaaaaaacagtcctaaatttatatgaaatcacaaaagaccttgaatagccaaaactatcctgagcaaacagaacaaaactggaggaatcccattacccaacattcaattatactatagatctacagtaacaaaaacagcatagtaccagcacaaaaatagacacatacataaatggaacagaatggagaacccagaaccaaatccatacatctacattgaattcttttttactattattatactttaagttctgggatccatgtgcagaacgtgcagaaggtgcaggtttgttacataggtatgtatacacgtgccatggtggtttgctgcacccatcaaccggtcatctacattaggtatttctcctaatgctggccgggtgcggtggctcacgcttgtaatcccagcactttgggaggccgaggcgggctgatcacgaggtcaggagatcgagaccaaggtgaaaccccgtctctactaaaaatacaaaaaattagacgggcgtggtggcgggcgcctgtagtcccagttactcggagaggctgaggcaggagaatggcgtgaacccgggaggcggagcttgcagccagccgagatcgcgccactgcactccagcctggatgacagagcgagactccgtctcaaaaaaaaaaaaaaaaaaaagaagttatttctcctaatgctatccctcccctatcccaccctctgacaggtcccggaatgtgatgttcccctccctgtgtccatgtgttctcattgttcaactcccactttctttttctttttttttttttttgagacagtctggctctgtcacccaggctggagtgcggtggcgcaatctcggctcactgcagcctctgcctccagggttcaagcgactcccctgcctcaccctccggagtagctggaatcacaggtgggggccaccacacccagtggtttgtttgtttgtttgtttgtttgtttgtttgttttttgagacggagtctcgccctgttgccaggccggagtgcagtggtgagatctcggctcactgcaacctccacctcccgggttcaagcgattctcctgcctcagcctcttgagtagctgggactacaggcgtgtgccaccgtgcccagctcatttttgtatttttagtagaaacggtgtttcaccgtgttgaccagattggtctcaatcacttggcctcatgattcggacgccttggcctccctaagtactgggattacaggcctgagccacctcgcccggcattgatcaggttttttttgtattgttctgtttatttgtcccactttacgaaactcactgttctcctattgcccagggggacatgtcattttatctattctcagtaactcatgcctgtaattccagcacttttggatgcaaaagtgggcggattgcttcagtacagttcaaggctagcctgggcaacatagtgagaccctgtctctactaaagaggaaaaaaaaacaaaacctttctttaaataaaagttttaaattgggggaaggaaggaagaaggctctatctcaaaaaaaaaatcagaaaaccatgaagggtgtcctctgactgggcaaatttttgttgtaaaaacccatattgtaggctgggcatggtggctcactcttgtaatcccagcactttgggaggccgaggcaggtggatttgagatcaggggttcaagaccagcctgagtaacatggtgaaaccccgtctctacaaaactacaaaaaatagctaggcatggcggcgggtgcctgtaatcccagctactcatgaggctgaggcaggagaatcgcttgaacctggaaggcaaatgttgctgtgagctgatattgtgccactgcactccagcctgggcaacagagtaagactccgtctcaaaaaaaaaaaaaagccatatttcagttttactttttacaggccaacaaatggcatgattgtgtttcaatgacgtttggcttattctatgacctgaaaattatatgaaatgcaaatttgtgtccataagtaaaactttattgaaacacaatcatgccatttgttgacaaaaagagtgaaactctgtaaaatatgggccgggcgcggtggctcacgcctgtaatcccagcactttgggaggccgaggcgggcggatcatgaggtcaggagatcgagaccatcctggctaacacggtgaaaccctgtctctactaaaaatataaaaaattagccgggtttggtggcgggaacctgtagtcccagctactcgccaggctgaggcgggaaaatggcgtgaacccgggaggtggagcttgcagtgagccaagatcgcgccactgcactctagcctgggccacagagcgagactctctcaaaaaaaaaaaagaaactccgtaaaatatttaaagaggttaattctgagccaaacgtgagtgaccacggccctaggcacagccttttttttttttttttttttttttttttgagacagtctcgctctgtggcccagactggagctatctcggttcactgcaacctccacctctcgggttcaagagattaccctgcctcagcctcccgagtggctgggattacaggcgcccaccaccacgcccctggctaatttctgtatttttaatagagatggggttttaccatgttggccaggctggttttgaattcctgacctcaggtgatccagctgcctccgcctcccaaactgtttgggattacaggcgtgagccactgcgcctggccaatccccaccttcttgactgaccatttaaaaaatgtaagaaacacctttagctcatcatgagcagcacaaaacaggcagggacaggatttggccctgaggcaggagaataggtctggaggcagggaacataaggccaaatcaaatggaaacaattcagctatgacaggaaatatcttctccatttaaagagggcatacatccagtaaatgactttgtaactttacttcatcctcttcatttacataggacgtacattaagtaaccagtgaaaacctctagagggcatttaaaccccagaaaattcttaaacaggtctcttgagtccgtatgctccactggctcccaccctgcggagtgtactttcgttttcaataaatctctgcttttgttaagcttcattctttccttgctttgtttgtgcactttgtccaattctttgttcaagatgccaagaacctgcacaccttcaacagttaacagcccacaggcagtagtttgcgactctagtagagaatgcatagggatttccattgaaaatcattttttaagccagttacggtggttcacgcctatcatcatcccagcaccttgggaggccaaggcgggtggatctcttgaggtcaggagttcgagaccagcctggctaacatggcaaaacccctgtctagaccaaaaatacaaaattagttgggcgtggtggcccgtgcctgtaatcccagctgtttgggaggctgcgacacgagaatcgcttgaacccgggagggagaggttgcggtgagccgagatcgcgccaccgcactccagcctgggtgacagagcgagactccatttcaaaaaaagaaaaaaaataattgttccctacgggaacggtataattaggatataattgtttctggccacagatcacatcccttctggttaagtccaggagaatctggaaatacgtagggcaaccaggccagaaggcgttgtaactgcctaagattgaccaaccctaacgcgggaggcgggacgacggtcactgatttgccagcgtgacgccggtctgcgactggccagtgccgtcctgggcgtgtcggtaggacggggctgcgacggtttcccataggctggcacagaaaggggcggggaaacaagagtgcaacgttaccaatcggcatgcgggacgtaacgcaattcttttttccgattggtccgtgaagctcgggaggtcgttgggggctcgaccttgggatagaacgcctgccttttattggtcaatactcttcgggccgggcaatgtggctccccgaggctgcctgcgattggtgaacgcgtcgcggctcggggcggacctgcggactgaagatccttatgcgattggccggggagccggaggggcgggcaatttgggatcgacagtgactcgcgactggtcggcgcggcgaaagcagagcggcgcgccggttccttggttcctgagggcgatggcgcggggtggctggcgccggctacgccgcctgttatccgcggggcagcttctattccagggccgcgcgctgctcgtcactaacacgctgggctgcggcgcgctcatggcggccggtgatggcgtgcgccagtcctgggagatccgcgcccggcccggccaggttttcgacccacggcgctccggtgaggacgccacgctgcttagtccttcaccccgggcgacctttgatcccgacacccgactgcgggccgtgacccctgacccgtggcctcagtcccccgcaggacccttgccctgaccgcgcctctccccgggtgtctgtctccccgcagctctgggtctccatcacctcccaacccccggaggtctctgcccactacccaggagcctctggagccgcgcctcctggtggggcttgtagtggaagaatgcacgggtgggctcttccggttttcccggtgaggctgaggctccgggatggcattgggcttacccaggccttagccagggagggagagagggaatggactgaggaacttgccggcccgacccagccccctgacttacactcttatagcgagcatgtttgcggtgggctgcagcatgggtcccttcctgcactactggtacttgtcgctggaccgcctattccctgcgtctggcctccgaggcttcccaaatgtcctcaagaaggtcctcgtggatcagctggtagcctctccattgctgggcgtctggtacttcttgggtaaggagcctcctaagcctaggctttgcctctcataggtcgggaggggtggagccagctttgtgttaagaaggatgcagaggtgcatttccaatttgccccctgtttgggtcgccctggactaggagccaggtcacagcggggacaggacggactcggccgatgtgaacgctggcgagtgtaggagggacgaggactgtatctgttggggctgccctgggcgggaggttgagagcatttcccaaagaaggggaccacactcagttgagacatgaagagggaaccagcgggcagagggaacagctaatgcaaaggctctgaggcctgaaggaagagaaattgaggctagacttaatggggtgcaaccgtgccagccctaggctcggtaaagacagcggtattaatagaggagtctctcattctccacctcccagcccggcttcctggtctgtgatggaaaagtaacacaactccctcaacttcagggtgtctccattggggcacgtgtttatatgtttataacctctctttctctcactgggactgacttgctctgttttgtctctacaccagctaccctaattctctgtccatcccatctgaaagtccctgtccctctgcccggggtgggcggcgtgggctctcaggggcccaaccccgccccctccatcgtcagcccatcttgtcgtctcaacagtacttcctggcctctaacactctcatttcttggtttgcttcccaggccttggctgcctggagggtcagacagtgggtgagagctgccaggagctgcgggagaagttctgggaattctacaaggtgggagcacccgccccttgcacatgtccggccccgccccctgatggccgctccgcccccgcccagctctggccccgcccctcatcccccgcctctccccgcaggcagactggtgcgtgtggcctgctgcgcagttcgtgaacttcctcttcgtgcccccccaatttcgagtcacctacatcaacggcctgacgctgggctgggacacgtacctgtcctacttgaagtaccgggtgagtgtggagggcataccaggcacccaggggactccccagggggctacacgtgtgagctccaagtggcagtgtagccagccaccctggagggtgggagtctcctgtgctcctgacaacccacacccaacagtgggctggcggagagctcctcactagcagttaagacccagccgtggctgagcgccgtggctcatgcctgtaatcccagcactttgggaggccgaagcgggtggatcgcctgaaattggagttagagagcagactgggcaatatggtgaaaccccttctctactaaaaatacaaaaaattactggtacgcacctgtaattccagttacttgagaggctgaggcaggagaattgcttgaacccaggaggcagaggctgcagtgagccaagatcatgccactgcactccagcctaggtgacagagcgagactccgtttcaaaaaaaaaagacccatgccgggcgcggtggctcacgcctgtaatcccagcactttgggaggccgaggcaggcggatcacgaggtcaggagatcgagaccgtcctggctaacatggtgaaaccctgtctctactaaaaatacaaaaaaaaaattagccgggcgtggtggcgggcgcctgtagtctcagctactccggaagctgagaccggagaatggcctgaacccgggcagcgaagcttgcagtgagccgagatcgcgccactgcactccagcctgggcgacagttcgagactccgtctcaaacaaacaaaaagacccaacccttctctgctgtctgatgtgacctcagcccggtccctgccaagtctgttgagcagggctgacctctggcccaagggcaggtagagggacagggagggatgagccaggcttctgaccagatgccttgtcttgtgtggacagagcccagttcctctgacacccccaggctgtgtggccctggacacccgagcagactgaactgtctgcttcctggaccagatgcaagactgtctcctggcggaccaccccctctgacagaaggggaatgggctcctgcagcaagctcgggtcttgagccacgtcccagcaccacttcagctccggagcattgggctgagccgccctttccaagctcacttctgggactgagtttcctcaaccggaacacacccatgaagatggatgatcatcccctagcccttctcagcaggaacctcatgcgacctgtgaccaagatgtcccatcctcagcacagggcccactctgccaaccagtctcaagcaccagcccctcaacactgccatccacctggctctgggccaagccaccaatccagagctccctcaggtcctgggactaaggcggggacatgactgatcccctcagagcaggctcaggcctggagtcggcccccaaaagtttcacatagggccaggcagcctctgtgtttctttccctggtcctgaactgtggaaatgccattaaactctctctataatgtaactgaaactgctggctgggcgcagtggctcccacctgtaatctcagcccttcccgaggctgaggtggaaggattgctcgaggccaggtgttcgagaccagcctgggcaacatagcaagaccctgtctctatttatattgaaaaataaaaataacaaaagaaaatgctgtggatgatcaaaaccagggtgggcaggacccggtgctcacagggacacacatggatggtccattcgctttattgggtgcgtgtagtgttgtcatgacatctcctaaggaactggggggcacgtttgacactcatgaggtcagaacaggtctggtgggcggggggggggggggtcccagggtggtgaatacccacagcacacccccccaccaaaagagaaaacggggagaggagcctggcaggccagactctgatccccatggtccacacagggaaacccccaacagcggcctcggcccaccgcggcagagccgaggggctggcaggcctggccacctcccattgcccgatcagcctgctttagggtgtcatctggcccctcttcacaactgacaactgtggatgggggtgaattttaaaaaaaggcggggggggggggttcaggagggtgagcggtgagttcacggggccacgagacaccacagctgagtggggaaagggctatatgtacaggaggggcagggcttggggcgggcaggggagcctgggcccctgggggacatcttcaataaataaataaatagctacaataataaataagggtgacgggctaagtcaggagcaggggtcttgtgcccgtggctggtaggggccgggtcaggcccgggtagttgggggaaggtggggaagacagggaagaggggaaagggagtgggatggctctcagcaggcgcagtcctggtgcggtggcacctgctggtcactgagctgtgggccctgcttggcgcctgtgaccgcagggtccgccgtgtccaacgactcggacatcttctcgcagatgacatccaccaggcgctcaaaggtctgcttgacgttaatgttgtccttggcgcttgcctcaaagaactcgaaccctgtggtcagagaaggcagggatgaggaccctggccacgccctatgccaactcccagagatgcttctctgaggaaagggaacacctggagattcccagtgccaagcaacttattgaaggtactgacaaatcccacagagaagaaacttattgaaggtactgacaaatcccacagagaagcaacatggaactgggtcagctttgcatttcctgctttttttttttttttttttttttgagacagggccttgctctgctgcccaggatggagtatggtggcgtgatcatagctcactgcagtctcgacctcctgggctcaagtgatcctccacccccacctctcaaattgctgggattataggtgtgagccagcgcacctggcctcctgcccttccttcctaaaattgtgtctcgttgtccttagggacctggcaagacatgccctgcagcgtccagcccagccccgtgcactggccctggaaggctctgacactcaaatccagctgtgacctccccctgctcacacaccctctgtgactccctattgccctccaaagagtcccagcctctcagcacatggttgaggccctctgtgatcggccacatttcctccagctgaccctcatgttccagtcttgtgaaattattaccaaaacacacaggacctttctcactgcaagcctttgcccaagctatttcctctgcctgaaagacccttcttcactacccaccactccaggaagcctggctcctctcatgtgctcctcccatccaggtccctccctctacctcaggggtccctcgaggcacccctagatgcctcttgagcccagcaacacccaacaaagcgttggacggtgagtgtcagaataaatccttaaactttctgcatggcaaactcctacacatccctcaggatccaactcaaatggctcctggatgaaggctagtttgcagaaagtgtgaattacctggctttagctgtaagaccttgggtgtgtgccctcccctctcttagtgtcctttttctagacttgtgggtctccagcccagctgggcactcaccaaggtggtcagctagctgccggccacgttctgatgacaccacccgctcatcctccatgtcacacttgtttcctaccagcagcacctgggcattgtcccatgagtaggtcttgatctgggtggacctataggaggcaccaatgggggcaggtcagggcttggaggatcccagctccaccctgacgggctgatgtggagcctgtgtccttgtccgaggaagaaagacccagaagcttgcccctccatcctccccaccatcctttcccccaatgtgccccgctttcaccccactccagcccccgactgacccattattgtttctgtgttttggggttttttttgagatagagtctgggtctgttgcccaggctggagtatctgcctgccttcgcttctcaaagtactggaattacaggcatgagccacccagcccagaaattttctttttttgagatagagtcttgctctgtcgcccaggctggagtgcagtggcgcgatctaggctcactgcaatctccgcctcccaggttgaagtgattctcctgcctcagcctcctaagtagctgggactataggcatgagccaccatgcctggtaattttttgtgcttttagtagagacagggtttcactatgttggccacgatggactcgaactcctgagctcaagatctacccacctcggcctcccaaggtgctgggattataggcatgagccactgtgcccaacccagaaatttttttttaaagttattacttctgagcagaaaattgaaatgtttacaatctctaacctatgccaactctccttttttttttgagacagagttttgctcttgttgcccaggctggagtgcaatggcaatcttggctcactgcaacctccacctcccgggttcgagcgattctcctgcctcaggctcccaagtagctgggattacaggtgtgcgccaccacgtctggctaatttttgcattcttagtagagatggggtttctccatcttggtcaggctggtctcgaactcccgacctcaggtgatccacctgcctcagcctcccaaagtgctgggattataggtgtgagccaccgtgcccggccatgccaactctccttatagtctctatattctccaccctacacttgcagatatttgtttctatatggttatagttttacttttccatctgaaatccttctctgacccctacgttttatttattattttttgaagaaagtttggctcagagacaatggccccagaatgagtgtggaaggccagaagcgatggctcacgcctgt
